United States Patent 9,029,523 (PROMOTER, PROMOTER CONTROL ELEMENTS, AND COMBINATIONS, AND USES THEREOF) - sequence listing, part 12

SEQ ID NO: 14042 - DNA, 3000 bp, Unknown
  misc_feature (1)..( 3000): cDNA_ID_3021476_gDNA_ID_2214694_Annot_ID_189476 3000 nt of promoter + ATG
aaaaattatcttcaatgaagactccgtcagatctccaacaaccttccgctccatagtaataatctctttctttaggttttcgtttctattggttagcaaatttacttattataaatagggtaaatgttgcctcccgggagaatatgttaacaaatctacgtatgaacatttagttattaagtaaaagtaaaatcaaaattttagctacaaattgagagattttgttttcccattctctaacatttaccggaaaaataaaaacagttactaatatttgagctaaacgaccgccacaaagggtgattccaacttatataaagaaggtcttgttgataaacgactaagatgtaaactgattcgcgtaagattaatatcaacggtcaaaatttaaaatctagtgttagaggtcaaccaactttgactgtgttagacaatccagctggcatttactattaacactgataaataatctcacacgtgtcaaatttccattcgttgattaaacagaagacatctaatcataaataggagaaaataaattgaggatgaagcaaaccaatcaatgattattaaaacttgattgtccttgttgctaactgctgaataatgattcttgggttctacatcaagaaaatgaaaatttgttggaattttaccttgttgattataaaattggatttttacgtttcgaataaacatcatactttacctagcaaacacacccttatttcacgaatcctcaaaacttaagattaaatgcctccaattccaaagcattaaatcgttggaagttaagagacttaaacacaatatttttcgtacatttaattttttgttaatgatatagctcgttaaacaccttgcctgaattccatgatttatattatcattagtaaatatacaaaaaaaaaaaaaaagattctaagaagaaccattattcgttaactagattaatgtcaacattccaacacagccatcgatgatgatgatgattcatcaagaagaagaagagatgccctcaaaacattcaatcgtcattagaagatccaaataaataaatcaagacaacttgcttgaattccattattcatattatcattagtacatatgcaaacatgcatgatttaatttatgataacttattatcagtatgcattattcattattcataacaatatcaaattaagaattcacaaccacatacagatgataaatcatgaaggaacataaccaagtatctcaaattccatgagagtaagtgacaattgaagaaatccggtttcctcaggaccagagaggttaacttcacggtaaaaatcaacccctttaaccgttggcaacaatgtgactcttctcccaacgaaataggtaccagttgaattcgttttgaaaacatctacatataaagattctacgggaaaattctgatcttgaaaaagttgtaattcttcatcaaactcaggatctccttcggttgctacaacctttgtttcatgtttctcgttttcatttgtccaagcttcaaccttgtattgatatgggcgaccattggtgactccgattgtaccaaagatattcacaagtagcttcacatcttcacctgtgattattatctttttccctcgcatttttcttcttttcaaataataaatctgagtagaataatatgtgtgattgatatgtcaacttaactacacctcaacaattgtttttgtggttttttctctcactaattcacgaaattcgacattttctaaatatatttatgttaaaatgcacgtgtttcatgttgtaattctttgtttataaacaagaaaaaatagatgctaaacaatgagaaataaatgttgtttgaataataaaaaaaattgaatgtttcttaataccatttcaaatactaaaaacaatgaaatatcatatttagagatttatttctatataatatctattttggtcatattcttagttatgatatttgactactattcaaaaacctaaccccaatatagtcaaaactatataaaaatgcagtaagatattaaatgctgttgaacaaaattcaatatcttatggcttgaaagtaaactagtaagatagctacaaaatgcatggtaagaagttaggataatcatattttaagaaacgaaaataaaatacctaatataagcttcgacacatacagctctttcttactggaaatcttgcatattccgaacatacatttttattttaggacggatatacctatagattcatttgcaagattgatttcctattgaaaaaaaacatgttgtggattcaaatatttgtcgctttttgttcattctcttttgtaatttcctaaacgagaggtcactaatccaaaaatcgttagcaattaactagaacatcttccatggttaacaccacctatcaattatttattttcttcaatgaaactttatgaaactctttccattttattaatttatatattaaagtttttgttcacactaaatttattgactcaatatatatctactttataactaaatactaattatttcatttactttttattttattaataatctacatatatatatatattgtttgtcttgtttattgtttttgcggtttgtatatttatatctcatattcatacaattttttagtatatatgcttaattaattaagatcgaattgtggcttgtttattatttttgcggtttatttatatgcatctcatattattacttttttaaattaatcgattaaaatttattaacttacgtaacatatttgatattgcataaattaaaaatcatatgtatataattctctttagtttaaattttaaaatgaataaagaaaaaaacaataaaatttgaaaactgaaaaccttttaaaacgaaaaagaatggctaagatgatgaatcggtctcgtacgggaaacacctacgttttggtttagtccggtttggttgaattcccagagactttgcttgaattgggtcccca

SEQ ID NO: 14043 - DNA, 3000 bp, Unknown
  misc_feature (1)..( 3000): cDNA_ID_2705885_gDNA_ID_2214694_Annot_ID_189473 3000 nt of promoter + ATG
gtcatgtcttttaattttagagtcccttcttacattgaacgaccttttggctacatatgtagacacaatcaatagttgatcataaacaactttatatatgtatatatatatatatatatatatagatatttatatatttataactttataagacaaagagtgggttcagattagtactcacagaactcaaacaataatagaaccgatcaactagccaaaacagaaaagtgttcctagttgaaatcaaatgacacctagaaataaaacaaatcactaggttacaaaaaaaacggtttagtacaaattaaaacttgatagtttgagatctgagtagtgatcgctaaatgggatttagttctaaatacattaaagattaaaaaaagtagaggctgccgtaaaattagtggggactaattaagaaataaaataaagtaataatgaccataattataatttatataactatgagttggatctagttgaattattgacgttttcaacgtacttttattggtgttcaactttttctgtattttaaaaaaataatatgaaattagattcgtacgtagcaaggactgtctcttgcgaattgatgaaataattatacttgagacaaagaattctctgattgggtatagcacgaaataagattcaacttacacatttaagaactatatgttttgcatataaaaaattaaaccaaattttaaatttcgtgacagataatgatccagagtagtcttagcgataagtagcaatccgttaatcgaggcctcttggttaattattttttaagacaactaagcttaagattagattaagcacaaaatgatgtatttataataaacattgttattattctaataaccatttgtcatttgtcaatagcagttccccaatcatcgttgacctttctctcatcatctccgaaagaaagcaataatttaacatttgaatataactagtgtccatattttgacaatctctaaatgattaatcagttgggatttatagataaatgccgaatttggatgagtaaacgaagaagtaaaacaaagctgtttggacatatttattggttcaaaccgagaaataacacattcatctttttacgatcgaagtcaactactacaacaacaaaaatatcgttaattagttcgtacacaaattatatttcataaatatttcatcgttctaccattatactactcaccgttcattattattgttggtataatctgtttcgttaagttgtatgataaattaaaactagtaaagccgttttgtttttgtttatagttgaaaaagtaagcgtaatataatctgtaatttctagagaattaataagcaaacaaatggatttgactcttatggattttttttatttatttgcgagtggatgtacaatgtggactgaaattattgtgactccgaggagtactcagtggcacctgccccctcattgccgtcacaatatcccaatactaaacaaatgttacttttttaaaaaatattgttttttttggtaggaaaaaagatgtattgttttatgcgtcacagaaataaaaataataattaaccaactcaaaattactcattttaatgaaacgaagatatttttcattcaacggatcaaaaattcaaaatgagtcatttcttacgatcataggttttaatttatttttggtattaaatgagatgactcacacaaatatttcaatagttacacgagtattaattaaagtagtgacagtttcaacaaattttaatatttttgttcagttcaaaattcatagatttttaataaaatcagtactgccaaagtgatcagggccaagcaagcaataggctgacataacctagagttgtgacttgtgattgtattggttcttttaccaaatgatccaaaacattgattatctacttaagtacttttccggcgtttttaatggcagttctacaaaacataaagataaaattaaataacgttggcttagtataatgagattaatcttgattactagttttagatccgaactaagcggtctcaccacgattatctatatatatatatatatatatatatatatatatatgcttatagcttttagttttagtagctagtctatccatgacaaaattcatcaatgagaatattcattaggatccttctgcttccgtaaatgcacgagaatacacacgtataaatagtttcttcttaggaaaaatactactatatagcaaaacatatacatttatatcttcaaaataaaattacgagattgataaaactctaaatattattctgtcttaagactatttgacccaattactcttaaaatatattagtggttggtctgatatagaatatatcttgtcaacatttatcctctttaattatcaaaaaaaaaaaacagttctccttattttggttctttcccttgaaagtgaatttcgtggtactgaaaaataatttgaatgtcataaaatattagttatataactctttctccaagataaaaacaaaataatttttcgcaaaaaacatttaaaaatctaaccaagttgttggatcgttttcatgagcattaattaattaaataaatccgcgaagaaaggagaaaaaaaatacccaccaagccatcaaacgtgttacggagatgggtgatgtcattccacatcatcaatgtgacataagcaaagctcttgcaagccaatgggtgaatagataagttataactttccaattataacctcaaatccatgactaaattcataactacgttggttactttccctttataccctttcatgttcattataatgcataagcatctctctctctttcctaagcatcttcctttgatttttttctgatcaagagaaaaaatctattttcttctctttccactatattacaacatttcttcattctcaaatcatcatactaaaaacctaaaaaaagttacatattcattgtatctttgtgagaaaaaaatg

SEQ ID NO: 14044 - DNA, 3000 bp, Unknown; identical to SEQ ID NO: 14041
  misc_feature (1)..( 3000): cDNA_ID_2995201_gDNA_ID_2214694_Annot_ID_189471 3000 nt of promoter + ATG

SEQ ID NO: 14045 - DNA, 3000 bp, Unknown
  misc_feature (1)..( 3000): cDNA_ID_3021484_gDNA_ID_2214694_Annot_ID_189469 3000 nt of promoter + ATG
cttgatgaatgagagtaaatgtcctttaagataaggcttgttaattgggtgcttcgagaataaaatattcaattatctgcttaaaaatttgttgctgggctgggacagcaatataatgttcaatgatctgcatattaaaggaggaacaaaaacgtactttcaaggcttgtctaatgatgtttctgaggttgagaatctcagttatctgctaaaattctatcttgtcgggctggggacatgataattcaacattctgcttaatgatgcttttattaaggcttcttgatagtctgcaaaatactctatatcttgatgggctgtgaaaccatgatgatgatcaatgttctggtggagtaaaaatgacatctagtaagacttctctaatgatgtctgagcagttcaagtgtctgctctgctatattgtgcatattgatgggataaagaattcttttaacgatgcttctcgataggaagattcaatagtctgcaataactctataatttgatgagctgggacatcatgatgatggtcaatgttctgcttgaggaaaaatgttctttattcaagtttctcttgttgatgttctagtatctgcttaaacatcatgacaaaaattcaatattctgcaaaagctccatattatgattgcttctcgacaggaaaattcaatagtctgcaaaatctcatatcgtgatggactgggacaatcatgttgacgatcaatattctgcttgaggtaaaatactattgctgagctggggcagcattgatacaatattcaatactctgcttgatgaatcagagtaaatgtcctttaagataaggcttgttaattggatgtttggagcatgaaatatatctgcatattaaaggaggaacaatgtcctttcataaggcttctctatggttgcttgactgaggcagcaaaaaaacatccaattaaaggaagaacaaatgccctttttataagaggcttgtttatgtgttgagactagagttgagatatgagatatttcaggtcatttgtctgcttagagagatgcattgctaggacatcatgagaagatcaatattctgcttgaggtaaaaaaatatcctctattcaagcttctctaataatgtatgactgagaagtttgcttaaacatcatgacaaaaatttcatattctgcatattgctaaagggaaaatgtcctgcaatataatactcaattgactgcactgatggaggagaataaccttttaataaggcttcttgaataacagattgaagagttcgagtgtctgcaataaaagctatagatcatcttgttgggatgacaacatgattcaacattcaacgatgtcccgatttctgaatttcaagtttctgcttgttgatgggactataaaatggtgtcctaagattgaaaaattcaagtttctgcttaaacgacagttgcgttgggacgacgttataaaatacttgaaatgatatccaataatctctgagattcaagtttctctgctaagaaaaaagaagaattcaagtttctgcatatattatcttgtgttgtactggggcaacatgatatattcaatcttctgcttagaccagcctttgaaaaagcttgtcaaattatataaaatcttcttgaggaaagatcttaggacagatttagagtattcaatcctctgcattcatcttgctgagacttgatgaagaaagtactcaatcctctgcgtctctaccgtctttgcaaggaggtaagtgtttcatctcaactatattgcactcgtctatgcagtgcagtgttatattttgacattggtctagtagcaattgggaagttcatttttcttctacttatgtacttctcttacaaattaatcactgtgttctaactacattttttggtgattgcttcgtaacagggaagtattgcagaaatccagttacgtgactgttgaactttctcagaggtgttctctttcagatccttaactctcaggtttcaggttgctctcttactctttcgcatcttgttgagcaaaatttcgtaaataagaagcataaattttatcagaggaggataggagctacatgtctactatttttagttttttagccaatgggagagctccacttcataccccacttttaccaatcgtgtgattccacactcagtctcacccatgtcgcgttgagcgcgtgtctacgatttctaaagggggttaatccacaaaaatcatgcctttttggatccacgcacctcattctcaaaaacccatcgcgtgtcttattttttttggttttcttctctaaaccaaagtaaaccgaaccgagatcaatttgaatttcaaaaccaatgtaaacccataaaacccatcgctgtgaaaacaaaaagctcggccactgtaaccacaaaaatggagacgacacaacttcgaagagaaatcaactcgaaatagccaagagaatgttcgaaaccccccccccccccctcaaatccgatgcttcctttgattccagcctccaaaagcccatctgctcaaatcttcatttcgaggacgaggactcgaggagtattacaaggtacctctatagaatcaatggcttccatggattttgaaactttacttctaataaacaccattgtaatgtctttttggttgtgtaaggaacaaaggatagtgaaagctgaagagtgggattcgtttatggagtttcagagtttttttgactaagtggcctctgtttttgattcttcagtggtcaattttgtgatgggatttgattgaaattgtttttgatgctcactctttatcttagttatgatgcattttgtgattcctagacatgttaacaaaatagtattgagcctttgaacttttgaaacagagcctgactatatatcattgaagctttgtcttttacgccttttaaaaggaagttggcttttggggtgtacatcaacacttaatgtttggtatcattgttgagaccttgaggacaagatg

SEQ ID NO: 14046 - DNA, 3000 bp, Unknown; identical to SEQ ID NO: 14039
  misc_feature (1)..( 3000): cDNA_ID_2785798_gDNA_ID_2214694_Annot_ID_189464 3000 nt of promoter + ATG

SEQ ID NO: 14047 - DNA, 3000 bp, Unknown; identical to SEQ ID NO: 14038
  misc_feature (1)..( 3000): cDNA_ID_1448161_gDNA_ID_2214694_Annot_ID_189463 3000 nt of promoter + ATG

SEQ ID NO: 14048 - DNA, 3000 bp, Unknown; identical to SEQ ID NO: 14043
  misc_feature (1)..( 3000): cDNA_ID_2705885_gDNA_ID_2214694_Annot_ID_136776 3000 nt of promoter + ATG

SEQ ID NO: 14049 - DNA, 3000 bp, Unknown
  misc_feature (1)..( 3000): cDNA_ID_3021559_gDNA_ID_2214695_Annot_ID_136789 3000 nt of promoter + ATG
aaacagaagttaattatatgattattttaacattatgttacattcattatatatacattattaaaataacacaaaaaaaaacgttaaaaatttgtcttaacaaaaattcattacatgctattaattttcatagatagtggatacatacgctatagtgacactgacatcttaaacaaaaatcaaatgtattaatttgtcttaactgtgttaagaaaattggacattgaaatattattcggtttgagttgaaattggcatttgacggatccgtggtttgcatggtgtaccaagcaagaatcgttggttaaaagaaaagaacacacattaattatcatgtttatgcgtaattgatatgtaagttaagtagattatatgcttctcaaaactaggtatttagacaatgagattagttagtcttaattattaaattaatatcccgatcttatcatataagccaaattatacgaagattcttaagaataatcattttaatttcactaacctctctctatctctctcttcattatccgaattaagccaatcgaatccttttcaacccgacgggtcgtgaaattccccaaaagattcctctttctcagctcaatttccaaaagctccgacctttacgatcctctagattctcggcgccggtttctcggagtaaataatggctcagttcacgggtcgggtcgttggagactacttggtgggtcgtcaaatcgggtcgggttcgttctctgttgtttgggaagcgaggcaccgcgttgacggtactgaggttgctatcaaagagatcgccatggacaggcttaacaagaagctgcaggaaagtctcatgtctgagatttttatcttgaggaggatcaatcatcctaacatcatccgtctgatcgacatgatcaaggtttctttttttgatttgaagtttcgatttttttggtcggttctcattttttagctgagaattttgaattgaggttagctttgttactatatatgtttctcatttgctcatcccaatgccaattttgtgtcataatgccatgattttgccggtgaattttggatcatatacatggaattaagcttcaattgtggaacaaaatttgggtctagtttgatgttgttctgatttgggcaatgtgatgcagtctcctgggaaagtacatttggtgttggagtactgcaaaggaggtgacttgtctgtgtatgtccaaagacatgggattgtccctgaagctactgctaagcatttcatgcagcagttaggtaaattctagtggcacttacttactctctgttttgttgtttttcttggttgccagaaacatgttttgtaatctctgacgggttttattttatgtaacagcggccggcttacaagttcttcgtgacaataatattattcaccgagatttaaagcctcaggtgtgtctgattctcattcctttcatttcaatgatcttctgtgcaccaggtgttttttattgttaatcagattagtgtgttagttgatctcactgttaaatgatacaactttcagaatgatgaaaggatgctgtagaagggtgctctgttagtttccaataaaacatgtttttggatatgttggggtttccttgtccaagtcttggagattccatctttgttgaaatttaattcttaaggttctttcgtttttgaaacagaatcttcttctatccacaaatgaaaatgatgcagatctgaagattgctgattttggatttgcaaggtattgtcatcagcaccccttgttactagatcaaagagtgtaatatgaatgaattagagaaggtttcaaatgggctcaagctgcttttgaatgtatattgtcgaatttctaggtaatttcattgttttcttgggggattatacttattatacgcctcccccattttgaacatcgctcttttcttgacgcagatcgttgcaacctagggggctcgcagagactttatgtggttcaccattgtatatggccccagagatcatgcaactccagaagtatgatgcaaaggtcagacctttctcttactaagctacctaggcccttctcttgacattatctccttacaatcctagctgaatacacaggcagatctctggagtgttggtgctattttatttcaacttgtgacaggcagaaccccttttacaggaaacagccaaattcaggttttgtgttctgtctcattgacttctatattatgtatgtgtttgtattctggtgcattaaactaatacgttctccatcgtgtgtttacagttgctccaaaacattataagatcaaccgaattacattttccaggggactgtagagatttaagcttggactgcatagacctgtgtcagaagttactgcgccgtaatccaggtcagcactaattctgcttgaagtagtggagactactattcttttgcatgaaaccatatgccccaggttctattggcatgtgtgttgatctaaaaatgtgaaattatattgaattgtggccacgttggattggcgattcaagcattttataatttgtaccgtgttcagagttttttgtttgattagcacaattaaaaacacaaattgtactgttgccatttcagtctgtcctaactttccgagtaactcatatcaacgggagttgcggagttttccagaacttggaattgtgatttgaatagcggtttatactaaactctagtcatctcctacagttcaccgcgtattttattcgagagagcatggtcctactctgtgtgtatccaaatacgattacaaatcattcttgaatatattgtcttttgcagtggaacgtttgacatttgaagagttctttaatcaccctttcctttcggacaggcagtcatatgatttctccaggtagatgtgacaattgtgggggctaatgcttttctctattttatgcagaaatttgtactgattaaactatctgtgctacaggagtagattggggttaagaaca

SEQ ID NO: 14050 - DNA, 3000 bp, Unknown
  misc_feature (1)..( 3000): cDNA_ID_2705917_gDNA_ID_2214695_Annot_ID_136790 3000 nt of promoter + ATG
actcatatcaacgggagttgcggagttttccagaacttggaattgtgatttgaatagcggtttatactaaactctagtcatctcctacagttcaccgcgtattttattcgagagagcatggtcctactctgtgtgtatccaaatacgattacaaatcattcttgaatatattgtcttttgcagtggaacgtttgacatttgaagagttctttaatcaccctttcctttcggacaggcagtcatatgatttctccaggtagatgtgacaattgtgggggctaatgcttttctctattttatgcagaaatttgtactgattaaactatctgtgctacaggagtagattggggttaagaacaatggacggttttctttcgtctggaagcagtccctcgagaaacatggaagaaagttctcaagaagactgtttgccgttccttctagatgatgattctagtggacctgaggggagcccttcatatttaaaaaagacatcctcaatgaagtcgtcctctggaattaaagtcgatacgagaattgagaggaaggaggtggaatctagtcctttaaaacatacagaacttacttctggatatagtagtttcaaccaaaaagtggaaaacgatagatttagatttgaaactcaaataaattcagataggagaaaccgcagggaaccgacaggattgactgattctagatcacttattgctccaggaagaggtaattgaatctttaccattttatccaccgtagagaatgataaagctttcttgttctgtttctcacatatgtcagttctgcagtagatgattctcaagactccatggatcaagacttcgttctcgtatctggaccaccagtagatatgccatcatcttcatcaagttcttcgaagccttataattttccattcaagtctcagtctcctcctgtagagttattcaacagaagcataagttcaacggctcccatgccaataattggtgctactagcaacagcattggtcagtttgggagccttgacagtcagtattctgccccgagcacttctcatgggtctctggatcttggtgatgcttttgaacagccatcaactcacagcctgacaagaatcaggtctctgagaaaatatgcagcaacaattgcagaactagtttatgaaagggtaacgaaacttttcactgtttgtagatagtcacatattatcatcgtgacatcactggccatcatgagtttctgagtagattattttcatgattctttgtatagattgaatctgacaaacatctagaagctttctcgatccaattggcgattctggcaatttggaaacaggcactgcacatatgtcatactcaggcaatttcaggtttggaaggaagcccaagccaagacattaacaaactaagaagtagcagcctgaaacacgatactcacagttctaataaagtcactgatctcagccatgatggatcggaggagatatcctctcagattcagaggcaatttatacaggagattgagcttgctgaagaacttgccaagagtattgaacctggtatgtttttttttctcttgggaaaaaataaacatttgtttttgaggtattaaagatcttaaaaggttttcatctacatgtttgtaggaaatacaaaaatgccagatgcaatggagacgatatttgaagcagcacttgatcttggaaaacttggaggagtaagtttcctttgtcttttcacaaagaatattgatgaacaatccaaaaacaatgaaaacaaaacaatcaacttgtctatactcattctcatatatggtgcctgtggctttttctgcaggttaaggaggttatgggagatacagagaacgccggaaaccaatattcgaaagcagtgcgtttgctggtattccttttagtagaagcaccaatgctgattctgaatccgccactgtctctcacaaactcagtcaggtatcgtctcaggacatatattgatttcctcagcagaagattaaaacatctgcagtcacatagaagaagttcagctggtcagatgcaaggatcatcgttagctatgatgaacagacaatcataaatccattcacttgggttgggttctcttgtttcttgtgttcttttatgaaaaaaaaaaaaaaatctaaaagagaaaaatgtatatgtttttgtacagcaacatcatatattcttattcttttggggttaatctggagggacgttggggaaatgatctgtgtgatggatgttgtaacttgtaacattttcttgttctattttgatcttaatcctatgttttttacttgactttatgcaaaaatatatgttatgatgattcttggatacattatttatgtataaataaatctatgactatgtttttaaactaattgtagagtatttatgatgcatattttaaaatcttaaaatctccttaaatctttctaataaatgatattcttaattttggttcgtcaagaataatatttatctcttacttaagtctttgacttatttatgtattgtactttattcgtatctcaaaattatgcaataaggacagaaccttaagggtttcagtttcccacacgtatgcagatgttaccacacgtgcaagagactgaaaagaaatatatacagtgaagccgaagaaaaataagcgccagtggccctaatcactcttgcagtcaccactgtcgccgtccgtctctccttctccttcttagggaccattcctcctctttcagaccagattctaggttagggtttcatcatcatcggctaaagtttcaatctttgaaatttccgttatctgttgatctcattattctctgattttgtgtagtttccacaagtttattccttttgatacattcttggggttttgttgtatttgcaaaagctttttttggaagaagcttcttatagcttgctggatttgatttgatatttgtcgaaattgccctgtttacagaagaggaaaa

SEQ ID NO: 14051 - DNA, 3000 bp, Unknown
  misc_feature (1)..( 3000): cDNA_ID_2705937_gDNA_ID_2214695_Annot_ID_136793 3000 nt of promoter + ATG
gacaagttcaggataagattttgatttggagattcactttgggtttggatttaatgaaaattagaagtttaaagtaagttttatagaccaagttgttggacaagcaatcgaattgggagctatgttatgtcttgattatgcttacgagttcttttatgttacctatattttcacctatgtgaatacggccgttgtgttgactcatcatcctcaacatgaatgtggaaaaaattaaggaaaattagaaaatgaaaactgcttgaggctgaaaataaggcaatgtgaaaaacactgtacaagatatgactcaacacagtgagcttacgcctatatatagaggaccaagtgttcttcttctctaacacacacacactgacacacacactccttaagatcatctctctcgtgtagtgtattttgtcaataaaagttgaacagatggagcataagaatattggtgcagaagtacttcaagatacgtacgatgatcaacagaaatgggttcttgattcttctcttgatagcagaggacgtgttcctcttcgggctcgaactggcgcttggagagctgcactcttcatcatcggtacatagcccttattgagattgtatatactttataccatagaattataacactgaaagaagtgtactataatatcccaaaatattaaatctttgtgaagtcttttgtttcgtcttctctgcacagcgatcgagttcagcgagagattgagttacttcgggttagctacaaacttggtcgtctacctaacaacaattctaaaccaagatctcaagatggctataagaaatgtgaactactggtcaggtgtcactactttgatgcctcttcttggaggctttatagccgatgcatatctaggccgttatgctactgtcttggttgcaaccaccatttatcttatggtaacatatgttcttacctctgatatatcctaatccaatttatttaaagattccataaacaaccttaaactgtgtcttgatggttaaacagggtttggtccttttaacaatgtcctggttcataccaggcttaaaaccttgtcaccaagaagtgtgcgttgaacctagaaaagcacacgaagtagccttcttcattgccatttacttgatctccatagggactggaggtcataagccttcccttgaaagctttggtgctgaccaattcgacgatgaccatgttgaagaaagaaagatgaaaatgtctttctttaactggtggaacgttagtctatgtgctggtattctaacggccgtgactgctgttgcctatatcgaagaccgggttggttggggcgttgctggcatcatactaactgtagtcatggctatatcactcatcatcttcttcattggaaaaccattctatcgttaccggacaccttctggtagccctttgacaccaatcttgcaagtctttgttgccgccattgccaaaagaaatctaccttatccttctgatccttctctgcttcatgaagtgtccaagacagagtttactagtggccggcttctctgtcacacagagcatcttaagtgagtagaaccaaactcaaaagtcttccatttgttaatttcaaccattctaaactgtttccttgtagatttcttgacaaggcagcaattatcgaagacaaaaatcctctggccctcgagaaacagagtccatggagacttctaacgttgacaaaagtcgaggaaacgaagctgatcatcaacgtgattccaatatggttctccacgttggcctttggcatatgtgcaacacaagcttcgacgtttttcatcaaacaagcaataaccatggacagacacatcggtggcttcacagttcctccagcttccatgtttacacttaccgccctcacattgatcatctcactcactgtctatgagaaactcctcgttcccttgctaagaagcatcacacggaatcaaagaggcatcaacattctccaaagaatcgggaccggtatgattttctccctcatcaccatgatcattgcagctctagttgagaaacaacgattggaccgtaccaacaacaacaaacccatgagtgtgatatggctagctcctcagttcatggtcattggctttgcggacgctttcacactagttggactccaagagtacttttaccaccaagtccctgactccatgagaagcttaggtatagcgttttacctaagcgtgataggtgcggctagcttccttaacaatctcctgatcacagccgttgatactctcgcggagaatttctcggggaagagttggttcggaaaggacctaaacagcagccgcttggaccggttctactggtttcttgctggtgttatcgctgccaatatatgtgtctttgtgattgtggcaaagagatgtccttacaaaagtgtgcagccaagccaagggctctcctgattcgtccatatccgtcgacgtctaaataaacaagacatgcaatgctaagtatatgtcgttaagtctaacattaaaaatcattagtaatcaatgttggtgttagatttttttctttggttaaaagataaatttagagttgaagatttaaatttcttatgaaaaagtgccaacatactttgttcaatatttgtattcgcattacgcttactagtaacccaaaatatatttccatttagaaatttgtcggaacaaattgtcattaacaaaaaaaattgaaagaagaaaagtcttggaaaaaaaaagacaacttgagaaactgttacgcatattccgggtatctcagtatctgagctgttttaccaaaatacccttctccttctccaagcaagatttagggtttctcaaagagttttccttttccctctctctcccatgtcgatgtctccgatctccatcgtaattcagtttccttcaattgatgtgaccttcgattccaaactcgcaaacccagaaacgggttactcatagaaacagtgatagagagatatg

SEQ ID NO: 14052 - DNA, 3000 bp, Unknown
  misc_feature (1)..( 3000): cDNA_ID_2705941_gDNA_ID_2214695_Annot_ID_136794 3000 nt of promoter + ATG
agagaggtgatgatggaggtaagaggaggactgaaaatcgtggtaatggtgggagattgagaaatggagggtcttcttcttctcaggtgtatgatatgactttgcagaatgatgggagatatgaaattggatcttaggtatgagttcttctttgttgtgtttggatcattgatgtctctgaacataatgtgtatgtaatctggaatagtttgattgtgattatgcaaagttttcagttttagggaagcaagtctctgtgttcaagtataggttttggttgatggattattgattggtataagcattgtctataaactggttaacccaccaaagtccttaaaggttggtccttttacctctacatcacaattcttacttccctcttcactagatatacctttcatcttcattttcttcattgtatcggcacaaaaaggcgtcatggatttattagagtaagaaacacgtaaaccatcattggtgacatcaaactgcatgttatcttccgatgtcaatacatttccggatgatgaagcagaataaggcgatgatgatatacataaatccgaattcctctgttctgaatcatctctcctctgttttttcttagtcctacttccttcactttcctcttcttcttcgctcaatgagtttatgatttgtttgactttgatcatgagggtttgacgtttcagccgaacgcattcacggttattggaacggtgatcatcaacaatctcctccacagttaatcccttatttcttgattctgtaacaagtttcgtaaatccccgaataggaacgctcccgctgctacttcctcttttccccatctcaaagtttttcagattagggtttctcggaaacaggggaaggtgtgttcttattacaaaattggggaggtgtagcaggctagccgtgagcagctgaaatcctaactctacttgaatggcgcagacaaatttatgaagccttaattgctcactcacttgggccttggatatcataatgggcctttgattcataatcatcatctaaagcacactatttatggttatggttatggacctatggttcaaattcttgccaattttttttactaatgaagtttatttattccgttattcttgatcagcattggtgatcatttaatacactaaataaaggaaatctatatgataatgaaatggcttaagtctattggatgtcaaaaagtttgcacttgataatggcatgatctccacaattcgctttcttgccacttctttgtgtggtacgttatcgctaaatcaattattagatgattggacttcatgtcaagataaatttatgtcaattttcttccagccactctggtgaatggtgattaatgttcaacttttaagaccactgggtctgctctaattggttatccattttaccgacgttcatttttgtcatctttagatctttatggtaacattttctgactcatcaaccattgcatggtgcttcatttgatttacagccatattgttaagcatatgtgtatcctatatatgacccacttctactgtttttagcagtgcataacaatgggagactgtattataactttctatgcgtggagcaaagcacgtgaaatagaaggatgcttagtggaggttagtattttcaatcaagtactttgtctaatttatcttgttgccatgacaaacgtgggaaagtagtcattctagcttctgtaatttgagctctttatttctcgcctttggccaagaaatcaaccagcatgtggtacatgtgctttattatattctgtgagctctttcttaaaaggagaactctaagccaattttttctttcttaaaaagtaacctcactgaagtggaggtcctactttcaggcaaatcaagtttattttggttaaggtggtgaaaaagagaccattcattggagaatgtggttttgatgagtcaatattcaaaattgatttacttttaagatgtccaccatttacattgtcatacttgctaaactgcgccaagtcttgctagaagattctatctctcttttcactatttgtttatgttggtattgcttgttggtgattcagttaatagtggttagcactatgggacaaggtttatctacttacctcagccataggccatagccataaagtcccatttggggttgactcttaggaattacaatcaattgtttaaattctgttggagaaagattgtaattataacaatctaagcattctatcctagtggagtaggtggagttaagattcagggttaaacaaacaaggtaatattgtcttagaataaagttcgttgtgacaagatgcagaacattgagagttttgattcccaataagaaaagtaaattgagtgggtagttttgagttgaattcatgtttttcattttggtctgtcagaaaaaggataagatttaggttagcgggataaaatcttttagtagaagaatgtaatgagggaatttttctttgttgtttttgcctgaaaaggtgaaaagaatacaaaaaccatcctgtaaagtttgttgaaggacaagttcaggataagattttgatttggagattcactttgggtttggatttaatgaaaattagaagtttaaagtaagttttatagaccaagttgttggacaagcaatcgaattgggagctatgttatgtcttgattatgcttacgagttcttttatgttacctatattttcacctatgtgaatacggccgttgtgttgactcatcatcctcaacatgaatgtggaaaaaattaaggaaaattagaaaatgaaaactgcttgaggctgaaaataaggcaatgtgaaaaacactgtacaagatatgactcaacacagtgagcttacgcctatatatagaggaccaagtgttcttcttctctaacacacacacactgacacacacactccttaagatcatctctctcgtgtagtgtattttgtcaataaaagttgaacagatg

SEQ ID NO: 14053 - DNA, 3000 bp, Unknown
  misc_feature (1)..( 3000): cDNA_ID_2705949_gDNA_ID_2214695_Annot_ID_136797 3000 nt of promoter + ATG
aacgatgttgatttgaagcaggagaggttaattccgatcatcgtcgccgccattggagctgaggaagccgagcaaattattttatccgttccagattttttttttattgttctttaatataaaattgattttacaatttttaggttgactttttcagtcaactcaattttcacaaaatgttacaaaacaactctcttaattatattcgaatgcacacacacacatatcaaatcaataaccaaaaaacattccattctcatagggtttggttggttacactcacaagttattgaatatccctattcctaaacgcccgcccacggaaaacagcgaacccaagagcatgcccgaaaatcgcggctaggaaaacaccaccgttgaaggaaacaacagccagaatcactaggtagctaaagccggacttgacggtatacatagccgtgcgaaatgcaactttagcaagcttatcggcaccctgtttgatggatgacgcgtcagagcaccgagcaagccactcagctaagaacgccagaaagaagacgaagataagtgcgagtgcatacatcccacggtcagaaccaggccagcctgagaagagcacttggcagttgtaaccccaatagaatgttgggtgtaacagtgacggtctatgtggcgtttgcgtttgcgttgtggtggtggtgttccaagcctctactacgacaacgtttttgctcgacaacatctcctttaatttggtgtaaaaagagaattgggatgtcgttgtcgtagtggaaataggagactcgctagtctttgcctataaaaagtgtttcgtcttgagaggaagagactggtcctactaaattatatgctatgttcatgttatgaagcaaactcaagatttgattgtcggatttttctttcgaaaagctacaccatgtccatcaataaactatttttggccgtatatttgtaatcaaaattcgtttttaaacgtatatataaatacattgatgcacatatcataagctaagctagctaactaaaagtaaagtatcttatggtttaatatgtttttttgtctacgttagaatattttctttgcttttttatataaattttatcacaagctattgcaagcaataataaaaatattaaataaaatatgctaataaaaaccagtaattttattttgattcacttaacaagtaaattagttatttccccaagcttgttttcaaataatcatcaatctattctaggctatctagtggttaatttgtttttagactagggaacaatcgatcatatgattagtcgatatacgaaattttttgattatgtcaacaaaaagtgacataaaattttcagtgataaaggtgagctagcccatgttacaagagctaaatactaatccgatcccctcgattcaacagaacatttttaaacttatccaatttattattatatgctttacgtcaagtttgcgttcttccacgagagaagccttaacacatgatggaagagtgtaatgttgcccatgccaattgccaagaaacaaacaactatgcgtctatgcttatggcgggcaccgactaggccacgttctctatttcacaagtttaaccgcgaacacacaaaaaacaaacaaccaaaaaaaaaaaaaaaaaaaaaacttaagattatgagtttgaagacttggatgcacgaagcatagcaacgttgaaggtgaggagaacgatctttaatgggtatagtccactttccatcatctaacctttgtttatacggatattccaactcaagtataatccactttaaacttttgtgatgagtgaaaactatttcaaaactacactttgctttttttatgcatttcaaatttcactttattaatgtaaagtgtataaatatttgaataattggttttgaatctagatcttaatgtcaaggcacctataaagagaaaacatcaattcagttgcaattaagggcatgtagctatatacatttttttgttcttcagccgaaacagtacttcaataatgattcaaaacacacacacaaaaaaaaaatagatagcgaaacagttatatcttagccggaccaaattttcctatgaaatcactgtcagctttcttactcattacctcatgcggcactacctttggaccaccccgatttgataatcacatccaatagatttcaccacgacaaggtactcaaatcctctaactaaatgtaagaggaagaagatacaattaccaaattcagtaaactagagaaaacttgcactaaaattattatttctataagaaatgttttaaatattttaatttattaaattagagtaaaaatggatatttaacggaagagagagtggaataattaataaagaattaaatccagtagtaacagaaaactcaagtgtttggacttcagtggcagttttaagtactttgcttcggtcagaatccttcaaacactgtttcttcatctcccttcgtcttctaccttttgatttcgcgccaccacgctccaaccttttcgttttcctctcactgctttctccgatctgcctgagtttctccgtaagtggtccctaattcccactttttcctctctctggtttggtttggagtgacaaaaagaaaagggaaagttacaatttcgttttcctttctctttcttctttggtgatcccattgctaaaatttgctgatttccttgcaaaggtttctgattctcctaagttttagttagatctgtgatctactgatatcctctagagcctcaattcttcaagagactgtttagcttttgctaagaattgagtatgaagtactgaattgtgtaattccaatgaattctctagtgatatttttatgcttaaactttatgtctttgttattgcagagtggttagtgtaaaggtggatgaagaaactaagatttggtttagtccctgaatgcagtatagagtcattgctttgaggttgctggtaattattctaccact

SEQ ID NO: 14054 - DNA, 3000 bp, Unknown
  misc_feature (1)..( 3000): cDNA_ID_1397867_gDNA_ID_2214695_Annot_ID_136798 3000 nt of promoter + ATG
atccacaaatcagaaactgttttgttcggtgttgactcgactaatgaagagcttgcagcaatagttcagacaagaaacacaactacaataatactcccaagtggagttcacacattgcctaaagacggtaacaattctcctctcccgttgattaaccggtggaaaaccggtggagaatgtgactgcggtggttgggacatcggttgcaaactccgtgtcctgtcttataatcatacaaagactcaaactttgtcaagctttcaattgtttgatcaggtaaactaacttgttcacttcaagcagctttcgggtatcgatggtttgagtcatttttcaacaatttgatttgattctcacaggaaagagacgagccagctttcaaaatggtgagccacggcgatgaactccactctgttgagtttggctcatcgatctctctcttggaagcgttctttatttcgttagcagtaactagtcatcagagttggtgtcaggaggaagaagaagaagaagtggttgtgatcggagattgtctgttaaagagagaaacaccggcgaagtacgcaacgaacccaccggtttctccaatcggtcgggtctagaggcagagagagttgggcttagacagtgttggatctggtttgggctgggctttaatataattgtaattaagaattacatggcataattaatcgtttagaatttgggtaatgtacaaaatagtgaaatgcatttatgaataatatagtgcttatggtttttcctatagtcctttgaaaaaaatcgaactgaaattattttcagaaaaactcatttcgagacgttttttcggttgaatcaaaactattttagattttagtatttgatgataaaaggaatagagaggcatgtgaggaagaaaccgtatttgacagacatgcttcgctgcattaccctacgtactcacatgcttctccaaatcatattcctccacgtgtagtgtttttttcttctttctcaattagatatagttaaaccttaattaagttttgttaagatttgcaaattggccacttacttaactctggttaccccgacattaccttcgaaattttaaattaaagcgtcaataacggttggtgggtttcatctcgtgaccactgactactttttagttttacttactgaacaaaaaagctctttatcagaattttgaatataccacttgtttcctatttcggataaattgatcatataaaattataaagtaaaggtttttctcttagaagataaattttttttctccaaatttgcataccatttaaaaaatgaaaaagactcttttaaaacaaaacacaggctgggactgataatatgatattctagaatctttcctgaaaaagaaaacttacatagaaacttcttcttactatgaactttttgtaaaagaaaaaaaaaggttcgaaatgagtgaaaatgattttaacgtgcattaaacttgtttgatatgaatcaattcatgtaataggattgaatgctgatagtaacatcatacttattttctgacaataatttaataaatgagtacacttgttctaaagttctctttgagaattctagaatacaagtctgcttaatcaaaaggctattttaagataaatgaatttttaaaaaggttaagaaaacgtatgaaagacttactgtgatggacatatcaatcgacagttattgggagtttttttttggagtagcaaagaaatgtaagaaaaaataatgagaagaagataaaagccaaagttgtgaggcttgtcggaccaaaaatggccaaaatgctagcaatccttgaaaacaagtgatggtaactggaacaccaaaatttaatgggttgattgaatcattgaaagatttgactttcaatatttttgatattttcctaaggagacttttatgacttttctttcattagtctctctagccaaatttgttttgcacggctcacattttgccttcaacaattttcattacttgatctaacatagttacttcttaaaaaggcaaaacaaaatttactttaatagctgagtttcttttttgtttctttaccatttaaatcatatagaatggctaaccatatttgaaatagtattgaatcgaatgtatctaccattagaccaccatgaatgatttcatttatactcatgtattttacagtttgttaagttgattcatatactaatttaacaactgataattgttacacatccattaagctttcatcaatacttaaattaatagcaaaaatgaataattaacagctaaatacacccaaattttacagaaatattctactcctacaatttctaccagtcactactctctaattttggtataaaaatcatatagctcactatataacagctatcaacctgtaatatataaattctgataattaatattggagaatttagtctaattagctaaacattttattcgtataaagaaactttttttttcctcgtataaattctaattttcgtttcgtggtttgaattatactttttttgtttttatatataataattttcaattcaaccgtttctccgtgttgaactctaggcctttttaatctatgccttcatttctcagattcttctaaagaaaaatttcgcttttctctctacttcaaaacttttgataatcttctttaaactttcttcttcgatctctctttgttaactttctttcgttacgtctctctcgttctcgttatttcttattctcagatcttggattcacgaccatctcgatcgttgaccgtcgaatttgggttcggctaaaaatccaatctttttttttccggtgagaagctcgagagagtatataatttaataaagggtacgtacgattttggttgagtgttttgatgatgttgacccaatttgttggggtgtgaagtatacttatggaactgattgtcacaatacaagaagaacaacatcatcaacaaacaagaataataag

SEQ ID NO: 14055 - DNA, 3000 bp, Unknown
  misc_feature (1)..( 3000): cDNA_ID_3021527_gDNA_ID_2214695_Annot_ID_189514 3000 nt of promoter + ATG
agttgggcaaggaagctttcccttaccgttacagttggtgcatctgcggagaaaagagagttttctgtaattaaaaccacacttttcattttgcaaccatcaaagtataagtagagttcttgatctgaactcacattgtgtcggacccatctttatgagcaaccaagcctcttccatagcaagtggaacacttcatcatctgattctccttgtaaaatcctggctctccatcagcattgcatgttggacatactacatctcctcttccggtgcaacctgtggatcagttaaaccaagtctcatcagtatttacaacattctgattgtcctaatggtcatatgtacattacatttgatacctgtgcacttctcaacagtctcagaattaggaaccaggacttgagtttctttatacgggacaaacagagtaggaaactgcggtctcaggtccagttcccataaccccggttcagatccatgtttctttccattgaattcaccaccagtgaaaggcacagtctgtgtcaaagcttccctctcctcaatgaaagtatcaagagttccgacataaacattgcagtcttcaacagcatgaatcttccatgtacgagcaggacggcttccccaacagcaacgatgaccaatatgatcaataagcagctctcttatttcaatctcatcaagaaactgcctgtaagaaattacataacgttcaacataagttaagaaagtgagggctaacaacagcaataagggaaaaattaggaaccattatcactagaattacctttgttgcaattcatgacctgctccagatgcacttggataaccaatagcttgagctgttaaatgccaagaagaaatcagaaatttgtataaaaccattaagaagcaaagagagaagattataggaaatgaatcaatgatgaaactttcacatttggaagatcaaaaatcaaaatctagagaaaacagcatgtagatcacttccactacgaatcaagactcgaataaaaagtctgctactttcaatggaagctgatcaaataactaaaggtgtcaatacaaaattttgaaggatcaggaaagatggaacgagacttacgaatgggtaacgaaacaggggtcttgataacgggaggataaagagacggaggatcagaagaaacagcagaagcggtacggatttcttcgacggtgacgacgccagctccggcgaaagatgggttacgagcagatgagctatttctctgcaggtattggtatgaatccaacctctcggattcattcgttttctctgatcctaaatgagcatttcgacaagacaattttatgaatcagaggactcaaaggagatatacacagaggagatgatatgttcgtctgaatttacctgaaagcagaggcttatccatggattacgaatctctctgtcttcccaattaaccaaagtagtggtttttcttagagagtaaggaaaaacccaggtcaattcgatcttcttctccgtgcgagagaaattttcattacaagaagaaacaagacaagaattcgagtttttcttatcgggtcgggtcagatccagatagaaccgggtcttcgtattgccacgtgtgaaacggttgaggatattttcacccactatataattggttgttataagtacgtaagctaaaaagagattcacgagggaaataattgcgcgttttggtccagtgtttaaggagagagagcaggtatatgaaaataacacttacacatggatgcttttaagtcctatcacatgcggcatatcggcaacaaaatctttttcatgttcgttcatttccaagttattcaatatgaacgattccaaaattttgtcgttgatttgattatagttgacctggaaaagatactatagatactaacgaacatcatctctgttggtctagtacatgtatttaggagtggacacaaaatggattttttttacttttttggtgctctgtccggattcaacatatatctagttttgtgtatcattttgattcattatggaataattggttacaagttacaacttcataatgaacaatttattataagacgtcgtcgactctactgatctcacctcacgtatgattaagcacaatattggtgtatgtttcttttttctagtgttgagatgtctttcatacaaatcccatgaatatgcatgtctcttgttctctcaatctctgctaacacaatttacgacctctatgttatattaccataaaaacattacaagagaaagaagaaaaatttaattagttttcaaattaataaaaatttagacgttttaagaaaataataataatttacaggtcataaaaaaactgattgaagaaatatatttccagctctaaaacccaattcctaaatctatattcatttagaaaatatatatacatttggtatttaatattcttaaatggagtaagataataaatttatattgtaatattaaataccaaatatatatattttggtgtctttttaattaataaaaaaataacaaagacacttattctaaattaagaagagtcaattaacgaaataataaggaatgaaattctcaattatgaaaaacacctgtcacgaaagtaaacgggaaaaaaatcgcacgatagataattgcatcggtgctcagtgctctgtttatctcgttatataataatgttagagaaattggatgtgaatgcaatggggcggtttaatgtgaattgatgagtagacacaacaagagtttggtttggtaatggtagcaacaagccaagagcactaactaccgacaaccactcgcgtccacatttgaattttcctcaattcccccactcacgctttttagctctttctcaatctttcatggcggattatctctctctctctcacttctccttctcgtgtgattctgattctcctctctaagatccgtatctctcttactctcccttctcaagctcacttcaatcaacc

SEQ ID NO: 14056 - DNA, 3000 bp, Unknown
  misc_feature (1)..( 3000): cDNA_ID_2705969_gDNA_ID_2214695_Annot_ID_189513 3000 nt of promoter + ATG
agtaaacgtatatacataccccggaccacggccatagcacaactcgttctgtccattgcaggtactgtgattgaaatcacaaggcagtccagtgtcaatgcaaaaggtaccaagagtatttggactcacatcaccacagtttgattgacagaaggcagagacaaatttacgcttcgaaccgtttcttactcgggttttaacatcaagggacttatccacagaatgtcctctagatgacttataagtagccgcaatatccaaaagtctactctctgaaacaaagtaaaacaaaaccataactttccacatcagtctctctgcaactgcaatgtagagaattgctacattaggtaactcaaggaaaggatatgactcacggtttctactgaaatcagaaacaatggttgatactctccgagggatgtttctagagctaacagaattcttctgtccattctcaaaccaatcctccataaaccgagctgcagcgcctttgttatctccactaatcaacgagttagtccgactcatggaagtcccatgagtagcaaaccagttaaaactaccagtaggtcccaactgagaatcaacaaacttaacaagagtcatttccttatcaacatcatacttatatttactcctctcagctgcaggattgttcagataagaactcggacttcgattcacaccagcatccaaaagatcccctattaacaaatcatcacacaaaatggctcaacaaacacaagaacatcaataaaggagattgacaaagaaaagattgtaacttctttacctttgttaacaaaagcagaaccaggacgtaggctttcgtgtgcttggacaatgctttgctcaatgccgttaacaacaacgtcaaaagattgacgaacaaatccaagagacgtcacaatatatgtgacgtattgaagatatcctcctggtccagcatgtgtgtgaattccacttattgctacattcttctctgtgtaaagctcaccatacctattgaacttttaaaaaattagctatccattctcatggattaatcactgattccactaacactctactcaaagattaaatctttagctaattaaatattcataccttgctttgagacgctcaagaactttgattgtaacgatttgagaagccatacaagcgtcgagattgacaaacacgacgcggttaccttgaggctcagcgacgatgaaggcacgagctcgtaaccggaaatgaataccggaagcgatttgatctgagtttgcgtagcccatcatgttgacatcagcggcaggaccagtgatgtcatagcttccgactccgattaagtatgcataaaccgttcttgaaagaagaagaagaagaagaaagagtataaattgaaacaatggtagtgaaacagccatggttgattgaagtgagcttgagaagggagagtaagagagatacggatcttagagaggagaatcagaatcacacgagaaggagaagtgagagagagagagataatccgccatgaaagattgagaaagagctaaaaagcgtgagtgggggaattgaggaaaattcaaatgtggacgcgagtggttgtcggtagttagtgctcttggcttgttgctaccattaccaaaccaaactcttgttgtgtctactcatcaattcacattaaaccgccccattgcattcacatccaatttctctaacattattatataacgagataaacagagcactgagcaccgatgcaattatctatcgtgcgatttttttcccgtttactttcgtgacaggtgtttttcataattgagaatttcattccttattatttcgttaattgactcttcttaatttagaataagtgtctttgttatttttttattaattaaaaagacaccaaaatatatatatttggtatttaatattacaatataaatttattatcttactccatttaagaatattaaataccaaatgtatatatattttctaaatgaatatagatttaggaattgggttttagagctggaaatatatttcttcaatcagtttttttatgacctgtaaattattattattttcttaaaacgtctaaatttttattaatttgaaaactaattaaatttttcttctttctcttgtaatgtttttatggtaatataacatagaggtcgtaaattgtgttagcagagattgagagaacaagagacatgcatattcatgggatttgtatgaaagacatctcaacactagaaaaaagaaacatacaccaatattgtgcttaatcatacgtgaggtgagatcagtagagtcgacgacgtcttataataaattgttcattatgaagttgtaacttgtaaccaattattccataatgaatcaaaatgatacacaaaactagatatatgttgaatccggacagagcaccaaaaaagtaaaaaaaatccattttgtgtccactcctaaatacatgtactagaccaacagagatgatgttcgttagtatctatagtatcttttccaggtcaactataatcaaatcaacgacaaaattttggaatcgttcatattgaataacttggaaatgaacgaacatgaaaaagattttgttgccgatatgccgcatgtgataggacttaaaagcatccatgtgtaagtgttattttcatatacctgctctctctccttaaacactggaccaaaacgcgcaattatttccctcgtgaatctctttttagcttacgtacttataacaaccaattatatagtgggtgaaaatatcctcaaccgtttcacacgtggcaatacgaagacccggttctatctggatctgacccgacccgataagaaaaactcgaattcttgtcttgtttcttcttgtaatgaaaatttctctcgcacggagaagaagatcgaattgacctgggtttttccttactctctaagaaaaaccactactttggttaattgggaagacagagagattcgtaatccatg

SEQ ID NO: 14057 - DNA, 3000 bp, Unknown
  misc_feature (1)..( 3000): cDNA_ID_3021531_gDNA_ID_2214695_Annot_ID_189512 3000 nt of promoter + ATG
tcgttttatgtctgtgtttgtgtaaatttttatatagtacagatttatgtctgtttgtgtttatggccttgtggggattttgctaattatatgctttttttggttgattttattacattctttgatttatttattagtacttcccaaatatggtacaatagaatattttcaagtttaagcatctcatatactgtatatctggattttaaaactttgggtatagataataacactagtcataaatgttcacgaatcattcataagccagtgacatatttgctcaatcggagaaagtgaacggaaaaggttacaggataggccggtgatggaagagaggcaatctccctcagcgtccataggttcacacagagatagagagtgtatattgttttctacgattagagcaactatatatatattacccaattaaaagtaaagttataacttatataagttctaacttacataagttctaacttctaacctatcccacaacaaaatggtttgtagtttatacccgatccactaacactctctcgcccatgtacacctctagatcacggccacacatgtcgttcgtttaccctttaattattattttgttatttagaaaaatgaacaatgcaacttagttgctatcattacatgttttaaaatgtttattatctttgtctttaaaatttttagctaatttcttacactagaaactgaaaaacgtacaaattaacacttgatcaagatgtaacatgtgggccaaaccttagatttgccgtcaaatatattggacacgtaacccctaaccacatacctcctatcacctgctaccacgtggattcattccaaacactttccggatctcaagccggtcggcaaagagcaccagcgtgaaattcgtcttctgcaccttcttcgtgccttgatggccgttggatccgaatcagacggccgatacacgatctcccttgatcttacatgtgaacttgtcatttgcgttaagtcaagtaccaaatcatttgtaaatatgtcggacgaggtacaaaaatgtgttgttatacaacaaaatatttaaaactcatataaaataaaggtatacaaatgtgaagagtattgcaaatagatttagctggttagtgatgttttgaacgtcatggatattgtcgtagtatgtgtttataagttgatcgttgtctatgtttcaatgtaaaaacagatttttggatgtaataaattagaaatgacaatcggttttaaacttcaattttctgataagtggttcattgaaatactcaaagttgatgatttatttttcctcgtttagaacttgatgatcttcgcaaagatcttaatcataatataattagattttgtttgtgagtaatccagtcatatatagaattaaacactagcattgtatgtttaaggcaaaattgcaattacaataagattcggtttcatatcaaatctcttgtttatggaacatgtatgtgtcttttttttttaagaagtttttttgaatagaggtttggtgatagatatggtcctttttttttaagaaagggagggtataacgatataaatatattcttcttccaaaaaagagtgaagggcaacaaatacaagaagaattatgttgaaatcaggcgttaattaaaaacataaaattcagatgtgtattcatgctgcattgaaattatttatatcgaaaatgataattgtagtaggagtagaataacaaagacatacacaagtgcaactcggtgtaattagataagatcactgctttgcttctttgtaccttcgatcatgttcttgtataatcaagattcgtatagaagctaatatattcacatgtttttgttcttctaattatgaagttgaaccatctattattgtagttggggattaatggacgatttgaaagaatcaaccgaaactcactagatcgtgtatttgtgtcttggttttatgttttatctttttaaaaatttctatactgaatctggttttcttagcagcttaaatttttaattaatatcagaatgagatcatgataaaacttttcacaaaattgttgatcttgtattagagaacaaattgaacaaccatgagaatgaatttcatgagtcacacacatcttcacattatctagatggaaacaagtatacttactagaaaattcaaatggagccacctatcaaataaatcccctgttagataactcatgatcaagatattcatgatcaagaaattatctactcgattttctgttttagctcttttgataaacactaatttttaagtgttttatattcctcacacacatattcaccaatagattagtcattaatctcaagttaacacacgtacctttatattcaatagacctaagtcttgtttctgacctcaaactgttggtgccagactcccacttccatgttcgaacttctttacattctttaagtcaggttattttttggattccaactgtagtgacaatccatacattccatggctaccaaacttatcttgattcacattatgctaagaagctaaaacatacaaaaagaaccgaaattgtcgtgagtttttttaatacgatagggtattaatgtattcttaacaacgttatggtcttgagaaataaaatatgcaaatctcgggtagggttatttggattagtgaaatttgggattttcttaatttaaggctaaaaactatgaaatttagagatttatgacagttaataaatacgaataacggtgttcgttgcaattttatgtggtacttatttgtttttaaaaaaaaagtttagtactaaattgttcgatttcgaaagttaaatatatttttgaaagttataaaggaagaaaggatttcttagcaaatttccgttatttaagttggagagaaaaggtttaactcaaaatatcgcaaaaccctaacaaaaaattttcattcttcctccactctctcaattccaaaacactgcgccgggaagac

SEQ ID NO: 14058 - DNA, 3000 bp, Unknown
  misc_feature (1)..( 3000): cDNA_ID_2705961_gDNA_ID_2214695_Annot_ID_189511 3000 nt of promoter + ATG
tcataaatctctaaatttcatagtttttagccttaaattaagaaaatcccaaatttcactaatccaaataaccctacccgagatttgcatattttatttctcaagaccataacgttgttaagaatacattaataccctatcgtattaaaaaaactcacgacaatttcggttctttttgtatgttttagcttcttagcataatgtgaatcaagataagtttggtagccatggaatgtatggattgtcactacagttggaatccaaaaaataacctgacttaaagaatgtaaagaagttcgaacatggaagtgggagtctggcaccaacagtttgaggtcagaaacaagacttaggtctattgaatataaaggtacgtgtgttaacttgagattaatgactaatctattggtgaatatgtgtgtgaggaatataaaacacttaaaaattagtgtttatcaaaagagctaaaacagaaaatcgagtagataatttcttgatcatgaatatcttgatcatgagttatctaacaggggatttatttgataggtggctccatttgaattttctagtaagtatacttgtttccatctagataatgtgaagatgtgtgtgactcatgaaattcattctcatggttgttcaatttgttctctaatacaagatcaacaattttgtgaaaagttttatcatgatctcattctgatattaattaaaaatttaagctgctaagaaaaccagattcagtatagaaatttttaaaaagataaaacataaaaccaagacacaaatacacgatctagtgagtttcggttgattctttcaaatcgtccattaatccccaactacaataatagatggttcaacttcataattagaagaacaaaaacatgtgaatatattagcttctatacgaatcttgattatacaagaacatgatcgaaggtacaaagaagcaaagcagtgatcttatctaattacaccgagttgcacttgtgtatgtctttgttattctactcctactacaattatcattttcgatataaataatttcaatgcagcatgaatacacatctgaattttatgtttttaattaacgcctgatttcaacataattcttcttgtatttgttgcccttcactcttttttggaagaagaatatatttatatcgttataccctccctttcttaaaaaaaaaggaccatatctatcaccaaacctctattcaaaaaaacttcttaaaaaaaaaagacacatacatgttccataaacaagagatttgatatgaaaccgaatcttattgtaattgcaattttgccttaaacatacaatgctagtgtttaattctatatatgactggattactcacaaacaaaatctaattatattatgattaagatctttgcgaagatcatcaagttctaaacgaggaaaaataaatcatcaactttgagtatttcaatgaaccacttatcagaaaattgaagtttaaaaccgattgtcatttctaatttattacatccaaaaatctgtttttacattgaaacatagacaacgatcaacttataaacacatactacgacaatatccatgacgttcaaaacatcactaaccagctaaatctatttgcaatactcttcacatttgtatacctttattttatatgagttttaaatattttgttgtataacaacacatttttgtacctcgtccgacatatttacaaatgatttggtacttgacttaacgcaaatgacaagttcacatgtaagatcaagggagatcgtgtatcggccgtctgattcggatccaacggccatcaaggcacgaagaaggtgcagaagacgaatttcacgctggtgctctttgccgaccggcttgagatccggaaagtgtttggaatgaatccacgtggtagcaggtgataggaggtatgtggttaggggttacgtgtccaatatatttgacggcaaatctaaggtttggcccacatgttacatcttgatcaagtgttaatttgtacgtttttcagtttctagtgtaagaaattagctaaaaattttaaagacaaagataataaacattttaaaacatgtaatgatagcaactaagttgcattgttcatttttctaaataacaaaataataattaaagggtaaacgaacgacatgtgtggccgtgatctagaggtgtacatgggcgagagagtgttagtggatcgggtataaactacaaaccattttgttgtgggataggttagaagttagaacttatgtaagttagaacttatataagttataactttacttttaattgggtaatatatatatagttgctctaatcgtagaaaacaatatacactctctatctctgtgtgaacctatggacgctgagggagattgcctctcttccatcaccggcctatcctgtaaccttttccgttcactttctccgattgagcaaatatgtcactggcttatgaatgattcgtgaacatttatgactagtgttattatctatacccaaagttttaaaatccagatatacagtatatgagatgcttaaacttgaaaatattctattgtaccatatttgggaagtactaataaataaatcaaagaatgtaataaaatcaaccaaaaaaagcatataattagcaaaatccccacaaggccataaacacaaacagacataaatctgtactatataaaaatttacacaaacacagacataaaacgaaacagagagagattagaaaaaaagcttcgacgcctctcagccttaagccgaatctcacggtggctactaatacagaaccccccccccaaaaaaaaccataacatgcctaaccactactaaccctctaattccaaaaacaccaacaaacaaacaaaaaaaaaaacaaccttttttttctctctctctcaaaaaaaaaaaatcaatcctttttttcaatttggcgcttttctagagattgattttgtttctcaggcggcgagatg

SEQ ID NO: 14059 - DNA, 3000 bp, Unknown; identical to SEQ ID NO: 14054
  misc_feature (1)..( 3000): cDNA_ID_1397867_gDNA_ID_2214695_Annot_ID_189506 3000 nt of promoter + ATG

SEQ ID NO: 14060 - DNA, 3000 bp, Unknown; identical to SEQ ID NO: 14053
  misc_feature (1)..( 3000): cDNA_ID_2705949_gDNA_ID_2214695_Annot_ID_189505 3000 nt of promoter + ATG

SEQ ID NO: 14061 - DNA, 3000 bp, Unknown
  misc_feature (1)..( 3000): cDNA_ID_2705941_gDNA_ID_2214695_Annot_ID_189501 3000 nt of promoter + ATG
ccgtgagcagctgaaatcctaactctacttgaatggcgcagacaaatttatgaagccttaattgctcactcacttgggccttggatatcataatgggcctttgattcataatcatcatctaaagcacactatttatggttatggttatggacctatggttcaaattcttgccaattttttttactaatgaagtttatttattccgttattcttgatcagcattggtgatcatttaatacactaaataaaggaaatctatatgataatgaaatggcttaagtctattggatgtcaaaaagtttgcacttgataatggcatgatctccacaattcgctttcttgccacttctttgtgtggtacgttatcgctaaatcaattattagatgattggacttcatgtcaagataaatttatgtcaattttcttccagccactctggtgaatggtgattaatgttcaacttttaagaccactgggtctgctctaattggttatccattttaccgacgttcatttttgtcatctttagatctttatggtaacattttctgactcatcaaccattgcatggtgcttcatttgatttacagccatattgttaagcatatgtgtatcctatatatgacccacttctactgtttttagcagtgcataacaatgggagactgtattataactttctatgcgtggagcaaagcacgtgaaatagaaggatgcttagtggaggttagtattttcaatcaagtactttgtctaatttatcttgttgccatgacaaacgtgggaaagtagtcattctagcttctgtaatttgagctctttatttctcgcctttggccaagaaatcaaccagcatgtggtacatgtgctttattatattctgtgagctctttcttaaaaggagaactctaagccaattttttctttcttaaaaagtaacctcactgaagtggaggtcctactttcaggcaaatcaagtttattttggttaaggtggtgaaaaagagaccattcattggagaatgtggttttgatgagtcaatattcaaaattgatttacttttaagatgtccaccatttacattgtcatacttgctaaactgcgccaagtcttgctagaagattctatctctcttttcactatttgtttatgttggtattgcttgttggtgattcagttaatagtggttagcactatgggacaaggtttatctacttacctcagccataggccatagccataaagtcccatttggggttgactcttaggaattacaatcaattgtttaaattctgttggagaaagattgtaattataacaatctaagcattctatcctagtggagtaggtggagttaagattcagggttaaacaaacaaggtaatattgtcttagaataaagttcgttgtgacaagatgcagaacattgagagttttgattcccaataagaaaagtaaattgagtgggtagttttgagttgaattcatgtttttcattttggtctgtcagaaaaaggataagatttaggttagcgggataaaatcttttagtagaagaatgtaatgagggaatttttctttgttgtttttgcctgaaaaggtgaaaagaatacaaaaaccatcctgtaaagtttgttgaaggacaagttcaggataagattttgatttggagattcactttgggtttggatttaatgaaaattagaagtttaaagtaagttttatagaccaagttgttggacaagcaatcgaattgggagctatgttatgtcttgattatgcttacgagttcttttatgttacctatattttcacctatgtgaatacggccgttgtgttgactcatcatcctcaacatgaatgtggaaaaaattaaggaaaattagaaaatgaaaactgcttgaggctgaaaataaggcaatgtgaaaaacactgtacaagatatgactcaacacagtgagcttacgcctatatatagaggaccaagtgttcttcttctctaacacacacacactgacacacacactccttaagatcatctctctcgtgtagtgtattttgtcaataaaagttgaacagatggagcataagaatattggtgcagaagtacttcaagatacgtacgatgatcaacagaaatgggttcttgattcttctcttgatagcagaggacgtgttcctcttcgggctcgaactggcgcttggagagctgcactcttcatcatcggtacatagcccttattgagattgtatatactttataccatagaattataacactgaaagaagtgtactataatatcccaaaatattaaatctttgtgaagtcttttgtttcgtcttctctgcacagcgatcgagttcagcgagagattgagttacttcgggttagctacaaacttggtcgtctacctaacaacaattctaaaccaagatctcaagatggctataagaaatgtgaactactggtcaggtgtcactactttgatgcctcttcttggaggctttatagccgatgcatatctaggccgttatgctactgtcttggttgcaaccaccatttatcttatggtaacatatgttcttacctctgatatatcctaatccaatttatttaaagattccataaacaaccttaaactgtgtcttgatggttaaacagggtttggtccttttaacaatgtcctggttcataccaggcttaaaaccttgtcaccaagaagtgtgcgttgaacctagaaaagcacacgaagtagccttcttcattgccatttacttgatctccatagggactggaggtcataagccttcccttgaaagctttggtgctgaccaattcgacgatgaccatgttgaagaaagaaagatgaaaatgtctttctttaactggtggaacgttagtctatgtgctggtattctaacggccgtgactgctgttgcctatatcgaagaccgggttggttggggcgttgctggcatcatactaactgtagtcatg

SEQ ID NO: 14062 - DNA, 3000 bp, Unknown; identical to SEQ ID NO: 14051
  misc_feature (1)..( 3000): cDNA_ID_3021551_gDNA_ID_2214695_Annot_ID_189500 3000 nt of promoter + ATG

SEQ ID NO: 14063 - DNA, 3000 bp, Unknown
  misc_feature (1)..( 3000): cDNA_ID_2705983_gDNA_ID_2214695_Annot_ID_189519 3000 nt of promoter + ATG
gttctcaacggatagtgacaaaggaaagagaaaatagagagggttgattagtgagattataaaagaaaggtgtgaaattagaataaagagaaaatatgaggggtcaggttttgaaaattccttatcgctagttccgttgtataactttagcagtgagtcggtagtacaacactactactactactgcagacagagtaagcaaaaaagtctaggggctctcgcttgttaaatgactgttacgcccctaggttttacttctactatcactacctatgaagttaaaaaccaaagaccatctttgttttgtttcacgaacttgaagggacaagccatttgtttgtctactcaaattttgagttttcacactcttttttttttttttttttttttttttaatttgtaaggtaacgtatttccaaattagctggaaccaaaactcatcatttaagactatttttgtccttacacatttttattcgagtttaaatgtgaataccgaatgtccaaggtcaaaagtgacaccaatctttgtgttttgatgttcgtacgttttgaaccttctttgatcttgttttctacttttatgcatgttttactatttttccatgattcgagttgacatacctatttatgttaaatccatggactaattagtttgatcatacatatatctattctatagtcgatttatggttaaatgcacgctggctggtctagaataagttcgttaactcttatgttctacggaatttacatgactagtatcatgtatgcatgtatgggtcttgtagagaacatggaagctgagtgcaacaatatccttacttggatgataattgtatgtgttagtttatttatgtgtgattgtattaatataatgaataatcataatattgattcttaaatgacattttaaaatatatttcgattttttttttcaatttacgaggaaaaaacatatgaatagtgtttatactttaagggggaaaatgcaaagtcaggtaatagctcgaggatgtttctgccattacttattcactttataatcacatttcgctttcattttttccttttctgtcattctctttatattttctgtctttccactttcattttattttagctttttcttgttccattgctctttttgttttctctagcttttgccttttgagaacacatcaaataatgcatgttaaataagatgttaattgtactcgtgtaaaaacctcttacataaaaaatgccaactttttatatgttttccatgtacaaaatcccatcatcttatttaactttattatataaaattggacacatgaaaaaccaagagtagaatttagttattcagtgtggaggtaaattcacacacgtgaatagtattatctcatcccaacaaaaaaaaatgaatatccaaataaactcaggatttaaattttaaaatgaaagaaaaaaattaattgggaaaatgaagaagggcgtggaatagcaccgacggcgcacgggggagagtgatgaagattgatgagagtcacgtcggtgagtcacgagttacttaaccagactggtgtaaaccacacatatatcgattttgggcttagcttcggcccattttcttgagatagatgactcatgtcttcatatggtcggatatattaggctaaaagtttcataagaaaatgttattttgttctgtctctttcaattgttcccccgtaggttgttgtatatttaaaataggcactctcttcttttttagatgtcgtagaagtagtttttatattggtgaaagatcatgtttctctcttcttttttagatgttgtaggagttttaatggattttggaatcttttatttatttaggaaggaattcaaaacatgcgagggtaatgtgacctctgccatgttatgaaccactcataggtgcattcccactttgaactttttttttagactcacttttgatgatttgaaaatacgtatagccccaaatgaacatatcttgagaaacacgagcaatttctcataaatgcctaatagtttagccgtttaggcatctcatgatctcactgtaaactattaggatagttacacatacacttaaataatagttacacatacatctaatattttgaaaatcctttatattctatgaattatccacaccaaatgacatcatgtgtgactgtataaatacgactacaaatctatgtaacctataccaattacaaatatgtttttctatgtttaatagctataccgtttgtgtgtgatatatatgattagttacattaagatactttaacacaattctagatttctagtgcaatgcagttatcaaatacttctgattttgaattgacaaagcgacttaaaaacgattgattgtaaaacaacttaccacatggcaagcacactcctaaacgcatcgaacaaatccataaactgcatcatacatacaacaaatccaatggctttgtcattaggatcactaccgtagcaccagttggggcatagtgaaatacaaatgcctttttcttatgtcattgtcttaaacagacatgaccatctctctaatttacgactactttttcctttttgggctttgaatgaatcacgctttcaaataattgggctgcttctttctttcccattttagaccaatttcaaagacaaaaaataaaactagcaattgctaaccgaaactccggtatcccggttaacccgttgtaggtggggctgacgtgggtgcaatcactttgtcatatcaacacatcacgtgtctccacgtaggatgcagcagaaactatttactacattgactaaaatacccttcaccaccaaacaccaccagcacacgaaactttcatacgtttctttcatggcggattcgctctctcgctgaaactctctctctctctcgttactccaaccactcctaattattcacatcattattggcatgaaaagttaatctttcctatataacaattattaatg

SEQ ID NO: 14064 - DNA, 3000 bp, Unknown
  misc_feature (1)..( 3000): cDNA_ID_1807244_gDNA_ID_2214695_Annot_ID_189518 3000 nt of promoter + ATG
gtttttctctttcattatctccgcttattacattcttgatccgcgtatcttgaagaaatcaagattacagaaaaattaatcaagatttcaagatttggtttccttatataaatagctaaatatagcttttcacataattgaatcgttcgtaaattccaaaattgtttttcaaaagtgtaaaacacatgaaagaatatccgataatttaaacaaataaaataaaataatgatatataaattagaaaaagagggagtggttgttgaaaaaaagagtaggtgcgttagtttgagcggcaagcgtggagaaggcttgaccttaatgtgaatgtgaaacttattaccaaaccgtttataatgtggccgtgtgggtcacgttaattgtccttttattgagttttgtctggcttcaaagctaaaaattagttacaatctcctgattttggagacattcaattccaatgcaaaggacagaaccattacataggaatataggatatgatcctaaattttgagtttagatcactgataaaccgaaattcagatttaatctcaaaacaagtaaaaaccagactttcttgctacttaaggtgtggatgatctaaaccaatagagaagttctcaattactagattgatttcttctatatatataggttagggcactttgatgagtaccacttaaaatgtttggctaacactatatatatgcttttggtactatgacacttgtttattttgcagtcctccttcctatggggttacattttttcatccgttatcggaggggcattggtggatcggtatggaggaaaaagagtgttggcttggggtgtggcattgtggtccttagccactctactcactccttgggcagctgcacactcgaccttagccttattgtgtgtccgcgccttttttggcctcgctgaaggcgttgcaatgccctccatgaccaccctactctctcggtaattccttttattctacattttgaaaacgttttacgtttttaaactattgggtttgaaagaaccacaacctaagttagatatatggtttcctcaggtggtttccaatggatgaacgagcgagtgcggttggtatatctatggccgggtttcacatgggaaatgttgtgggacttctgttgacgccactcatgttatcttccataggaatctctggtccatttattctttttgcatccttaggtctattgtgggtatccacttggtcaagcggagttacaaacaaccctcaggacagtcctttcatcactaggtcagaactcaggcttatccaggctggaaaaccagttcaaccgtcaaccatttcgccgaaaccaaacccatctttgcgacttcttttgtcgaaattgcctacttgggcgatcatttttgctaatgtgactaacaactgggtgagtttgagtttaatagtatctttatcagagcaatacctcatcttttgttgccataaactcacacggttttcgttagttgttgttcacagggatactttgttcttctctcatggatgcctgtttacttccagacggtatatagggattattccatgttttcattcagatatatatgaacttcaagaaaatatatgatgttttatatctttgtcttgtttgatcataggtgtttaatgtgaatttgaagcaagcagcttggtttagcgctcttccatgggcgacaatggcgatctcaggttactatgcaggagcagcatcggacttcttgataagaactggtcactctgtaacctcagtacgaaagatcatgcaagtgagtattagaagtgccatacttggttaactaaatagccgacccataacattctaacggaaagtccctgcttttgtttgtcagtctattggatttatgggtcccgggctgtctctgctctgcctcaacttcgcaaagtcgccttcttgtgcagcggttttcatgaccattgcattgagcttgagttcctttagccaagctggatttctcctcaatatgcaagtacgttaactctcacccttatataaccaaccattcattctaaacttgattgatcactaacctaaccattttgggataatcttgaatctcacaacatcttttggtttctctttgcggaaacaggacatcgcaccgcaatatgctggtttcctgcacggtaataatgttatcagatggtggatcttttcttcttcttcttttgcatcgattttgtttcttgctgaaaaagttagggtttgtatatctggtgtgcgagacaggtatttcgaattgtgcgggtacgttggctgcgatcgtaagtacaatagggacgggatattttgtgcagtggctcggctcttttcaggcgttcttgacggttacggcctttctttactttgcaaccaccgtgttttggctcctctttgcaaccggagaacgagtcttctagatccaaaacgctctccttggacactttactgtttagagctttgactagaattaaaattaaaattcattctttcttttatttggaagttagagtagatatttctctggcacgtctgtgataagcactatatatacttccgattaaatcataaaatagaaattagtttttatatacagtattgtcagtatcattcaaaaaaatgatttcagtctagagattgaattagttaataatggtggccaagtggccaaaacctagcttctttagagatttcacttactatttttcttaaaaatgacccaaaagatgaatgagttagagatatataataagtacacatcatacgaccacgagaaatgaatcgtttacatgtgaaaaacgacaattctagtaatattatcatgtgtgaactattccattatttgtgaatttatttacagtaaacaatcagacccaaaaaataaaaaattccaattaaagttctccaattggagttgattctgcccttattagagagatctgatctttccccaattccataacccgaaaaatg

SEQ ID NO: 14065 - DNA, 3000 bp, Unknown
  misc_feature (1)..( 3000): cDNA_ID_3021519_gDNA_ID_2214695_Annot_ID_189517 3000 nt of promoter + ATG
aacttacgtttggtcaaagaggagaatcgagcaaggtacgaatttatcgaccggacgaaggagtttggagatcggagcgaagacgaaacatcaagcaagccacgatcctattttcttcaaattaattacctttttcagaaaatatacttttttattctttttgataaataccatattttatggattttacattaatttggaacaattattttaatgatacatgtataattatttttttttaaactatgggttatttttttcaaaaaaataatgtgtggatgtttcaaaaaaaatcaaatttcataatgaaacaaacaaaaattcgaagaagataatacacattgtgttgagaacaaacaattattacacattgtcggattaaccatataaataccgaactttgccttttgatttggccaaaaccttaaagttaaggtaaaaccttcatagctgtccaacaatgttaataaatccatcttagagtttaaggtcattgacagaactttcagtaactttgtctcccaaagcactccttatgtgatacacatacactaatgggtaaaaaatttcaatttctctgaccatatcaataaatgtcaacggcagaggcaaaaaaaaaaaatttggtcaacgaagcaaatcatagtggtttctaccactgtaaagaagcctaacaacattcttgtttgtcttcccctttccccagcctcctcgaaattcacttccatactcttgaatcggtataaaacccggcccataccctcctcctcttccatgctagataaacaataccaaataactcaagttctgaatacagttactagaacaaaagaaacacctagtcttgcttacataagactcaaattcaaagggcgtttacctcgtgctcaggtatgtagacgatgataggctgtttacatagcttggagagaacctgttgaagcaaaacactgacattagatcatttctctatgatggcagttttaaatgcaggaaactcactagcagctcggactctcctccccagaaatcgtgtcttccaatccgctggcaaaagctgaagaaaaatgcttaacgtgataaggaaaaacaatgccatttagctgaaaagtggtaatgagtgtgaatgaattcttatgagttatgactcaccgtttcagagactcatccacagtgatagccactaaagcttctttgtacttctccctttccttggggtcattgcatataacctctttcacagccattcgtaactcatctgtgaaacaaaggcaagttttgccacacaaaaacatgatgaacaagagataaacattcaaatgtatagaccagagaaaccacaaaacatttttccaccaaaaaggctaacagaatgaaacaaaatccagttttgattccccaatctcagcaagcttaacacagttcaatctcttagatttcaaaaacacacaacaaaaatcaaaacaaggctatatgatcaaatatatagttacctgcatcatctctctctcgttgggggttaagagtaatacccttattaaaggccattcctttcacctaatttacattgaaaaatcacatcttttattcaggaaaccccaacaagaacacataaaaataacagaaactacattaccaatgctcgaaacagacatctcccatcccctttaactctatccacagcatacttctcaacctttttcgctgcaggagaccgattcctagagatgaatataagaatcaattcgcagattagcgtaaagggttttatcagagactcgattgttgaattcaataaacgagaaaacacacatcgaggaattgattctggcgaagaacacataactatttcccttcgttgtgcttatgaatgaagcagggagtgaagtggaagatattgaatctgacacagaagcagtaggagaagaaacaagctcgaatctagcgaagccatttctcagctgctctagaatgttatctgcgatattaatgaatgatagtgttagaaattaaacgagaacaaagcaataagggtgcagagcaatgaagtacttactgttggaagaagatttgagctccattgcaggggacggagataagggaggaattcgaattttgacttgaagaagcaaggaagaagactcagaaatgtagccatgaatgtgtaataagttaaatagttaaataactctacgataacacaaatccgttgtagtctagctggttaggatactcggctctcacccgagagacccgggttcgagtcccggcaacggagtttttttaatagtttttctttttttttgtcggccgtccgattaatccattaaacgacaccgtcacatataacctaaccccaccaaatccaccggaacatatccaaataagtgataggtgttaatctcacacgtaggaggagtcacgtgggcacgtgcgagagagcaaaggtctaaactttatggtttaacgaccaaccggaaagttctggcaattggcaaggaaggattcgaagctggttgtttcccaatctgcataagaaatatcgaaacacttccacacaaaatccacgcgctctctcacgctcactcactcgcataacacttgttccttcttctctcaatttcaaaaaacgacgatctcttcgatgctttctcttccttcctccttcatttccttctgactctgctcttcttcttcgtcttggatcttcgaatttgtctttgtgatttgaggtaaagtttaattctttgagctgggttttgttttgttgttgatgggtttcagagatttgcttgttttatttctgagacacgaaatgggcagtggaacaaatctgaccaatttgtgttcttcttcaattttatttaatctctcgtggattcagtgatcgacgattgcttttgatctaatttgtgttggttttggtttctgtcagtgttatagaataaagatctgtttggagtggatccattcaagtaattgaagaactcaacgcaaaaa

SEQ ID NO: 14066 - DNA, 3000 bp, Unknown
  misc_feature (1)..( 3000): cDNA_ID_2991191_gDNA_ID_2214695_Annot_ID_189516 3000 nt of promoter + ATG
cttggctctattggttcgccctctatgaacactccaatctttcggtacttagccatcctgtgtttcaggagctcctccccactcatttttccgaattcctacaagttcccaaaaaaaagttagaactcttttagatccacatccagcgttgagaagaacaactatgcctacattcatgttttcattgatagcaatctttatttgctgcgacgtccatgaaggatcggcatgggcccctccaagcggttcctgtacaacatgtgagagttactcagtgatccaaagtgagaaaagaagtgtaagaggaaacagatagattagaggtaggatcagttacaggaatgattccatcagctacattaagcttgaccagctccttggaggtaattctaagcttttcagcagcctgcgtacacgagtttcattcaagtgtaatattagagtctacatgatcacttttaatcgagtagtagagcagtgtacatacctcaggagcagccttagaagtcttccacaagatcgctgcacatgcctctggactgtgaaaggcaaaacaacagacgtgataaatcaatctgtaaaaacatcatctcatcatacctactacattgggaaaaagtttacctggcaacatagaaaactgcgttttcgagcatcagcattttattcgcacagccaatggctagggcaccaccagaaccaccttccccaatgacaatagaaagaattggcactttcaggccgaacatcgtcctcagattgttggcaatcgcttcaccctgttatacagataagaaaaaaaatgttatgatgcagataaaccagtagtacatttcaaacataaaagacatttcttctacctgtccaagttcctcggatttaagatctgcataggctccaggagtgtcgataaatgtcacgattggaaaaccgtgatggtctgcataatacatcatccgaagtgctttcctatatctgttgtagacattacagaaatttgataagagagttgttgactctgaatgtttctatttaactacaaacaggaagctcctcgtgaaaacatacccgtgaggagtaggcataccaaagttccgcattatattttctttggtgtttctacctttctggtgacctatgaacatgtaacgttttccatctatggttccaatacccgtcacaattgcagggtcatcataccccgctcggtctccatgaagctccataaactgaaacaagagcagagagtcccaagaatgtaaaaaaacaagaatttatcgtcaatgcatgacaaaaaagccttactactgagagaccaaaccttgtcagttatgttatgtatatgatcaaggaaagtaggtcggttgggatggcgcgcaatgttcacacgttgtatcggagtaagatgcgtgtaaagatctttcagtgcctgacattaaaatggcgggggtcagtaagaagtctttcccaaacaaaattgtagctatacattaacatcaaatttgaatggtgggtctccctcaactatataaattgaaaaccaacctatactagcatttttacctgtctatacttgttctccaaagtgataatctgctcagtgaaatccaaccccgtttcattcgccatcttcctcacctgcatcacaagaaccaatgttatgagaaacttcacaccatacaactgctaggggaaatcaaactaagatgcaaacagatgataagtattcacattcgtacatcaacaatcttcttctccaattcgactagtggcttctcgaaatccaaagtgacaggcttttgagtatcccccaatggtttgaactcggccaggtaagacaagactcctcctttcacattcgggtcaggatttgcaggccatggatgctcaaatttcttccctttcttgagccgagatgtcaccgccaagtccttcctcctgatggtagtaaacactgctcttcctaaggttttcaatggtaccccattaacaccattgctcgaactacgcaagtaatctgaagcagaagcagaagaagctcctcctaaagctagtgatgaatgcgatattgaagccattttttgcgttgagttcttcaattacttgaatggatccactccaaacagatctttattctataacactgacagaaaccaaaaccaacacaaattagatcaaaagcaatcgtcgatcactgaatccacgagagattaaataaaattgaagaagaacacaaattggtcagatttgttccactgcccatttcgtgtctcagaaataaaacaagcaaatctctgaaacccatcaacaacaaaacaaaacccagctcaaagaattaaactttacctcaaatcacaaagacaaattcgaagatccaagacgaagaagaagagcagagtcagaaggaaatgaaggaggaaggaagagaaagcatcgaagagatcgtcgttttttgaaattgagagaagaaggaacaagtgttatgcgagtgagtgagcgtgagagagcgcgtggattttgtgtggaagtgtttcgatatttcttatgcagattgggaaacaaccagcttcgaatccttccttgccaattgccagaactttccggttggtcgttaaaccataaagtttagacctttgctctctcgcacgtgcccacgtgactcctcctacgtgtgagattaacacctatcacttatttggatatgttccggtggatttggtggggttaggttatatgtgacggtgtcgtttaatggattaatcggacggccgacaaaaaaaaagaaaaactattaaaaaaactccgttgccgggactcgaacccgggtctctcgggtgagagccgagtatcctaaccagctagactacaacggatttgtgttatcgtagagttatttaactatttaacttattacacattcatggctacatttctgagtcttcttccttgcttcttcaagtcaaaattcgaattcctcccttatctccgtcccctgcaatg

SEQ ID NO: 14067 - DNA, 3000 bp, Unknown
  misc_feature (1)..( 3000): cDNA_ID_3021523_gDNA_ID_2214695_Annot_ID_189515 3000 nt of promoter + ATG
gagagcgcgtggattttgtgtggaagtgtttcgatatttcttatgcagattgggaaacaaccagcttcgaatccttccttgccaattgccagaactttccggttggtcgttaaaccataaagtttagacctttgctctctcgcacgtgcccacgtgactcctcctacgtgtgagattaacacctatcacttatttggatatgttccggtggatttggtggggttaggttatatgtgacggtgtcgtttaatggattaatcggacggccgacaaaaaaaaagaaaaactattaaaaaaactccgttgccgggactcgaacccgggtctctcgggtgagagccgagtatcctaaccagctagactacaacggatttgtgttatcgtagagttatttaactatttaacttattacacattcatggctacatttctgagtcttcttccttgcttcttcaagtcaaaattcgaattcctcccttatctccgtcccctgcaatggagctcaaatcttcttccaacagtaagtacttcattgctctgcacccttattgctttgttctcgtttaatttctaacactatcattcattaatatcgcagataacattctagagcagctgagaaatggcttcgctagattcgagcttgtttcttctcctactgcttctgtgtcagattcaatatcttccacttcactccctgcttcattcataagcacaacgaagggaaatagttatgtgttcttcgccagaatcaattcctcgatgtgtgttttctcgtttattgaattcaacaatcgagtctctgataaaaccctttacgctaatctgcgaattgattcttatattcatctctaggaatcggtctcctgcagcgaaaaaggttgagaagtatgctgtggatagagttaaaggggatgggagatgtctgtttcgagcattggtaatgtagtttctgttatttttatgtgttcttgttggggtttcctgaataaaagatgtgatttttcaatgtaaattaggtgaaaggaatggcctttaataagggtattactcttaacccccaacgagagagagatgatgcaggtaactatatatttgatcatatagccttgttttgatttttgttgtgtgtttttgaaatctaagagattgaactgtgttaagcttgctgagattggggaatcaaaactggattttgtttcattctgttagcctttttggtggaaaaatgttttgtggtttctctggtctatacatttgaatgtttatctcttgttcatcatgtttttgtgtggcaaaacttgcctttgtttcacagatgagttacgaatggctgtgaaagaggttatatgcaatgaccccaaggaaagggagaagtacaaagaagctttagtggctatcactgtggatgagtctctgaaacggtgagtcataactcataagaattcattcacactcattaccacttttcagctaaatggcattgtttttccttatcacgttaagcatttttcttcagcttttgccagcggattggaagacacgatttctggggaggagagtccgagctgctagtgagtttcctgcatttaaaactgccatcatagagaaatgatctaatgtcagtgttttgcttcaacaggttctctccaagctatgtaaacagcctatcatcgtctacatacctgagcacgaggtaaacgccctttgaatttgagtcttatgtaagcaagactaggtgtttcttttgttctagtaactgtattcagaacttgagttatttggtattgtttatctagcatggaagaggaggagggtatgggccgggttttataccgattcaagagtatggaagtgaatttcgaggaggctggggaaaggggaagacaaacaagaatgttgttaggcttctttacagtggtagaaaccactatgatttgcttcgttgaccaaattttttttttttgcctctgccgttgacatttattgatatggtcagagaaattgaaattttttacccattagtgtatgtgtatcacataaggagtgctttgggagacaaagttactgaaagttctgtcaatgaccttaaactctaagatggatttattaacattgttggacagctatgaaggttttaccttaactttaaggttttggccaaatcaaaaggcaaagttcggtatttatatggttaatccgacaatgtgtaataattgtttgttctcaacacaatgtgtattatcttcttcgaatttttgtttgtttcattatgaaatttgattttttttgaaacatccacacattatttttttgaaaaaaataacccatagtttaaaaaaaaataattatacatgtatcattaaaataattgttccaaattaatgtaaaatccataaaatatggtatttatcaaaaagaataaaaaagtatattttctgaaaaaggtaattaatttgaagaaaataggatcgtggcttgcttgatgtttcgtcttcgctccgatctccaaactccttcgtccggtcgataaattcgtaccttgctcgattctcctctttgaccaaacgtaagttttcttattgatcgatgtttatcaaatattactcctttaacgacgttctcaaaatcgattaaagtaatgagattgatgaactttgattgctccagtttcattgtagagcctttacctagattagtcttcatataaattgtgtagttatagattgggaattgaaaaaattcagcttagtttcgagtttgatcgcagctaacgtaatttctagggtcaaatttgcgatttttagatgattttttaagtgtgattttgtgtccatcagcttaaaagagttctcttttagcaattcattgctactttctagccatggatgatgttttgggggcttattactcctttagatatgtgtttctttgttttcataaccaaatcaatgatcctggctcttttgattattctgcaggtcctgacgaaataagatg

SEQ ID NO: 14068 - DNA, 3000 bp, Unknown
  misc_feature (1)..( 3000): cDNA_ID_2705957_gDNA_ID_2214695_Annot_ID_136800 3000 nt of promoter + ATG
cttgattgttttctatcctctccagtttccacagagaaatcatggggttctggacactaatggaaggattgctactatttgcaaacgcactggctatcttaaacgaagaccgttttctagctcccaaaggatggacgctcgcagaactccaccaaacgggcaaaagaaactctctcaaaggccaaatcattggtctcatccacgcctgtcattacatgaggcttcctctcatgctctttaacttaattgtcattgtctttaagcttttctctggttaaaatgatcaaaccccgtttttgaataaactcaatccaaacatttctgcaacttctttagcaattcattttatagtatttaacttcaaaagctcagatttgtatacattattgttatgcttcttacaactacaaacacagtgaaacaaaataaaaacaagttctttgaaaccaaaagcaggaaactttgaatcaaattcattcaacaggaatcatgacctcattggtcctaaacggtggtaacgtccatggaggattatacctagcaagaacgaaatctccggtgatcttaaacccatctttctcaagatgactactcagcttcttcaccttctcactcaccacactctccgacgctataccactaaacttaatcacaccatacttcctccctccttcctccttaatcacaaccctctcatccgttggacgtggtgcctcctccgccttcttatacatcgacggcaacaaaaactgcatcgtcaccaacttcttccttccttctccaccaccttccttagttacaaccggagaagtcatctcaatcttctcactctccttagtaatcaccggagcagtcatcgcaatcttctcaccttccttagtgatcaccggtgcagtcatagcaattttctccggtttctcattctccggtttgccaaacacacctatgtacttagccaaaagctgaaagcctccgtctttatcacctttgaactccgacgcatcgtatgtaacctccgccgcaaccgctggtggatattcacggatctcataaccgtcaccggatttagtcaccgtgtatttaggagtctctacagcgattttaccaaaaaccattcccattatgtaagttttaccaaaaactattctcataggagaagtagtatttatcagtttggttctttcggttactaaacgcaaacgtgtggttagcatttgacaacgtatgtgtataaaaatatttcaatttatttatagaagaagatatgataaactcaaatcgaatttttggctttttttgtttgaaaaatcagagacgcgtcatggttaattatttgctttatgactaaatttacagaagcagtttgacacgtttctggtttttgtggttcagagcattctttcgttacgtggaggttcaggttacacgacaaagatgagagactattctcggtggtctaaaaaacgactttgttttagacaaaacggtgcgtagttgtttttagaaaacggcaggtagtttgcgtctcaaaggatatatctgttaccaaacagaagagtagggttttgtcttcggcggcttatataaataattttctcgagccattgaatcttagaatctgttcgtcgatttgtctgattaagctagggttttgatagattttcttattcgatcttgttttcttttggtttatgttttgataagagagcatcggtgatgaatccatgaaaaaattgttatccttgcactttgattgctagtgaagaaacaaatggggttttcgatgtctgagatgctcattactttttttgtcttctttgctcgattttgcttcgtgttagactgttaggattggatcgatgattgattagttaaaatactgcgttatctttctgcaaatctcctataaggatttgaagacaaatcatgaaaaacctgagatccaatgtttttcaatcaattatccaatgtttttcaatcagttgttttaaatctggattggttgatggatagaatcagatcgatgatgtcatattaaactgcgttatctatcttaaaatctccgaaataggagttgcagacactaaacagaaaacgctgagatctgatattagcctaatttcaattgatagtgtttatgacaatggcttgttgttttgttcttaatgttagtttttggattcttaattaacgagtagtgtccgaaaaaaaataaaaaaaaataaaaaaaattaacgagtagtgttatactgaacatattcataagagtaatgcattaatatgattggcgtgttcgaaagaagaaaaaaaactgcaacagagctcggctgatgcaaattgtgaacttgtatatgattgaaccaaacctgactcaaattaagccctttagttaggcttttgattgccacaagcacacaaggcacaaaagcgcaagccaaaaaaaacaaaagaaagccttgttgaagaaaacaaaaatcaaaaattttgcaaggaatgatcgaacccatgaactggttttcttactctcagcaccttaaccagtagaactaactgcagtttcagaaactgtagtgtaagaatgatttatcaaaccagacagtacaaagtagttaaacccaaattacataaatttctaccaaagttatcaagataaaaaaaaaccatagtttaaattgaaccgaaattttgactaaagttatccagataaagaaaccaacgaaccagccgaaaccagacggtccaaaatagctaatcgcaaaaatcttaaaatcgaacggttccataacaatatatggttttccaattttgtcccttacaaaaaatttggcatcacccgccacaagaaatctcccgggaaaatcgaaataaaccgttccaattccaaagcttctaaaatctcccgctagtcctttaccttcttcttcttcttcttctaatcaacttctctctccctctcctccgcttcttcacattccgatcattagtgttttcggagaaatg

SEQ ID NO: 14069 - DNA, 3000 bp, Unknown; identical to SEQ ID NO: 14058
  misc_feature (1)..( 3000): cDNA_ID_2705961_gDNA_ID_2214695_Annot_ID_136802 3000 nt of promoter + ATG

SEQ ID NO: 14070 - DNA, 3000 bp, Unknown; identical to SEQ ID NO: 14057
  misc_feature (1)..( 3000): cDNA_ID_2705965_gDNA_ID_2214695_Annot_ID_136803 3000 nt of promoter + ATG

SEQ ID NO: 14071 - DNA, 3000 bp, Unknown; identical to SEQ ID NO: 14056
  misc_feature (1)..( 3000): cDNA_ID_2705969_gDNA_ID_2214695_Annot_ID_136804 3000 nt of promoter + ATG

SEQ ID NO: 14072 - DNA, 3000 bp, Unknown; identical to SEQ ID NO: 14055
  misc_feature (1)..( 3000): cDNA_ID_2705971_gDNA_ID_2214695_Annot_ID_136805 3000 nt of promoter + ATG

SEQ ID NO: 14073 - DNA, 3000 bp, Unknown; identical to SEQ ID NO: 14067
  misc_feature (1)..( 3000): cDNA_ID_2705975_gDNA_ID_2214695_Annot_ID_136806 3000 nt of promoter + ATG

SEQ ID NO: 14074 - DNA, 3000 bp, Unknown; identical to SEQ ID NO: 14065
  misc_feature (1)..( 3000): cDNA_ID_2705979_gDNA_ID_2214695_Annot_ID_136807 3000 nt of promoter + ATG

SEQ ID NO: 14075 - DNA, 3000 bp, Unknown; identical to SEQ ID NO: 14064
  misc_feature (1)..( 3000): cDNA_ID_1807244_gDNA_ID_2214695_Annot_ID_136808 3000 nt of promoter + ATG

SEQ ID NO: 14076 - DNA, 3000 bp, Unknown
  misc_feature (1)..( 3000): cDNA_ID_3021559_gDNA_ID_2214695_Annot_ID_189496 3000 nt of promoter + ATG
gatgttctagtatggctctaaaacattcatccaaactacatcattggtattatgttattgccatggtatattcagatggatgataataattgtcacatatatagcgttattgtgaaataggataccaaaccaacttcatacaagaactacaaattatatacataaataatcaacaaataatatatagactactaaaattcaaaatgcttcagaaaactaagaattttcacataaaataaattctaggaattttccaaacgagaaccattctaaaagatgtgaaacaccgaagctcagcaacctcctccgcctccgcctcctcctcctcctcctccgcctccacctccatccccaccgccaccaccaccaccaccaaaacctccaccacctccatcaccgccaaagccacccccatttgctccatcacctatttccacatcttcacctccgccatcctctcctcctccaccatcacctccttctccgcctcctcctcctcctccgccgtcaccaccacccccacctttgcccccggctccagtcaaggccgcaagaaatatcaaaacaccaacaaaagaagcaatagcaatgataattactatccaagtatccatcttatgcaaaatcgttacgtttagctaccttcgattgtgtatatatagtttgttgccgagggttggctgcagacaaataacgtgtgtcaagcttgtattgacttaagacttttattattcatatgtttctatattcaaacttcaaaggttttcattacgggccggtaaaacttcatctattaattaaaatgtttctatattcaaagttttcattacggccggataatacattccgtatgatgcttgctttctttgataatgccaactatgacaaatcttatactaataaatatagatagctatatctttgtcgttgataaaataaaaaaaaagctatatcaatgtttgtctaagaatatatcgattgactcggtcagttgaagttgaattccaattggtttaaccgttcaatctatgtgacatatttcacacggtcttgaccagaatcaaacatgagaaagaagtgcatgcacatatgatcatatcagttttggataatttagccttgttttgaagactttgataattatgtggaagtatttatagtctggtatatatataattatgaaatgtctacaaatttattggatatatacgccacagtgacatgtttgaaaattcagtatatatgttgtcttcattgtttagaaaatcggacagtgaaatcttttttttttttttttttggtttatgtgaattactttgacgaaagttcaacagattatatgaacagtgaaatatttttggtttaagctgaaattttgcaagtgttatgattcgtatatttatggcttgcatgccaaacacataattcgaggaaccttaatatttaaactaacatcaataatcatttgacaaggacgatcagacaagtcacatttttaactcgacgaggtatccgaataagcccaatcgaattcttttccaacccgaatacccggtgatgtaatatactctaataattatacttttctgttcataaaaattgaatattctagtttttgttgtttgttctacaaaacttgattttctagcgttttcattttatttttattgatatataataataaatcttaaacttgtaatgactgaaaatattaatcattaacttatttttggttaaagtaggtcaagacgcaagtggtttctaatgcaggtggacttccattgatgattctagcattgaatgcagcgttgcgtatccagactagcgtttggctcatgtttgttacttagtatttccttatgttttgcttgcgctttgctttttagttaagtttgcttgtgttagaaaaccaaaatcaaactcttgtgttagcttagattaaatgaaattgtgtattcttgatgatcctaagtactagattgataaaaatattagtctgttattagttagaatttaacttactaaaacgcttgtaaaacgcaagatcacccatcatcgatgatgacaagcgttatcattaccgatgatgtagacactattcagaccatccgccaaatcaatgcagaggtcttcatcctcgggatcactgccggaaatgaccacaagttagcgtgtctagccgccggagcgacacagtgcgtcacaaacttcatagatgtcaaaaagattaaggatatcctcgaaagtctccccgacgtcccggtcccagccccccaccgtttaaatccacatcatcaacctcgatacattcattagtatatatatatatatataaacagaagttaattatatgattattttaacattatgttacattcattatatatacattattaaaataacacaaaaaaaaacgttaaaaatttgtcttaacaaaaattcattacatgctattaattttcatagatagtggatacatacgctatagtgacactgacatcttaaacaaaaatcaaatgtattaatttgtcttaactgtgttaagaaaattggacattgaaatattattcggtttgagttgaaattggcatttgacggatccgtggtttgcatggtgtaccaagcaagaatcgttggttaaaagaaaagaacacacattaattatcatgtttatgcgtaattgatatgtaagttaagtagattatatgcttctcaaaactaggtatttagacaatgagattagttagtcttaattattaaattaatatcccgatcttatcatataagccaaattatacgaagattcttaagaataatcattttaatttcactaacctctctctatctctctcttcattatccgaattaagccaatcgaatccttttcaacccgacgggtcgtgaaattccccaaaagattcctctttctcagctcaatttccaaaagctccgacctttacgatcctctagattctcggcgccggtttctcggagtaaata

SEQ ID NO: 14077 - DNA, 3000 bp, Unknown; identical to SEQ ID NO: 14063
  misc_feature (1)..( 3000): cDNA_ID_2705983_gDNA_ID_2214695_Annot_ID_136809 3000 nt of promoter + ATG

SEQ ID NO: 14078 - DNA, 3000 bp, Unknown
  misc_feature (1)..( 3000): cDNA_ID_2710890_gDNA_ID_2214696_Annot_ID_136813 3000 nt of promoter + ATG
ctccatccacttcaacatctgtatatacacaatattggcaaaaccaaaatctgaaacttccataaaaaggttaaactctcagtttaattaagcgagaatttccaaacctctagagcgagatcgtaacgattagaacaaatgagacgcttggagatcaatcagagctccaataacgagatgtcgtgaccaagttgatccgtttctgaagcagagaggtaacgttgcctcgtggacagttctttctaaattgtagcgcctcggtttcgaaaatatggtaatgcatgtagagaggtttaaaagaatttagtgttttgttaaagctaaatttggatgcttgctaagttaaatttcttattcatttggctttggattcattttggcctattgggaagttgaacacacatattttcatcaattgggtaatatatatatcccttttcaaaattttaaatcacaatatatgcaaaacaaaaaaaattatgattatttttttaatttgagatattatgtgatgtttcaaaacatttaaaaaatgtttaataataggagaattgtaattttaaatcttaagcaaatcttctaaatatttatatttttatatatggtataaccgcttcacaatttataattttgtatatatcttacccgatccaaagaaaaatatggatatccgatgtgagattttgaagtacattcgatattaagtcgggtaccaaatttgttgtatcacaatttaacccatccaatgacaaatgtacttcgaaaatactataattaactataaagattatgtctctctcttatttctctcgaattctttagagagagaaccaccccttgattccgattgaattcctttagagagagaaaggtcccttgattccgtcttgatctgaaagtgaattcgtcctttggcctattttcttctgcttttactccaaaatgcctccttatatccattcttgtcccaatccatagcatacctgaaaagactcaaaaacatatacctaaaacatagctaaaaacagtgaaaatagggttatatcaactcccctaaacttagtttattctttgccttcaagcaaaacacaaaagccgaactcgtggaagaagaacaaaggaactcccaacattctctagtctattgccatgatcattctaactaaatccatttgcctagcaagtctaatcaaatcctaaccaacatgtaattcttcgtaagcttacacaacattctagattccacacctaagttccacaactatatccaccaggctttcattcttgggtctcatcaagcaatctaatattcaagaactttctagactcattcttgtactataccatgataactcgactattctctttctttctttttttaattatttttatcctccaaacttgttcttttcagagataggataaaggagtactcgcttcatcggatagatatcctccgtatatttttcaacatttgcaattgatcattccttagaatgtaagataaaaggatcaaaggaaaaattcctaaccctttacactacaagaaatcatctcaatcacactttttttttatattacataggggaagataacttattctatatcatctcatatattaccaggtataaagaaggagtaaagttctatgaatactaaccgttttgatgaggtaaaaggaagaggaatgagattagctccaaccttaatggattgtgttggaaaccaagatatcctcaagtctctcggtttgccatatggattatccaatagttggattgagtcgaactttcagcaataatcaaccaggcaataatctaaagaaatacatatcataattcctaactagactatacaaaaacgttttttttttctttttgttttcttacctttttgttagaaaaaaagaaaagggaaattagcaaaactaaccaacaaaaactttatatttgaaaaactaacacctcaaactatatgtgatgtaatttatataataattccaaacataacatgtgcgtggtttacacgctctctttcttcttcattctgcttctttcatctcgaacttatattgttgccgctgtgaaaattcaaattgagggtgaattgcagagaatttacaatacccaaaataaagcgtggatacataaaacgagcaacttgggaaagtttcgaagagtgatatagatcgacaccgttagagtggcgatgcaagggtatccggtttttcgatttgggggtttcgcataacggcgacagggctggtgacggtgaagtcgagtaagcaacttccgggtgtgcaatttgtggcggggactatataatcgtcgaatttgagttgcgactagggtttgtgcattttgcatttgggggtttctaattagttagagattaactctgtttgggttgatagaagtgagaacagttggttctatttgtgacggcacctatacgaacatcgaatttcaggaaacattggtggattcgaagtgctccatcgacaaacgtgattgtcttatcaaagtttagaaagtcggaggtatgagttgaaatatttagtctttgtcacaaatcattgatgaactgtattcaataatttcctaattgatttgtgtgtttaattatgtggttttttcgctttagcatttgctgtcatttgttgttaaggtcggattgtagtgttaagttaagcgtgtatgtaatcctgaaactaatggaaagatggctacatattgcatgtgtggtttaaccacctatatggtgagttattgaacatttagtgccagtttagattacatgatttgtatacatctgttttgggtatctcgtaagcgaaaagaagtgataatggtacctttgaatttcagggtatctgttaaatgggggatgatgagttgacaaagcgtttctttcggctttgttctgaacccgaaggtcgaaagaggataaacaattactttacacttaggtggattgagattataaaggctgcactagatg

SEQ ID NO: 14079 - DNA, 3000 bp, Unknown
  misc_feature (1)..( 3000): cDNA_ID_2710886_gDNA_ID_2214696_Annot_ID_136816 3000 nt of promoter + ATG
gatactgagcagagactaatcggtcgcagatccgtcattctatctggatttggcttcttaggcaataagcatatttgagtaaagttccattcaacaggaaaggatcgtgaaacaaataacttcttaacttcctcacaaacctgctgtccaactacattccaataggattaaaaaaataatcccgtcatcccatctgctccaggtgcactgctactcctaatagagaacactgcttgtttaatttcttcgttagtgacctctttagtcaaagcaatattcatggtaggtgtaacccgaggtgccataccatcaagtaaatccgcagcattgcaaggttgtgatgaggtaaagagccgttgaaaataatttactacaatatcacctttagatccatctgcaaattgctccacgctattgtcatcgattaatgaaaaaactttattttgcgctcttcttccttgaacacttccatggaagtacttagtattcttgtcaccatcatgcagccaattttcctgagttttttgcttctaataaccttcttcctctctataagctacaaccaactctcctctccatttatgtaagagaaagtaattaggaaattgtttgctgccttctgtttctaaaaactctctcagcttcttgatctctgtcttagaatttgattgtgaggctcttttccatctggataatgatcttcggcacgctgcgagtctgtcaaataagcttgtgtgctcatccataccgtcactattccatccttgtctaacaatatccacggtttcaggtttagaggtccaccttttgtcaaacataaatcgaccaataaatgattggttttcattgacaaaccgagttatcaacggcctatggtctgaaccaattctctccaagtattcagactgcacacgcgggaaaatatgaaaccattcagcattcccaagagctttatccaatcggatttggatccacatgtcattgcgtttacccgcccacgagaatttattaccagaaaaaggtatgtcacggagacgacaatcttgtaccatgttgcgaaatggaataaaggaagattcttcacgaccaggcccaccaaacttttcagagttatcccatatctcattcaggtcgcctacaacaaaccatggatcattccttgctaaaccaatagttgttaaattgtcccatacatcttgtcttaaatgccaagctggatctccataaacaaatgaagcaaaaaaccataaggacccaagcttaacttttgtatcaatgattctcttgtccgagcggagcacttcaacttcatatgatgctttccaaaacaatgcccttcaggatccacgatatgaacattatcgtagcctaaccattgcttaactttcagtatgtaatcactggagttcttcgtctccatgaggaacagaatatccggaaaatgagtacgtctcatttcctttaaacttatgttagagaaaaattatttgatttttggcttgaaagttataaaactaataatttattctttaattcctgggaaattattttgctgagaaattctattgttatggtaactatatgaatatactgataaatgatacattattagaaaaataattaattataaaagggcattgcaaaaatgttaagagattttttttattataaaactatatttagacaaagtgaatataaaaatagtgtattaaatttgagaggaatgacacatgtgcaatgaatagagcgccatttgttagcttcttagagcatctccaagagatactctatcccctcaaatataaagttttaggttctccaagagatactccattacttcataatttagagtattgaatagtgacactctatatttggagtatcactattcaatactctaaatttgaagtttcaccttttttatttgcatttaagtccctaaaattcaatatttcatatacaaattactatgtttatcattttagtccttaaatttttatatattcaaagtatttcgacaatttttggcttgtaatctacagattataaataaaatgattcatctatgtcttcgtaatgcattgattgatcatatatgagagcattacggaaaaaaatttgttgagtaatttgtaatttataagttaatttatgtatttttaatttttatttatatgtattttatttataaatttattgttttgttaattaagattatgtgtaatattttaatgtatgttttagagttatttataaaagttatatggttttaaaattattatgaacaatataaggactataatgcaaaacacacattttagaaactttatatttgaagtataccgtgggagaagaaactactcatactttatatttgaagtttacatactctatatataaagtatctcttggagatgctcttagaatatcacttcgaggagatcttactttattatatagataaagatacatacttcttgttgcatcatcttttcttaactatttatagatgaccaataaaatttgtaaaactttttcattcggtaagttcggattatttgatattattatcaaaagatttaaatacatacttcttgttggatcataacgaatgccggttttctatttgtagaaataaacctaaatctattttctccctattttaaattgaaaaaaacaacaacataaattatggaaagcaaaagaaaaggcataaaaacagttcaaaacacacacatatgcattgtcaaaacacctcagtttaaggtctgccacaaactacaaaaccgcatgcaagccacttgtgtaaagtgtatatataccacttctttgtcttcacaccacatcacaaaactaaagaaataatcacagttatttttaccttttactcttcttgttctttaagacaattcaaaagagaataaggagagttttaattttctgtctaaagaagccgagcttcgtgaaaattgttgtttctcatcattgtgattcatcatg

SEQ ID NO: 14080 - DNA, 3000 bp, Unknown; identical to SEQ ID NO: 14079
  misc_feature (1)..( 3000): cDNA_ID_2710886_gDNA_ID_2214696_Annot_ID_189539 3000 nt of promoter + ATG

SEQ ID NO: 14081 - DNA, 3000 bp, Unknown
  misc_feature (1)..( 3000): cDNA_ID_3021584_gDNA_ID_2214696_Annot_ID_189543 3000 nt of promoter + ATG
gtgagatattaatttaaacaccacatctacgaccgacacaactttccgaacatcctcctcgtcctcatcagattcaccagctactttcttcatcttcttcttcttcttcctcgtcttcttttgtgcatatcctccaccagattaaacaccctcattgtgatagattttctacttctttgcgggagattcagacttagcggctgctttatcttttacgtttttcttcttcttctcattcctcttcacatccctatagcctttaacattccccatgtatgtcttcaatcaagtgatcaagtgatgggtcttctacttcatctagccacatatgaaatagctcgcttacatcatccgtcataaccattttacgcacacgcatatataacataagagattataaaacccatcagtatgtttacagtcagtcatcaataagtataacgcagacattgctcaactatgattccaccatcactaaaccacaaccaagtcattactaaagtataactcaaccatcaataaacaataacacatccatcacaaaacataactcagccatcacaaaacataactcagtaagtaactatcataacagagccaaaaccttacctcaccaccatgcgctgtaatatcttcagcaatggtcgattccattgttgcacgggtacggttgacaccccatctaagtaatagaatctcatcctctttgattacgttcccatatcgctctccaatggtgttgattgacttatacgcccgagcctgtaacacgaaagcaacaccactgatggtgtacgacttgccaataggcctcttcaactttatagaatcaacaagggcttcaaatgctaaccgactccataaataagtcttcatggcttcgtcatcaaaaattcttttggcactctcaaatagtatcctagagttatgatgcaagccaaaaagtccattggctagacgagtcaataaccccaaccatctacgcttttcaggaggccatgctctccacactactaagcctcgcctaagtatctaacttaggaccttcaccacaatgcacattcaattccctgaagaacgttttgtagtccacttcaggttcaaactactctataggcagtggatctgtgtttaaccccgtgatatgaccaaattaattcaagtcaaacctgataggttaaccagccacgagacaccaaatctccttcttcagtattcttaactgtctacagagtagtgaatgtacagtattatcagaccaaacaaaatgactatcaactagcttagcaattactttaagaggtgtctttttcatttgattccatgcatcttctctaattgattctctaatcagagggacatctcccatctcgatgttgtgattaatggctttattctctagattagattccccttctggataaagtcttggagggtaatcccttgcttggtcttcagacatctgataaaccataaatcagccataagcatacattaattcagtcacaacataaaacaaactcaaccacagatgcattaaaaatataactcaaccaaaacataaaaaaaaaactcagcaacaacatcacagaaactcaatcacagatgaaaggttaagccataactcagccaaacataaaataaactcagccacaatatcacagaaactcagccacagatgtaaggttaaaccataactcaatcgtaacataaaacaaactttgccacatacgcattggtaaaccataactcaaacacaccatataacaaattcagacacagatgcattgataaacataaatcagtcgtgaaacaaacagtaactcggccatcaaatcgaatagatctaacaaatcagccatcgtatgtaaatcagtgacggcgaaaatcaaccgtaataattgtcgataaaaaccctcaatatcacagttttcgtaaaacggtttcagtcacgggaatcacttgctgttgaacttagatgtcgaaaaaatctaattaaagttagtttagacacttaccggaacaagttcaaatgcgacttgatagggatgtgactttactcgacttaaaattcgacactatcgaaggattttggccgaaagagatgagataaatagaaaacattgacaaaattagggttccaattaaggaatcaagtcgacggaacaagagaagagagagccagagaatagttctttttttttttttttttttttttgcacgcggattaaccgtgtagagggaaaaaggaaaactaaaaggtttaacgaaattttcgggtaatgacgtggattaggataatgacgtggataatgattgtttttaaattaaaaaaaaaatattatttagataaactaatcaaaggtgttaattgtaattatacaaatgctcaaaacatatgagtaattttttaaaactctatgatattctagtaataaacatacttttctatgatatctgagtaattaattcacccatttttaatataaaaataccaaaaaattagttttagattataattcataaaacctaataagtttttagtttaaaactaatatatcatagtcacaactcatgactaatatgaactactgaggaacaatgggagattagatcgcatagagttcaattcccgttctcaacccatgaccaatatgaactcaaagtttccttcaaaaccctcgttgctccgttcgatgcctaatttaatagggaacctcaaagcggctctatttcattctattccatacatatcccaattccattcatttaatatcattttggtgtcattgacataagagatgtaatttctagtctatctctttatatttatatatatgaaaagttgcaaaatcatcatataataatctagaaattgaaatagaaaagaaaaaagagaggtttgtgatggaatttcaatcttttatagtaggtaatctagtatccttatgcatgaagataataaatttggtcgttgtggtcggactctattgtggattt

SEQ ID NO: 14082 - DNA, 3000 bp, Unknown
  misc_feature (1)..( 3000): cDNA_ID_3021580_gDNA_ID_2214696_Annot_ID_189544 3000 nt of promoter + ATG
tgtcgcttctagcggaattgcttttttgttgttacaaggtgggagaactgctcattctaggtttggtatacctattaatcctgatgatttcacaacctgtcatatagtacctaattcagaccttgctaatatgctaaaggaagcatctctcatcatatgggatgaagctcctatgatgagtcgttactgttttgaatcattggatagaagtctaaatgatgttattggaaatgttgatggaaagccatttggtgggaaggttgttgttttcggaggggatttcagacaagtacttcatgtgatacatggtgctggtagggcagagatcgttttagctgctttaaattcatcttatctttgggaacattgcaatgtcctcactttgacaaagaatatgagtcttatgtctaatgatttggataaagataagggagagaaaatataagaattctctaactggctccttgccgttggtgatggaagagtttcagagccaaaatgatggtgaagttctcatcgatattcctgaagagttacttattaaagatgccaatgatcctattgaagctattaccaaagcattttggatacctcgatttgtcgcagcctaataatgatcctaaatttttccaagagagagctatattgtcatcatgctcgagaaacttaatggtaagctaagtttaaaattgccgtggactaagactattttgttgtaagaattctaacaattgttttcaaacacgtgaatcaattacttatttaagtgcggatagtattgatcctcaagatccagcgtcattgaacaatcccgtcttcacaccttatttcctcaatagtataaagctttctggtttgtcaaatcacaatctcactctgaagattggtacaccggttatgttactaaagaatattgatccaaaaggtgggctatgtaatggtactagattgcaggtaacgcagatgggtaatcatatactagaagctagagttattactggagatagagtcagagacaaagtgataatcataaaagcacagatatcaccttcagatacaaaattgcctttccggatgaggagaaggcagtttccaatagctgtggcttttgctatgagaataaagaaaagccaaggacaatcactcaaagaagttgaaatttatcttcctaggccagtattttctcatggccagctatatgttgccttatcaagagtcacttccaaaaaaggattgaaagtgctcattgtggataaagaaggaaacacgcagagtcaaacaatgaatgttgttttcaaagagatctttcagaacctaaggggttaggaattcgtttcattgctttggttattcatatgatgttttgtattgttgtttcaaacaacaatgtttttatttctagacaatcgtaaaacagatttcatttctagacagcataaatcatctatttccattaacgctaaaaacaagaaagctttattcaattataccttcagtcaaccaaatctaccaacgaaaaacatggtgtataaacttgattgaaagctgatgtgtaactaaccttatatatatgagtattgatttggttgtcgacgatttgtacacttaaacgccactgagatgtatgaacacctatgaacaacaaatctcaggtacctatgatataatatataaaccaattcatcatgtcaattgccttataccattcctatatggaatcattaaaaagagttgcaaataagacatgactttataagattgtttgtattaatgacagctgctaaattaaaaatatgtgaatcaattcattggtttagctctctcctataagggtagaaacaaataagaaacatgcatgttcccgagtcaattgaaatgtgtttgttcgcatttaaaggtgccgtatcacagcttatttctgcacataaatcgtgaaaaacaattaactagcaatgttataagacaattaactggctaaagtctatctctttcttagctactctaaacgagataaagcagtacaaagaggaaaccaaactacgagctttgcaacatataaatttcgaaattagtgctaagggtaataaccaactcaatcaaactaaaatctaagaagtcatgtgtattgtcaatcttgatgaacggattggaaaactcataaactattacaataccaaaaccataaccaaatatatattttccagaagattgaaaaatacctgaactttgatactataagagaaatttcggatggttttgtagtaatcagcaaaatacgagtaacctcagcactaattttaatcaaaaaatgaataaagtcaagctctttcatatattcacataactatttggttagactaatgagacaaaaccaaactaggagctttgcaagtataaatttcttagttttagtaaagggtattcaccgattcaatcaaactaatatctagaataccgtcaagatttttgtcaattgaagtaactgattggaaaacacataaaccattgccataccaaaaccataacctaagaaatttgtgaagaagattcaaaattacctgaactttgataatgttagagaaagtgtcgattgttttgtagtaatcagcaatcaattcaaccagagatgtctgtattctctcaaatgctctgattctatcggcttcaacattgtcatgcacccattgtagctcaagagatttttgtaaaaaaatcattggaagttgaacagagatttgtaatgtgggcaatcgctggtgacttacatttttggaagacacgaatgctggtatacgccaaaccaattgcaaaaatcggtggtggaagatcaatctgacgataatggattgaatgatttagctaaagtgagcattgctcttccgtcgtcagctacggatgtggtgaagaaggtggtgtttgtgaggaggaagagaaggaggagaggcgttggagcctccattgattagagaacacgacagtcacgtagagaggaggaggatg

SEQ ID NO: 14083 - DNA, 3000 bp, Unknown
  misc_feature (1)..( 3000): cDNA_ID_3021594_gDNA_ID_2214696_Annot_ID_189540 3000 nt of promoter + ATG
cagctcttgcctcttttgggtcacccaacatgttaacaatggaagtatcaatcgcatcttggttctctactcttgaagccctagctgaaagtagtatcacatagtccttgtctacgtctttggagaatacctaaagaacaaagaaatccacaagacatgaagcttctaacgtaaccaatttaaaaacaaattatgatgatgaagagatttgtcttgaaacctcaatcaagttcttgtcaactgtaagtttgttgagagttagagttccagttttatcgctgcaaagaacatccataccagccatttcttcgatggcggtcattcgttttgtgatggcaccttgttgagacaacctatgtgatccaatagccattgtgacagacaacacagtgggcatagcgattgggattcctccaatgagaaggacaagaagattgtcgattccatctctatactttcgatgttggatcggatacattataattatctcaatcaacattcctattccgattgaacagatacagaagttaccaatggcggttaagacctgcaacatttatcaagaccatattagagttatatcataagattgcttgcatcgcaaggaaatataattcagaggtcagtcatatataccttttggaaatggccaacattgttagtactatcaacaagatgagctgccttgccaaagaaggtatgcactccggttgcaatgacaacagcctcgatctcaccttgtttacaagtggagccagaaaaaacctcgtctccctggtgtttagtagctgggagagattcaccggtaagagcagattggtcgatcttcagaggatcaccttctaggagacgagcatccgcgggaacaatgtcacctaacttgatgctgattaagtcacctggaactagaatcgcagcttcttgctctccccatctcccatcccttaatacctttgtttttggtgcaagattggccatgagagctgcagctgcattaccggcattgttctcctcgatgaaactgattgtcgagttaatgatgagcaaacatgtgattccaacaaagtcttgccaatccggtggcctcccaccgccatttgccaacacaatggccatgattgcggcagcttccatcacccatgaaagagggttccacataaaccctaagaactttagaaatttgttctctaccttctcttctagtttgtttgccccaaatatttgtagtctgtttcttccttcctctgaagacaaaccttcccgggaacatttcagctgttggaacacttcgtccaccggaattttctcctgtaatacatacattcatggtttcgtacgttttatcaacaattcatgttaaaactattataaggtaaaatgtgtgttttagcaacaacaaattacttacaagatcaacattctccttctttatttcatcccatgagatatcagcagccatgatgaatcacaatgatgagaaacaacaattttcacgaagctcggcttctttagacagaaaattaaaactctccttattctcttttgaattgtcttaaagaacaagaagagtaaaaggtaaaaataactgtgattatttctttagttttgtgatgtggtgtgaagacaaagaagtggtatatatacactttacacaagtggcttgcatgcggttttgtagtttgtggcagaccttaaactgaggtgttttgacaatgcatatgtgtgtgttttgaactgtttttatgccttttcttttgctttccataatttatgttgttgtttttttcaatttaaaatagggagaaaatagatttaggtttatttctacaaatagaaaaccggcattcgttatgatccaacaagaagtatgtatttaaatcttttgataataatatcaaataatccgaacttaccgaatgaaaaagttttacaaattttattggtcatctataaatagttaagaaaagatgatgcaacaagaagtatgtatctttatctatataataaagtaagatctcctcgaagtgatattctaagagcatctccaagagatactttatatatagagtatgtaaacttcaaatataaagtatgagtagtttcttctcccacggtatacttcaaatataaagtttctaaaatgtgtgttttgcattatagtccttatattgttcataataattttaaaaccatataacttttataaataactctaaaacatacattaaaatattacacataatcttaattaacaaaacaataaatttataaataaaatacatataaataaaaattaaaaatacataaattaacttataaattacaaattactcaacaaatttttttccgtaatgctctcatatatgatcaatcaatgcattacgaagacatagatgaatcattttatttataatctgtagattacaagccaaaaattgtcgaaatactttgaatatataaaaatttaaggactaaaatgataaacatagtaatttgtatatgaaatattgaattttagggacttaaatgcaaataaaaaaggtgaaacttcaaatttagagtattgaatagtgatactccaaatatagagtgtcactattcaatactctaaattatgaagtaatggagtatctcttggagaacctaaaactttatatttgaggggatagagtatctcttggagatgctctaagaagctaacaaatggcgctctattcattgcacatgtgtcattcctctcaaatttaatacactatttttatattcactttgtctaaatatagttttataataaaaaaaatctcttaacatttttgcaatgcccttttataattaattatttttctaataatgtatcatttatcagtatattcatatagttaccataacaatagaatttctcagcaaaataatttcccaggaattaaagaataaattattagttttataactttcaagccaaaaatcaaataatttttctctaacataagtttaaaggaa

SEQ ID NO: 14084 - DNA, 3000 bp, Unknown; identical to SEQ ID NO: 14078
  misc_feature (1)..( 3000): cDNA_ID_3021617_gDNA_ID_2214696_Annot_ID_189532 3000 nt of promoter + ATG

SEQ ID NO: 14085 - DNA, 3000 bp, Unknown
  misc_feature (1)..( 3000): cDNA_ID_2706002_gDNA_ID_2214696_Annot_ID_136817 3000 nt of promoter + ATG
cttgactcaatcaagattgtgaagataaaacaggagatggttgaaaagaataatgaagctaaagtcgttggtgagaagctcaatttctgaatgggaagcagaagagggagtacgcagatgaagttaatggagttaatgtgaagccgatggagtaaacataaaagtagtattcatgttgcatttgcttctgctttgttgttttagttttaataagtggtttttctttactgtttccacatttgtttctgttttttaaatgataattggttttccatttggtttttaatcttcttagttcctcaaaatcattgaatactaaactcttatcacctttcattatctaaacaaatgaagatgtgtcgttctgttctaaaacaacaatctctctcagaagaggaatcaattgtctctgttgcaattttagtaattggcagcatgaccctttgagttaacaaagtttgatgttattggcaaagtttatagaaaatgcgttataaatctaaatttgcatacggtatagagttgttgttaatagctctagattctctacagcaactaataaagattggatgaagatgaggaactaacctttataatcgttcctcagtcgtcagattgcaatcttgattagattgtagactaagcattaacctgaaattaaaaaaacaacaacatcattattagatgcagagaatataatagatacttaacaataatattctgatttggcaatcaatataacaataatatataattgcaatcatattaattagatatcttaacaaaagattatataatcttcaagtcatcgctaagttttattttaaactctattagttagaaaattatagttctatcgttatacaaacaatagcttaatgaagttaagaagtgccttggttgataaaggtgaaaaccacaccactccatttgctaagaggaagtgttcatcgagcaaaaacagtttctatagtcaccacaaagctaaatcatctggaaatgggtttgttattccactgaaatcaatatttgctcggttaattacggacataacaaaatccaagcctatggttttagaagagtctctttgtcctacatgaaaaattccagcacaatcttatacatgtatatcattatattctacagtatgctaattgatttatccatgtagttaagacttcactactttgttatatgtacaaaatggcttatatgttttttttccaaatgttcagttgatgagaacacctatctaacacctgtttgtgttagacaatcattgtcttcgcaagaacaatactctttatgcccgcggtccatatcaaacataacaaaatctacttctgtggttttagaagggtctctttctcctttagctaaaaatctatcagtgactgatataggtaaatcattctctctcgaagaggctaaaatatagttctatataatattgactttcgatattttcatcaatgttgtttgtggcttctcttaattttttcaggctcaattgatgagaactcatatctaacacctgtttgtgttagacaatcattgtcttctcaagaaccatattctttatgctctgtgccaattacgccatctaatgtctctcaatgccaggaatatataaattcttctggtatgttgatcgacatactatttttacaatgttttattggttaaaacataacttatgctcaaaacgatccttataaatgtatgtagaacctcttgaatgtttaacaactgatggatcaatattatctgatataccaattaaacagtcaacttcaatacttggcagcaacgattttctaacttcaatcagatcagaaacaatcaaatgtgagcattatttgtctacacccaatttttgtatatgagttttgtttagatactattgtttttcattctaacataattacttatattctgttttcagcatacagtgcaacagaaaatcatccaaatataaagactgtcagaataagccaatcttattctgaacttggttcacaaaccttcttatccgacataagaagagaatctactaaacgtgagtttctgtttgctatagtttctgactttgagcttttattcatcttaattctaatatgtaattacactctaaatctatgttctttttttgttagattccattaatcaggtttctaaacttgatacactgaaattgaattcaaatactaatagaactaagaaaagggttctaggagacatatcaaaccaacctgatagaagacgacgaggtgagccacttaaaagcagaattcagtattctacacaaaacaaagaaaatgtcacaccaaaccgtgagtatacaattatccaccatcacgaaaataataatgattgtattctatcaatattcatatgattgcagacctaagttattcattttcctgaacgttcaacagtcaaaaattcacaacagccggataaacaaagaaaaactaaaaagactaaagatttggatgactgtcgtgtaaatctgtttgagtcaatccctttagatggtaataatcgtgatttatagatttgttctttgaaatatgaattcgattttgactaataacatattgttgtcaaacagaagaagatatttctgatctcgaacaggaatatgatgttagtagtcaagaagatttggcttctgatagcagttctggatatgaaactgaaacctctgttgaaacacatgaaacaatgcatccacagaatcaaagggcaccgtgtattaaaggtagaaaagatataagtcctaagcgaagtagatatactagaggagcacctatccacaggaaaaggaaaacaggtttgtatgatcgtttaattatttttagttttagaacgaacatatgaataacatttttaaaatcgaatttgatttgtttttttttttttgcagatcctctcattgacattccttatttagatcacggtgatccaaaatggaaatgtcaatactgtggtgctatg

SEQ ID NO: 14086 - DNA, 3000 bp, Unknown
  misc_feature (1)..( 3000): cDNA_ID_3021692_gDNA_ID_2214697_Annot_ID_189549 3000 nt of promoter + ATG
gaatgagctcggctgcttctcctccacactgatttttctccgtgcctgctccgcatgcgcttcgcgcgccattggcgctttgctctcctcttattcttcattggacggttcggttcggatggacttcgccgttctttcccaactaaaaaagaaaaggctgtatcacatcgagatgtcgattcgttttccgcccccaatgagatggggaatttgtaaccccctatttctactttggggcccttcatctttctgaatctaggcccgtcccggctcgtgtcgttccaacaaccggcggggagcatctcagtatacgatcgcgcgcagtaactgggagtcctattacacctaaggcgaacttcaattcaccaaaccaaggttcatctcgtgtagtgattgtggactctactaaggatattgagtagacggttgatgtatcagactcgaccctatctttcgtagcatgcattcccatcggtgtcgcaactgattcggtaagctacgtgtccggtgcacggagaactgccttcggtcctccaaacttacttattcgtggcaaccttccggccgcccaacgacctataacgctagtcactactcccactggggctagaaagtaagccccacaacccaaagcggcgaagaacaaatagaatttgctacaaaagccggctaacgggggtattcctgcgtatgagaacatagtaatggagaaggtaatagccgaaataggattcgttttggctagagcgcccaaatccgctatatatttgacacgggtttgccgtaatgctgaaactatggcgaatgcatccatcgtcattaatgcataaataaagataccaattagtagtgattgaattccttctatggttccacatgagaaaccagtacgaatataacctacatgtccaattgaactatgagctagaggtcttttgactttcgtttgggccatggcggccagtgctcctaagatcatagaagcaatgctgcagaaaaagaagatttgttgcaatgtagctccataggaaccataaatagaaacacgtaaaatattagcagaaatagagattttaggcgcaatagaaaggaatgctgtaaccggggtgggtgaaccctcatagatatctggtgcccacatatatagagtcaaagggaatatggagtccgagggggagggggttttcttcggggctcgagagattgaatagacccacaagtttgaaattcgccactggggaattcacacgaaagggaacgaggaattctcaacgaaaaaagtgctctctgaaccgaacgtgaaagtttttttccatcagacggctgttcctgtaactccactctcgacttggattatatatccaaaaaggtccgctctcggccattccacacgctgcctagccgaggtgtggtttctgaagtggattctctcttttctagtagatgccgaacctgctgccccattgactaagaagaggggcgggcgcagcagctacatggaccccttcctttctgttgttgccagcgctttcccgggccgagccggaatttttgattattattctaatgggcaggcaaaggccgcaggctgctatcccaataggccagcgggcggaacgaggagaggctccggcaatcatagcaccgcggtcgaaaaagcgtgctcccttcagataacacgcaccgtaggctatcctcggccttcttcgttttcgatgcaaaagaaaggaaatctctcgatctccgaaagccttttccttaccccgccgcatctccctcccttcgtcgagcctttccggggttgttccttccttatcaaaacttggcgggcattctttccagccgggggatgggttttgtttgaacataggctcaaacataattttaaggtcctagctacgccatgcgttcaataccaaatctggaaagctgcagaaatgacaaaaagagggcgctttcctatgttgcactgaaaaaagaaggacctaagagcgtcttctcttaggttttttcctcccgcgcccgccgccgcctggcccccgttagaggggaaggggaagattagcaaagcgaaaaaagacagagggagggggagcagcatcttattctcttcgcgagaacttccggattgaagaagcattcggaacgggctccgcgttcatttcattggcgggaaacgatccaatccattcggggcttcggccaaaaacgaattcgacttgattcatagatagaatcaatgataaataaacaaaagatagatgaacgagatatcttttctttctataaaaaaagaggaatagaatagacatccctttctttagatgtctatctatccttccgattttatatcgttatatctgctctctcaatttttttttagagagagcagatagatcctatcccctatatcgaacactaattcctatctattgataggaagatcttcgtctaatagcggactttgcctttttttaggaatttctcatatccaaggcagcttaccacaagaaccccaccccatacaactagttgggggggctgttcgccttttgaatcaaacaaagtaagttgtaggtaggggcttcatagctactttcattctaaaggaaagcgaagaaccaatctttagtcaataggagccctacttccctcgacctcatcacttcaattgttgcgcaaacctctttcttagtcaccgggcggagcgcacctttgtcacagtagggcgagctgtttgatagtgacttcttgcgtttggtagggcgacgaaagggctacttccttcaatctaggaaacagccggaaactcgagaaggtcgcctttggaagcgttcgccagtaaccaaagcctcactccttccttttgattatgtcgtgacgctgactgaatccaatctataaaaaaacccggaaactcaacaaagtgcgttccctttcgtcaagtaggtaaagtaggcatacgaaccacttttgctttgcggaataaaacaatgaatg

SEQ ID NO: 14087 - DNA, 3000 bp, Unknown
  misc_feature (1)..( 3000): cDNA_ID_3021672_gDNA_ID_2214697_Annot_ID_189562 3000 nt of promoter + ATG
tatgttagtatctagattgagtatcataccattttccaaagaaagatagtatgctaaaatattatgctaatatggtcatttggtatgctcttatagggatagagcactatgtaagaggtctcgacgagcctccaccatactaagctaaggtctactagctatagtagctagatgggaatgtagcctagcagctagtagctctcttcttatagctcggtagttggatctttcataattcctttatggttagagcacactgggatagaagaatagatgagtttgtatctttcttcctactttttttttatcggaaaacagagctagaacaaggaacaagcaacactagcacttaaaataaggtaggcggctaaaacaattgggcatttccttgatgtccggaaatggtatatctgaaaacagaagaaagactttcttttgaaccaaaactaaagatgatccgatccgtgcaccgcttttcttctctaccctttagaatccaaggaaaaggcaaagagaaagaggttgcagagggcacctaaccttccaaagacacagcagctctagcctaacttcggattcgaaaccatacttccctgacttcctctcaacaagaagttaaggctgaaagtcctaatcttcttatcccgatgcctggagtagcgggtcttagttcggattagtaccttttgagcaaggtaagttaagtttcggcagtgaaagaaagtaaccaggatccgcttaaccagttatggatgaaggtaggtctactccaatccctcagccaataaacaataaagtaggcacatttccctcggcaaagaaagtagtccctcgctaaagagtagacttgagtatcttcgaagtcaaagccgaggaataagactcagttcgggtagagcaaccatttatattttcattattcttacccgtttacataaatgaaaaataaaagtgaattaccacggaaaatatccacctaaaaaaatttctggggttacttggcatagtcctctaaagaccctatttagatactctttcttccgagttcgagataaggaggaagaatggggcgacagataaaattaaataaagagcaaaaatgcttgactttcattttattaaatataatggtaggtagggcttcttttaggtcataaagggaatagtacttttagctcgttcatctaattctgctggtctataggagtggctcccagggctatgtgatagcacccaaaatacgacggcctgatcaagagagccagaagctgggtccgcccgccggagcttctttcaatttccggggggcttagcttgaaccactcccaagtgccaagaaccggcgaatgaaggctccgtggcggcatcggagctgccaataagctaatccgttcccagtgagctattacgcgctctttcaagggtggctgcttctaggcaaacctccttggctgtctctgcacccctacctcctttataactgagcggccatttgggggccttagctggtgatccgggctgtttccctctcctagagaaagaagttctctagtcactaaagtgcgtttcactctcgttcctctcgtttcactcgggttgctaaagcacctctcctctgccaagctctctgtcttggttaatggttatccaaaaggatatttctcatgttaggcggtgtgagacagggggataaaggatcccccgttgttattttgtattgcggaagatgtcttatcacggggtcttaccgggcttaatcacctgggcattctttcttcaattaccgagacctgtacatacaaagatctaggcagctcatcttcttctaacgaagtcagatctttttccataccataacatatatagaatcgattttcttttctgatcgctagcctgccgggccgcccccgcgatcaaactatcaatctcataagagaagaaatctctatgcctcctttttcttggttttctcccatgcttttgttggtcaacaaccaaccacaactttctatagttcttcactactcctagagacttgacggagtgaagctgtctggagggaatcattttgttgaaatcaattaatctaatcatgcctcaactggataaattcacttatttttcacaattcttctggttatgccttttcttctttactttctatattttcatatgcaatgatggagatggagtacttgggatcagcagaattctaaaactacggaaccaactgctttcacaccgggggaagaccatccggagcaaggaccccaacagtttggaagatctcttgagaaagggttttagcactggtgtatcctatatgtacgctagtttattcgaagtatcccaatggtgtaaggccgtcgacttattgggaaaaaggaggaaaatcactttgatctcttgtttcggagaaataagtggctcacgaggaatggaaagaaacatattatataatatatcgaagtcctctccttcaaatactggaaggtggatcacttgtaggaattgtaggaatgacataatgctaatccatgttgtacatggccaaggaagcataaaatgattctttcattctatagatacctctggtaggtaaagcactcgactgtgctttattgaaagttcccatcgcgggggcgaggatacttgccttcgcggttcgactttcttttcaggcttgactcattcgctagcttctcctcccctttagagctctttatgatgcccactgagtaagattcggggacttccggcgcagaagctcattctgaaccgcgggaaccttcgtctcaatcttcataatcaatttatgccatcttaaaaaaattggaatcttgttaggtacccgtacgacagctctaataatgagctaacgtactcatctttagagtggtttgtgcgcaggctcgagaagttgctgcccgcttcagaagaccttagggtgccttcgattcctggacgactttgttcgtcgtgtacaggggacgggaagag

SEQ ID NO: 14088 - DNA, 3000 bp, Unknown
  misc_feature (1)..( 3000): cDNA_ID_3021657_gDNA_ID_2214697_Annot_ID_189568 3000 nt of promoter + ATG
ttataaaaaaaatataatccggagaaaaaccttcaaatagaatccgaatagaaagaagcattaggggtgagaatgacgccaagtgccccgagtagctatggtatccatagttaactttctttcctgcatatgtagggtaagtactttgtgctttcttcgtctagctcacacaaggtgcagagtggcgtgttgactcgagttctttgaacaagctctccccacatcaattgtgaattgacgatgcaatgctactattctgcagaagaccgaaagtgccaagaagaaaaattagtgaaagagttttctcgctagacgattctgtagaaaatagagatcatagatctggtgcgtcttagcatgtaacggactttccccaatcgagaagaagaatttaatacaatcgaagcactcattgctgacgtttaccgctttctaggcccaacgcataaactttactagagtccgagaagatcaagaaaaatgcatccggtggtggtgatcagagctgaatctcattctttttctttctagaagcatacgtcaagtgtactgactcaatcaacctatcggcctacaaaggctctccattctatacccctagccctacattaccactcttaccattatcttaaagataagataaggaccaatggcaagcatattcaagtcagtcggtcataaaagtatttaacaaagacaattgtaaggtctgcaagcctccctattacttcaaactgaaacagaatcaagggagatatgaaagaaatgaaaagaagatgtcagtccctctcacttgaacaagattactaataagaaagagaagagaaggaccaacggccagtaagttcatcctatccaccactttaaaatgaacacgggaaagggaataagaaagaataaactgctgacgcagctgaaatgcactaaaaaggagaatgtactctcgctttttcgttccgaggaatgagagaaggtatccaagtagttagcgagacttcaagaccagcagccgataagaaggtcagagtcacaatcgctttctcaattgacactgcgccagaatctaccaccccattcattgactatctcacctcacctcccatgggtctgggcgcttagcagcccctactttcacatttcttcctatgaaactacttggtctacttccatttagactgagagatggcgtctctttcgacggattgatccggacttccccacttcaacactcgcaggaaagaaagaaaagaccagaatcctactgaagctgctaacagagactgagcagatatagacctatgagatttgtacacttcggcttggcaccttcttttggttcgtgctcgcacgggccgtttctctgccaatctcgaattagaatctttgcttacccgtgggccttccaggatcactttttgagctcgcaacgttgagtttgattcctcccacccagtggatccttactaatccataatatgaagttaggttagctacttccctcagtggggataaggacagaatagaaaacccgaatgaaatgggatttttcctattatctaaaatagggctttgaaccagcctgagagaccatttttctttaaagaaagtcccgttttaatgatttacagaaatttcagttttttttgttcaattcttcaaaaaaaatacttcctgccaaagcgagcaagtcgcctatttcagggaagctaaaagcatgtcgtcccgcctatagtcgtagccagttcccttgcaggccttgattagcaaggaatagagagagcattgaaagtacgtaactctcgaacttgtttctcgagaggttgtgaacacaaactcgactgataaaggagaggtccggaggtattaactagttgatgaggtctcgacgagcgactaaaaggagaggtactgacgtgactcgagtgaaactatattgaggagagggaaggggacttatgtaactatattccgaatccttctccccgtcaaaatctgcctcccttgcccataaggagagagtctccctagtgaggaatcctttagaactgatgacgtcctagctgtgagctgacccaagagctacactgattaggaagcagattccgcacagaagaccaagcaaatctcctcttctagtcttacccccaggctgtggtgctacgagatggcaatttatcgtatagaagaatagatccgtgggcctattgattgaccatagatcatagaaccgatcgactgctatctaagagaagataagtagttcttctatcgttcaagggcaagggggagaacatgtagcggcttgcctagatctcgtatttcccacgtagtccgtaggtcaaaccaaggattctcttcacagtcttaaaggatgtatctctcctttgcgctgacttatgctctgcgagctaggagcgcatcataggggcagggcgaaaacgaacataggatcatcatcatggcccttttcttctttcttttgctgctgatctcacatcgagagcagctccttcttgttcagggtcatcagatgagagatcttcttccgactccgagaaatcggtcaaacgggaggctaccctctccttttagtcgagtaatcaatccctcgactcatctctctatccataaaaaagcccttcccagaggagagcggaagctccaggatgagtatgccctggattcccggattcattctcgtcctgatccactctggaattttcggaatctacaaaaacattctaggaaagggctcgtaatgatcttctcaaagatcacaaggtgctgaagtggcaggataggagggggatccgtaggtttttgtgaaagggatgctcttacttatcatgtctgaaaagaaaaaccgaattcctcgatttcattcgattcatccacatttccatttcttgtagaggaaggctaactgtgcttgctggctgggagctgtatgagcggtaacgtccacgtacggttccgtgagaagggcggtggacagaaatg

SEQ ID NO: 14089 - DNA, 3000 bp, Unknown
  misc_feature (1)..( 3000): cDNA_ID_3021669_gDNA_ID_2214697_Annot_ID_189563 3000 nt of promoter + ATG
agataagaaaaggcgaagcgttctcttggtttcccaacctgttgcttctagaggctgccctctctcggctggatgttggtccagcctactacgaggatcccgtatccaacaacccaacctataaaaaggacataaaaaccccttgtataggttggagctaagaagctttccttattatcagagaaaggggaaagggcttttttcagctggtgcgcaggagcgcacttccgttttccctttactagtagggtgggggtcccgtggttcctatgccgccgcgtttcccggtgcttttcttttagtgcttcgacccgaagcgatagcttctagctagttcagtggataagatggctgcgctccagctcactcaagaatgggacgacagtggtccgccggcaagctcgttctgatcttggacgcagtacattggaatcctgaagcaccaccacgaacgctaccgcgcgttcgcctgcagtgcggtaaggcaccaccctgttgtgccagcagccaactccggcgtgtcagcttagttatcctcatcaagccacttacttgatgtctagcttcccaactggtagacggttccttttcccccagatcaatgaagaaggtagaagtaagttgattcttccgaagaaccggaagcgaagcgctatgccggggtgggggggacgggaaaagaaacggctccgaagaaataaattggggttcccaatgcttctctacgcccaatgagatgcgccaaccccgggatgctttactcctaacccacaaggttccgagacggagcttaacctgagtcttggttaagaacggcgatgatctacgtttcacacgacgcacgattccatggatagtttcattcgacatcgtgatggaggacatagcttacgatcatcggctttgatcatgccgctaggcatttgattaagacattgcacaatgatccgaagactttgtcgcatctcttcgatacggatacagtaacgatcatagcgatctcctctggtacctactggtacgtcaagatccgattggtcatgaacatcgtaaggtgctgctcttcgcgaatcccagcatacccctggttgggatgggtaggcccaccacttcactttaacttaggcccgggccgagtcagtgggggaccctgtcgggctcctgccccccccaaaaaaaacaaactgtacgtgagagtttcccttcatacggctcgaatcattctcagatgcctccccgggcatcctttccttctttgttgagttggttcacgcgcgcgcaaacgagcaccagccgcaacagcaggaaactatgaccaatagagtcagacacttagctacatccgcacgcaaaaggaatgtggttctggttgagactttctttccggggcgcgggacgttcgcggagtccgttccttccgtaccaccacaagactggttgttcttgggcttaacagccccctaatcataagggataggggaaaggtagccaggcctatcatatcaaaagggttgtagaaagagaacccggccccctatttcattcgacgttccggggcaggaaaaaaaccattcgaccaactttagttttgggtaacaagaaagaaggcgagttgatctgctttgatcaaggaaaaagcccagtcagccaccaactcggtgcaggtcacgtgacctacagctcggccttcgctttttgaggcttcctctacccgcatctctaagtgctcgcagcacttccatatggagaaagataggcttaccatgttccatcaatagcacctaatctatgccggttttggcggaccgtgctccaccccggtgaactcacgcggttccgacgtgcccagaggccagaggcgaaatccgttcacggtccgtaggaccaacaccattcaaaggtgggtggctccccccgcttagaacagtcatctttgactgggcttacacacattcgctcacttacgctgtccccccccagctcaccctagccccgggccttttgctcttctaacgtaagctccaaggcttcacaccaagtcttcacttacataatatgcatgcttaagtagagtcaggcggaaccattgttgcctgatgggaacttcccccatattgctatcaatgtcttcatgtcgcacgacctcttaacattacaccactgaatccccaatcctttgcttgctgtgcagtgacagtaccaatatccactaatcgttgtttccagatacggttgccggttgacatctcttctaattcatcgatacgagaagcaaattgttgtgtgaaggaatcaatatctcgacataagccaagaggcagatcttgtgccactccacctggtcgtatgaaactggcatgcatcctggctcccgagactctttcatagaattccaacaatttctcccgctcctcaaaagcccacaggaacggagttaatgctcccacatccatagcatgagtagttaaagcaagtgaatgatttgaaattcgagttatttcacggaataacactcgtatatattgagctcgtaatggtacctcgcaattcaaaagtttctctacagctgaagaatgagcgtgttcttgggccatcatagaaacatagatagggtcgaaaacggaacgaaaaacgaaactttacgacagctttttcgtacacgttcacttgcatcacatacacaagtgctctctgaaccgtgcaataaggtcacccataacacggctctcccacttgagttactttagccccaggccatgctattcaataatattggaaaaatggcagcgtaacgtaagaactagtactgaaagctagtcttcttttgagggagggaaagcctttcaataggagccctacttccctcgaccttatcactttaattgttgcgcaaacctctttcttagtcaccgggcggagcgcgcttttgttactttgcttatagctttttaggttatgcaatagaagggaggcaacgctctgggcttgcagaaatgaatg

SEQ ID NO: 14090 - DNA, 3000 bp, Unknown
  misc_feature (1)..( 3000): cDNA_ID_3021682_gDNA_ID_2214697_Annot_ID_189556 3000 nt of promoter + ATG
agaacttgcttcgctaggaaaggaaaagggagagttggtttcaccttccctataagaactaaggtttaccaaactccctagccatctatgaaactatgatactttatacttccaaacctgaaaaggaaaaggaagactaaagcatgggactaaagctgaggaggagctagtggaactgtctacccaagaattagaacaaaagctgctcacagtacacctttgtttaactgtacgagcgagaataccagctaatcatgtaactgccaagaataaggattctaaaggaaagagttaggtgtgccagagatcctgggattacctttggagaggaaagctcctactattactattaaggagcactcaaagcttgcttcgctaggacaggacagcacagaagagtagatagcttgcttcgctaggagtgtgctaacttattctcataggcgtacccgcgtagaagaagctaccttcctcaaactcctctgcgcaacccagccataccagagagtgctatcacaaggaaattgtctggtctcagaagatgagagcttcttttttagcagaggtactgatgtcaggagagtgtcgacgcgctcttccccagtcgtgttgaagaagtttgagggaaagatggattctgaaggaaatcggctgacctatcggatgaagcagactgctgcgaaagtggtgccacgagtcgagaactcttagaattgtgctcgttcaggctctttagtgcacctaagtgcgaagctggtgctgcaagggaggatgtgggcgggagagcggtcagtcctctacctctcgctatcgatcccttttgcgtcctttctagctatcgactctatccctttttctttctagctatctcttcttccgtaaggacctttttgttcccccccacgctgatcaacaaccattgagataggatagagccaatgcaggaggtgaccgaagtagctcaataaaagaatgaagaaattgggaatggtaattcgagcaatgaaaagaaagaaagagttcgcccaatcgtatagctttttccttcaaatgcttctatctcacttgtttgctagcttgcaactgctgggcactgaaactcagtcggccgacatcgataagggagattttcttccaaccccttggaagagaggaagagaaaggagtggtgatggcttaaagaaccacgttgcataagccggaagcacagaatgttactcggaaacaagcctgagaacgactcttcaccgttagccattatgtttacctggtcaaatgccgtcgtttatgataggtcggtctagtgagagcaaatgatcaagcaagaacgtgcctacatccgttgatgcacttcgttgactagtgaagggtttttccttggggcccacgttgccactggggtcgctcatcttactctagggtagcactctctatggaaagaagagtggttgtgcttcactactagccaagtccatgcagatggggataagggggttcactgctgtctgatatcatcatatctattttgacctaaaagcttacttgggatatctaagagctaattaaatcttttctcttaaaaaaacgggtaataagaaaacacttattatctttttatttgcaagcaacatctgctcaaaaagaaaaggaagttgacttcacctccggtgaccggcttcgcgggatcgccttacgtataaggacctgatccactctaggcgaagcttttttgggcgaaagctacttactatgttatcttccaattgagttgagagagttttcaatcgaattccaatttttcgttatataagctatttataattgaatgatttaaagattgagtttcaaaaagaaaataccggagaaaaggtgatgcaaacaggaaacctgcttcgcccgttgatggtccaagcccaagtattcattccttaaggagctggacgtattgttcagcttcctatgaagctaggctggcacttaggaagattggacgagtacaagatcgaaaagaaccctataggcaggctaaaagcgctgtccgtcttcatggcctcaataatactcagtattgtactggccgaatccgtttcgcagcacggagtatacctcaatctccgttagttccgtttcggctttttccccaatttcccactccttctgtgaggcaaaacctcaccacactacacttcgacacaagagaagaggaccgggcgcttgtatcttcgggataggagttatcggtcttctttaagaaaactcaaatcaaatactccttatctcatggatcaacttattgctgatttcgtttctaggatgggtttggctctgcctgtacttttattcttgtagccgttaggtctggccaaatgatccatcaaataaatagtattaatatggaaataatcctgactgatgtagcgcgagatgcgcttcaagaaaaaatcgtgtcccaactctcaattctgttgagagtatatagggatactaatactagtgagagtgtgaccttacctttatccggagtaaatctccaagaagtcgccgctcgtagtttttttaacaacgagagcattccatggttttttcatctatttagaccttgtcaatcagggcacgaaaaaaaaccactttgcccacaagctctggagttagtgctttcgttcagttcataaggtagactttttttttctaaagcggtattcctccttgcctctaatcctcaaatctaatatgattactcggctgttcgcccaactggtatcgttatcaattgtaacttattggaatgacgctattgttgcgacaaacttttcctggctcttcataactttctttgttatgactttcacctttcgtaccttctcgcgctacttcaaaaaaccgatcatttggactttctatttttttttatgtttaatagcctttctccttctttgggcagcccgaatccatataaatatccttttctcatttgcttttggagatgtttatagcttcttc

SEQ ID NO: 14091 - DNA, 3000 bp, Unknown
  misc_feature (1)..( 3000): cDNA_ID_3021726_gDNA_ID_2214698_Annot_ID_189587 3000 nt of promoter + ATG
aaagcaagaatagatagagttgaaagaaaggcgctcgtatagagccctcgactatgtatcggacatatggcaggttgggaaagcgcgcttggaaaagaaagactatcctcgaggtaaatgtaaatcaatctatctcgcattgcccaatctgaatgctaaaggctcgtaaccccctaaaaggaaactcaccaccaaaagaaaaaggtaggttaactaacgaaactcaaaactacattttaattcttgctcaccgataatcctttataaaaaatattatacagctgtatacaggattattggtatagctgtccactagccgaaaatcggacaccaaattattgtagactgacgacctgtccttaatagaaccgatctgactctctgaacaatcggaatttcgtacttctgtcggatcctccctatctcctgatcgagcttgtgtaggtagatgttgcctggtagggccgatagtagtacactgtgtgggacggagtaagggcccctctcaactcctacgagtcgtccggcggaaaagactttctgaatggagtaaaagaacttgggatcgtcgatctcttccttcaaaatttggatgagtcgatgtcggtcgatggtgtgaaaacacttcctgatgtcgaattctaaaaaccagcgagagattccccactcttctttgatccgtcttaggaccgagtggcagccttgacccgagcggaaatgcgatgtgtctggaaactcgggatcgtaaatggattcgagtaccattctgatcgcctctttcatgatcttttctataggtagaactactgtgagcggtctaaacttcaacccttctttctttcttcatattgtaaaggggggaaaagctcgttttttgctccccttttttataatcaaaggccccctcctgccgtcgtttcagtgactcatagggcttccctcagttcagtctttttggttcttgaaaatggtcgccacctctcctcttctttcagtcgatggggttcctctccttttagtcgagtaatcaatacctctcccaggaccggaatgattatccctgcccgatgggtctacatccatccctgaatgtcgtcgggtactgttcacttccccgccattcttgtaaccgtcacctgtaatccgcgcgggtgtgtccgcacccccctgagtggacgagaaagaaaggatttctcggagcaaccccccaggttccagacccaggagtcaactttcccgtatgagcattcggtacatgtatcagtccgtgggaagaggtgaaagggtcaccactactgaggatctccccccccccctaatcttagataggtcgtctgagggttcgccgcggttcattgctgtgcttacacacaaggctacccttctccgaaagctacgcgggaccacctaccactagtcttcggccggaggggtttattgcacaaaaacggccgggacgcaggctcccgaagagggaagcccaacgaatgtcagatgcaaagttccgcacctcattaagatcatattggcatactctcccaaaaaaaaaagagcagaccccattgaagacgagagtaaggtacaacaaggccatttctgtccaccgcccttctcacggaaccgtacgtggacgttaccgctcatacagctcccagccagcaagcacagttagccttcctctacaagaaatggaaatgtggatgaatcgaatgaaatcgaggaattcggtttttcttttcagacatgataagtaagagcatccctttcacaaaaacctacggatccccctcctatcctgccacttcagcaccttgtgatctttgagaagatcattacgagccctttcctagaatgtttttgtagattccgaaaattccagagtggatcaggacgagaatgaatccgggaatccagggcatactcatcctggagcttccgctctcctctgggaagggcttttttatggatagagagatgagtcgagggattgattactcgactaaaaggagagggtagcctcccgtttgaccgatttctcggagtcggaagaagatctctcatctgatgaccctgaacaagaaggagctgctctcgatgtgagatcagcagcaaaagaaagaagaaaagggccatgatgatgatcctatgttcgttttcgccctgcccctatgatgcgctcctagctcgcagagcataagtcagcgcaaaggagagatacatcctttaagactgtgaagagaatccttggtttgacctacggactacgtgggaaatacgagatctaggcaagccgctacatgttctcccccttgcccttgaacgatagaagaactacttatcttctcttagatagcagtcgatcggttctatgatctatggtcaatcaataggcccacggatctattcttctatacgataaattgccatctcgtagcaccacagcctgggggtaagactagaagaggagatttgcttggtcttctgtgcggaatctgcttcctaatcagtgtagctcttgggtcagctcacagctaggacgtcatcagttctaaaggattcctcactagggagactctctccttatgggcaagggaggcagattttgatggggagaaggattcggaatatagttacataagtccccttccctctcctcaatatagtttcactcgagtcacgtcagtacctctccttttagtcgctcgtcgagacctcatcaactagttaatacctccggacctctcctttatcagtcgagtttgtgttcacaacctctcgagaaacaagttcgagagttacgtactttcaatgctctctctattccttgctaatcaaggcctgcaagggaactggctacgactataggcgggacgacatgcttttagcttccctgaaataggcgacttgctcgctttggcaggaagtattttttttgaagaattgaacaaaaaaaactgaaatttctgtaaatcattaaaacgggactttctttaaagaaaa

SEQ ID NO: 14092 - DNA, 3000 bp, Unknown
  misc_feature (1)..( 3000): cDNA_ID_2123774_gDNA_ID_2214698_Annot_ID_189589 3000 nt of promoter + ATG
agtaaggtaagccaggtaagccatgtcagttggtaagaaagtaatcccttccagagttgtaaggttagtaagcttttcccgtttataggaatgggtttctaagcctaggaagtcaaggaagttgtgttggtctttccctggttccttgttcccctgttgcctttctcttcatttcattgacgggttggagaaatgttcacgacgtaagtcagtggaagcaaacgggcaatcggctgcctaaaggaccccatttgtggttgaaggctaagttcattcttcgatatatatcactccgctatgctagaagactgagcagcttcagtttattaccaacctcgagttcaacaactattgggtaaagcctaaaccttactcctttccttctatcggaactggcaacagatctctagatccgatgcaactagaagtcagtcgattccgtctgaaaatggtttcagtccaaaccttttttgtcgagtgaaactccgcttcttaagagcttctttggacagactcactcccttactcgctgggttggcgtatccaaggtagcgccagcagcaagcgtaggggttactacgtaagtgcgttcgttagcgcgttacgttttctcgcttgctagacacgacaactaaggatagacgcgctgggatagcaagcaagtttgttgaaagaggggcagtagattctagatctgctgaaaaccaggttatagggctatatctttattccatggtagggctaggggcagggtggtttaaaataactccttttactttccctcctacaattacaatgggaagggacgagacaaagccttcttttaaactaaataaagtaggattccgctttcactgttctcaaggtatctcctgactcgaagattagggcttcttcccagccggaggcatccgaaactggagaatcatcaaccctcgcataaagaaacaactaaactatacgcggcaggttggtcaaaaagggaaagaaaaaggtgacatacattctattcggggacataatagtgattcctatcgagcacactctgttatatcgatcccaatcaatagtttttgggggaagtcgatggtcccccccatgctttatgacatcttttctcttctccgtagtgatcagtgtatgcacgtagcatcacagtcaatcttttatgcttggttccggtcgcgctcttcttctaactgcaggagcccgacagggctgtcttactctttttgttgctaatgaataacctttttcttggtgattcatttccaagggaataaaagaaagacctgtgactcattgtctcaatcataacttcaaacagaacctcactgtagagagggagacccccgaaagcgtaagaacgacgatttttgagcctgagggtgaggttctccatcgacgagtgagaaaagggcctggtctcggaagagatgcagctaacgtgagtaatagctgaacagttgcctaatgcatgtggtcagcatcagacaaggttataaaatacatctttacatcccggtcaaagtaacgaaaaaagacgagttttagcaactttttcatacagttttgccctcttttatataaaaaactaacttacgcaaatagtaaatgagaggaccttagcacttttcgttatggagtgattcatctaaaattcccggggttttgtgaatgaattcaactagaaaatctcaattgcacgggattcgcgattcggtgtaagttcaaaatttatcgtgctggacgaccacggttgagttttgttgtggatccaactccaagcgtttgcgggattttggatagatggaatactcttgcaacggagcttgtctgtcaaatctggtctggtatggtagcggttcataatggcagctcattttcctggaatccgggtgaaagatcttttctttccaaggtctttgctttctattcgacttagcgatggagtcgggtcggaaataaatactaagtaaaggcagacttacaataatacgcaaacaagggtcccgcgatgtcttgtacattctaagtactttgcctgctaagacgtgacaaacaatcgctgattctttactaacgagcccagtagccactaaggcgatccgaatgaggaaacgccggagtgaccgagtgtcttcaaaaacactgcgccaagagaccaagcggagcctctcggtgaatgtggtaaacaaattgaaagccatatcaatcggtataaaatgacaaaccttttggtatgtaccacaaaacactaagaaagaccccgccggttctactctccttgacccgtggacaaacgccacgtgatggacggcgcccggctctgacgaagaaccagtaagattaggtattgcctaatccgtaaggttgtcatacccttatcagctttctgaccaaacctctgtgttgccactttggtaaggaaagtccaccaaccgggcatagtacctcgttagcaggaccactattgctccttttaaagctttgtgctcaagtgatctgggagggtgtcaaacctcccccagccccttattcaggggatggtgccagggagtttgaactgttaacaaaagattttctcgatacaaagaaaagccccactcctagaatagttagccactcagtccacagattcggcttagtgaaaatagccctagaaagatcaaggtgcggaaggataatttcctccgttaatgatagctataccatagagttttccatcaaggaaagacaatgccttctcttctccatcctccaggtaccagggaagaactctatattccgggtccaaggatgatggttgcaacgccccgcgcttccaccaataagaggtgcgggggatggtgatatcccttgaaagacataactaacttacaagacttaaaatgaaaagtaaactaacggaacaaggcgccggaggaacccccttctaaaagtctaagagctagaaggcggggtacagcggttgcttcctgtaagatttgaatagtcatg

SEQ ID NO: 14093 - DNA, 3000 bp, Unknown
  misc_feature (1)..( 3000): cDNA_ID_3046155_gDNA_ID_2214698_Annot_ID_189597 3000 nt of promoter + ATG
gaatgaaagcttctttacaggacctcttctatttccctccattcttcttcctagtgacctaggagttgggttcgtgacattttttctttctgcttattcaagtagcccggtctggtaagtaaggactttgctctcaatagaagtcaaaaagccttcaacaagaccacatccgctattgaatcagctgctatagacttagctaaagaatgtcttgcacgagattcaatgttatgtgcttgattgcgatcacatttttctcgtagttgatgagctgccaacctccggaattgagggttgtaggtagagtttcctgcgttcaacttggagttggaagagttggatttggagtttataaaagctgttattagttccgactccccggtctaggcctggtacttgttagttctaaggtatcagtgtcgctactttctgtaaaaaatttcctgcgaagggaagcgggaaagacaaggtttcgaatcttggtctaagaacttacactacactacggaggcacgggccaagagatcataacagtcaaatcctcaacctcacaagcagacaagctggtggatcatctgatcttgaaataggtcatcccagctatcccgatcttttctctctttatttcgtcaggtatctgaatcatacgattcctcggatgtagcttttcacattggaccaaaacaaggcccggaaaccccgctagctttgttgatagaaagttagcttcccgtgcttgactagtagggctaatgaacgacccttaactatggaatgttacgcctttcctcggttactcacaacgtaatcaactccattggttattttccccgggggaacacctatagccccaatagactgatttagtaggtatgatgtattactaggagtctctaagttcctgctttggttgtccctgtccaggctaagcggagtttagctttggccgttaataagagcttccctccattccttcagtccagtcacgcttttcttttcggcttttgcttcagtctcttcttttcgtcctttcaggtggcatttcgcttagtcttgtcattccttccgtcatgctactgtcatgtgctataaattgatcctcccgtctagtgtttcctctctcatgttatacagaccgctcctttaatccaatgaataggcggcgagggtgacaaaggcttagaagcaggggcgggcagaagcagcattaattctttcgcccgcgcgtacatattctattgagcgtatacgatcattgagctgatcaccggtggcttcctcacttgtgatgtgaagctgctttccatttctcatttttgaggatatcgatattctcttaagagaaagggtagccttttgtcacgagctggactcgaaccagcgcgtctggcaaaaagaccatccagatttcaaccttagactgatcgtgactttggttactcggttccccacgcgaaccccacacgccatgggtacgtccgaggtagattaactacgaacttttttcaaaaaaagtgtgatatattttcctcacttactagcaaagaactggaccaggattcgtccttggctgcctacgtacccctttgggaatcaagtaaatcgtagttctcttacttattgtcttctttctaagtcttgctttcttctctctttactattgcttctttttcttttctttctataaaatgttcctcaatagcactgattcttcatatatttttgtcaaagcaattgggttcacaaagcattattttctcggtccattttccacctctttcttttgtcgaaccatgctaagcaaagatgcacggttccagtcttctttccctccccgtgtccactagcgctcctatcctctccttttcagtcgagtcactagggttcctctccttttagtcgagtcattagggttcctctccttttagtcgagtcattagggttcctctccttttagtcgagtcattagggttcctctcctttttttagttgagagttacgtcagtaccttttagtcgagtggcttctcgctcctgcccagaacgaagagaaggcgaaaaagcgccgccgaagcagcatgagcgggcttctattgctacgtaacaatagagcaggatagcattttgcgcccacatgtttgaattttagggtaaaaagctcgcttgttatacgggatccgacgcatccagcagagcgaagcagcgttccattcttttcggcggcatccttccgcattggcggcgagtggagtgccacaatcccattcatcatttttgatctacataagccaaagccctccgcactggcgacgtccccggcataaatgcaaggaggatgtatagctgatataggatcttgtggaacaggatttgattctgcaagcggttcggtacaaacaaagaaatttcgaacaaaaggatcggaactcgctgataggaaaggagagaaaaacaaagcaatgccaagagctccgtcaattcgctgttcatcgatagacgaagctctctctttatcatctcgtgccagatgcaacaaaggatgagtcctttttccttctcgcgaaccacgggagcgccaagcgtccagaggatttttaattttcctttcaggataaagcggcgcataaaaaagggctggtccgtcaaaagtccggttccttcgcgaacgaagttcagaatcaacaagggttcgtagaacgaagggagtgtacaactggtttttcaaaccactttcttgttcgtaacgagggagagataaaattgagttcttcacgaagttcgagacaaaaaaaaaaaaaagactttccctatggcctccttgttttaagacattatggctctggggtcgaccccggtaacaaagaaaaaatccataaaaatttgggatccgacaccataataaaatactaccctcatgattagaccatgttcctgagatttgataaaagaaaggtgcattagcggttaatacgttgtaattggataagttattaggaatatg

SEQ ID NO: 14094 - DNA, 3000 bp, Unknown
  misc_feature (1)..( 3000): cDNA_ID_2161890_gDNA_ID_2214699_Annot_ID_136827 3000 nt of promoter + ATG
tagtatatgtttttttatgttctttttttctttgtcattctcttgtccttcgtgacactatgtaatgattaaaagcaaataattgatgcatgagttcaaatgttctttgaaggatccatcttattagctttgtaattgttgtgatatcttaatcttattggttacgtatttcaagtgctttagaaaaaatgggcctaagagattttggggagcttttttggcttgttattttcctcacatatacaacttgcagcttattatttattgaaaatcttttcttatctagattcaaaaagatttccacaaattttaattaacgacccctgattacaaagaaacctacccaaagtcaaattttgtccataatttctatcgtgtaggacactaaaaagtaaaaactcatacctaattggtttctagtagaaacggtcagtgcactatctttctttcaggttatcgaaggaaaaaagatcagtagagtagcatcgttaatagtagagttaagaaaagcatgtaacatgtggtctactttttatttcacagaaaaataccataccatgtgataatgtcgcataaaatctttacttttccggtgttatcgatgtgtgttaatgctaaatacccgaaacaatttcaagactcaattttgaactatcgaatagaattcttctaaaatggatgaggaaaaagtcgctggtttaagtcgtgcgaccctcaaaataaagttaggaatataatcacaagctgcatactttcattaatcaatttaaaaagaaacgactaactttattctttctttgccaaactccataattagttaagtctatgaatgaatgtgaagagagagttttacatttaaaattgtaaagggcaaattatagaaaattctgtgtccaccaattaggcttggctctttaactcactgttctcaatctttaataatccccatcttcttttctcctatatgattatctctctttccttcgtgcgtgttatctctctgagccacatgccgacacttacataactgttgaccaagtctctcttccttctttatcaaatcatgcaaccttcaagaacaagagtttcattttttgaaacaggagagaccatgaagcaaagaaagaagagttatctctcaatcttcgtgatcttcttctctcttttcttcttcgggatcttcatgtacaatgacaacctcaaatcctccattgctgacttcacatcttcgaacccattctctagttcatttgtggagttgccgccggatgagtgtgatctgttcaccggtcaatgggttttcgacaacaagacatatccattgtataaagaagaagagtgtgagttcttgacggagcaagtgacttgtttaagaaacggaaggaaagattctttgtttcagaattggagatggcaacctagagactgttctttaccaaagtaaagctaatgtttcaagatgccctgtttttatccggtttgatcgaattggtatttaacaattgtctgttttatgattggtttgatgaagattcaatgcaagagtgttgttagagaagctgaggaacaagagattgatgtttgtcggtgactcgttaaaccggaaccaatgggaatcaatggtttgtttggttcaatcagtgattcctcccggtagaaaaagcttaaaccagaccggttcactcactgttttcaaaatccaggtaataaacattaatccacttgtgtgacactgacactaatgacattatttttatagtttcttactttcttgggatatgcaaaactgaaatttaaaataggactataacgcgacggtggagttttattgggcgccatttttggtggaatcaaattcagacgatccggaaaagcacagtataatcgaccgtataataatgccagagtccatcgagaagcatggagtcaactggataggcgttgactttcttgtcttcaatagttacatctggtggatgaatactgtctccatcaaagtcctgtaagtagtaatgttatagtatacacactcacacatacttatgtattgaatatcctaggattgaagatttgtgatgatggaaacagacgtggatcgttcgatgatggggacacagagtatgatgagatcaaacggccaatagcgtacgagagggtgttgaggacattgggagattgggtggaccataacattgatcctctaagtacaactgttttcttcatgagcatgtctcctcttcacatcaagtaataaatttctcccatccataacattttttttttgtatctaatgtttatatttgattgttgttctgtttttgttttaggagctcagattgggctaatcctgagggtataaggtgtgctttagagacaacaccgatcttgaacatgtctttcaacgtggcttacgggcagttttccgcggtggggacggattacaggctgtttccggtggcggaaaacgttacacagtctctaaaagttcctattcatttcctcaacattactgcattgtctgagtatcgtaaagatgcacatacttcggtttacacgatcaagcaaggcaagttgctgacgcgggagcagcaaaacgatccagccaattttgctgattgcatacactggtgcttaccaggccttcctgatacatggaatgagtttctctatacacatattatttctcgaagatgagattctttcatcctcttttttggtttaaaaaaattcttgtgatgtatataggacagagattcaagggatttgaagttagccaagtaaggctaaaaatttgttgaataaagtgtacaattcacagggaaacacagatactataatttcagtaaatgacaagattagtaggtgtgtattatcagctacatgattgtaaaagatgttgaagtagttgaagttaaaacgttttgatagaccaactacgacccaacattcattaatgtcaaaaccaattttctcatatcgccagaaaccgaacacaacgag

SEQ ID NO: 14095 - DNA, 3000 bp, Unknown; identical to SEQ ID NO: 6149
  misc_feature (1)..( 3000): cDNA_ID_3079672_gDNA_ID_2214699_Annot_ID_189611 3000 nt of promoter + ATG

SEQ ID NO: 14096 - DNA, 772 bp, Unknown
  misc_feature (1)..( 772): cDNA_ID_2706651_gDNA_ID_2214700_Annot_ID_136835 3000 nt of promoter + ATG
catactattctcaaaactcaaacaaacaaaaaaatcaattttgaaatataattatttctaattttcatatttttgtaaattgaatacacaagcgttcgtcgtatacgaccattgttttcagcgtgtaagtttagcaaaaaaaaaatcttaaaacttgtggttcatttggaaaagtaagaaaatatacacgaacgtaataaacacaaacaaacaattgaaacatgaatgtacaggtttagtgttattatctgaccacattgtgcgcgagtgtggaccatgtggacgttataagtttcatcaaaccaagcatacatatatatgtgcgtcaacgtagaccctcaagttttcttgattttcactcgaatcaataccgtatactcatgttttatcgtaacatagaaaaaaaaaaaatcatggactttctcaagaatcaccaaaaaaagcatgcagcttcataatcgaagaataagattctttaaattgattgatgagcgtctgcactatgaaatgtttcgatttcaatcttctcctccaattttcttcttcattagtcctttttcgctcccaatatccttcatgaaatttctctataaatagagacataaagcattaacatgcaatgcaacaaaacttaagaatattagagtcaaataaattttaaaagaaagttgacagtaaaaaaaagccttaaagaaaaagaattagaattagaccttataaaaaaaaaaaaaaaagaattagaaagattgttctggtgagtgagtgagggatg

SEQ ID NO: 14097 - DNA, 3000 bp, Unknown
  misc_feature (1)..( 3000): cDNA_ID_1985614_gDNA_ID_2214700_Annot_ID_136836 3000 nt of promoter + ATG
tggaaactggatcgtagattcatatacaattgagaatttaagatcatgccaaaggcgattgctgatatcatatttatgtagcttttgtactttttaatagaagtggacacaatactgatatcattagtgaataatcttttcatatctttcagtctaagtatacacaaatatatcgtatatgcataaaacgaatgtctctcattttcgtaggaaagaaaacacaattaaaaagaaatatttttaaaaagcaatgtgaaaagaagttggtaacttgaggttcacgagatccaaatgtggatgaacgttggaacagctaaatccacgtaataaaagaggacgaagcttatgattaaatttggtcagttaagattctcatcctatgcaactacctaatacaatacaattaatttgtctccctcccaaattcattcaaaatttttttttgcttggttataatctatttattttgaatctggtggctataatttttcaaaaatctatgtcaagtaacgtatcttacgaaaaaaaacactgtgattaaattcatcggaattactagtctcatactaaattctacaaatagatatcattttctcttgtaaattacacaacaataacaaaataacaacaaaaatcattattttcttctcgttgcttttattcttacgaactggatactatctttcttatatgtaaaaacaacacgtaatatctaataagtaaagtagggaaagtagacttacttatgttacatagggtcccccttattaggctacatatgtataagcaggaagtagacttggcatttgaaatagacggttgatatctccctgtcactatttatccatccttatgacctttcggcgggaaattcgaaatgacatttgcagattttcttgttttttccttttctttttttgtttgtccactccacttatatctttttttcttttggggtttttaatcgcatcctacaacatatcactcggatagggtaaattgccccaaccaaccattcattattaattaataaacctgacgaggaaaatgaatatattttggtttcaaatgttttgtggaatgaaggcagagagaaagacagcttctgtaaaagcatttgctggcagacacaaccctaaacccaccttcacttgcctcacctcaccactctctcttcctcgcgcgtgtctatcacttccataaactctcattgcccataattgcttgttttctttctatatgccaagcctgataaatctcgtagtaaattacgggaaaaaattggattccacctcacacaataaagcattttacaaaaccagctttatcattgggttttttaacagattatagtattgtgggtgctcttaatatctggtacacaatagtataaggtctatcgacaatacagagtagactccgggagacaagagaagccaactaggggcacattttttgggcgtaactagacattatatattaatttaaaacttttgagtttcttcgttgaaaaacaattatagaatatagttttgtcttcaatataaaatgagaaagaagagaagaagatctgttcccgctcttttgacttaacggtgctgtcgttttcagcaggttaacctcgaccccaccctccatttttcacttccttctttttaaattattttctctatcactaaaaatatcaaaaaggcgggaaaatcacctattatccaattcagtttataaaccggtttcggttccgtcgttaacggctgattcttctgaccaatgaaaactcgtgaagtctgacggagaagaagacggaactgttaaaatccgttacgtcagacggagaggagggagagggacggatgactgaataaatctgccgaatcctgctgaattgccacgtcagctttattcaaaattctctgagtggtcacgagatttctatggactcttttttttttgttaattaaaagtttaaaaccctacaaaataggggtcttcaatggggttaccagaaaaaaccgaacagtcgccgattccttggtttaatctttgaaccgacagtgtgaccttttaattttctaacctttgctatattattatgaaaatcagatgtaattatttagtgccattcattaacgtgattcttacttataattcctctcatgaatactaaatggagtgtatataattatatttagcagtaaaaatgtattgtattgattgttggaaagggaggaaaaaatgatgagaaggatttgcatgaggaaaagagagagaaggcgtaattatcaagtgttcgatacttttgattagcccacacatttataatattttagtgtagtagtgagatttttatttagggttttaattagaacatagtataagacattggagctgtaaatgacaacttgtttgggatttagtgggttccacctgtatttctcatgcccttacacatttccacattaatatctatcttatcttataaaaaaaagttccaaagaaaagagtgagatatacatatattagcaatatgagtttaatgtgccattcaaaataaataaataacattttgaagaatattaagagtctcaattaaaaaatatttaacttgttctttagtgagttacatccatatcttaagagacatgtgaagagttgaatccaaatgataacacaccaaaattgatggtttttaaaaaatgtgaatactattactgtttttttctttggatttccaaggcaaaatagttaagaaaagaccaaaggaaaatagttttgattttcgtccatcacgcattaattacggataattattatattaagaaggaaaaaaaaaaacaaaaaaaagcagaagtgatattaaagtgcttttgagctgtctcgtagaaaccatgaaaccttaataaaagcaaccttgtcttcaacattctccatcttcctcctcacttaatccccaagttcacacttcaaatccactctttctatttctctccttcttcttct

SEQ ID NO: 14098 - DNA, 3000 bp, Unknown
  misc_feature (1)..( 3000): cDNA_ID_2710916_gDNA_ID_2214700_Annot_ID_136838 3000 nt of promoter + ATG
tagcagctcaagataaatttgaggacaacatcattagttccattccatggttgactaaatttatttgcaaacatggatacgcatatcgtacatacgaaatgcatatctctacctactattcgttcgtacaatcatttttctccccatttttatgaagttataaaattaattaaaaaatttataaaagaaggaaaagcacaaaacacctaactgaattaaaatagaaaaacaaacagaatcatgggctcagcttaaaaagcccagtatggactatgggataggaatataaagactgtggagatgggtggctcctaaatgtgaacaacccgtggatatgtagacagatactcgtcttgagagtgctcctcatttactgccagatgcaattaagagtgctcaagtggcctctacatcaatcatatgtcttgagcttgaacatatggttgcgagggagggtcaaacactatttcaacccaatgaaactggcagagaagcggtaaaagaatgttttgaatggactttcaaggactcaatcatacctcacttgcacaacccaaatttttcgaacccaatattttcagatcccataatgacctattacccattcatcctcatgcacatcttgattcaaaactttcttgtgtgcaatttttttattacgttttattacaatgtttgagatgaaaatgattggcatctacatatcatatcaatcaataattgtactcataaaacttttgttagtcaaatttttaccaaattatattcctaccaaaataaagatggtccaaaagatgttttctcctttctctttcttttcggtgttaaaagtaattcaaagtttgcttatagaatattctagactttgttgttgtgaagtgaccttgaaactaattgcgtccacagcagtaagactcctttatggtccattattaaggcacttcacagcatctagggtataaacgagatatacttattcctaagtaatttctcaactatcatatagaaaggaacgtttgttttatgcatgttaatattactaccaagtaccaacatctaaagcggtaactcaactgcacgagtgtatgatcaatacaatatcagtaatattagccaaatcacaatttttgccttaaatgatacaggcttttgtaaccatgtaaaacttttttttggaacttaactcaatctaaaattgtcatgaatatgttcttttttcttcaaaaacaatattcatctagaaccccacttggaacaaaaactactgttaaagaaaaggaaacttcactatagtcgacaactcgatatccacatctaaatacttatttataattattttattgattggtaatctatttgtattatattctctgcaaagaattttgttttgtgtcatggtcagtgagtggcatatgatttcagtaaacacaagtcacttattatgcaatcatgtacagattgattcaaaacatatccgttaattaatttgaacagttggagatgtataaagtctgagttggtacttccaaatggtttaagatttataggaagttgtgtcctttctggcttctgccattaacctcagccaatagactgtaacttgcatggctccgcctccaatcaacttgctctctagaatatgttgtactattaaattaaacaatatatcgataaattcgatgaaaatcccaactgtaattttttctcatagtatcaattttaaactttactgtattttctaaaggcaaaagaactttctattatagataaaaaaaaaatattaaaattgtgtaaaagagaatgtattgaagttttaaatgatcgagagtcaaagacattatcatttgactagagactaaagatgcacattctgtaagatgttaacttaggtataaactttttttttaagtgtgatgtagaagttttccacgcatatcgatcagcttaaccttttatttaaactataaaacaaatcactatcaatagttttacttaacgtgtttccttctccatatcaaacttatataaataatctaagaaaaaccataaaagccaagtacaaacgtatataaatcgggtatttctcaacctagatatattttggtaaagtattaagaaaacaaaactgtatccaaaattggtagcttgagaataacatataactaaattaatatcgtaaagattgagaagatcatcacttacaaacattcaacaaggtagcttcgacaacaacacaaatctaatgtgtttagatggttccatatttttaaataaaaaatcagtttgcaaaacaaacaattagtactaaaatagtttgtttttttctcacttaaaatccatatttccctagttcacgtacattttcatttattattcgtcagcaaaattattatatcttcttgaaatgatgaattcaaataaaataagcaaaacttggcaaagactcaaaatagcacaactagacaaaaataccagctaacagaaagtaataagaaaaaactcaaataaatggaaagacattaataaggcagatatatgtttttttatattataaattgtttttttttatagtataaaaataaaaatatcggcattcttataggatcgatctctcatgcaaaacaacaaattcagacaagaaacctcaacggctcagacccaccaataccaattttttaaagagatttctgtcacaagtaagaaagaagcactaattacaaaaaaaaagaaaaagaatcaatcttttgttcttcgattcgatttctaatcaattagattgtttttgttttgtttaacatcagttgcgaatcgagctggattcttgggctcgctttttctttcaatcaaaagtttcgatattagtgaaggataaaattcgctaaaaaaagagaattttttttgttaaaaaaattataaaagctggctttctcaaaatttctccatgtggtcgacgaagaagacgaagaagacgaagaagaaagagaaagtctcttagcaaac

SEQ ID NO: 14099 - DNA, 3000 bp, Unknown
  misc_feature (1)..( 3000): cDNA_ID_1808783_gDNA_ID_2214700_Annot_ID_136839 3000 nt of promoter + ATG
gttccaattgttgttttgtttttcaatctggtttcgataagaatgtgtttgcttagatgtgtcgaaaaaagttttgttttttttaaatgtacggagattgtttccccaatttcaatttctttaatgctttttttgattaaaatatgaaaatggtatcaccaggaagaagaagtagaatctgactacttcaaaatgttgactttgatgattttaacgatgacccttttgaaaaaatgttttctttaatgatcctggaaccataagattgggaaattttcttgctttgccaaaactctgctttctataaactgagatcatgttttgggaagcttatactatgttttgtggaatgtgcagattcatggtttcaggtggcgttcgttttgaccaccggtataaacagcgcgtatgtgttgggatattcaggaacaattatggttcctttaggttggattggtggtgtggttggtcttcttattgctactgcaatctctctttatgcaaacactctaatagctaagcttcatgagtttggtggcagaagacacattcgctatagagaccttgctggattcatttacggtaaataaaagaccaaaccagctctcttaatctcttctctgttgttaccttcattggaatgatctctctttttatcaggtaggaaggcttatcatcttacatggggattgcaatatgttaatcttttcatgattaattgtggattcattatcctagctggttccgccttaaaggtagtaaaacattttcttctcttgattcttgatttcgttagacgagttagttaattttggttgtgtgttctgtttctgcaggctgtttatgtgcttttcagggatgatcataccatgaaactacctcattttatagccattgctggtttgatttgtgcgattttcgctattgggattcctcatttatcggctcttggggtctggcttggagtttcgaccttcctcagtctcatctatattgttgtggcaatcgtgctatcggttagagatggtataactaatcaaatgatcatcaagattcaacattactaatgagtttaactactgcaaaaatctaattcttgctttgttttgtttgtttctaggagtaaaaacaccttcaagagattacgagatacaaggatcatcattgagcaaactttttaccatcacaggagcagccgcaaatctggttttcgcattcaacaccgggatgcttccagaaattcaggtgacttttccctagacttcaaagttcaattgtttgtttgtgtttgcttttatgtattagtgtaccttttgttcaagtaaaacctgcatcttaaacaaagtttgtttgttaatcatattgacactataatttccacaatgttaggcaacagtgaggcaaccagttgttaaaaacatgatgaaggctctatactttcaattcacagcgggtgttttaccgatgtacgcagttacattcatcggatattgggcttatggatcctcaacctcgacctatctactaaacagtgttaatggcccactctgggtcaaagcccttgctaacgtctctgctatccttcaatctgttatctctttgcacgtaagtttcttagcgccaagtctacgcttttttaacaaagactgtcgtctctaactatatgtctgactcaattctttgttgtagatatttgcgagtccaacatatgagtacatggacacaaagtatgggatcaaaggaaacccatttgcgataaagaacctgctgtttaggatcatggcgagaggcgggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatcctttattcttaggcaggtttatttctcctgtaagcttgtattctctctctatttgtcttaccattagagcctaaataaataaatcaagttctaaaatctaaaaagcatataaaagaccactttcatcataatcattctgaaaatttaccaacaaagaatactaagttgcatgattaaagtctctattagaaatgtaaatcatagtattagagaagaacataaaaacacctaacttaaaaaaaccttaatttagtgagatagagaagagaagaaacagaattgttgttggtttaacaaaaacctaatctttcaatgattagctgtttaatttgaaattataacaataatttagacaggccaaagtggaaccccactgtctccaccaaagctctagataaaaaaaaaaaaacgaaagcgttagatattttttatcaatcgtgctccgtaatcattacctttcttcttcatcttcatcttcacgcagcgacttctttgattctctctttttattctcagctccaatttcaacctgcatttctctcttctcaattttgggtttctttttttgatatctcatttgatcagatcgacgaagaggtaaccattttgccgtttgttagttcttaacgattttattctgttaaaaatcagatttttttttgcaatgcttgtagaaaaagattcgatttttgtgtactgattgaatcaaaatatgtggttatggatccatggattgatttgtttgaactgatgcaaatggctaatgtgaaaagtcaagaatgtgttaatgtagttttttttgttaaacctctttgtgttgttgggttttgaaatgttgttgttacagaggaagaaggtttgagctgagagatctttggaggtagaaagaagatctcaaaaacg

SEQ ID NO: 14100 - DNA, 3000 bp, Unknown
  misc_feature (1)..( 3000): cDNA_ID_2706056_gDNA_ID_2214700_Annot_ID_136842 3000 nt of promoter + ATG
atgtgatagtgacaacatgagacattgaactattacaaaatgtctctactttatctttggaacatataaaactatattttacagaaaactcttgaaaacctatacacatcaaacttcatgatctcatctttcattgtaatccaaaacatcatcataggtaaggcttggaagtttgaacagacgcttgctttgccaattccactggcctcttaacacatccatatgattaccaatgactccaattacgcggtgacctctttctaactcttccttttgtcttgtatcttccctgctataagataatataacctctggctttatgctactttgatgtgaataaaattagtagttgtaaaagcttattgcaaacctcataatcaaatgtgaccagtcgctgtatcctctagattttaactgctcgattgtggcgttccgctctgtttcgggtcttcttgataatagaaccattgaatagccttgtgatctaagcttagaatatagtgcaagtattagtatgcttttctgatgctttgcttcttcaatatacttcatgtagtaactatcttgttctaatctacataaagagaagaacaagaacgttaacagtttaaaaacttacaaaatgttaaatgaaaaacaaaacacttacagattggtgtcatcaatatcgatcacaacaacatcgcagttatcattcatcggtttgatggtttggaaataagtgagagccatttgaatagtgaagtttaactctctcaagtaaattccttgtttgattctgtgtaaagcaacatctctacataacagtggtaattcactttcttcatccaagctattgagctgagagtgtaaagacaagattttacagtaaccgaaactctcatcgagtctttgagcctcgacgattgcaatattccggttctcacagctttgtaacatggttgataaagcaataagaagtgttatcatcaaaactccaaatgttactagagaagctatgaagatggaagctgctaaagatgtcatgtaacatccagattctatcgaataccgactccccaattctgcaagataaacaagaagatttatcaaattcaagaaaatcattgcaataaatcaaactaaacacagatggtagaagataatgaatatattagtacataccggaattgcctcggctggatagaccggagagctccctctccatcggatgcgtataagccgacattttcaccttcttgtctaatcaaacacttacgatgatcataaaaacatcatctatagttttagaagacaaaagagtgactactaagaaagaaaaaaaaaagttccaaaatattgaagatattatggatattgttttgatattttccataccttgtagaagcttcaaaaccaaaacgaatctttattttgatcaagatccgaaaaaaaatccaaaggttcaaaatctgcctctttggtcacaagaaaacagagaacatataatacatttacacgtgactttttttttttgtgtgtcatcagatccaaagttgatatgcctcagcttatcttctttactcgatcaaataaacttctcttctcttcaatttttttttaaaaaatcttacactagtttattttattttccaaatttggcggagacataagaaaaaggaatcagaccaaacttttctttatttagctgctgatagatcgtttcatcattcctttactcgattatacaattatcaaatatatattgattagtcaacacaaaagtgaattattgaattttatgttgttggacaaagtaattttaacattctagttacaagtaaacttgcaagatggatctatatatagatggaaagatttgtgatgtgaaaaacatctactcgtatcgtatgttataacaactcatacggttgaaaatcgtgtacagtaaaacctctataaattaaaaatgttgggactgctaaattttattagtttagaaagatattaatttatgtattatacttttagtatattgaaccataatttgtacgtatttgactcttatgcatttacgacaacaattttttaaaccctatatatgttaacaagtaaataagtcattatcattaggggtttaaatatctgaacttgaagaatttgtaaaacggttctccgcgtcatcagtatgtataatatggctggccactccttagaccgaagagctcgttgtataatatgttttattttagattttctcaaatctcgcggagacatggaaaatgaaatttattaaatggatggagcaatttggtaatttaatcagtatgtctgtatgtgttttgtaatgttatagtttaagatatgtatcacaatcatctatatgtgacgtatacgacaagaatttaactgtacgtacgatacccttataattattattcacttagatttttgtttgtactttagaagaatctgaagaagggtcccggcgtcaccatgcatgtatggtcactccttaaaccagagattcgtaaataattatattgtagtttccattgttattgtcgatttatttatggtccccaatgttctcttggagtcgagggaccatacatttagcttcaaaaatcttacgattaggaaacgtgtgacaataacatttgttttgttagctacaattcctaatttcctatgatttgtacaataatttaaagattaacacagcttgtgggatgcacatggaatttgtctaatagaatttagttccatcatatttgcatacaaacaattgtcacctattaatactttcattattactttcgatgaaacattgttattgggtatataaattaaggcccggccctaaagcccatttattagccacgtgcagtaacttattatttttttcacttatcaatagtaaaaaaaaaagatcaaaatgatcactcttttgagtgtgagtgaacacacttcgtcgtctctctttcactacttttgagaagctctcttcttcgagcttcc

SEQ ID NO: 14101 - DNA, 3000 bp, Unknown
  misc_feature (1)..( 3000): cDNA_ID_2706036_gDNA_ID_2214700_Annot_ID_136843 3000 nt of promoter + ATG
tgttctgtaaacagttctgcatgtttatctggtagattcttttgatgtagtttgaattaagggtaacttgcaagcatttaaaagctcttggacttgatccaacttctggttttcagcatctagtgtttatttgttagtgcttttgattttgatattagagtgtttttccgactgatttcttgacgttttatctcctattggtcaggggtaacctgagccttatggtcttgccaacatctgacttgagactctcatttattggagacaatggtcattcagaacaactctttacctataccagcaaatctcagtgctctgcggtgtcaattgaggagataactgtggacagctctggtagatcttttgttataaggatcgcaaatggcaatgctttttactattggtgctcagagaagtcaaaacttctgggaactgaattgcgtaggaaggtttgtgaaatagtgttgttttaaaatccttgtctgtgcatctaaattttctcatcatctgttgttatcctgtgtagatgaaagacttgatcaagaagaagccatcaatctcagaattaactggaattgaagaatcacgtcttggctctgttgcttctcatctccgtttgtatctcatgggttcagtggtgcctaacatcaaaggttgtcaggtcccatctcctgattcatcatcatcttctggcttttctgaaacagctgattcctcctcgagtgcatcatcaaaatctcttagagcacgccactgtgggactcaacagacaaagacccaaggaagcctcagccctagagcaagctccttcaaagaaaacacactgagaaatgcttctctacgtatctcctctagagataaatcaaagggacacagtgaaggccatttctcaatctttgataattcatccattacctctatccccaccaatgtagagggttttatccagtcagaaggagaagttgaagaagctactgagaattataatggaatcagacaaattattgcttttgaagaagcagagtcaacaccaagtacaatgaccggacctcccccatttcctttgaagatgggtccaccagtcttttctccttattattgctggtgccctccaaccacttcatcgcttcacgcaccatctgcctcttatcagttccctccactatccattgagctaccttcccttccgccactttcctccttattaccagcatcgggatcagatggattcttgatcccgtcatcaccgctcgatctctctgacatccctccattaccattagtccaccacatacccattccaggctcatcatcatcatcatcccagcaacagatgatgattcctataatgtgcgaccctattgttcatattccagttatcgatatcttctcttcaggtcaaagctatctggtaagcgctggacccaccgggataatatccacgggcatccctccgctcccagtggagaatgattcgctggtcgagaaaggtgcaagagaaacactacgattgctcataagcggagccaatgcaacaacatctacacctttgaaccatcatggaagcagaggtctatacagtgtgagccgggatgtgagtggtgtgagcttgtttgcacctattgggttgcaacaaccgagttcagttgagggaggagatggtggtggtgagagtgtgagctcaagcgaagcagtgcctgcgcctcccagagagacttctggttaatttttttggttctttgtaagtgtggtccgagttaagtgtatagaaaactcatctctcgcctagtttttggttttgttcagcccaagtcttttggtttcaggtgtaattagtcgggttttttgtagcttgcttatattacctttgttatttccgagtttcaaatgaagctaagaaatacgatcataataaaaaagttcttttgcagtattcattttctttcatggttccctccttattcatagtcattgttgttctttctaatacttttcctgagctttttttttctattggaaaaacttttgtcactgaaagaaatttcaatgtgattggttcttttcgcaactgtaataagcactaaaagttaataatttgctgctttttaagtcttgttgctgaatgatttaatcccaaagacgttaaaaaaaagacatgtaaatagtctttgttccaaaagtaccattttgagcgctttctttcgacaattgatgttgaacttgtaccaaataaaccttgaaaatcatacatcattaaatgtagttttttgttatatacttatattcatatggtccataatatatagttaaccatattatggaccatataaattcatgcagtcaacaactttttttttcctcattaaaagctactaatactgtagaaaatttttatcttacaaaagaaaggagaattattgtatttttattttaatcacatataaagcaaccaaagataacatatactagtatttagtatttttaaattttttgcttaggattcaggttattaatactctataaagaaataattaaatctatccatcgaataaatcacacagcttattggatcagttaaatattctaataatattgtcgtgtagctgagatctgaccactgcaaaaatgaaaagaaaaacatagaagtagagagaagatcgcatctcgaccgtcaacttcagtgtatgaaataatgatcgtcccacttgatcctcaaaaatattattaaccaaacaaaatttgattccatcgtcccactttcttcttcttcctcccaatccgcctcttcttcctacgcgtgtcttcttctccctcactctctcaatctctagtcttctccgattcaccggatctttcctttcttacttctttcttctcactctggtggttatgtgtggatctgcgacctcgatttcaattcgaagtcgtcggtttcttctctaaatcgaatctttccaggattcgtttgtttttttcttttgtttttttttcgatccgatg

SEQ ID NO: 14102 - DNA, 3000 bp, Unknown
  misc_feature (1)..( 3000): cDNA_ID_2706032_gDNA_ID_2214700_Annot_ID_136844 3000 nt of promoter + ATG
gagaacagggattttttgattggatgcatcgcattatatccttttttctcgaattcaattgatactttctgctttctgcttgactctcatttggttggtttccagtggctaagatgaaatttaagaaaattgagattagagaacttgtaatgtggctcgaattctttgtgcttagttagcattagattttggaaaaccttcttgtatctaaagtatgactatagaagctgatcgatatatgtcttgtatttggataattctgaagaagatgtttggtccttgactatatgacacgtatgtagtgttgaatgcggtgttgcagctgattctgtacactaaggagaagaatgcgattttgttcacctatcctcctgaggtttggtctctgactatttagaaaagttatttcattgagaagtttcgtggtttgggctacattcttgttttgtctatgatgctacaattgtattgtatttctgtgatttaggtgcataatgtaccttttttccttgttcacttacttttaactggagctatagtttgaattctggtgtcaaacttttgcattccttttgttttgtattttgtttctgcttgcctgacatgttatgtaaagtttgcaactttgcatatcttaaggcatctttttttttttttttttttttcatttgagctctaggcaaaactacatttccctttcaatgtattgttcaattagttttagtcttcaaactttagattttgaaaaatagttgaacaaaagtttttgatgtttgcaatcgtttctgtcttgtttctcgaaacataattgttcaactaagtggaggattctggactgtaacttgggtggtttatttctcattcttaccagcttgaagaaattactcctctcatttagttagtatccgagacgatgagatttttttttccaaacatttcattctgtactcgtttagttagctctaggaaacataacaaaaagagctcagacattttgtctttctgaagccatgttaaattgatgcaataatttggttagtgggattgcttcattttgttatgtcaagactcaagatcctaaagctctctggttgatatatatttgctcactctcatttgttttgctactgttcaaacatgtatgtttagctcatcatttggtgctcctctttggaaaaatcttaaaatctgatggttgatacgcagggatcattcaccagcactggtttggtggtatcttcaaagttgcccagattctctgatcagtacactctcaccatcgacagtgctgatccaaaatcaatctcagctgggaagtcagttcagctcaccaaaagtgtcacccaatggtctctctctcggcatctttcttacaattgctcgctctgttttccttacatgagtctcattagatggtttctctgtgtgtttttcaggttcacgaaagatggagttcttgttgagggtttattctggaaagacgtagaagcactaatcaagaactatgcagaagaagaaccaaagaagaagaaatgatcatcttccagagaaatatatgcttttgaaactccatatgttggcgttttagaatactaaatcgatggtgactttgtttagagatgaaactaatatttggatttttccttatagccaactttttgaattaatccgagattttatgatcactatttagaaaagaataaaaagctttacctaagttagtaagccaatggctcacatcaagtatatgcttgtcgtttagttatttgtactagatcatacataaaaaaaaggtcaaatgcttcacgaattgtggatgatttgattcgtaatattttgtatgattgatgataaaacacctacatatgatatgagtggcttggatgactctagtctctttttagacagccttttctttctcgtatggcttgggaaagttcatttggtgattgtagttggttggagtcgcctttttttagcactttttgattagaaaattttccattttccgttataaaaaattccacagcttaacaagagatgggtctctatgattttgcaaaagtattgaataactttcttgatgtaagatgacaatccaaatttggatatacaattttaaacatataaaactccaaataaaataatgtaaagaattgtgttttaaaagataccataatttttgtttttcctgcttttcatagttctaaattctaatcatagcagcggtcaaaaaaaaaaaaaattaatataaaaatttataataaaataaatctctaaaaatatggaagctattaaaccaattttcgtttgaaaaaactttctcctcgtattaacataacgtagtggaattttaaaatattccaaatcacatgctataatccatacattttttatccattcattggccacaaaatacaacctgtccatcgccgaagatcaatttcaacgaaagaaaaatataggtttgcaataaaaaaaaacacaggcccatcctttgctagggcccattaaaagctgacgtggcaccagctcgaagtcaggttttgcaaggaacccactcctaaatttgtaggacccaccataggattcaatcaaaacgagccccggatctcaaatgttttgaataaaataaattaaataaaatcgtttcgaatccgccagaacatctaacctatataaacgtaaacgttgtgctgttttggttttcttatctttccatcttccgcgaagggcatccaaaaaaaggcacttgtttcaattaaagatatttttattctctctctctcgaaacaacatcaatcaaaaaaaaaaaaaaaaatttaattagaacaaaccctacctcttctctcaatttggatttgattctttgaaatttgaaagcactaatcaatctttaggtttttttattttgaaactcgacgaactttttttattttgtcaatttctggatcgagtttttggtttctctgacaagttaccgatacgatatttgatatg

SEQ ID NO: 14103 - DNA, 3000 bp, Unknown
  misc_feature (1)..( 3000): cDNA_ID_2710910_gDNA_ID_2214700_Annot_ID_136845 3000 nt of promoter + ATG
taattctggatctcttcctccttggcattagaatcagcgattttcgatttctcttgtttttgctcataattttgttggtgttggaatatagaaatcatgtcggacgctttgatcaatggattggctggagctggtggtgggatcattgctcagcttctcacttatcctcttcaaactgtacacgattctttcgtcacctaattcttctggataatcttcaatcgtctcgtttaaacgcgattgtgtctgtttgttaatcgttgaattaggtaaatacgcgccaacagacggagcgggatctgaagagggagaagaggaaacttggaactatcgaacacatgtgtcaggtttttttttttgttttccactctcaatctcatgatcagagattcaatacatgagtgttgctatagtatatgagccttgatttgctctgatttggttctagttttagaaagaacgtgtaatggattcttttgttgtcttacatttgtatgacctgttattaaatagctttgatttgtgttgaaggttgtcaaacaagaaggatgggagaggttatatggtggattggcgccgtctcttgctggaacggctgcatcacaggtatgttctctcattggtgtgaatatttggagaatctgtaattttagccatttttttggtatgaagtttagaatataggcttgaaagtggatgttaattttggatgagacagggtgtgtactactacttctaccaagtgtttcggaatcgagctgaagccacagctcttgcacggaagaagaaaggtttgggtgacggatcagttgggatgtttgcttcacttttagtggctgcctttgccgggtacaatagaatttcgttatgtaaatttgttttatatgctagtttttggtctgttacaatacggattagagattaccattagttaggaatgctatacagaatttcaaaatagctcttaggtgcttcagtttttctcataaacttcacattggctgtgggtgaaggctcgccacggtcacatttctaatgctatcatctatgctattatactgttacttgtctagtggagcttctaggtggatggtcttaacttttcctgtcaggtcctactgtcatagctgttttcttctttgattgtaaactttggtcgcatgtatagttcattattgtaatttgttttttttccattgtttccgttggctcatgtgaattttgataacactctcactgtgcagatcggttaatgttcttatgacgaatccgatttgggtgattgttacgcgtatgcaggtataaatggcttcatatacactagtaccgtaaagtgcttcttacgctgtccagtcaatttcaattacattttctttggtccgtggtagttttagttttgcgtttgagcatgaatctatggattttctctcctcacttttatttctcctcttgattttttgaatacttgtatgcagacccacagaaaaatgacaaaagatcaaacagcggcccccgagtcaccttcttctaatgcagaagctctggttgctgttgagccgcgtccatatgggacctttaatacggtatgaggcagcttcccgtatttaaaaactagaagaagctggctagggtcatatactcatatcaattattatgagtcaaatcaaactctataaacctctcaattaagacagtttctgtgatatttgttgaacaatgtctcagattcgagaggtttacgatgaagctggaataactggcttctggaaaggtgtaattccaacattgatcatggtacgtgagcttatgattttgaagcttctcttgtattgtttgtctaggtgcattttattaataattagatgtgtgtgtgtgtttttaacccacaggtaagtaatccgtcaatgcaatttatgttgtacgagacaatgctaaccaagctgaagaaaaagcgtgccttgaagggtagcaacaacgttaccgctttggaggttcagactctagcattttgctttcgttttttttgaataagatgtttacttgctttccaacttcccatgattgtgctttctattttccacagacatttcttctcggagctgtggcgaaactcggagctacagtcacaacttaccctctcttggttgtaaagtcgcgacttcaagccaaacaggtcacaacaggggacaaaagacaacaatacaaaggttttccctcttatcatgaaatggccaaaataactcatttgtcagttaaagctaagagttgctgtgttggttttgaattacaggaacattggacgcgattctgaaaatgattcgatatgaagggctttacgggttttataaagggatgagcacaaagattgtgcagagcgttttagctgctgcggttctgttcatgatcaaggaagagcttgtcaagggagctaagctgttgctctcaaacgctacctctagctaagtcaagtccaagccttcttgaatgaacgctagtagttagaaataaataaaaatagattaaatttccaatagttttcttgattaattattacactattgggattgttgttcatttcctgatgattgcaattgattattgtaatttctgcaagattctttagtaatgaaatctgaataaagtttggcagatttcctttgttctttcttcaatagaaagaaatcttcagcatttaagtttataatagtcaaataagggtttaattagttgacaaaaaaggtttagatgtgtcattagttgacttgactacattaagcccagcaaggcccaataaatttcatccatcaaaacgacatcataataaacgagttttgactgaaacgtcttctagctccatccaatatatcgtcttcttcctcctcgaaccaaaaacatcagtctctcctagtctcagcgctcgtgaaaatctgaaactctgcgttcgaattttcgaagaacattagagatctggtattatctggatccgatctgttcaccatg

SEQ ID NO: 14104 - DNA, 3000 bp, Unknown
  misc_feature (1)..( 3000): cDNA_ID_2710906_gDNA_ID_2214700_Annot_ID_136846 3000 nt of promoter + ATG
gaacctcgctgtggaatttcattaacaccttcgcggaggtttctagaggtgctaagaatgtgacacgtcagcctgattttacgcgggagtctgtgctaatctcaccggctgtgctcaaagtccctcaaggtggtccaaaggtgacatttgacgaaaacgcgccgttacgtgaacggatattcagtttcagtagagaatcgattcaagagcttaaagctgtggtgaacaagaagaaatggttgacggttgataacggcgaaatagacggtgttgagttgttagggaaacaaagcaacgataaacttaacggaaaagaaaacggtattttaacggaaatgttggagagtttgtttgggagaaacgacgccgtttcgaaacccgtcgcggttgagatctcgtcgtttcaatctctatgcgcgttgctttggcgtgcgatcacacgtgcgaggaagcttccgagttcgaaaacgactacgtttcgtatggctgtgaattgtcgtcaccgtttgagtcctaaactgaatccggagtatttcggaaacgcgattcaaagcgttcctacgtttgcgactgcggcagaggttttgtcacgtgatcttaaatggtgcgctgatcagcttaaccagagtgttgcggctcatcaagacgggaggattcgtagcgttgtggcggattgggaagcgaatcccaggtgttttcctcttggaaatgccgacggagcttcggttactatgggaagctctccgaggtttccgatgtatgataatgatttcgggtggggaaggccggtggcggttagaagtggacggtcgaataagtttgatgggaagatttcggcgtttccggggagggaaggaaacgggactgttgatttggaggtggttttatcgccggagactatggctgggattgaatctgacggtgagtttatgcgatacgtgactaataagtaacggagtttatgaataataacgttaacggtttttctctgtttttcttttcttgttaattaagaacttaacgatgtaagattattgtaatgtgactttgtaagttgacccttgaaaagaatgttatacatttgctatattagattgcgactagaatccaaaagtaacattagatagatcatcaatttgccttaaccagtctcgaggccaagataaacttcaagataaccaacagttacgatatttccactggtgtccaagttctgaagtttgatcttacggtacacattagcgtttgttttcatgggcaatgctgtatttgccctcccaatgaaaaatgcgtcagtgtcagctgaatttacactgaacaactccaaattgagaaaagatgaagccatgttttgaggaagatgcaaaacctcacggaactcaggatctgcgtttgttgtcacaatctttgtttggcgtggatcatcttcgttagtccaagctctcaacttgtagttgtatttttgttcaccaccgtcgccaattcctgatgctcctactaccattacgaataagtccattttttgttgttgtttctttgattttctctacacgtaagacatatataagggtgttagaatttatagtgggagagctaaaaaaagctaaattactttcataatagtattgaaaatataagctctacttagttttttttaaaacctccaattattgatgatgtgattagtttgctactgtattttgagtattacttaaccaaaacttatcataacatctatttataataagatttaacaatattttataatttgtgaaaataatttattgacaattatgattaatattaattattgttaattttcacacctgtatcaaaataaatgatggggaagtatgcacttaaatctttttaaaatggaaatatgtgtaagcacgctattagattaaaaactataaaatgccacacgcccaacctctatattaaagatacatctactcatattaatcgtgagattaaatttttcatgtacatttggtattatatccatcctgcactccaacttcattcaaatcattaacaatttatttacttctgaagttgtttattaacaattgatacctcaactgccaaagaaatgtttctctcttgttggattcttctgtccaaaagttagagatgggctttgggcctgtacaaagagctttaggcctaacctgaaaagtttaaaagaagctcaattaaagctagtaagcccatacgatggtgagagatagatagctttcgatccccaacagtcttactataaaatcaaagaagataattcgaagcaaatgaattgtaatttagttttacaaaacgagttatttaagaaaatgaggaaaatatttcagtcttaaaacatattttagtttgtctaacaatatgcataatgtagataaaactaaatcatgatttatctatgatactagtataaagcaaatatgtaaaccgagtcataccatattcagccaaacgtttaaaagttaaacaaaccacggaggcaaactaattatggaatgatatccatctttatatgctaagctgaatcaaataagaccgaacacgcagttcaagaaaaagagtcttatccagctaaaccaaactagtagtacatggaaggttaggcttccgtaatatcactcaattataagggcatatcagtcaattacatacctcctacactcctcattcctcaacgtcaacttgcgtgtctttctttcttcgaatgaacttctgaagcgaaaaaaagagagaattaaagtcattcattatttggggaatggagaagaagctcctttcctacagacgccatcattaacaacatcctcttaagcttctgcgattctctccgtttgtcggaagatttcacgacgattcttcaatccttatccgaaccggaggtaattctggatctcttcctccttggcattagaatcagcgattttcgatttctcttgtttttgctcataattttgttggtgttggaatatagaaatcatg

SEQ ID NO: 14105 - DNA, 3000 bp, Unknown
  misc_feature (1)..( 3000): cDNA_ID_1808500_gDNA_ID_2214700_Annot_ID_136848 3000 nt of promoter + ATG
ttgtagggaaacatcaaacatgtattaaaatctctagtgttgcgaatttaagtttatgctttcttgagtttctttaattgcccgtcattacgctactaaaatttcacaattttgtccgttttatacataaatatacataaacaaatacgtgatttttctctctttttctattcaattcattatagaaaataaatgacgtttttcatatttgcaactaaaacattgttttctttcagttttatgtggtacatgacacctgttatgttttacgattgttgatatatattcaaaacaccatgtgcatgattagttgaacttgtagctgtagatcgacaactatcaaaattattatatatttgcttcgatcaaaaactatctacagcttgtaaatattgctcataagtgacaacccataacgcatgactgactttcaaaaatgtatttgcagaaaattttatattcttatcgatcaacccctaaatgttatactacatcgcatatatcatcaaataaaacatttctatatatgtattaacatgttatgaacatgactgtgtgttttaactttaacttttattaaaagataatatcttaccaaaaacgagaaaatattcgatatttccttagaaatcagattactgaacattcgactaatcatcaggcatttacctttcatagaaaacagttcaaaaagcaatataaagccaaaaaacgaaaaaaagattatcctgaaattaatccacagtactggttttttttttttttaaaaaggagaccgcgtttctacgctgactttcaaatcagtcgcgtcggtattattccacacgccttttttctcgtccccatcctctatccacatttctctctatatatactctcctcgtatcctaaactcatcctcaaattcaaaatttaacacacaaacacaaacacacacaccaaaaaaaacacagaccttaaaaaaataaaaatggttgatatggattggaagaggaagatggtatcatcagatttaccaaactcacctaagctttcttcaaagcttcacgtaactattccatcaccgttcaaaatcgtccctgtttcatctccgatctcatgttcagcacctgctctttgctctgcttacgagctttaccttcgtctccctgagctaagaaagctctggtcatctcgtgattttcctcaatggacatcagagccgattctcaaaccagctcttcaagctttggagatcagtttcagattagttttcgccgtttgttctgatactagaccgtacatcaaccaccgtgaatggaaccggaggctagattctctcatcacgaagcagatccagcttgtagcagcgatctgcgaagatgaagaagaagaaggtatatcagcggaggctccggtcggcggtggacggagttcgttgagtttgttaccgcagctagctacgtggaggagatcagaggctttggggaagaagatcttatatacgatcgataacgagatgagtcggtgtaagtacacgctcggactcggtgaacaaaacatcgccggaaaaccaaatctccggtacgatgcgatttgccgaccaaacgagatctatagcctcaaggataatccatacgcagatcatatcgataatcacgagaatcaaactctctatatcattcaccagatcctcgaatcgtggatctacgcatctggaaatcttctgaatcgaatcgtctcaagtatcgaagaagagaaattcggaaaagcttcaaacgatgtttacttgctggagaagatctggaaaattttagcggagattgaagatcttcatatgttgatggatccggaagattttttgaaattgaagaaacagttacagatcaaatcgacgggtaaaaacgatgcgttttgtttcagatctaaaggattagtggagatgatgaagatgtcgaaagatctgagacagaaagtaccggcggtcttggcggttgaggtagatccaaccggaggaccaagattacaagaggcggcgatgaagctttacgcgaggaagacagagtgcgataagattcatttgcttcaggggatgcaagcggtggaagcggcggcgaagagtttcttctttgggtataggcagttagtggcggctatgatgggaagtgcggagatgaacgcgacggcgagtcaagagtcgtgtgactcactgagtcagatatttatggagccgacgtatttcccgagccttgacgcggcaaagacgtttctgggagagttttggagtcatttgggatgattaaattttaatttctgctggtataattatttaatataaatttaaattggtggtttggtttaatttagtttgtaagatagtgaaatttttggaacatttgacgatccatatttgaatacaaattcatttttatatgatttatgagattttttaacaaacgataacatttacgaatatcgtaatccatactttgaattatccacaagtcgtaattcaaatatgggtggtctactaacgagtaacgactaatctatatgctctgactaatcgtcaacaaatcaccacctatccttcgtagatgttagtgtatgagaaaaacacaatttcacacctatcctttgtagatgttaaattatgagaaaaacacaatttcactttcacagtgtataatattcaaaattcaatgataaacacacacacaaaaacgttataaaaaacccaaaccgacgatgagtaaccaaaccgatgtataaaacgacattgcctttctctgttttttgtgttcaacaaatttcattaagagaaagaagggaagtgtttgaatgagtattcattcattagtccaagaaaaacatttaatgggcctgtttgtaggcccactggcacataacctatcttctgtatcattgatgccttctcctaccttcctctgacgctcacatcggaaaccctaaatctccactctctcgcgccttttaccccttctcagaatcttaaccatg

SEQ ID NO: 14106 - DNA, 3000 bp, Unknown
  misc_feature (1)..( 3000): cDNA_ID_3021804_gDNA_ID_2214700_Annot_ID_189638 3000 nt of promoter + ATG
tggctgaagtacaagccaaccaattgcctgagaatcacaatgaagagatggctgaggaagaacaacccaatcaattggctgtggaaatacacgaagaagagaaggtgatttgtttttcttccttctcgttctctttctgtgcaggttcacaaatctgttgcttccattgttgggattcgttttgctggcattattagaaaccattgacagaattcttgaacttggtttacccaaatggtatgtaacttgcagcatgatccatcttttgtaatacaggagcaggagcaggacatgcatattgagtatggaagagaccaagctgatgagttatcaatcaatagcgaagcagtcaatgacccatcaccagcagctattcatttgggagaagcatcatcagattatgcacaaagttctgttcgaggtaataaaagcttttttactcatatccataccaatctcaacataagaaatgaaacattcttttactgcggtcaaaataattgattaggtgtggagaatcttcattgtggatggctaattgatgaggaggagacggatcctgaggaggaaacggatccagaggagaaggagaccgagccagaggatccaaaggagaaggagacggagccagaggaggatagtgatggtgatgatgatgagatcattcagcttactccagaacctctttgtgaagaacttcaagagcttctcagggaagtacgtggacagaagaggaggaagaaagagatgaggtgggacaagtaaaggagctatggagctcctgtaagtagcaaattgatatatatgttaggaagccaaatagtagtagtaagctatagtattgtggtgaaaaaaggtaaaacgacccatcttaacatctcttgagatattggtttttaataatttgtgatggagtagagaaagcagatagtctttatcagtagttgtatgagtcatacaatagtacccgaacccacttatccaaagatcaatgtcgaaagtggaaaccaaatccctctaaagtaaattgaatagccagtctaaaagttagaccaaatctgaaagtcggtttaattgcaattataccttctaaatgcaagaaccaatatcaaccggtacttcatattcttttgatttttgatttgtacatataaacttttttttgtacatataaacttaaatgcaagtatagcttgacttgtattttacacatcagcggaaaagtttgagagaggaagcatattgtatttcgtttggttacaacttttgctaacttttacaataaatggaatgaaatttttttccacttaattcctcctgaatagaaagaaattgatgcaattttgttccctttttaaatccatgagccaataagtgcatctccaattatattccaaatttcactctaaatactaatttagaaaaaatccttttaataccactatattctcaactctaaaagggagtgatgaatatggtatgatatcatctgtcacttcattttggagttaccctttactttttatttacaaaatattttcctaaatttatactcatgttcttcatttatgtgtaaacaaaattatataaatgaagaaaaagagttattgttaaccttctccatgttttcattataaattgatatgagcattggttaccgttctttcggataaaaacgaagtttatctcttgaaaacattgttcctttcatattcatatcgcatcaatatataattgaaaagttcatttatggtgatcgatcaaatatataacaaaataaaatgaaaaaatactttaacattttatatataatttttgaagacaaaagagctgtttttttgtctttaattgattggtcaactgtttacatattcatttttttggtatgaactatttacaaattcatgaatacaaaaaatatctcaaatttttttttacaagtcgatccacttagttcttaccgtttttttggtataaccattattttataaaacatcgttcccgctagatttttatcgcatcaaacatagcgtactacaaacggaaacggtcatctatggcgatcgatcaaatatacaacaccaaaatcgaatccaaaaaatagtttacttgaagtatttatatgttttgcttcactgctaattctatggttttgaaatcctttattcttctcaaaaaaaaaaaaagtttgtcaatggttgttgacatggtcttgcataatatgtggataaatatttgttttaatcattttcatcatcattgcatattcccaagtgttatcaattgtttgacaaataaagaaaaattaaaattgatacctttttattttagttaattaataacgaaactgaaaatatttctccctttgcatgcaatgtgggttttaaagacggaagctgaagagtgaagaagaacaaaagatttttgagagagaaaagtagagtcactccaaaattgttctctcgcaatcttctttctcggtttcctcttttaagaaaaagtccgccattttcactctcactcagatttcttccctcttctcacctgcaaaaacccttgtttcccgctgtttcgtttcttctccggttgaggaaccaaaacgggtcaaatacgcagctgaatcatcgaattcttaggtattttcgtcttacccaactcttatctttagatgtttttccgggaaaagagctcgatcatgactccgccgtgtttttttttgggggggggggggtttctccgaaatgggtttcaaatgtaggttactctaggtttgaaagttcggattttttggttcactgtgtgttactacagcttcgattttgtgtaaacgagtataaaaattgtatcttttacagatttgagaacttgttcttcaaagacttgatttttctttgtatcaagttagtgagctcaaatgtctttgtttctctgtttgtttacatctgataagagctaactcggtctcgctggtgtgtgattttcgctcgttagggttttttc

SEQ ID NO: 14107 - DNA, 3000 bp, Unknown
  misc_feature (1)..( 3000): cDNA_ID_2992340_gDNA_ID_2214700_Annot_ID_189637 3000 nt of promoter + ATG
ttcagaaaattcctcaacggagagaaattaaaaccagaaaggtagttttgatgaagaaacaaaatatccataaacgtaacaaagaaattctgaacgtgaaagttttaaaggtccataaaataaataggaaaggctggcaaaagataagacggtgtattttaaccgaacagatcaaatcccatgtccccatcagactcttctgcagcttcttcctcaacagctactgccaccactgctccaccagactctcctgaaaccggtgcagccactgcaactgcaaacttggttggatcctgatccataaatgtacagttaacaaacaatttcatgactactaatcccaatatctgaaacgcaaaatgaaagaggacaaacctttaggaactccttcacattctcagcctgagggaaagagtactcagtagctaaggcaacagcaagaacgttcttgtaagcattgaggaacatgtgaggcgcagctgctacggttgggtaagagattgcaagagaaagcgcagtgatcatcgagacaccagctgcaaacttctcaacaaggtcgtcttcagtgaggttaagcacttcagggttaaacactgacccattatcgtagactgactcaacaacgagaccatacgaaaagggcctgattccaagcttggcaagaagcgcagcctcggatgaaccgactttgtcgcctttcttgatgagctccacaggggttatgatctcaaccgtacctttgttgattttggttggaatgttaagcacctggaagaaggaggtctgtgaagggtcaagaccagtgttgcctggttgcacgaccacatcaattggagcgactaaacctacacgagcaggagctccaacctgtcaaaaaaaggacaatgaatttctcatcaattaacagtacaagactaagttgaaaaaatcaatcaatccaacaacatgaaaggacgctacaaaaatgtgagcctaggaaactagtagactctcaagtaagtttcttgaatgtggttgcgtttcaagacagaaaatagaggttttgagttccaatttaaaccaaaatgcaaactttatcacctatccaccttacaagttaataacctaaagccataggttaaaggatgatcataaactgactaaatcatcaagtaacagtagaagctaaaaataaaccaatcaatcaaaacacaaaacagaaactacaaatgtcgtctcctcaaacctcaatgaaccaaaataactagtactataatctaatcaaccctatttgcttggaaagtgaaagtttgcatttgtgtttaaaatcgaataatacaacaccttgcattcttgcttacttagagataatcagatacagcataaaactaaccaaactaagtaataaaccaatcaatgaaaatgtaatctcctcaaagctcaacgaatcataataatctcaattagaatgtggctgcattttaagcaagaacacatatgatttcatttcaaactcaaaaatacaaactttcactttccaagctatcaatccatatttgaactctactaaagcttaacaacaacaataacatcaattgagccaaagaaacaaaccttgtacttagcaacctcttcactgacttccttcaagtcacccttagtgaagatcaacccaacattcccctgttaaatagattctaacaccaaaccaaatcaaattctccacaaaaccaaaaaatcaatactttatatccaaatgaaaacaaactattcaagacaagagaaatgaaacctgaagaagaggaaggagactgaggaaagcttgattgccagttttatcagcatgaatcctcacagatctcttcatcattgtgttcttccccatcaaaacaactgaatcacctcgtaaacctttccttatgttctgaagctgagttgatccaacattgtcagctgcaacgacaagaatctgagagtactcattcaaaagctgacaaagctttgaatcgtaaacgatcttcttctccgcctttgttgctttcaccgccatttccacttaaaaatgataaagtgagactaaagaaactaaattttggggtagagaaaatggagggcctagacgaagcttggagctcgtacaaggtggacagcgcgaattggcgctgtctctttaacctctgtaactgtttttaacagaggaaggaagagagaaagaaaaaaagctgcgtaagaatttgcttaaggttgaagaagaagtttcttgggtttatatagttatcggaagacggaaggatgaacggtcagggtttgtgggatgacctaaatctaacggcttatattatttgtagtagtatcaatgggatgggccaatattgcccaacatgtttaacattatgaatctttttcctattgggctaaaagctctttcgacccacatctcaagcccaactgagatccattcattgtaattcatactttattattttttatagtaaccaataagaaaatggttgacttaacagagaaaatggttgacccaaacaaatactatattatttttttaattcgatttcattcaaagaagcatttttgggagacgaggaggcgatccacggcttattcttaagaaaccttccacagtcgccgccgattttatcttctccgccgtaagtactctctttccctatcgaatctgaacgaaacagctcagcacattgtcatctctgtagcaaaattaagttcgtgtttttgtgttttgttgtgattctgtttaggtttcatttgggtttgaattttagggtatttttggtttatctctagtgttactgattcgggatttttgggaaagagctcaacttttgttttgtttcatctttcgttgattttgttgttacataggtttgaaaaaagggatcacttgtttggttgcctttgtttgtttgtttgattataacccaaagacttatacttttggtcctccaatttcttctgaaactacagggaattgtgagggatcaacaa

SEQ ID NO: 14108 - DNA, 3000 bp, Unknown; identical to SEQ ID NO: 14105
  misc_feature (1)..( 3000): cDNA_ID_1808500_gDNA_ID_2214700_Annot_ID_189634 3000 nt of promoter + ATG

SEQ ID NO: 14109 - DNA, 3000 bp, Unknown; identical to SEQ ID NO: 14104
  misc_feature (1)..( 3000): cDNA_ID_3021816_gDNA_ID_2214700_Annot_ID_189632 3000 nt of promoter + ATG

SEQ ID NO: 14110 - DNA, 3000 bp, Unknown; identical to SEQ ID NO: 14101
  misc_feature (1)..( 3000): cDNA_ID_2706036_gDNA_ID_2214700_Annot_ID_189629 3000 nt of promoter + ATG

SEQ ID NO: 14111 - DNA, 3000 bp, Unknown; identical to SEQ ID NO: 14100
  misc_feature (1)..( 3000): cDNA_ID_2706056_gDNA_ID_2214700_Annot_ID_189628 3000 nt of promoter + ATG

SEQ ID NO: 14112 - DNA, 3000 bp, Unknown
  misc_feature (1)..( 3000): cDNA_ID_2992578_gDNA_ID_2214700_Annot_ID_189626 3000 nt of promoter + ATG
cctcaacctcgacctatctactaaacagtgttaatggcccactctgggtcaaagcccttgctaacgtctctgctatccttcaatctgttatctctttgcacgtaagtttcttagcgccaagtctacgcttttttaacaaagactgtcgtctctaactatatgtctgactcaattctttgttgtagatatttgcgagtccaacatatgagtacatggacacaaagtatgggatcaaaggaaacccatttgcgataaagaacctgctgtttaggatcatggcgagaggcgggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatcctttattcttaggcaggtttatttctcctgtaagcttgtattctctctctatttgtcttaccattagagcctaaataaataaatcaagttctaaaatctaaaaagcatataaaagaccactttcatcataatcattctgaaaatttaccaacaaagaatactaagttgcatgattaaagtctctattagaaatgtaaatcatagtattagagaagaacataaaaacacctaacttaaaaaaaccttaatttagtgagatagagaagagaagaaacagaattgttgttggtttaacaaaaacctaatctttcaatgattagctgtttaatttgaaattataacaataatttagacaggccaaagtggaaccccactgtctccaccaaagctctagataaaaaaaaaaaaacgaaagcgttagatattttttatcaatcgtgctccgtaatcattacctttcttcttcatcttcatcttcacgcagcgacttctttgattctctctttttattctcagctccaatttcaacctgcatttctctcttctcaattttgggtttctttttttgatatctcatttgatcagatcgacgaagaggtaaccattttgccgtttgttagttcttaacgattttattctgttaaaaatcagatttttttttgcaatgcttgtagaaaaagattcgatttttgtgtactgattgaatcaaaatatgtggttatggatccatggattgatttgtttgaactgatgcaaatggctaatgtgaaaagtcaagaatgtgttaatgtagttttttttgttaaacctctttgtgttgttgggttttgaaatgttgttgttacagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaagtcagttttcctcttttgcctttcctaaatgtagttattagtgttttgagagtttcatttagatatttagctagagagatacttgatctgaattggtcttcgttaaagtgataaagttaaaacgtgttgatggtttctgaacagctgagcaattattcatcaatggaaggagtggtgtattgtaggcctcattttgagcagcttttcaaggagtctggtagtttcagcaagaactttcagtcacgtatgtaaaactcttttcttcaccttctggtccagcttttacatgtggtcactttaattttaatcttcaaactttttttttcctttcacagctgcaaagccattgactgataagccaaccccggagctggtaaacgcttcttaacaacgatgtttttatttagttacacgacttgagatacatgactctatttctcttcttggttgttctcagaataggacacctagtcgacttgctggtatgttctctggaacgcaagacaaatgcgctacttgcactaaaaccgtgtatcctatcgaaaaggttagtatacatttaagcttgtatatgtcattaccattgctttccaatacacttttgtgttctctctgtgattgttgtcaagaaaatcacagttaaacttatttggatcatttgcaatatgagttacatggatccgaatcacataaagttgagatctctttaatacagtcaattcttatatctcattgttctgttttctaaaaattgtaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgcgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgagtttcttgtttgtgatactactacatctataataaccgaggacttttggctttgatcttggtcttttgagctggaccgaaccggaatgttagaccggacaaatctctatcgttactcgtcgttagtcatctccggtccggttcttcactaaagttaaaaatccagttaaacagaaatcaattaagaaaacacaaaacccaaattgaattgtgtaaagatatgaactttacaaaagaaaattgtcaatttcgaaaa

SEQ ID NO: 14113 - DNA, 3000 bp, Unknown; identical to SEQ ID NO: 14099
  misc_feature (1)..( 3000): cDNA_ID_1808783_gDNA_ID_2214700_Annot_ID_189625 3000 nt of promoter + ATG

SEQ ID NO: 14114 - DNA, 3000 bp, Unknown; identical to SEQ ID NO: 14098
  misc_feature (1)..( 3000): cDNA_ID_2710916_gDNA_ID_2214700_Annot_ID_189624 3000 nt of promoter + ATG

SEQ ID NO: 14115 - DNA, 772 bp, Unknown; identical to SEQ ID NO: 14096
  misc_feature (1)..( 772): cDNA_ID_3021834_gDNA_ID_2214700_Annot_ID_189620 3000 nt of promoter + ATG

SEQ ID NO: 14116 - DNA, 3000 bp, Unknown
  misc_feature (1)..( 3000): cDNA_ID_2992340_gDNA_ID_2214700_Annot_ID_136851 3000 nt of promoter + ATG
ttctcagcctgagggaaagagtactcagtagctaaggcaacagcaagaacgttcttgtaagcattgaggaacatgtgaggcgcagctgctacggttgggtaagagattgcaagagaaagcgcagtgatcatcgagacaccagctgcaaacttctcaacaaggtcgtcttcagtgaggttaagcacttcagggttaaacactgacccattatcgtagactgactcaacaacgagaccatacgaaaagggcctgattccaagcttggcaagaagcgcagcctcggatgaaccgactttgtcgcctttcttgatgagctccacaggggttatgatctcaaccgtacctttgttgattttggttggaatgttaagcacctggaagaaggaggtctgtgaagggtcaagaccagtgttgcctggttgcacgaccacatcaattggagcgactaaacctacacgagcaggagctccaacctgtcaaaaaaaggacaatgaatttctcatcaattaacagtacaagactaagttgaaaaaatcaatcaatccaacaacatgaaaggacgctacaaaaatgtgagcctaggaaactagtagactctcaagtaagtttcttgaatgtggttgcgtttcaagacagaaaatagaggttttgagttccaatttaaaccaaaatgcaaactttatcacctatccaccttacaagttaataacctaaagccataggttaaaggatgatcataaactgactaaatcatcaagtaacagtagaagctaaaaataaaccaatcaatcaaaacacaaaacagaaactacaaatgtcgtctcctcaaacctcaatgaaccaaaataactagtactataatctaatcaaccctatttgcttggaaagtgaaagtttgcatttgtgtttaaaatcgaataatacaacaccttgcattcttgcttacttagagataatcagatacagcataaaactaaccaaactaagtaataaaccaatcaatgaaaatgtaatctcctcaaagctcaacgaatcataataatctcaattagaatgtggctgcattttaagcaagaacacatatgatttcatttcaaactcaaaaatacaaactttcactttccaagctatcaatccatatttgaactctactaaagcttaacaacaacaataacatcaattgagccaaagaaacaaaccttgtacttagcaacctcttcactgacttccttcaagtcacccttagtgaagatcaacccaacattcccctgttaaatagattctaacaccaaaccaaatcaaattctccacaaaaccaaaaaatcaatactttatatccaaatgaaaacaaactattcaagacaagagaaatgaaacctgaagaagaggaaggagactgaggaaagcttgattgccagttttatcagcatgaatcctcacagatctcttcatcattgtgttcttccccatcaaaacaactgaatcacctcgtaaacctttccttatgttctgaagctgagttgatccaacattgtcagctgcaacgacaagaatctgagagtactcattcaaaagctgacaaagctttgaatcgtaaacgatcttcttctccgcctttgttgctttcaccgccatttccacttaaaaatgataaagtgagactaaagaaactaaattttggggtagagaaaatggagggcctagacgaagcttggagctcgtacaaggtggacagcgcgaattggcgctgtctctttaacctctgtaactgtttttaacagaggaaggaagagagaaagaaaaaaagctgcgtaagaatttgcttaaggttgaagaagaagtttcttgggtttatatagttatcggaagacggaaggatgaacggtcagggtttgtgggatgacctaaatctaacggcttatattatttgtagtagtatcaatgggatgggccaatattgcccaacatgtttaacattatgaatctttttcctattgggctaaaagctctttcgacccacatctcaagcccaactgagatccattcattgtaattcatactttattattttttatagtaaccaataagaaaatggttgacttaacagagaaaatggttgacccaaacaaatactatattatttttttaattcgatttcattcaaagaagcatttttgggagacgaggaggcgatccacggcttattcttaagaaaccttccacagtcgccgccgattttatcttctccgccgtaagtactctctttccctatcgaatctgaacgaaacagctcagcacattgtcatctctgtagcaaaattaagttcgtgtttttgtgttttgttgtgattctgtttaggtttcatttgggtttgaattttagggtatttttggtttatctctagtgttactgattcgggatttttgggaaagagctcaacttttgttttgtttcatctttcgttgattttgttgttacataggtttgaaaaaagggatcacttgtttggttgcctttgtttgtttgtttgattataacccaaagacttatacttttggtcctccaatttcttctgaaactacagggaattgtgagggatcaacaaatggctcccagaggaagaagaaaggtataagctgtactgttttttttgttttgtttttccaaattaaaatgctggctaacaagtaaagatatgagcttttgaatcatatagtttttagagagtatagtggaaaactaagataaaagcatagacatagacattagagtagaatgactatatagatgaagtatttgaatgacatgattgttgaagttaacattttgtttctctctacgacttctgtgtactcaacgttgagaacactgatgagataagtttacaaatacttctttttatgatgggtgttcttgtttttttccttctatgattatctctcttttctatgcttttaaattgctacttttcttttgcttttttgcagaaggctggattg

SEQ ID NO: 14117 - DNA, 3000 bp, Unknown
  misc_feature (1)..( 3000): cDNA_ID_3021804_gDNA_ID_2214700_Annot_ID_136853 3000 nt of promoter + ATG
gtgtccatttgttctaccctcagtctcttagtgctaaggcagaggttatggagctcttctctgtggagaagcaactgcttagctcacatactggacagctgattttgcagatgggtagtgattctttactgtctttgagggtaatgctggagcgggtatttctggacaaggcaactgctcaacagttagctatgtatggctctctgtccctgccaccaccagcactaaggaagtccagtaaatctggcccagcttggacagttttccagattctacagcttgcctttccagaacgtctgagttgcaaaggagacagattcctggttgatggaagtgatttgctgaagtttgatttcggggttgacgcgatggggtccatcatcaatgaaattgtaacttcaatcttcctggagaagggtccaaaggagacacttggattctttgattcgctgcagcctctattgatggaaagtctgtttgctgagggatttagtctaagtttggaagacttatccatgtctagggcagacatggatgtaattcacaacctaataatccgagagatttcacctatggtgtctcgcttgagattatcatatagagatgaattgcagctagagaacagcatccacaaagtgaaggaagtggctgctaactttatgctgaagtcatattccattcggaacttgattgatatcaagagtaactcagcaatcaccaagctggtgcagcagacaggcttcttgggtcttcagctttctgacaagaagaagttttacacgaagactctggtagaggacatggctatcttttgtaagagaaagtatggcaggatttcttcatctggtgattttggaatagtgaagggctgcttctttcatgggctggatccgtatgaagagatggctcattcaattgcagctagggaggtaattgttcgctcttcaaggggattagctgagcctggaaccctctttaagaacctgatggctgttcttcgggatatcgtgattacaaacgatggaactgtaagaaacacctgtagtaactcagtcatccagttcaaatatggagttgattctgaacgtggacatcaaggtctgtttgaagctggagaacctgttggagtattggcagctactgccatgtcaaatcctgcatataaggcagtgcttgattcctctccaaatagtaattcatcatgggagctaatgaaggtatagcaatatcaaatctgccttctgaatacagctttgttcatctgtattgttgtgtaattgttttctgtatttgttcttttcccaggaagttctgctctgcaaagtcaatttccaaaacactactaatgatcggcgcgtaatcctttatttaaacgaatgccattgtggaaaaaggttttgccaggaaaatgctgcttgcacagtcaggaacaagctgaataaagttagtcttaaagatactgcagtggaattcctagtcgagtaagaattgggttttagtaacttcagtcgctctttttagtgtttgtgttattttttttttatggttttactaaacctctttgcaatctgctttctctttacttgcatgaagatatagaaagcaaccaactatatcagaaatttttggaattgattcatgcctacatggccatattcatcttaataaggtttgaatctggttcctttactgttgaatctttctggaagcctctacctgtcatagaaacactttcctattatccttttcttgctgtgtaattggtgtttttggtttactagacattgctgcaagattggaacatcagtatgcaggatatacatcaaaagtgtgaggatgtaattaactcactaggacaaaagaaaaagaagaaagctactgatgatttcaagagaacaagtttgtctgtcaggtttgtacaatgatttgcttttcctctggatgtcgtctctggttgaatgttatgcataatttgtccagaaagcaagtctgatgttgatttctagttttccagttatcttctttccatcatttttgttcttcatagcataatgtctagctttggtttctacctgattatgattgatttattctccaatgaacagtgagtgctgctctttccgagatccttgtgggagcaaaggttcggatatgccttgtttgacgttctcctacaatgccaccgatcccgatctagaacgaactcttgatgttctttgcaatacagtttacccagttctgctggaaatagtgatcaaaggtatttgaataaaacttttcatttttgtatatttcgcttgtttccctacacttcgatttcttctttgatgggggagcagtgtatctgatagagtcttcctttcaaaattttgtagttacatggcttacgaaattttgttttttgccagaagtttaatgaaccaaaatattttctcaactagtctgattgaattttcctccaagttgtgatcgatattctgtgctactataaaagaaagcctatgttttagtaagatttctagatacatgtttttgatgatactcctgtatctaaactgagcaggtgattcacggatttgctcagcaaatataatctggaatagttcagacatgacaacgtggatccggaatcgtcatgcatcccgccgaggggaatgggttttggatgtcactgttgaaaaatctgctgtcaagcaaagtggtgatgcatggagggttgtgatagactcatgtctttcagtgcttcatctaatagacacaaaacggtcaatcccttattctgtaaaacaagtgcaagaattgcttgggttatcctgtgcttttgagcaagcagtacaggtacttactaacttaaaacgtgatccgttcctggatcttacacttaagtcatgatacttcttacatatttcatgtttggtatcacatttgctcattgtttgtgtaaggattttaaacgtaagatgttgatttgatttgcagcgtctatcagcttcagtgaga

SEQ ID NO: 14118 - DNA, 3000 bp, Unknown
  misc_feature (1)..( 3000): cDNA_ID_2710950_gDNA_ID_2214701_Annot_ID_136865 3000 nt of promoter + ATG
gggcgataattataaatatagcagaaactctataaattaataatgataggaccacataattttattaatttatataataaattaataaatattaattaataagataaattaataaatattaatttaaagaatatttacgtaaaacacaatattatttttttttaaacaatatttttaatttagattttctcgtattttgttgtttgtatattcaattatgttatatattttattttatttttgacttttttaatttattttcttacaagatattgtgttcgtatatctacgacgttaacgtatagcttaatccaatttttctttacacaaatcttaacaatgatttttcatagaaaaaaatgttacaaaaccaaatatgatggatcaaatactcaaagagttgtgtgagtacaaaagagatcataccaactgtaatctaaaaagaattgcaattgtagttttaacaaaagtttcatataaaattagtcttaaaatatttgtttaagatctatgattattaatttatgatattattggaaccatatttttacatagaaatttcaaaaaaattattatcttattatcttatcgattttgcttaatttttacattggcccgacttgagactagcaaaattaattattttattgtatttattaatttatcgagtattaatttatagagtttccactgtatgtgttttgttgttaagtaagatttgtgacagtaatggtgatagtgtgacactatttaagcagagtgatatttgaattagtaatgatttggtttgcttggttaataaattcttaaaaatgaacaagtttttttttttgcttattttattatattcatcaaacattttctgaaatttttctaacaaaaagagacgtaaacagtcaaaataaatttgttgccttgcaacgttgcaaatttcaaaatctacttgaaatctagaaatatgatttctaccacatttcgtcttccgtcgtgccaaaatctatttaaaatccaatttgatcaaatccaaaaggcaaaatttcctacatacagtatttatatatcacacatgacacatgtgcactattagtatttataaaataaatgtcaatgtcagcattttttttttgtgcaaaatcaatgtcagcatattcctctgtcctcaaatctcaatttgcttcttcttctccttcttgattacttaattaatcacaattattagtaaggtaaacttcttgtccaataatttgtgatacagtcactgttttgaagttgtcattaatgatgtcgggtatcatcgacaaatctaattcgctaactgtgttattagtattataaaattacaacaagcagtgatattgtaaatattaatatgctcatggaccacttattttgtgcaagggggataattaacaacacattcaattcaaaaacatattaataagttaacataaaaatagtagaattatcattcattgaatcttctaaccaaatgatactcatttttgtatttatttctaataaagtaactccactatgaagaaaaacaaacatatatatttgtagatgaaaactatatcaagatatgtaatatttctatgctaatctcgcagttgtgttactatctaaatttaaatttgcatattgtattatcgaattttgtggtaactcgagctctttgttttccaagaattttctttcattctttgtaatgtaggttcgtctgagccgaatagaaaaggataatgagagaatcgaacattggtaacaatccttccataagaagatcggttgatcgactatcttcttatggagtatccgattatctacgagcagtataccctcaaaatagtttgaaagtgataaaaaataatgacaattttttttcaatgattattttataccttctgatccgcttgatacctctagataaaatatagtagtacaaaaaaatttgaaaatacatttttgatacggcttttttgattaataattattaaaacattaaactctatactgcattgataccaagttatttaatttactaatcaaaacttcttttctttttcgtatctcctcagctggtatggaaaattctttcaaacttcctcatttcttcttccactagttatgtttggttttgcttgattcttaattgcataattagaaaatgtcacacaaagcatttttcctaactatttagactcctattaacaacaccattggtttaggtcaagattgtgttacaccaataaatatccattggccattgcttccaaaagaatatgtttgacctaacctaacggatgagaaagaaaactctttttgtttataatattactaatcaacaacgacacactacataaaaagatttacaactgttacaagagatagattcaaaattttgagctccaagtagctgggatgattatgatattcccattgttttactattcgacaaaaagtaatacaagtatggtcattgtgttgagtggtatagttgacatattgaaccaatcgatttaatttaatttcaactacttcttaaaaaatttaaaagcaatttaagcctattcttcttcctttttattaaatgtacacattaattgaacctatcatatcatagtatcaatttaaaaaaatacaataaaatcccatcattagtgttatctaaaataaaaacactaattatgacgtgatcttaaattaatttttagataaacaaaaacgaaaacagaatcacacaaatgatgacgtggcaattccctacgtgtaacaccacacacagtaacgttcctctcctcactctaagcccaaaaatctctctttttttttttttttatctcgcgtttataagaatcctctctctctctctctcacattattttctgtttggaatcttggatctttctttctgagatcattcgtcttttgtactgattttgagagatttcatttttgtttgtttaccgatccgccgccgtggatttttgttttccgatg

SEQ ID NO: 14119 - DNA, 3000 bp, Unknown
  misc_feature (1)..( 3000): cDNA_ID_3021839_gDNA_ID_2214701_Annot_ID_136866 3000 nt of promoter + ATG
ccttgcacaaaataagtggtccatgagcatattaatatttacaatatcactgcttgttgtaattttataatactaataacacagttagcgaattagatttgtcgatgatacccgacatcattaatgacaacttcaaaacagtgactgtatcacaaattattggacaagaagtttaccttactaataattgtgattaattaagtaatcaagaaggagaagaagaagcaaattgagatttgaggacagaggaatatgctgacattgattttgcacaaaaaaaaaatgctgacattgacatttattttataaatactaatagtgcacatgtgtcatgtgtgatatataaatactgtatgtaggaaattttgccttttggatttgatcaaattggattttaaatagattttggcacgacggaagacgaaatgtggtagaaatcatatttctagatttcaagtagattttgaaatttgcaacgttgcaaggcaacaaatttattttgactgtttacgtctctttttgttagaaaaatttcagaaaatgtttgatgaatataataaaataagcaaaaaaaaaaacttgttcatttttaagaatttattaaccaagcaaaccaaatcattactaattcaaatatcactctgcttaaatagtgtcacactatcaccattactgtcacaaatcttacttaacaacaaaacacatacagtggaaactctataaattaatactcgataaattaataaatacaataaaataattaattttgctagtctcaagtcgggccaatgtaaaaattaagcaaaatcgataagataataagataataatttttttgaaatttctatgtaaaaatatggttccaataatatcataaattaataatcatagatcttaaacaaatattttaagactaattttatatgaaacttttgttaaaactacaattgcaattctttttagattacagttggtatgatctcttttgtactcacacaactctttgagtatttgatccatcatatttggttttgtaacatttttttctatgaaaaatcattgttaagatttgtgtaaagaaaaattggattaagctatacgttaacgtcgtagatatacgaacacaatatcttgtaagaaaataaattaaaaaagtcaaaaataaaataaaatatataacataattgaatatacaaacaacaaaatacgagaaaatctaaattaaaaatattgtttaaaaaaaaataatattgtgttttacgtaaatattctttaaattaatatttattaatttatcttattaattaatatttattaatttattatataaattaataaaattatgtggtcctatcattattaatttatagagtttctgctatatttataattatcgccccaaaataataaaaacagtacaggaaagtcattatgaacatcattacacaaagcccattacaaaattcgcccataagcccaatctaacaacggcagagattcagagtcagttccgacggcgctgaccaaagaaacgcgtctctctctctggagaaaatttcctcacagagaaagaagaaaaagacgagagacgtgaagaagaaatcagaattcagaattgagaagcaaacaatggcttcaacgatctacacttgcaaagaatgcggatcagatctgaatctaaaccctaacgatttatttccaccggatttctacttcgaagccggtaacaaaggaacactctcattcgccgccgtcgacgccgagaaattccgattcgagaaagaagataagatcatgcctttcttcgaaaccctaaattactggggaatccaacggaaacgaaccaagatcaagtgcactagctgcaaccacctcatcggttacatctacgacgatggtcctcctctcactggtggtattggccaatacggatttggtccgagtcaagtcattcctcgtgctcctcggtatcgattcaaaaccaaggcggttcaagtctcgtcccagacttagctaaagcagagggtttaatgcttttacatagatatgtataaacttgttaaaagggttaataggattgtagatgtttgttgcttaaaactcagatagtaaggtcgttagacttgccatcggtcttggcgcttgcttcagcgccaagacggatggcaatacggaggtttaaccgccttttggaactgatttttgttgcttgcttttgaagaaacatctacaatcatattctctcctttgtctcttgtctattgtagctagtatagttaagatatgtatgttaagtatgttgttggcttggattttgatcatatttgtagtgtttgtgtttgttgtgagtttgaatcacatggttgactgatttgttcaatgatttgggacgaatattttcgtagtttgttcaataatcatcggttgttttgtttggtgattcgagttttgtacgaggaactttagaagctgattgttttaagaacaaactctatcggcttaaagagaatgtgaagaacagaacaaaaaccaatagtgttagtttaatggaggacgtcatttgaaaatgacgttttggtgatattgattgtgatggccatttatgattcaacggctgtgattgaatgatgtaacattagttgcttcaagaccatatattttatattatccatacactacctaattgcttaaaatattgttgatgttgatgaagattggaagttacatctacttgtctacttgtcgtttcttgtatagttggagtttatagtttgtcttaacgtacaagataatttgaaaggtagacgtagacgttggatacttatttggtaggctcttaagaatcttaggtgtatctctttagtttgaaggttagattcagaatctctgtagattcattagtagctttttctgtgtgatctttgtgttgtatatatatagatcgaattgattttagctggtgaaaggtgaagttgtggtatgaatatgaagaaacagatt

SEQ ID NO: 14120 - DNA, 3000 bp, Unknown
  misc_feature (1)..( 3000): cDNA_ID_2686544_gDNA_ID_2214701_Annot_ID_136867 3000 nt of promoter + ATG
ccttgcaatcctctctacgcaacttcgctcaatgtcttttgaaccatgagcagcaaactctgcaagatcaatcgtcttgcatatatgtatatatttgttcgtgtgtgtctctgtacatgtcatgtgttattgcttctatattaatggatctggactttggtgtggttgttgatttgtaactgttgaataaaatctttctatggaacactaatttcttcttgttccatagatgataagtattcttgttctatattgtattttggtggctacagtctacaattctacgcattagaaagatttaatacatatcaggtgcataatgagtctccatttatcttatttgaattacagaattgttgctgaatttaatcctagcttatatactttagatagtagatttgagtgactaataaccagggtttgttatatattatccttcaaactaaatcatacttaacatgagtttctttttttcttcatttaaaattttgtcaattggtggttttgcattgaacttcttgctttaggtctgaagcttcatactgttttaatctgcataaattgcgacagatatttcaaattaggagtatgaaaatgtaaaaaaggtcttcaagatttttttttaccatagacttttttattttttcatgataacattaatatgaccttctttttttttaacatcaacataaatataccttgtcaccacaatattcttagtttcttttcaaaaataaaaatcgtaatttttctattattacatcatattttgttaattttttaaaaaacaccacatgcatattactgtagcttcacatattggagatttggttttgtatcacgacaatggttttgttgtttgagtatcagtttagataatgcatgtcaattggttcaccccacaaaaaggcagttgttcattatgtcattttcaagctacacaagtagatcatcagactctcaaccatcagcaaagcagagcaaccatgataattttaactcaatagtcacatttggattgcaagcatgggtggatgtatgttaggagtatgtgggacacgtgccccacattgattataatgttttgcgagtattagagtttacaatggctacttagcatctttggtcgtaatgtagtaaagtattaccattcccatgtttagatccctttgatgttgcaatgttttctttatgtgtttattagttatccaaataacattattctaatttcttttttggttggtctttcttataaaaatgtcaattctaagttttgttatcattattttgtattttactaatcaaaaaaatataatattgaaacaatatatatatatatatatatatatttgaaataaaacatatattttttttgtgccccatacaaaatacatgtttagatttgtcactgattctaagaacttattttgtagaaaagtaattttcttaatattctatgaatctttcgaatatgttatgcatttacgttggaactgttaggtttctcataaaacattgtaaaactaaaatataataaggggtgtgtggaattttggctcaaaaagattgtatactttgccagatttattgattttgagactatgttgtgcagcatgtgcacaaaatttgttgattttggtaatagtgacaatatagatccaaagatgatttttaaaaaaattaagtgaatatatagttcatttttatcgtaaataattggttaaattataaaattaaaatattgtataaagagaaattaaagcgattgtaccattgtagcaaccacaaccagcatatatgtttgctcaagatttttaagttgttttatacacgattcaagcatatgatcttaatatcaaaaaggatatattaagtttaatcggctttccattttagttggtagcaattgtaaaaatttaatattatatccttatttattaaatattattattacctaaccttttttgattaacaataatcataaaaaagctgaccatctcaatttgaagataaacaaatagatttaaagaagtgatcaaatcatgtattggtaatgtctaacatgttcttaccacatcttaattcacagataaacatatacatatacattgaatatgtttttatataacacatggttcaagggaacaaaggtgggataaatcctatcatattttctattcttgacttaccttcataagtatctaggttataagtttaaattttctttataaaaaataacaatataaaaagaaacagttaaatttgaaatttactactttttaacaaaaattattcatccatctgtcattcaagtatcaatatagaaaataaacaaattcatgttgtcagccatactgcatgaacatgaatttcttttatctttttactttttttcgtaaaccctcaaaataacatcagtaaaaatggatagcaacataacagataaataaaaaccaaaaacaaaaacaaatccagggtaagttaatatgaaacaaatgcattagatcaaaaacttatttattagtgtagcaacttaaacagaaataataagtctcaaagttaattttttttttaataccaaaaattatatcttttatattttgaatgaccacgaatatctttttcacttgatcgataaaattacatcatacagtacatcttttctaaattaaaacaaatctaaaacatggttaacaaaacaaacgggttaaatgtgaataaacaaaaagtatcgggtgcaaaacataaaaagacaaaaataaaagactgagtccaaaattccaaaaagtcaaagccaccttcctaacttgtctgcatagacgaagaagacaaagaagaagagattcgatcacacaagaaaaattacaattcttcttaatcctcattattatatatataaataaacttcaatctaagcttcttcgtaatttctctttcgttcaatgttattcttttagatctcgaacaaaacaaaatctccagaagaaaaaaccaaattcc

SEQ ID NO: 14121 - DNA, 3000 bp, Unknown
  misc_feature (1)..( 3000): cDNA_ID_3021876_gDNA_ID_2214701_Annot_ID_136871 3000 nt of promoter + ATG
gattttgaatatagtgttaagattatcaacaatttgtataaatatttctggtataatattatgagagttttgaatctaataagattagaaagcaaatatatagaactttatgttaaaagttataattataagagaactaagtaagaacctgaatcgtgtagtttttgaataaaggatgatcataaattggatgattattcatatgaacgcagtctattatatctccatctggactctgtataaagattatcgaatattcacgaattaatattttaatgaaaaaaattgttaggtgtaattatttttgtgtgaaccaacaaatttcattaaccttgatagatttaagagcaggtttgttgagtttctttaagattttttctacttttgcatcacgagtatcagaaaactcactaccagaaactatcgccgctacgattagaatgctgagcacaaaacgagcaatcatcattcgattgattattaagagtatccaaaatattttttttctttggctaagtagatgattaaggtgagtgccttatatatatatctacaatgaagaattttttttgcaaagcatatgttaacaaatggtaagaaaattatacttcaaaactttttattcattagagcaagactcttaatttaaagcaaattaaagtgtatttaatttgttccttgaaatagcttaatctatttttgactaaataaattgtatatggacatgtcaaaagtcaagtaagctatttcaaggaacaaattaaattttgatttaagttttattattttatcaaaaaatacaatttttaatgaagatgaaaataagtttttatatatagaaaaatacagatttaaatgattttaaagagaaaggttgggtttttacttttgaaaccttccattcaaatagaaggtttaagtattttcagatttagccagatttgatttagtcttagtttattttcctggttttgaatttgatttgttaatttctttttaaaatgtgtttttgttttaatgaaacgaaaactgttaaaaatttaatccaaaccggttttagattagtttttaatcttgttgtggtttaggattgaaaagattcatttcatgtggttctttaaaattgtcatatctctcgtttggagtttctatagtatttctgatatagttttagttttgatgtcaacttgattttcattttaccattatacatgtagatgaaatcatattttgtgaacataattcttttttttctgccaaagattagacaattaatatcctcttgaattttgaaaaaaataatgtataacacaattaaatttagagagcggtatgctatctatgtgttacacattgaaagtgtctgtattatgctatctattaaaactatgagacgcatgcatgtatttacctaacaattaatgtccatgttactctaaacttcaagtccaagaaagcatcaccaaagcttcattcaacttgttcattttgcatttatccatgatttttaagctcattgattgtaaattacgaattgtggcattgtatcgtaactttcttcagattcacatctttaacagtttatatcactcatgccaaacaaaaatcgcatcaatcatatttctataagttttatcagtctaccaaataaactctgttgatttaatataatctattagagcatccacaacacaagttattttttcatcaaaaaaaaaaagttttgggttatggatactctaataaacacaagctattgaagtgccatcaagcccaatactatgagacaaacaagcccatgtaattagggttctctagcaagtagaagtcatccaactctccttcttcatgtgatgaaacatcaaatctagaatcatttgcttttggtgaaaatttaaagtctttccttttgctttctatgcatcttaataaagctgcaattaatgagctatttattttcagttttagatttctcctttaataagctgaatgagcataaacctatctaggtttagaaatgtcaacacaatcttttgaagtattatgaatctcttcaaactcatgtacacgctctcgaaacaacaagacaaagtaaataaagcaagacacaaccataaattaatcgagcaatattgtactatcttggtgtaatgtatggaactaattaccgactacggagatcataacacatttattaatacataattacgttttaaaaaacgagaatgacgaaaagttggtccaacactccaactacatataactaatatcaagctttaaatacttgaatgacgtgttgacgaaacaaatatttatcaatacaattgcgtaaccataataataattcaataggacttttattaatcgtgtgattacaaattttacacacacgttgaatattcgacaaatatgacttgatgtggtcctacttcgatgacttctacgttgacttttgctgtttgaggtagagaaggaaaattacctgccatcttttttttactataattaaataaaataaaataaaaactttactttattatattttcgggaaaataaattgacttcaaagtttcatcatcatacaaaggagaaaactttgaagcttcttactttctttacttcacgatccttcttttgcctaatttctcggtttcatttccaaaattctcttttgattctttcttactctttcgctagagaagatttagactgggttttgagtatttctcggaaattttcgtgttttttttttctgggaaagtttccgagatctcggtggagtactttttttggcgacgaaccagtatggtttggtactcaagctgtagaattttgtttctgggtctgcttattttgttggcttcgagctgggttttggatagatgcgagggatttggtgaatttgggtttgaatttcatcatcgtttctccgatcaggttgttggggttttgcctggagatggtttacctaatcgagattcttctaagtattatagagtg

SEQ ID NO: 14122 - DNA, 3000 bp, Unknown
  misc_feature (1)..( 3000): cDNA_ID_2710928_gDNA_ID_2214701_Annot_ID_136873 3000 nt of promoter + ATG
tgtgaaagggtcagacttggttgcagcgcaagatccttcaagacatttaaaaacagtacaacacattggatgagactacgggtgacttaagccaggtttcttttattctcagctggaatataaatctcttgatcgtatattttaagatagcctagttagtccaacctggctttcttcttgtgaaggattgaaggaacattcattacagctagcaagctttaagcattgctggattacaccaggcatgggagctgtgggcatatggcgcagagacatagaaaccggtactctattcttgataactgtcttagagctcaagtacatgtctcatgaattggtacacgagaaaagtcctttatagttattgagctacagagtataaaaaaggttcatgtacaaaacatgctctcactggtacatacgtaactgagtttattttggtgaatggacaaaatatgcactcactaatttattttctcgacatttttatattatttgtatctaaaatatttgttggatatttgccaaccaacacgatccgataatgaagtttctaaaaaaaaaatctaaataaaaaatcaatagtatttcaagaatatattccaaattaaagggtatattatcatttgtatttctcttttaataatgtagagatagattttagaattaaaattttttccttttcttataaatatatgaacaaatttaaatttggcatgtctctcatttatgttaatgactaactttccaaaactaaaacttatataataaaattactaaatatataaatattaattaatataaaatgaatagaacaaatcattatatactatatttgtcttcacaaattataattgtattgttagagaaaaaaagaaaagaaacaacaatttatttttctatttttgtgaaaccctagatttgaacatcgctcatttcttcttcctacctctccatagatttatcatccttcaacaccaattttgttattattattcatcgcttctcctcatagatttatgatgagtaaaccgagatggtttcaagtattgacagaggaagacttagatggaaactaccaaaagcatacttgtggtttccgaaaaaacatcttcaggttcgagtcctgcgacgtagtgtgccccgagggcatagatcccaaccatattcaacctcatgttcaagtatgttctaatttttttctatatgccctaattatatatattactttatcataaattttgcatctttgaatcagtgcaggtgtgcaccatgcttgatcttaacgcctttgaactgaaccaaatctctgatctctttgattgttcccaaattcaagtaacaaaatagacaaattgttctcatccaccaatttctctaaaggtaatttatttaaacacatgattgatattttttttacagaatcatggttacgttggagggaagcagtttataatgttgaggccatggagagactgtgtaagaaatacagaaggttgcactaaacatgtccaagggattaattccaagttctgcactttcacctgcaagatcgaacatgttttggagcatgaaggtgatttgtccagcattactagactttggtcgtcggaggatgattcgagagaactgtcagaacacgttggtgatttagcaatccatccttgtggtgatccagagagaatctttccattaaagaagaggtctcgaagaagaagagagttttttgacagctactacgaagacatctatgcatcatactagtttccgagatatctcttagttctattagacattgttcacatgtttgttttgtggaaatacagtttagcatattatcaggagattgttattcttggtttaaaatctacatatagagaacccttctcttcctaacgatagctaagcaggaaacatcatacaacggtacaaactagcaagtgtgcttagtgatatgtctgaggcaaaccaaatgagacacgtgaaaaagaattagttgttttatcaaatgatggaagatagttatcacgaagggttaaataccgattagggatgaatttgagtttttggtacggtacaaagtttgttaattggttcgagggactaaacgtttaatttgtttgttataggtgcttgtgacaagattataaaggtaatgagataatgatataacgagttaactaagtgataaagaacgggaaatgaaaagtaacgtaataagaacaatgatgatgagtttgatttaccataagtggtgcaagctacgttgatggatgatgcttaacgatgatggctgcatgttttacactttttttcaaaataaatatttagctaaaaactcacgcgtaaagctaaacgcggtagaatggctaattcgtaatttgcaactcgtgcaagcagactccgacgtggcagtgaaaaaagaataatctacattcgataatacgaccaaaccatcaccgaaactctcgtgactcgtgtactctcacgatcacattagctactccactatcttcttattttcttcttctttttttggataatcactttgacctctcgttccaagactaataccttctccacaagtaccatctctgtaattcttgactttcttcaacctatgaggtgaagcatttcaacactatctcctctcttacaaaaatattctaaatttctatgattttccatgtttgttcactttgatttcactctccaagaaacatttttttctccgatgagtttacacttaaacagataaaattttcactttaagaaaaaaattcttaaaatgttctctgttttgaagatctttaacgtagtagagaattttattgtcgcagtcgaaccataatgtgattccttggtaacttcaaatctctttgttattcataatcagaatctgttcacacgaggtaaaagtctcaaactttcttatgttctgcttcgttttaggtctcaaaatttgagtttttgagctgtttttggttaggaagagaaatg

SEQ ID NO: 14123 - DNA, 3000 bp, Unknown
  misc_feature (1)..( 3000): cDNA_ID_2991474_gDNA_ID_2214701_Annot_ID_189680 3000 nt of promoter + ATG
aggaggagcagaattctgttgcgcttctcattcatatgttatataatgatgacccagaagagatgtttaaggtgcattgagctcttgcacattcagattcattaatgtgtgtcatatctttatgctgactttaggctttctagttattggcttacattaatatttttaatgtttaatggcatttattcccagttgcctttattctttgtttgtaattttcaactgagacatagattatacttatccccaggagtcatcatttccttcaaaattctattaaggttttggctttcagtgtttgaagctgtttaattgaatttcagatagtcaatgtcctgaagaagcatttcctgacaggagggccaaagcgcttaaaattcaccattcctccccttgttgtttctactctaaaggtttgatttcttaagcgaagttattctttaaagcccctcataatttatgttgagcttaatttgcgatgacatggtttggttgtttctatttatgtgccataccgcatagaagagtatctgatatagtttgttaattttgttcttcttcaaattctgtaatttttgttgtctgttttgtttaaattgtagctaatcaggcgattgccagtggaaggagacaatccttttggaaaagaggcttccgttactgctactaaaatattccaatttctaaatcaggtaagtttcataacttttcactgccttgtgtgttcagatctgtttttaggtagaacaatgtgtctcagagctacattacttttttaaaacttagccaaagttagttcatacaagctgattgacaacgttgaaaattctcaatcaacagtttgtagatattagctaaagagactgctgttattgctctgtctccactacagtcatcagttcttgtatttattgttggatttttttgcttgttgcagattatcgaagcgctacctaatgttccatcacctgacctggcattccggttgtacttgcaatgtgctgaggtaaaactacgtacctgtttatttagtatgcacttgctcggtaaaatgctcacagatctttcctatttcatcaggctgcggataagtgtgatgaagaaccaattgcatacgaatttttcacccaggcatacatcttatacgaagaagaaatttcggttagttatgttttcgcggacgttcatatgtctcgtgtctaaaccaaagcaagtaggtgagtttaactctctctcgtgcgtcaaaaacttgccttttgaacaggactcaaaggcccaggtgactgcgttacaacttataattggaactctgcagaggatgcaagtatttggtgttgagaatagagatacattaacgcacaaggctacgggggtatttcatcatgatatgataattagtctcttaccatattcaattgtctctgcttaaaggctgacaagggaaaacttatactcttgcagtatgcagcgaaacttctaaagaaacctgatcaatgtcgagctgtttatgcctgttctcatttgttctggctggaagatcgtgagaccatacaagatggagaaaggtaatactttcttctgtgcgatagaacacagtgtgtttaaaatagctcattaggtttcttacttgaaatcagggttctactttgtctgaaacgagcgcttaaaattgcaaattcggctcaacaagtggccaacacagctcggggtagtacagggtctgttaccctcttcatcgagatactaaacaagtaagcgctttttattgtttgttttacttctcattttcccagatcagcaagcagcattatgtaatgtgaattatggcaggtacctctatttctatgagaaaggggttccacagataacagttgaatcagtagaaagcctgataaaactgatcaagaacgaagaatcgatgccctctgatccatctgctgaatcattctttgcaactacgcttgagttcatggagttccaaaagcagaaagagggtgccattggtgagagataccaggcgatcaaagtatagaatctcatgttggtcaaaagaagtcggtttgtttttattaaaaaaaaaaaaagctttgctttgagtcgtttgagaatcggaaagggactgatattgtgttgcttgctgctcgaaatgtaaacccgggtttaggtctagttttattcctcggattttcaaggcggttcatggtctgtaacttgtggagtttgatgtgtgtttatacgaatctttagtattctgagtttaacattggatattacatattagataatgtccttcatgaaaaaagtattcattttatgtattctgttgaatgattattgacgcataaaaacattttcaataccattgtataacgcataattaacaacctttgtgaggcttcagccttcaaatatatcaatagaaattcagtttacgaaatcaacttaaaaaattttgaaaaaataataaaatttaaaaaaaaaacaaattgtaggttaaatttttttaaaaacaaaataaaacagaaaagaaacgagaaaaaaaaaaagcaaaacaatcggagaaagttgatggaggagattgttcgttttgtgaacgcttcaatggcataaatttccggccatcacatttcttctactttctctttctctctcccttgttgttgttctctagaattcgattcatcgttgttaacgtcgtccattcttcttctttgatcccttctttgatctctcacatttccgattccaatttagggtttcctctcttttcacatttctagggtttttcttgttccctttgtaccggagatggtgaattgaaaggaaaaataaaacgcttttgagagcttatatttgaggttgtttcctcaggttttgtagatctgaggttgctatttttgaattagagattcttttttttttttttcaaaattttgtttgttgtgatcatacatagacgtacgtagctccatttctggtggagaaggaagaagaagagaa

SEQ ID NO: 14124 - DNA, 3000 bp, Unknown
  misc_feature (1)..( 3000): cDNA_ID_3021858_gDNA_ID_2214701_Annot_ID_189679 3000 nt of promoter + ATG
cttcatgctccaaaacatgttcgatcttgcaggtgaaagtgcagaacttggaattaatcccttggacatgtttagtgcaaccttctgtatttcttacacagtctctccatggcctcaacattataaactgcttccctccaacgtaaccatgattctgtaaaaaaaatatcaatcatgtgtttaaataaattacctttagagaaattggtggatgagaacaatttgtctattttgttacttgaatttgggaacaatcaaagagatcagagatttggttcagttcaaaggcgttaagatcaagcatggtgcacacctgcactgattcaaagatgcaaaatttatgataaagtaatatatataattagggcatatagaaaaaaattagaacatacttgaacatgaggttgaatatggttgggatctatgccctcggggcacactacgtcgcaggactcgaacctgaagatgttttttcggaaaccacaagtatgcttttggtagtttccatctaagtcttcctctgtcaatacttgaaaccatctcggtttactcatcataaatctatgaggagaagcgatgaataataataacaaaattggtgttgaaggatgataaatctatggagaggtaggaagaagaaatgagcgatgttcaaatctagggtttcacaaaaatagaaaaataaattgttgtttcttttctttttttctctaacaatacaattataatttgtgaagacaaatatagtatataatgatttgttctattcattttatattaattaatatttatatatttagtaattttattatataagttttagttttggaaagttagtcattaacataaatgagagacatgccaaatttaaatttgttcatatatttataagaaaaggaaaaaattttaattctaaaatctatctctacattattaaaagagaaatacaaatgataatataccctttaatttggaatatattcttgaaatactattgattttttatttagattttttttttagaaacttcattatcggatcgtgttggttggcaaatatccaacaaatattttagatacaaataatataaaaatgtcgagaaaataaattagtgagtgcatattttgtccattcaccaaaataaactcagttacgtatgtaccagtgagagcatgttttgtacatgaaccttttttatactctgtagctcaataactataaaggacttttctcgtgtaccaattcatgagacatgtacttgagctctaagacagttatcaagaatagagtaccggtttctatgtctctgcgccatatgcccacagctcccatgcctggtgtaatccagcaatgcttaaagcttgctagctgtaatgaatgttccttcaatccttcacaagaagaaagccaggttggactaactaggctatcttaaaatatacgatcaagagatttatattccagctgagaataaaagaaacctggcttaagtcacccgtagtctcatccaatgtgttgtactgtttttaaatgtcttgaaggatcttgcgctgcaaccaagtctgaccctttcacattttgatcaggttacttgtgtgtttcgcactttctaaaaacttcatccaatacatgaagcatggcgttatagctctcttcagataaagatggctccttactcaatttcaaagaacggacacagagatctgtgccaccgttgagatactaagaatataatttctctatatttttgcatcttttatcacagttgacacatactgagaagggatactaagaatttaagttatttttctttgaatataaaataaatgtggattactatttattattcaaatatcatccatacattttatatctaaatatagaatttaatttctctacatttttgcatcttttatcacacttgacacatactgagaagggatactaagaatttaagttatttttctctaaatataaaataaatgtggattactatttattattcaaatatcatccataagattgagtgtgtaaaataataatagaatgcaaaagactgaaatgaagcaaattttattaagttaaatatcaaagaaaaaatattgattactattgtactattcaaaatttaaatattatcgatcaaaattatttttttttaccttacacccgcctaaatatgcggatcttatctagtattctataatactaagttactaacattaaagaaactaacaaaaattttggtccaagaaaaaattatcaatttttttgtttcaatgattgatcgaccatttcctagattccaaaggtacctcccccatcgaccattttacacacttgtctactttagaattgtttgttagattggtaagtaggtaagcttttgtaatctccttttcttgttgttttagctgggttcagcttggaatcttttttaattaatggaaatttaaaatacaaaaaaaaaaagttatacaaatggttctaatttctatttaaaattttatgggcctgctatgtataaaaaatagaaaaaacattttaatgggcctaatgtcaaaaaaacagaaacaattgttttctatgggcctgcttttgggtcttatggttcgaaacaatggtccatgtgaagcgtgcaccgtcaagtaacctacaaaaccacgacatcgtttagtgctattcctgtttccaaacacaccttaagttcgttatcaaccccatcctctttttttctataaataacgaagcaacgagttaacgagaaaaattctggatcggagagagctacgaagcctgggaattttcgttacctccttcgttcttctctgatctcgaattcaataccaaattcttcaatctcccgaatctgattttcttatcactatccctggataacaaaagcccccaaagtaaaaacccaattgcgattccctcgtaaaccaatctagggttttcgcgagttcgtctctgagcttgtttgtttgtgatcgtgtgaga

SEQ ID NO: 14125 - DNA, 3000 bp, Unknown
  misc_feature (1)..( 3000): cDNA_ID_3021862_gDNA_ID_2214701_Annot_ID_189678 3000 nt of promoter + ATG
atccctatcctttctatctttttcattcctcttgtgttttctatctttcttcacttcctcctttgccccctggatttccaaaccaatgaaagaaacaacaataagtgtccataactttcttatccagtaaacctccaaaggacaaagaaggagagtagaaacacacaaacaatgtagaaattgtcaatgacttactctacttctataagttttaggaggctattcaatttcaaccacatttgtcagtattcagtccaatgaatcaatttcatgctttgagataaattagttaactttttaagtaagatttgaattcccatctatatggcaaattacttctccatgataatcaaagtttccaactttgacaaaagattatcaaaatcaaagaagcaggaagctgagcaataaaaaaatcacatgaaccaagaacataaaaaagaaccaaagtcatggacttttaaattgctcaacaaatcaaccttgatcgattcgatcagactttctttccaaacataaccaggtggtggaaacggataacaccgagacattctcacacgatcacaaacaaacaagctcagagacgaactcgcgaaaaccctagattggtttacgagggaatcgcaattgggtttttactttgggggcttttgttatccagggatagtgataagaaaatcagattcgggagattgaagaatttggtattgaattcgagatcagagaagaacgaaggaggtaacgaaaattcccaggcttcgtagctctctccgatccagaatttttctcgttaactcgttgcttcgttatttatagaaaaaaagaggatggggttgataacgaacttaaggtgtgtttggaaacaggaatagcactaaacgatgtcgtggttttgtaggttacttgacggtgcacgcttcacatggaccattgtttcgaaccataagacccaaaagcaggcccatagaaaacaattgtttctgtttttttgacattaggcccattaaaatgttttttctattttttatacatagcaggcccataaaattttaaatagaaattagaaccatttgtataactttttttttttgtattttaaatttccattaattaaaaaagattccaagctgaacccagctaaaacaacaagaaaaggagattacaaaagcttacctacttaccaatctaacaaacaattctaaagtagacaagtgtgtaaaatggtcgatgggggaggtacctttggaatctaggaaatggtcgatcaatcattgaaacaaaaaaattgataattttttcttggaccaaaatttttgttagtttctttaatgttagtaacttagtattatagaatactagataagatccgcatatttaggcgggtgtaaggtaaaaaaaaataattttgatcgataatatttaaattttgaatagtacaatagtaatcaatattttttctttgatatttaacttaataaaatttgcttcatttcagtcttttgcattctattattattttacacactcaatcttatggatgatatttgaataataaatagtaatccacatttattttatatttagagaaaaataacttaaattcttagtatcccttctcagtatgtgtcaagtgtgataaaagatgcaaaaatgtagagaaattaaattctatatttagatataaaatgtatggatgatatttgaataataaatagtaatccacatttattttatattcaaagaaaaataacttaaattcttagtatcccttctcagtatgtgtcaactgtgataaaagatgcaaaaatatagagaaattatattcttagtatctcaacggtggcacagatctctgtgtccgttctttgaaattgagtaaggagccatctttatctgaagagagctataacgccatgcttcatgtattggatgaagtttttagaaagtgcgaaacacacaagtaacctgatcaaaatgtgaaagggtcagacttggttgcagcgcaagatccttcaagacatttaaaaacagtacaacacattggatgagactacgggtgacttaagccaggtttcttttattctcagctggaatataaatctcttgatcgtatattttaagatagcctagttagtccaacctggctttcttcttgtgaaggattgaaggaacattcattacagctagcaagctttaagcattgctggattacaccaggcatgggagctgtgggcatatggcgcagagacatagaaaccggtactctattcttgataactgtcttagagctcaagtacatgtctcatgaattggtacacgagaaaagtcctttatagttattgagctacagagtataaaaaaggttcatgtacaaaacatgctctcactggtacatacgtaactgagtttattttggtgaatggacaaaatatgcactcactaatttattttctcgacatttttatattatttgtatctaaaatatttgttggatatttgccaaccaacacgatccgataatgaagtttctaaaaaaaaaatctaaataaaaaatcaatagtatttcaagaatatattccaaattaaagggtatattatcatttgtatttctcttttaataatgtagagatagattttagaattaaaattttttccttttcttataaatatatgaacaaatttaaatttggcatgtctctcatttatgttaatgactaactttccaaaactaaaacttatataataaaattactaaatatataaatattaattaatataaaatgaatagaacaaatcattatatactatatttgtcttcacaaattataattgtattgttagagaaaaaaagaaaagaaacaacaatttatttttctatttttgtgaaaccctagatttgaacatcgctcatttcttcttcctacctctccatagatttatcatccttcaacaccaattttgttattattattcatcgcttctcctcatagatttatgatg

SEQ ID NO: 14126 - DNA, 3000 bp, Unknown; identical to SEQ ID NO: 14122
  misc_feature (1)..( 3000): cDNA_ID_3021866_gDNA_ID_2214701_Annot_ID_189677 3000 nt of promoter + ATG

SEQ ID NO: 14127 - DNA, 3000 bp, Unknown
  misc_feature (1)..( 3000): cDNA_ID_3021876_gDNA_ID_2214701_Annot_ID_189673 3000 nt of promoter + ATG
tgtccatagttgagtcacaacactttgtttctctttgtctgaagattcattatttttacctttagggtaagaacttggtttcatctatgacacaccaatgttagaaacaaatatcgaattaaagataagaaaggctagcttaagagcagaattaatccaaccaattaaaacaatgttttagagtattattgacctgattttgaatatagtgttaagattatcaacaatttgtataaatatttctggtataatattatgagagttttgaatctaataagattagaaagcaaatatatagaactttatgttaaaagttataattataagagaactaagtaagaacctgaatcgtgtagtttttgaataaaggatgatcataaattggatgattattcatatgaacgcagtctattatatctccatctggactctgtataaagattatcgaatattcacgaattaatattttaatgaaaaaaattgttaggtgtaattatttttgtgtgaaccaacaaatttcattaaccttgatagatttaagagcaggtttgttgagtttctttaagattttttctacttttgcatcacgagtatcagaaaactcactaccagaaactatcgccgctacgattagaatgctgagcacaaaacgagcaatcatcattcgattgattattaagagtatccaaaatattttttttctttggctaagtagatgattaaggtgagtgccttatatatatatctacaatgaagaattttttttgcaaagcatatgttaacaaatggtaagaaaattatacttcaaaactttttattcattagagcaagactcttaatttaaagcaaattaaagtgtatttaatttgttccttgaaatagcttaatctatttttgactaaataaattgtatatggacatgtcaaaagtcaagtaagctatttcaaggaacaaattaaattttgatttaagttttattattttatcaaaaaatacaatttttaatgaagatgaaaataagtttttatatatagaaaaatacagatttaaatgattttaaagagaaaggttgggtttttacttttgaaaccttccattcaaatagaaggtttaagtattttcagatttagccagatttgatttagtcttagtttattttcctggttttgaatttgatttgttaatttctttttaaaatgtgtttttgttttaatgaaacgaaaactgttaaaaatttaatccaaaccggttttagattagtttttaatcttgttgtggtttaggattgaaaagattcatttcatgtggttctttaaaattgtcatatctctcgtttggagtttctatagtatttctgatatagttttagttttgatgtcaacttgattttcattttaccattatacatgtagatgaaatcatattttgtgaacataattcttttttttctgccaaagattagacaattaatatcctcttgaattttgaaaaaaataatgtataacacaattaaatttagagagcggtatgctatctatgtgttacacattgaaagtgtctgtattatgctatctattaaaactatgagacgcatgcatgtatttacctaacaattaatgtccatgttactctaaacttcaagtccaagaaagcatcaccaaagcttcattcaacttgttcattttgcatttatccatgatttttaagctcattgattgtaaattacgaattgtggcattgtatcgtaactttcttcagattcacatctttaacagtttatatcactcatgccaaacaaaaatcgcatcaatcatatttctataagttttatcagtctaccaaataaactctgttgatttaatataatctattagagcatccacaacacaagttattttttcatcaaaaaaaaaaagttttgggttatggatactctaataaacacaagctattgaagtgccatcaagcccaatactatgagacaaacaagcccatgtaattagggttctctagcaagtagaagtcatccaactctccttcttcatgtgatgaaacatcaaatctagaatcatttgcttttggtgaaaatttaaagtctttccttttgctttctatgcatcttaataaagctgcaattaatgagctatttattttcagttttagatttctcctttaataagctgaatgagcataaacctatctaggtttagaaatgtcaacacaatcttttgaagtattatgaatctcttcaaactcatgtacacgctctcgaaacaacaagacaaagtaaataaagcaagacacaaccataaattaatcgagcaatattgtactatcttggtgtaatgtatggaactaattaccgactacggagatcataacacatttattaatacataattacgttttaaaaaacgagaatgacgaaaagttggtccaacactccaactacatataactaatatcaagctttaaatacttgaatgacgtgttgacgaaacaaatatttatcaatacaattgcgtaaccataataataattcaataggacttttattaatcgtgtgattacaaattttacacacacgttgaatattcgacaaatatgacttgatgtggtcctacttcgatgacttctacgttgacttttgctgtttgaggtagagaaggaaaattacctgccatcttttttttactataattaaataaaataaaataaaaactttactttattatattttcgggaaaataaattgacttcaaagtttcatcatcatacaaaggagaaaactttgaagcttcttactttctttacttcacgatccttcttttgcctaatttctcggtttcatttccaaaattctcttttgattctttcttactctttcgctagagaagatttagactgggttttgagtatttctcggaaattttcgtgttttttttttctgggaaagtttccgagatctcggtggagtactttttttggcgacgaaccagt

SEQ ID NO: 14128 - DNA, 3000 bp, Unknown
  misc_feature (1)..( 3000): cDNA_ID_3021839_gDNA_ID_2214701_Annot_ID_189668 3000 nt of promoter + ATG
gaatgtgttgttaattatcccccttgcacaaaataagtggtccatgagcatattaatatttacaatatcactgcttgttgtaattttataatactaataacacagttagcgaattagatttgtcgatgatacccgacatcattaatgacaacttcaaaacagtgactgtatcacaaattattggacaagaagtttaccttactaataattgtgattaattaagtaatcaagaaggagaagaagaagcaaattgagatttgaggacagaggaatatgctgacattgattttgcacaaaaaaaaaatgctgacattgacatttattttataaatactaatagtgcacatgtgtcatgtgtgatatataaatactgtatgtaggaaattttgccttttggatttgatcaaattggattttaaatagattttggcacgacggaagacgaaatgtggtagaaatcatatttctagatttcaagtagattttgaaatttgcaacgttgcaaggcaacaaatttattttgactgtttacgtctctttttgttagaaaaatttcagaaaatgtttgatgaatataataaaataagcaaaaaaaaaaacttgttcatttttaagaatttattaaccaagcaaaccaaatcattactaattcaaatatcactctgcttaaatagtgtcacactatcaccattactgtcacaaatcttacttaacaacaaaacacatacagtggaaactctataaattaatactcgataaattaataaatacaataaaataattaattttgctagtctcaagtcgggccaatgtaaaaattaagcaaaatcgataagataataagataataatttttttgaaatttctatgtaaaaatatggttccaataatatcataaattaataatcatagatcttaaacaaatattttaagactaattttatatgaaacttttgttaaaactacaattgcaattctttttagattacagttggtatgatctcttttgtactcacacaactctttgagtatttgatccatcatatttggttttgtaacatttttttctatgaaaaatcattgttaagatttgtgtaaagaaaaattggattaagctatacgttaacgtcgtagatatacgaacacaatatcttgtaagaaaataaattaaaaaagtcaaaaataaaataaaatatataacataattgaatatacaaacaacaaaatacgagaaaatctaaattaaaaatattgtttaaaaaaaaataatattgtgttttacgtaaatattctttaaattaatatttattaatttatcttattaattaatatttattaatttattatataaattaataaaattatgtggtcctatcattattaatttatagagtttctgctatatttataattatcgccccaaaataataaaaacagtacaggaaagtcattatgaacatcattacacaaagcccattacaaaattcgcccataagcccaatctaacaacggcagagattcagagtcagttccgacggcgctgaccaaagaaacgcgtctctctctctggagaaaatttcctcacagagaaagaagaaaaagacgagagacgtgaagaagaaatcagaattcagaattgagaagcaaacaatggcttcaacgatctacacttgcaaagaatgcggatcagatctgaatctaaaccctaacgatttatttccaccggatttctacttcgaagccggtaacaaaggaacactctcattcgccgccgtcgacgccgagaaattccgattcgagaaagaagataagatcatgcctttcttcgaaaccctaaattactggggaatccaacggaaacgaaccaagatcaagtgcactagctgcaaccacctcatcggttacatctacgacgatggtcctcctctcactggtggtattggccaatacggatttggtccgagtcaagtcattcctcgtgctcctcggtatcgattcaaaaccaaggcggttcaagtctcgtcccagacttagctaaagcagagggtttaatgcttttacatagatatgtataaacttgttaaaagggttaataggattgtagatgtttgttgcttaaaactcagatagtaaggtcgttagacttgccatcggtcttggcgcttgcttcagcgccaagacggatggcaatacggaggtttaaccgccttttggaactgatttttgttgcttgcttttgaagaaacatctacaatcatattctctcctttgtctcttgtctattgtagctagtatagttaagatatgtatgttaagtatgttgttggcttggattttgatcatatttgtagtgtttgtgtttgttgtgagtttgaatcacatggttgactgatttgttcaatgatttgggacgaatattttcgtagtttgttcaataatcatcggttgttttgtttggtgattcgagttttgtacgaggaactttagaagctgattgttttaagaacaaactctatcggcttaaagagaatgtgaagaacagaacaaaaaccaatagtgttagtttaatggaggacgtcatttgaaaatgacgttttggtgatattgattgtgatggccatttatgattcaacggctgtgattgaatgatgtaacattagttgcttcaagaccatatattttatattatccatacactacctaattgcttaaaatattgttgatgttgatgaagattggaagttacatctacttgtctacttgtcgtttcttgtatagttggagtttatagtttgtcttaacgtacaagataatttgaaaggtagacgtagacgttggatacttatttggtaggctcttaagaatcttaggtgtatctctttagtttgaaggttagattcagaatctctgtagattcattagtagctttttctgtgtgatctttgtgttgtatatatatagatcgaattgattttagctggtgaaaggtgaagttgtggt

SEQ ID NO: 14129 - DNA, 3000 bp, Unknown; identical to SEQ ID NO: 14118
  misc_feature (1)..( 3000): cDNA_ID_3021888_gDNA_ID_2214701_Annot_ID_189666 3000 nt of promoter + ATG

SEQ ID NO: 14130 - DNA, 3000 bp, Unknown
  misc_feature (1)..( 3000): cDNA_ID_2710924_gDNA_ID_2214701_Annot_ID_136874 3000 nt of promoter + ATG
gtacctcccccatcgaccattttacacacttgtctactttagaattgtttgttagattggtaagtaggtaagcttttgtaatctccttttcttgttgttttagctgggttcagcttggaatcttttttaattaatggaaatttaaaatacaaaaaaaaaaagttatacaaatggttctaatttctatttaaaattttatgggcctgctatgtataaaaaatagaaaaaacattttaatgggcctaatgtcaaaaaaacagaaacaattgttttctatgggcctgcttttgggtcttatggttcgaaacaatggtccatgtgaagcgtgcaccgtcaagtaacctacaaaaccacgacatcgtttagtgctattcctgtttccaaacacaccttaagttcgttatcaaccccatcctctttttttctataaataacgaagcaacgagttaacgagaaaaattctggatcggagagagctacgaagcctgggaattttcgttacctccttcgttcttctctgatctcgaattcaataccaaattcttcaatctcccgaatctgattttcttatcactatccctggataacaaaagcccccaaagtaaaaacccaattgcgattccctcgtaaaccaatctagggttttcgcgagttcgtctctgagcttgtttgtttgtgatcgtgtgagaatgtctcggtgttatccgtttccaccacctggttatgtttggaaagaaagtctgatcgaatcgatcaaggttgatttgttgagcaatttaaaagtccatgactttggttcttttttatgttcttggttcatgtgatttttttattgctcagcttcctgcttctttgattttgataatcttttgtcaaagttggaaactttgattatcatggagaagtaatttgccatatagatgggaattcaaatcttacttaaaaagttaactaatttatctcaaagcatgaaattgattcattggactgaatactgacaaatgtggttgaaattgaatagcctcctaaaacttatagaagtagagtaagtcattgacaatttctacattgtttgtgtgtttctactctccttctttgtcctttggaggtttactggataagaaagttatggacacttattgttgtttctttcattggtttggaaatccagggggcaaaggaggaagtgaagaaagatagaaaacacaagaggaatgaaaaagatagaaaggatagggataatgaggcggggaggagcaggaagcatcggcataagagacggcggaaagatgaaggcgccattgctagtggcaaattagtaagcagtgaggtcgagttgttagagaagagctgccagactgtggaacttgagcttcaaacatcgtctcagaattcttgtgatagcactcttcatagcaatgagagaccaaagcaaattcagagtcagccccttgatggtaggcataacataacgactctggtgagcttgtttgcttttacttgttgttgggtctgtttgcttatggtgtcattctttcttggtttaaagaaaccagcatacggactcggttacctgacaaagggcaggaagatcctgaggatggggtgatgatgaccagcaaggatcaaaaacagcgcttttcccgggaaatgttagatgcttctcaagctgctactgctcctaatgagtctgttggtcattcaagggtctgtcaagagaaaagaatagatccaacttttggttcgtcgagagagatcacaacaaaactcaacaaagagaagaagtcagttccttcgaaagataacagaaaagttagtaaagagaagaagatgccatcattatcttcatgtaaccctctggaacaagagaaaccgacctctagtcatcaagaaacccctggaccttccaagctattatgcaggaaatgccctccttccatggctgggcaactcttgaatcttatcgagaactgggctcctgatcgggttgagagcaagctcactgactctgaagatcaagaatggtggttgttcatcaagtttggagccaaaagtccacaagttagcaatcagaaaaccaaccagggaagtagttccatggtgtggccgactgctagatttcttcctgaagccgaagtacacgcattgccattcactgtcccgttctgatttcaacaaagttggtcgagagagagtgagagagagagagagagagtggttaacatgaccaacatatagttttcccaagtattttagagtagccttgaaacttaagaaactcagaattatgtgtgattctttgtagatgtactggtaatatagtaaatcaccaattacgtaaatggtaaatatatgtgctggttagatagtaaattacatgagagtttcgaacttctttggctacttccttatcaatcgtaaatcttatttacgatctttgttttttttttctcataagtgttgcctctcattataaagagtttgccaacggtacaaaagtggaacaatccactttcaaactacagacaacacattaaacagaaaacaacattggaagaccaaacaggtggtatccatgttgcagagaaaactatttataatttgatttggttcgattttaatcaaaatgcaaatcaaaaatataataaaataacaaagtagttacaatattttatattaattgatatgtttattcataatacataaaatataaaattgaaataaattttgtttatccggttcggttgagttccaatatagcagaaacgattgcggttaaaattctggattttattcggtttgatgaaatagaatatggaccgttagatctaaagttaagtagaaacaacgaacggtggatagcgaggaaaacgtacacgtgtgaagcatgacataatttttttcccatccaaagactttcacaaggtcttttttttgaaacctgaaaagtgagaaacccagagatcgagattgagatttagagaagacgaagatcagaag

SEQ ID NO: 14131 - DNA, 3000 bp, Unknown; identical to SEQ ID NO: 14123
  misc_feature (1)..( 3000): cDNA_ID_2991474_gDNA_ID_2214701_Annot_ID_136875 3000 nt of promoter + ATG

SEQ ID NO: 14132 - DNA, 287 bp, Unknown
  misc_feature (1)..( 287): cDNA_ID_2705235_gDNA_ID_2214702_Annot_ID_136876 3000 nt of promoter + ATG
ctccctacatttccgattcaaaaccattacagctacacaatggacaaacagagcaaaagtttccaaaacaagaaaaataaaacccaaaaaaaaaaaaaaaaaaaaaaaaaaccagaaaatcaccatcaccggaatccgtctagcggaacgacggagacatcttccttctttgcatgttaccgccgtttcttggccgtagaagatataaatattgatagtcgtatataaaaaaaaaacatataagacaaggtacataagaaaaaaacaatttcgttaaagaaaaaatg

SEQ ID NO: 14133 - DNA, 3000 bp, Unknown
  misc_feature (1)..( 3000): cDNA_ID_2711004_gDNA_ID_2214702_Annot_ID_136881 3000 nt of promoter + ATG
acgcatgtatttgttgaccaatattatagagagtttgtctaacctagaggatattttggtcataaacattacacacacttttttgttccttaaaaacaattctttgtattcatctctttaattttccttaacaaacgttacattacggactgcatcgaccgacccactatgtagttgtattaatggtttgtgttaacccaaaatcgattgcgtgtctcaaaagacgaaaaaaaaaacgactgtcttatacaaaattcattaattatgatccaagtcttgtgttaattacggtcaacattttaagttaaaattaattatttattatatatgtggtggatttaaataattattttcatcctgaacattaaagggttaataatttacctaaatgactcaccaaaaaattaatttacctaaatgaccatgatgaatatctaattatttaggtaaatgagcaaatgacaaacatataatcaaagaaacactttaatatatataaacatgtaaacaccaattatttaggtaaataatgtattttctatcatttgactttaatgtctttatatatatatatatatatatatatatagatacatatgtgttttgcacaatcattttattttaataaacaacgtactgtataaatcacataaataaaatagcataatatttttgctaattaaaagtcgcttatgtcatccaatacagttgagtgtgtttttaaattgttttatgtaatatataaaagttcatggttaattaggatgaatattcaaaattaaaggacaaactctgtttctattcgctacatatatagttttacggaatacactctgcacaagtcatcataaaacaactggaatggaatatgcgatgaatctctttaataataatatgtgggatctgactgtggattctaatctaatatttctattataagcaatttggacgattcgtgccattttaaaaatggttgagggatttttttatggggttgaatattgtcattgcgccttatcagaaacacaaaaacaaaaaaaatattgtcattacatgcatgatgttgatgaattatttttcaatcatataaacttgtggttgaagaaaaagcacaatatttaacaaacaaaaacataacctgaaacaatataaacttactttctaaattaataaaacatttgaccgaatggggaatctaaaagtgtgtcatataagatattgatttaaagacctagatgacgtatgggcttacataatatgtggtcaacattgaatattatagtcagagcaaacttcgcacgaacaaatcaactccaatctcacaccaatagcataagaccatgccgtagtctatatgattgccacaaaagaattattcttattggccaactttgacctagtgttatatttgtatttatatcttttaattaagtatttattgaattatgtatatacattgattgttgcattcatcttttttacttagtatgccatctattcaattagatgaacacattgtaatactataataaattacgtatgtttagttacgatagtgctttaattttgatctaaaccacatgatctagtcagaacgctttgatcgatatttgtttgtgtttattttttttgttgttgctaaattgtaaatatcagtaaggaatgaaagttggggcgtacaagaagttagacctataaatataattgctactttgccaaaaaggtataaaaacaagggaacatatacaagagaattttatgagattcaataaaagagctttagtggagccacacggttgcatcagtcttgagaagctgcgcaaatgtcgtcttgctgagattgagttacggagtaacttgtatattgttttggagtaacttgtgcttgggttcaattggtttactagtactttatgtagcaagttatagaacagttcatatctgtatatacagtttgtgagggtggcatttccacagtctctattggtattgtatgtttatgagacaattcatgttacgtatatgaattgttacaaaactttatgttgtgaccagctacaaaattagttaccaagtcaatatccatggccacgacaacacaatagcggccactatactagtgaacaaatcatcggtagctatacttcttggaaatggtaatgaatactacaaaaataaccccacaatattcttaagttttttgtgtggctacacgcctacactagcttagtcatggataaagtcgtttacatatgtgatatgtccgcctaaccaatgaggattctgatttctgaatcgggcagatttgtccggaacacgatctatgctcatgtaggtcctcatcactcttgcaatgatctttaccacaattaattcacaaattcaacttaaaatcttataagttgaaaaagctccgatcctccctctttgttcacattaaaacaaaacagaacttattgaacacatatctgcatgactgcattttaaaaagaaaactagctgtattgggctatgttgtgggcttcgctagcccatgtaggttgaatatctcttgtcatagtaatgaccatctatattgaaataaaattcttatgataacacaaaccatattaaatctgaacattgattcacgcaaatagagatagttggcaccaaaagtctaagacgcacactcatcttcataggaaacccaaaccctaagaaatggaaaattaacagcttcatagttcaaacgcagaataaaaataactacaaaggtaatattcagttttcacataaatcattttccttttttctataacaaatggatttccttttttaaacaggaaaatacctgaaaaagttaaggcaaaggtggctactaaattatttatatatctacgttcccttagctctctgaacttgagtctaagataaagaaactctcgacgacatcttgagaatcgaacgagaatgatccaaaatctgcaaaaattaccccaagacctccaatcctcggca

SEQ ID NO: 14134 - DNA, 3000 bp, Unknown
  misc_feature (1)..( 3000): cDNA_ID_2706080_gDNA_ID_2214702_Annot_ID_136883 3000 nt of promoter + ATG
cctcaatcgactgaccacccacaatagaagtcaccctaaaccctagataatgcgcaaacttaacagtttcctcctcaatctgctgagcaagctctctagtaggggccataacaacagcataaggcccctcagtctcattctcttcgctcatcggtggcaatctagagatgtaagctaacatgggtaaaacaaaagcagcagtcttaccagaaccagtctctgcaatgccgataacatcacgctgttgcagtccaagtggtatagctgccatttgaataggagaaggtttcttgtatccagctctctccacagctttcaaaagctcagaagtaagcttactctcttcccagctcctcatcggacgaggaatcctcgaacccttgtaagagatattgaaatcttctctgaaaatacgccaatccctttcagtcatctcctctaatctcttatcactccaatgcctgtcaaccctcatatcaaacgagtcataagtatcagcagcttcttctctcactctctgagcagcagcttcctctggtttctctacaataccatctttcttacgaatctcgtctcgcatctctttctcatgcttagccgcttgtttcttctgctcacgacggtccataccagcacgaaaccctctcccaaagagaagctgagcttcatgagggttttggtaaagaacgttcatatccctagaagtatcctcagtgttttcccaatcaaaagagaaacgaaacttctcgcttggcctaatgactctcttcttcggcttcttacctccaagatactgctctttaatggcgtcaagttccttctccttctctctctcaactaatttctcaacacgcgccttctccctagccttaacctcctcttccctctccttttctctatttctccgatccggttcacgatctcgttcacgacggtcacgctcacggtctctctctcgctctctatccctatccctgtctctatccctatcgcggtctcgatctcgccctctatctctctccctatctcggtcacgttctcggtctcggtcccgatctctatctcgatccttatcccgattggtatctccattggagacatcttccgtctcgggctcggggcgaccaagttgctcacgacggacacgttgctcggagatttgatcctggcggcgttttagggctaactcttcccgctgttttttggtgaggaagacaggcttcttagcaatggaggaatcgagagtattgacggaggtagatccgacgacttcgttgattgttcgcttcatcggtggttagctggagattattcgcttggtcgattagcaggaggggaaagcaaacaagacctagaacctttcttctcttcttctctcgctctgatttctttttcacttggattctctttttctacatttttccaaaaccccccaattctagcaaactctcaagggttttaggcccattagtttttcttttgcattccgaattcaaatctaattttgtttttaggcccattagtgttttttcagcggagattatgtagagtagttagattttctcttgggtgaagattacaaacccatttcaagggttagagaactcgcttgtagtagtgtggtgtgacacagttcattcatcattagggattaaaccaactacactaattctgtctttccaacatgaagttttctggtaatgcaaacgaaaccgattatcttcgacatcaatgttcagataaagttgaaaactgatataatggttgctaaggagacgacaaaatgttttttgtggaagcagagaaactaaaacctgattcgttctaattgatgctctcaaaacataaccctgcttaaatgctgatgttcctaaactcaaccctgctaaatatgctaattcatcgtataatctatacatatcacctaatcttagttaagcaattaccaaagataatgcttcaccccaaggccattgcaagtcaatatgagctccttgtactcattcaatagttcctgcaacagaagatacacagggatttatcaaactcaaaagctttggaagtagtttctctctcgaatgaaattaataactttcgtctaccgtgttgtgctcatagatacgacgcatccttttcttatcgtactcctgccttgcaattgggtcgctcaacactgttcagttacaagatcaaattctttattgctaaagtccacagaatcaatggctaaatgaaaacagattcctttcccctaaactagtaaacttctttccttcaataatacattctgcattacatagttagaagaagaccaatgaaacaaattcacattctaagcttactactacttcaaagcctagctcaacaaacaaacacaactacatctacacgatgaaagagaagcaaaaccttgataagcctcgttgatttcttgaaacctagacgtagcagaatcctcttctttaaatttgtccggatgccatttctgcaacacaactccaacacaatcatcactgaagaactcacactcagagactgtcacaaattagtgggaaaatgaagtggaaaagagaaggaaccagagcaagacggataaagctggaacgaatctcatcatcagaagcgtcacagttcaattccagaactttatagtgatcctgcaacacccaattcacaaaaaccaaaactttaacaaattcaaaaccaaacaattatcaaatttttgtttttttgtttgtttaccttgtaatcctcgaaatcgaaaaaatcgaagccatggctgtctccccaatcggaacaccacattctccagagcaaacaaacgattccaagcttcctcaaatttacgattttcctcctctcgtcactgtgggcttcttcagataaaattttattattattatgcaatttcgttttagacccctaaactattacattattacagttaaaggacatttcgcagcttccagaaacatttagagacggctgagatacacagtg

SEQ ID NO: 14135 - DNA, 3000 bp, Unknown
  misc_feature (1)..( 3000): cDNA_ID_2710982_gDNA_ID_2214702_Annot_ID_136888 3000 nt of promoter + ATG
cctcagatgattctatctttctggaacaataaatgacaaaaccatgctactagataccaagtagtgatacaaatcaaccgattgcttcagagttgagtatcaaaatcaaaagtctgaacatctaaacgttctgtatctaagaaatcaaacgagcttcatatctatcaatcaaccatttgctttctagtttaagggagacaaagagcaataccaaaaccagttgcacaatagatagctgagtgcttcagagctgatgaacaaaagactgatcattctgtatctatgaaactaaacgagcttcatatctatcaatcaaacatttgctttatagattatgaaattcaagagcataccacaaccactttcacaacagatcaaccaatatcaaaaaggctagaacaaatgatcgaacactttatctagctaaaactagttgatatttggtttgcgatacaagatccagactaatccacatataaaagagcttgatatctatcaatcgaacatatatatgctttctagtttaagcgatacatgagcataccataaccaatttcacaacagatcaaccaatatcaaatgctagaacaaatgatcaaacaccttagcttcatctagctatatctacttgataaattgatttgcgatacaagatccagatctaattcatgtaccaacgataacaattagaagaaacgctccatcaacaaatgcacatgagcgatcgacatgaatatctcgataactgcatagtgaatgatgaaatcgaagtttacataacctaatcagagagaaacatgtaacggagagatatatgacctggaaatgctttcttccttcttcttacggccatcttcgtgcgctttctctctgaattgctgcaacgccgacatgattcctttgaaatcgctacacgatcaacacggaaacacaatcgcgagtcacatttcagcaaaaaaacagaagaaacgaagaaaaagaagaagacgaagcaaaagaaaacacgagaacggacctagaaacatcgacatccaattcgtccgggagttttgctttcggtgttggcttcttgagcgattgcggcggctctggccgagttctcttagtgcctcttctggtagacgacattgcagacgaaacttagagagtgtgagattcgatgaagcgaaatcaatagctctggcgagtggcgattatctgctctctctcgctcgtgtgatttggatttgaatttgaattttgaaattctgtttgtttgttagaagacttcacacttcacaataatatatagcccacttacgtattgtggatgccgtcgtagctgatcacgtactctcactattttcgttttcttttttgatttttttttcttctttaagttatggctaacataattactattataaaaataaaaaattattctatgcatataattcttcaaattgtgggtaacaaaagtcactgttacttctatttacatcaatttttaacccaaatgaaatatgagacttgatacatcatgggcctctatttttttgtcaaaacatcattgggcctcatggcttaaaaatgcgtatgaaaacttccttcaactcaaacccaaattaactcaaattattgcatgtcgatctcattgttatcttgagattgatcattgaagtatagaaagttagaaactttcacccctaggcctagtttatggtttactctagcgtatatctgtcttacctcttctctcaaagcttaaggccattgtgtttacgtttatgtatatcttcacgctttatttttatttttttggtttaggttaataccaatcctaaaaactaaatacatatcaccgtaccatttaacgttttatcaaagttctgtggttcaacactctaaatattacatgtgacgctataccatacgtttgcgaagcttggaatttttcaaaaagtatttgatctcacatagctttattcagaacctccaaaagaattgcacttataatctccaaggcattgtatagtttaggaaatgaaatcttatgcatgacgtgaaacgatgaaagtataaatcttttttgtaaaacactagaccaaaagagtttccactattaattaacatcaatttttaatagttattttcctgatttaagaataattacacgggcattgttttaccagtttcattaaaatctagttgactttttaacgtattttatcttatcctgatctaagaataattttataggcaccgttttgctaatttaatcaaattggaaacccaaataaatagaaacagaagtgtggatattaattgaacttttaaatgtgttgtaatgtgttgaagccgcaccaggcgcatcttgttgccatgcccatgttaaggaccacaaaacatggaacatgaatgaaaactcatgcactaatactatctatatcccagatatttgcattgaaagttacactgtaaatttacatattgtccaatagaatttgtaaaattatatctatatttttttttactaactctcattaaattcacaaactataagaaattcacatatacatgactataattttctcataaaactttcaaatcataacattaatttgttgaatattaacatatatatgactaaacactgtattgaattcagctgtgatgcattcgttaattattatcttttcatcagaaaaaataaacttcaggtaggttgacgaagttttcatttattctattaaaaaaacccgggaagtgactgtactacaaatcaatatcgagtttcttgcttcaagtattcaaacctgttaggagatctaaatctaaatctttaacgggactacatcgatcggaaacttctcgccagttgtgtacatgtgctgtgtatgcctctactctctagtatctatatgaagtataaaaaattgtagcccgatatctcctataaatacacccaagtcacatcaacccaaagtcacacacacaaagaaaaacaaaagaacaaagatg

SEQ ID NO: 14136 - DNA, 3000 bp, Unknown
  misc_feature (1)..( 3000): cDNA_ID_3100679_gDNA_ID_2214702_Annot_ID_136889 3000 nt of promoter + ATG
atactcatctgcaaaattcaactctctctctcacatgaaagatggaacaagaagagaagaagaggaagtaaaagtaaccattggaagagatataaaggagccccaaacaaaagtggggaaggatcttaggtgcttaagttgttggaccactaaaatttcactcctaaggtataaaaattattagcatgttgtgtaaaaaagagtacgaacaagctttagtgctctattattttgtatatgcatacatgcatacatatgtatccttaaaacctgacgaggacccagctctattttgtagttttaagttaatgtcgatgctatgacaccaccccggtttattttgtggttgatcatgttaatgccgatgctatttcaccatgcgggttcaaatatgcatgttgtttgacaagaaaatattgagagagagaaactgagaaacactgtgaacattttgtcgcgagattagtggaaaatacatgtgaagaatatgtgctaatgtagtgattggaaaagcaagactgaacagtaaatttacattgtgtaatgttttatttttgtggtaacaagaagttgagattcgaactaaaaaacagaccaaacataccacattgcgtttttatgaatcattcgctttttttttttggtagttaaagtttctgtatcaaaaaagaataacatatttaaaagatcattcgtagtgtactattttatttttctcttatgttgttggtttaatcatggagtgactcaataatttatccaactgtaggtttgtaaaaacgttattactgaggaatatgtccactaatttgcacataaatgtgtcgtaaggtttatatttagtttcaaaaagaagtgtttacgattttatagtatagggccaccactaaattaatttgacaatttaatttcttgtttggtgtagatgataaggtcaatcaaattagctatcggggccacgaagccaaaagtggatatacaagaatggtccaaacttgaattatgtattcatttttcaattggtattatgtaaaacaaagatattagcataattaaatggtaaaaacagcaaacacaactctgttattcgagatattttcttttcgatcttgtactcaggtctcagggtacactaaagactacacatatctcgaagacactctgagactagaagcaacaaaagaaaaaaagagaggctattcttaacgtgcaaggaggtttgtggttcgtgagatttgaagatcatctctaacttaaagttcacacctaaaaccaagaaaagaaaaaaaaaaaacttgttcacaccataaaaccatgcacatatactaggttatgtcatcagctagattcatgcacatcagcacatccacatatataaataatgaggagcgtcgtcaaatattgatgccaatgctaatcaaatgttaaatgattttgccgtgttatgtcatcagctagatccatgcacatccacatatataaaatatagaaggaaatggtacagcgctatgcaaacgttttgctctatatctcttagaggtaagggacaaatctattttttgtcaccccctccttttgactatttacgaaacaaaatcaccagtttactatctccactatttagctctatttgtgtttacatcaatcgatctagtttgccctaacttattttcatagagccacttgaacgaaaatctttgttgccgaggcaggcataacataaaattgagttccacgacacttgaaataaacagaatcgaatcaatatcttgaacccaatttataaaaggaatattgttatgcacttatggtttattttctacttcttttaagttgaaataatatcttaagaaaaaatggacaaaaataaataacgtcaagattgggcagtagagtcgtcagctgtcatgacactacttatcattattgtactgcctgtcaattttttgattgtatcttttattcagcagcatcacattctccttcagtgtccttctcttcttttctttttcttttctttttctttcctcattaaacccatacaattctacggtaaatattatggatttgcatacaaactctctaattgtttgtttgggtactataatatggggtccctataatatgtgtagcttaactttaagatagaactaagtcaacaagatccggagacaccatgtcaaagttctatgttcttatgattagatgaacaaagttatgatttattcaagattatcacgattcgaactagttctaaacttgtaaacgtaaaataataaataacgtttgcaactacaacactgaacataaattaatgaagtttgcttgatgtgttggttaaaatttggaatgggacaataaaaagaagaagagaactgagagaagtggtgggggaagtgggaaccttaacttccccacgtgacactaacgagcaacgttaattgaatagtagtaggccctttttgtagtacactcttttatatatggtcaccttttaattagtttgcaaatcacatacttttaaaatcataaaagcaattaacgttgctcgttggtgtcatatgcgattgtagttagtataatcgatcttaattaaaacaaagtccatattaaaaatgaccaaagtatgtaaaaataaaatgttgaattagcatatggtcactgatcttttctattttaagatttagtaaacctaagatgtatccgcaagcctatagggtttgatgtggattactactagttacttttgtatgggcttgaagaaacttcattgggccacaaagagggaggagtgagcgaagagcccaaattcaaacaaaaggatatgagggttcaaatgttattataaaatatattgtggccaatttgtaaagaaacttgataattactttaaaagccccaacacaattatctttacagtttttacgatctggtgctggataagccttttgcttcattctcacttccttcctcatccaaaaaagctcctccatttcaatg

SEQ ID NO: 14137 - DNA, 3000 bp, Unknown
  misc_feature (1)..( 3000): cDNA_ID_2994331_gDNA_ID_2214702_Annot_ID_136890 3000 nt of promoter + ATG
gccattgaaatggaggagcttttttggatgaggaaggaagtgagaatgaagcaaaaggcttatccagcaccagatcgtaaaaactgtaaagataattgtgttggggcttttaaagtaattatcaagtttctttacaaattggccacaatatattttataataacatttgaaccctcatatccttttgtttgaatttgggctcttcgctcactcctccctctttgtggcccaatgaagtttcttcaagcccatacaaaagtaactagtagtaatccacatcaaaccctataggcttgcggatacatcttaggtttactaaatcttaaaatagaaaagatcagtgaccatatgctaattcaacattttatttttacatactttggtcatttttaatatggactttgttttaattaagatcgattatactaactacaatcgcatatgacaccaacgagcaacgttaattgcttttatgattttaaaagtatgtgatttgcaaactaattaaaaggtgaccatatataaaagagtgtactacaaaaagggcctactactattcaattaacgttgctcgttagtgtcacgtggggaagttaaggttcccacttcccccaccacttctctcagttctcttcttctttttattgtcccattccaaattttaaccaacacatcaagcaaacttcattaatttatgttcagtgttgtagttgcaaacgttatttattattttacgtttacaagtttagaactagttcgaatcgtgataatcttgaataaatcataactttgttcatctaatcataagaacatagaactttgacatggtgtctccggatcttgttgacttagttctatcttaaagttaagctacacatattatagggaccccatattatagtacccaaacaaacaattagagagtttgtatgcaaatccataatatttaccgtagaattgtatgggtttaatgaggaaagaaaaagaaaagaaaaagaaaagaagagaaggacactgaaggagaatgtgatgctgctgaataaaagatacaatcaaaaaattgacaggcagtacaataatgataagtagtgtcatgacagctgacgactctactgcccaatcttgacgttatttatttttgtccattttttcttaagatattatttcaacttaaaagaagtagaaaataaaccataagtgcataacaatattccttttataaattgggttcaagatattgattcgattctgtttatttcaagtgtcgtggaactcaattttatgttatgcctgcctcggcaacaaagattttcgttcaagtggctctatgaaaataagttagggcaaactagatcgattgatgtaaacacaaatagagctaaatagtggagatagtaaactggtgattttgtttcgtaaatagtcaaaaggagggggtgacaaaaaatagatttgtcccttacctctaagagatatagagcaaaacgtttgcatagcgctgtaccatttccttctatattttatatatgtggatgtgcatggatctagctgatgacataacacggcaaaatcatttaacatttgattagcattggcatcaatatttgacgacgctcctcattatttatatatgtggatgtgctgatgtgcatgaatctagctgatgacataacctagtatatgtgcatggttttatggtgtgaacaagttttttttttttcttttcttggttttaggtgtgaactttaagttagagatgatcttcaaatctcacgaaccacaaacctccttgcacgttaagaatagcctctctttttttcttttgttgcttctagtctcagagtgtcttcgagatatgtgtagtctttagtgtaccctgagacctgagtacaagatcgaaaagaaaatatctcgaataacagagttgtgtttgctgtttttaccatttaattatgctaatatctttgttttacataataccaattgaaaaatgaatacataattcaagtttggaccattcttgtatatccacttttggcttcgtggccccgatagctaatttgattgaccttatcatctacaccaaacaagaaattaaattgtcaaattaatttagtggtggccctatactataaaatcgtaaacacttctttttgaaactaaatataaaccttacgacacatttatgtgcaaattagtggacatattcctcagtaataacgtttttacaaacctacagttggataaattattgagtcactccatgattaaaccaacaacataagagaaaaataaaatagtacactacgaatgatcttttaaatatgttattcttttttgatacagaaactttaactaccaaaaaaaaaaagcgaatgattcataaaaacgcaatgtggtatgtttggtctgttttttagttcgaatctcaacttcttgttaccacaaaaataaaacattacacaatgtaaatttactgttcagtcttgcttttccaatcactacattagcacatattcttcacatgtattttccactaatctcgcgacaaaatgttcacagtgtttctcagtttctctctctcaatattttcttgtcaaacaacatgcatatttgaacccgcatggtgaaatagcatcggcattaacatgatcaaccacaaaataaaccggggtggtgtcatagcatcgacattaacttaaaactacaaaatagagctgggtcctcgtcaggttttaaggatacatatgtatgcatgtatgcatatacaaaataatagagcactaaagcttgttcgtactcttttttacacaacatgctaataatttttataccttaggagtgaaattttagtggtccaacaacttaagcacctaagatccttccccacttttgtttggggctcctttatatctcttccaatggttacttttacttcctcttcttctcttcttgttccatctttcatgtgagagagagagttgaattttgcagatgagt

SEQ ID NO: 14138 - DNA, 3000 bp, Unknown
  misc_feature (1)..( 3000): cDNA_ID_3593822_gDNA_ID_2214702_Annot_ID_189721 3000 nt of promoter + ATG
atgaataaaaaaacgaaagcgaagcattgaatgaaagtggggctaagttctactgcaaagagagtgagagagagagaaaaaagtagaagaagaagaagtaagtgaacagtgtctgaaacgggtaaaaagaagaccaaagaagagcaaagagagtgtgaagaatacgcgcaatgggaagagcgtgaggctcgagagactttccaaaagaagataggaaacagatgtcggggcattaaccaattgggtatttggatttgtaacccgttttgtccgggtcctgccccaatctctaaaccacttttgttgttgttgttgttgttgttgttgttgttgtgcctctctcttctatagctgtatctatctacatctacactgtctcgcgtgttcatcaaaatttaataagcaaaaacatatttcttttttatttatagagaaaaaaaaaatttgaaagaaagaaagaaaaaagtcccccctgatcctcgggttctttgtaatttatgacactcccaatttaagaccttcttctcactttttctctatttgtccttttttttgcagattctttttatcttacatttctacccttgcatgtttcttgtatttacttgtactttcattgttctcttgtttgctacattgtgcttgttgttgagatgagattcattctcacaacaatcggcaatgaaagaaaatgttgggtacttttcatgtttgctttggtttgtgtttaactctctatacatatgtacaacaatgttttgtaggaaaaagagaagatattcaaattgtggtttgatagtaagtattattagtaaaagaagttgattagtatttttagatttaaaacggtataagaatatcacttagcagagacaatagataagatatttgcatgtttgatatatgaagctaaaaagtaaaagaaaagaaaaacatttcaaatctctcgtttactttgatgccgttggaaaaatcaacgtacactgcacttaaattcaatatgttacataaatagtcttatttatgaaaagattaaatttattatcaagagatttaatgtacacaaaccatagttatatacaataaaaaacatttccgaactttattagtatgtgggaaaaaaataaacttatgagttgcgaaatatctaacacaactcaaggataaacattgtaatttctttcatatagcatcatcactagttcaagtgtaaatcgatctaattttgcatagaactgaaaggagtgaacaatgtactaggtaaagaagaacaatgtttttgtttgcatgtgtattaagctctaatttaattcaaagtgtgatatactgatatgattaggctagttcctcatctgggtagacataattataagaattttcgaaacctcatcttaccaaaaacatatataatctctaccatttgtttctctcaatatgccctaccattaatggaccctactttgtacttatgcaataattcttcctgtttttacaatagccattaggtaggtttctttagaaattcggatgacttgtgtatccatcaatttattcgccgttgataacaggttcatgcacaaatttcttaagattgtttcttcttgccttaactttatttttttatcaaaaaaaattagatctagctcacaaatcaaatttgtcacaagatacgaagttatttgtttcaaatttagtcctcgttagtcatttaatgtggttttgttattttgaatcgtttggttagaggaaaataaaatgttatttcaaatcaaatccaaatttggacacattggcaacaaaatgtgttaactttcacttgatgatggtatcaagtcattccaaccattggtttaaaaatgatgacaaatttagtaagcaaatgtgtttcttcttcataaaaaaatacaacaagaagtgaggaagaaacaatgtggtcgactatgattaatgtgatctattgggaacaatgtgattaggcgatgatgaataggtcgtattaaatcgtttactaaaatgatagatcaataacattagcacaaaccaatatatatatatatactaatgcatgatcttctaaaatatttttaaaatccatctaactagttccgaattcgaataacagcaataaacactgattatttatcacaaaggtgtaattttaatcagaaaaatatacaacccttttcaccatatactaaactactgaaaatcaaaggcatgaaagaaaactatcccccaatgtactttagaatataacggtagtccaaatcttcgccacaaaacacaaaaccacatgaactagtcatataataatggataaatgatttaaactatttcactaataatgtgcatcaatccctaaaagtatgccaccagtattcttttatttctcccacaataatatcaataaaaatgattcaaagacaaagagacaacagagacgaaattattcttttgtagatcttattatatataaatgattaactaaaaaccatatacttgtaacaataattattatatcagtactaaaatccaatagtatcaacattgcaaagaaactgttgtgtaaaagataataataatataaagagaaagcaaagaaatcaatctatttcaaaaatctaatcccatctaatgtctctctctccacgcacaaaaggtctaaaagccacaccacacacatcagtcaccagacgtagcagagagcctcactgttgcagagagcactcagtactgttctgtttctctgatacctctctctctcctctctcttttaacattgtccaaattaaaaatctaaactttttttctagttttttttttttctttaatagaaaagttttttttctccacggcttaaagactcactcatcactgtgctactactctctcttcttttggctgagagggtaaaagtcatgaagaaactcctctgagttttttttctttctttcttataataaagctcttatctttatctctgtttctctctctttaatg

SEQ ID NO: 14139 - DNA, 3000 bp, Unknown
  misc_feature (1)..( 3000): cDNA_ID_3021936_gDNA_ID_2214702_Annot_ID_189716 3000 nt of promoter + ATG
gataggaatggagttccaaagaatttaggtgctacgtactaaatctataactgagtaaaagaaggatgacataatgtacaggaatctcatcagtttgagctcatgccacaccaagtgacatttggtttgataactcagggtttaccatacttttcgacatacccctgcaaatgaacataagaattgttagcttatgcaatacttactacttaggtttttacctgctttaagtgtcttttatttccagctaagaaactcacctcgacaagtttcacaattctggttccagacaaaccaagatattgatcaactgattctgtgtcagttggcacctgatgaaactggacagcggcgccgactaccttttctgcagcttttttaactatcatgttatgcacgtctttagttagacgaccctcacgccacaacggtttcaacatttctttaatggtttccacaactgcagtccggaatagtctcattactttcattcctgcatctgacctcacttcaccatctatctcatctgatttctttgtctttttatatgaagacccatcacttctatgccaagaatcatgccctgcaggtttgattcttttcaaaacaactctattctctgcagccgtagccgaagaaatctctttgctaggcgttgctgtatcattttgatcaaccactgacgtagccaccccttccactactccatgtgcttccaaactccttgccacggtttcttggtgttgattttgactgcatgaactgcttttatcatcattcttgcaatcccgtgcttggggaccactagcagaatcaccatctttctgctggcaggaacttttccgtgcatgttctcctttacttgacaatgaatcattaagaggtctgtctcctagattctctatatccgtgaaaggatcgtagagggcatcagacgagggaagaatataaggtggaattgtaaaagatgctttaaaaggttcagaaggttcccagtcatctgaagaaactttctttttagtgctagtagtgttggcttctgcgcctttatcagaagaaacagctaccccttgcagcgttggaagtgatccggatccagataaactattcccattttcaaaatcccccaccgtagaagcacgatcattcataggaacagaactggataatgatcctgtccaggctggtccagcagatcccatgtctgtttttaaataggaactgatagaaggtctatgctcatgaacaaagctgcttctcaatgcgaaggaattggcgttattaataactagagacctgttgtcagtgaaatcagcaccatacgtttgcttcaaactctctcttctaatgttttcaaatgaaggcataaagcgcatctcgttattgaacgggaaaactctctgagaacctgggggattcacaaaagacatggaggagaaaactctctgaggattcatgaaagatatatcctctctggtaggcaacgatgtcacaccgttttcgcttaactgggaaactcttacaccttctctgctgtccaaaattcttctttctgaatagacataagcaaaataaattattggttgattcagaaagagtaattaaaccccatagatattcaccggcctctatattgttggaactacctccacatagaatcacaagaataagtattcatggtacaacgtacctagatcagaccggataccaccgtttccagccatactattttccgccagttgttgactagtgcaatttgaattctctttcacatgtagaaacttgcaggacaccccattgaaacaccaccctttagcaaaaaatttgcagggaagagctgcacgtttttgttctggttcattcccaccaccgccagtgaaaaagcttcttggcggtatacccggagcaggaaatctgataaccgaatttgtcagtataaaagcttcaacctcttaacttagtttcagcaaaacttaagcagaaacttttttgccataccttggtaaagtaccattatcttgagcaaaagcttgctcctttatgatttttgattgctcatctaaaggtgttgttacagaatgcctcttcacatctacatgagacaagtttaatcagtacatattagcaaaactgctgttttgaataaacaaaagagattccttacagaaacaagcacaaaactctgagaattgaatttgcttacttggtattaaagccacaatttttacaaaagagcttcagtgaaaatctaattgccaagtctttgaacctctaatcagagctaaatctagtcaatttaacaattctctctttcttctagaacaaaattcatcaattccaaattggaaaaggtgtttccatcaataaaaacacgaacttgacagaattaatcaacaataccatgtaaccaatcacgaatttcaaatactaaccgttgtgggaattggaagcttgaattggtggtttatcaaacaattcagattctcttacaattgtatgtacttgcaccttttgttcgacctcatcatcatcaatgtccatgtcggaatcagacatcttgaagtcttcggcgaggtaaccaacgcagagagtggtaaattgataaaaaaaaatactgcggcgtgatcggggtccgaagctcgctgttgagtcctgatgatctccgagaatacgtttggtatatcgaaaccaccattgttacaaagaccaccgaactattttatatctaatgggcctttcctaaataattaaagctttagtattaaggcccatactaaattccaaattttaccaactatttcctaaattaacacatcgttgcctttttatagtaaccggattaaaccaaaacaaaattaaagagaatcgaatcaaaccgtgaaaatcgtgaagcgtagtggtgctatattgcacgttaactgtctccatcactgccactggtaaaccctaagaatcctccgcaatttcgcaattttgtgaaggagccgccggctaaatttg

SEQ ID NO: 14140 - DNA, 3000 bp, Unknown
  misc_feature (1)..( 3000): cDNA_ID_3021940_gDNA_ID_2214702_Annot_ID_189715 3000 nt of promoter + ATG
ccaaaaaatacattttagtagcatatatcgacaagatttaaaaacaattttacatattttttatacggatataaaattccttatttgattaaccacaacattggtaaactatctgtagtagcatctgatatacccaaataaacaaaatccaggagttttacagtgtgtttttggtaataataagtttcataaagtgagagaaagctttcaatgacacattctggctctctaattttatctggtgactctgtaagcctacacaatacaaaaccaaagccgtgtgagaaattctcaagtagtataattaacataaccggaaacatatatatgtttttgttaccttgatctgtttgagtagattcttcgcgcgtgcgtctgttttgaaatgatcacgaacaggctgccatattggtaaaggacgttaattatttgttgttgaatacaaaacttattcaaaggttttctgaataattgtgtcagtcttttttctaataccatcattaaggactcgtaaagctctaacataaaggaagttttaacttacttgcaaaatcttattcaacgcgttcatcaggcctttctttagatcgccagggtgcaactcgccgctctcatagtcagcagcaatgtcttcaaagcttttgtaggtcctaatatttggaagaaaattccacagctcaatgacttatgtaataggattatagcaatccaaattggatttttcatgcagaaaccaagcaaataaaggttttagaaaagaacaaaaaggggtaaaactcacttgttaccgccatattcttcatttctctcaactgtgaactcatcaaaccatggtagaatgatgtatttgatgtattcgaggcatggattgcccttcacgacttttggagggcagtaagctttcttgatcttcacattaacttcagcctgaggacatccagacattcaaaacaagtcaacaactgtgataactcttatctacttttgtaaacttagaattttggctaagttatagttacctcttcatcttccataaagatagcagataatggatcacttttggacatcttttcttgtccttgttggagaccaggaagcatatctgcaagtagttaacaatgataaatgattaacaacacgctagaccagttaaaacgtggtataacagaagtcaaataggaaaatgcagagcatacggtgtgacaagattatcggtttgtttttcctctttatgtcatcacagtattctctcgctagcacatttacttttctttgatccatcccaagctggcaaatatcagcctacatatgtaacgaaaatggtttaacagtagtcacagaactcatcagccagatacacaaaatgtaacattacattgataaaatctgcaatcatatacagcttatttctagcctggagcttttatcaggtgttttatcaacaatataatagactttctgctgatgtaacgcttaagctaaattttttattccgagtaactagcagcagaatcaaagacagttcataagcaagcaaaggcttaacagtacctcaaggaaaaaaatatctgcacattgcatgcatgggtaaaggatctgggcagcactcagttcatcagtctcactacgtcccataatctgcacacaccttcaaggacaagaaccagagtcattcaggtcccatcatttccctcacataattacaacgtcccaagaatggagaagatttagaaaagtaaccttaagattctagggagcttgtttttgcgagcaatgtccatcacaagaggccaatacttatctgccttagaattaatttcttcggacgaccacaaaaactctactttgtcattatccatcccagcagccttccatatctcttgaaagtattctccaaccactctgattttcttcaagtcaccacccattttgttgttcaactgagcaaaccaatcagcaatccaaatcttcactctgcaaccagctgaagtcattttgttcacattgatgactttcatcactccctattaagaaaacaacagaaccaaaatagattagccaacgcttccttcccacatatggtaatggaacaaaggaaaactaacagacctgagcaatgtgcattcttcctgatggttcaaagccgtcgtagcaaatcggagcagccttcttagcaagaagattctttagctcttcctcttgtatacattcctcaccgatactcctaacaattttgtatctcttctcaacttcttcactcatcctgaagaattagtaaaatttcaatatctaccagaccaataagcagataacaagatcttttcaattttaaattccatacttctaaattgctatagctttttcatctcttccactctaatcaaataatataatccaaatcaaaattgaagcgcgaaaatgaaaaaaattgatgattggtaagaaaactcactggaatccatcggacgaagaagatgcctgagttgatgaaacggaaacagcttccatctccgacgacagagcattgacgatctccgaactttggtctgccatcaaatttagccggcggctccttcacaaaattgcgaaattgcggaggattcttagggtttaccagtggcagtgatggagacagttaacgtgcaatatagcaccactacgcttcacgattttcacggtttgattcgattctctttaattttgttttggtttaatccggttactataaaaaggcaacgatgtgttaatttaggaaatagttggtaaaatttggaatttagtatgggccttaatactaaagctttaattatttaggaaaggcccattagatataaaatagttcggtggtctttgtaacaatggtggtttcgatataccaaacgtattctcggagatcatcaggactcaacagcgagcttcggaccccgatcacgccgcagtatttttttttatcaatttaccactctctgcgttggttacctcgccgaagacttcaagatg

SEQ ID NO: 14141 - DNA, 3000 bp, Unknown
  misc_feature (1)..( 3000): cDNA_ID_1376943_gDNA_ID_2214702_Annot_ID_189714 3000 nt of promoter + ATG
attccttcgcattgagaagcagctttgttcatgagcatagaccttctatcagttcctatttaaaaacagacatgggatctgctggaccagcctggacaggatcattatccagttctgttcctatgaatgatcgtgcttctacggtgggggattttgaaaatgggaatagtttatctggatccggatcacttccaacgctgcaaggggtagctgtttcttctgataaaggcgcagaagccaacactactagcactaaaaagaaagtttcttcagatgactgggaaccttctgaaccttttaaagcatcttttacaattccaccttatattcttccctcgtctgatgccctctacgatcctttcacggatatagagaatctaggagacagacctcttaatgattcattgtcaagtaaaggagaacatgcacggaaaagttcctgccagcagaaagatggtgattctgctagtggtccccaagcacgggattgcaagaatgatgataaaagcagttcatgcagtcaaaatcaacaccaagaaaccgtggcaaggagtttggaagcacatggagtagtggaaggggtggctacgtcagtggttgatcaaaatgatacagcaacgcctagcaaagagatttcttcggctacggctgcagagaatagagttgttttgaaaagaatcaaacctgcagggcatgattcttggcatagaagtgatgggtcttcatataaaaagacaaagaaatcagatgagatagatggtgaagtgaggtcagatgcaggaatgaaagtaatgagactattccggactgcagttgtggaaaccattaaagaaatgttgaaaccgttgtggcgtgagggtcgtctaactaaagacgtgcataacatgatagttaaaaaagctgcagaaaaggtagtcggcgccgctgtccagtttcatcaggtgccaactgacacagaatcagttgatcaatatcttggtttgtctggaaccagaattgtgaaacttgtcgaggtgagtttcttagctggaaataaaagacacttaaagcaggtaaaaacctaagtagtaagtattgcataagctaacaattcttatgttcatttgcaggggtatgtcgaaaagtatggtaaaccctgagttatcaaaccaaatgtcacttggtgtggcatgagctcaaactgatgagattcctgtacattatgtcatccttcttttactcagttatagatttagtacgtagcacctaaattctttggaactccattcctatcctttaccgataatggaataaggttggaatgggagcttggtggaggaaatgtgtacacattgtaaaactcttcaaagcttaatttatgcttaaaacagttttcttttacctttgggaatatgatttagaatgtgatctttagaagtaatgtgataaagaatggttgccttggaagcagaggaaaagagaaagaaatggaataatgttgaggtacgtttcctaactatttgataagtaatttagctttgtgaaaccaagatttttcaaattagaagttagttttagttttgtatttctccatcaatataagtaaaacctctgtaaattaatactcggtaaattaataacctctataaattaataatttcttccaatcccgaggtgagactaatggaaaaaatgacataaatcgataaattaataagataataatttttttgaaaatcctatgtaaatatatggtctcattaatatcacaaattaataattgcagaaatgtatcaactatatatacattatatgtaagaaatttctttaaaatatatttctaatatttttttttgcttaaatttgtatttattcttatttgatattgagttctaatattttattgtatcaaaaaattttggtgttgttttctaaatatgatattactttttacttgtaattgattcttaaaaaatattttctataatgaaaaaatcttaaattttttttaaaagttaataaattagaaaaatatctctataaattaattaattaatcgataaattaaaacctctataaattaatataatttttcggtcctaacattattaatttatagaagttttactgtaagtagaaagtggtttttggtttaggataaagtgcatacgttttgtgtacagttttggaattagttttatctttttcaaacattttagtgaatcatttggactatgatcattaggacatcatgaacttattatctatggtgggtttgtggaaaactatttgattagagttactgttgcttaataatattaacttcacaaaataatcaaaatatgtttgttgttcctataatacttttccacgaaagacttgggattcttttgatttaagggtccctacactttatgactcgtcgtccttatccatatctccagctctatacccaccttgcattttttttatttccacacttctccctcactgctcacgcttctcatgatcaatggtttgatctatattataacattaatgttatatattaaggtcctttaaagtaggcttatccacatcctaatttccaaagatggcgtgtattttagctctaaaccctggaagttgcatgttatattaaaatgttgtaaaatgacatattaatacataacacacaatttacaattatattatgtattcatgttgtttattgacagagaataataacattttggctaaacgtatcaaattttaacgaaaattctatgtgcaagtatataaacttcatttggtaattaagttatcaattacttgtcaattatttctagtctattatagtatttctctagatattttgtgggtcaaataaaaaatgagagaactagtcgacaaaggaaaagagatatttttacgaatagtttaaaaatgagtctataaattagatgaaggaagccctttagtaagtacttcacacttgacacaattctatccaaaatcaacccaaaaaaagaaagaaatatg

SEQ ID NO: 14142 - DNA, 3000 bp, Unknown
  misc_feature (1)..( 3000): cDNA_ID_2994331_gDNA_ID_2214702_Annot_ID_189712 3000 nt of promoter + ATG
gctgtcgccattgaaatggaggagcttttttggatgaggaaggaagtgagaatgaagcaaaaggcttatccagcaccagatcgtaaaaactgtaaagataattgtgttggggcttttaaagtaattatcaagtttctttacaaattggccacaatatattttataataacatttgaaccctcatatccttttgtttgaatttgggctcttcgctcactcctccctctttgtggcccaatgaagtttcttcaagcccatacaaaagtaactagtagtaatccacatcaaaccctataggcttgcggatacatcttaggtttactaaatcttaaaatagaaaagatcagtgaccatatgctaattcaacattttatttttacatactttggtcatttttaatatggactttgttttaattaagatcgattatactaactacaatcgcatatgacaccaacgagcaacgttaattgcttttatgattttaaaagtatgtgatttgcaaactaattaaaaggtgaccatatataaaagagtgtactacaaaaagggcctactactattcaattaacgttgctcgttagtgtcacgtggggaagttaaggttcccacttcccccaccacttctctcagttctcttcttctttttattgtcccattccaaattttaaccaacacatcaagcaaacttcattaatttatgttcagtgttgtagttgcaaacgttatttattattttacgtttacaagtttagaactagttcgaatcgtgataatcttgaataaatcataactttgttcatctaatcataagaacatagaactttgacatggtgtctccggatcttgttgacttagttctatcttaaagttaagctacacatattatagggaccccatattatagtacccaaacaaacaattagagagtttgtatgcaaatccataatatttaccgtagaattgtatgggtttaatgaggaaagaaaaagaaaagaaaaagaaaagaagagaaggacactgaaggagaatgtgatgctgctgaataaaagatacaatcaaaaaattgacaggcagtacaataatgataagtagtgtcatgacagctgacgactctactgcccaatcttgacgttatttatttttgtccattttttcttaagatattatttcaacttaaaagaagtagaaaataaaccataagtgcataacaatattccttttataaattgggttcaagatattgattcgattctgtttatttcaagtgtcgtggaactcaattttatgttatgcctgcctcggcaacaaagattttcgttcaagtggctctatgaaaataagttagggcaaactagatcgattgatgtaaacacaaatagagctaaatagtggagatagtaaactggtgattttgtttcgtaaatagtcaaaaggagggggtgacaaaaaatagatttgtcccttacctctaagagatatagagcaaaacgtttgcatagcgctgtaccatttccttctatattttatatatgtggatgtgcatggatctagctgatgacataacacggcaaaatcatttaacatttgattagcattggcatcaatatttgacgacgctcctcattatttatatatgtggatgtgctgatgtgcatgaatctagctgatgacataacctagtatatgtgcatggttttatggtgtgaacaagttttttttttttcttttcttggttttaggtgtgaactttaagttagagatgatcttcaaatctcacgaaccacaaacctccttgcacgttaagaatagcctctctttttttcttttgttgcttctagtctcagagtgtcttcgagatatgtgtagtctttagtgtaccctgagacctgagtacaagatcgaaaagaaaatatctcgaataacagagttgtgtttgctgtttttaccatttaattatgctaatatctttgttttacataataccaattgaaaaatgaatacataattcaagtttggaccattcttgtatatccacttttggcttcgtggccccgatagctaatttgattgaccttatcatctacaccaaacaagaaattaaattgtcaaattaatttagtggtggccctatactataaaatcgtaaacacttctttttgaaactaaatataaaccttacgacacatttatgtgcaaattagtggacatattcctcagtaataacgtttttacaaacctacagttggataaattattgagtcactccatgattaaaccaacaacataagagaaaaataaaatagtacactacgaatgatcttttaaatatgttattcttttttgatacagaaactttaactaccaaaaaaaaaaagcgaatgattcataaaaacgcaatgtggtatgtttggtctgttttttagttcgaatctcaacttcttgttaccacaaaaataaaacattacacaatgtaaatttactgttcagtcttgcttttccaatcactacattagcacatattcttcacatgtattttccactaatctcgcgacaaaatgttcacagtgtttctcagtttctctctctcaatattttcttgtcaaacaacatgcatatttgaacccgcatggtgaaatagcatcggcattaacatgatcaaccacaaaataaaccggggtggtgtcatagcatcgacattaacttaaaactacaaaatagagctgggtcctcgtcaggttttaaggatacatatgtatgcatgtatgcatatacaaaataatagagcactaaagcttgttcgtactcttttttacacaacatgctaataatttttataccttaggagtgaaattttagtggtccaacaacttaagcacctaagatccttccccacttttgtttggggctcctttatatctcttccaatggttacttttacttcctcttcttctcttcttgttccatctttcatgtgagagagagagttgaattttgcag

SEQ ID NO: 14143 - DNA, 3000 bp, Unknown; identical to SEQ ID NO: 14136
  misc_feature (1)..( 3000): cDNA_ID_2992886_gDNA_ID_2214702_Annot_ID_189711 3000 nt of promoter + ATG

SEQ ID NO: 14144 - DNA, 3000 bp, Unknown; identical to SEQ ID NO: 14135
  misc_feature (1)..( 3000): cDNA_ID_2710982_gDNA_ID_2214702_Annot_ID_189709 3000 nt of promoter + ATG

SEQ ID NO: 14145 - DNA, 3000 bp, Unknown
  misc_feature (1)..( 3000): cDNA_ID_3021951_gDNA_ID_2214702_Annot_ID_189708 3000 nt of promoter + ATG
ggtttaggttaataccaatcctaaaaactaaatacatatcaccgtaccatttaacgttttatcaaagttctgtggttcaacactctaaatattacatgtgacgctataccatacgtttgcgaagcttggaatttttcaaaaagtatttgatctcacatagctttattcagaacctccaaaagaattgcacttataatctccaaggcattgtatagtttaggaaatgaaatcttatgcatgacgtgaaacgatgaaagtataaatcttttttgtaaaacactagaccaaaagagtttccactattaattaacatcaatttttaatagttattttcctgatttaagaataattacacgggcattgttttaccagtttcattaaaatctagttgactttttaacgtattttatcttatcctgatctaagaataattttataggcaccgttttgctaatttaatcaaattggaaacccaaataaatagaaacagaagtgtggatattaattgaacttttaaatgtgttgtaatgtgttgaagccgcaccaggcgcatcttgttgccatgcccatgttaaggaccacaaaacatggaacatgaatgaaaactcatgcactaatactatctatatcccagatatttgcattgaaagttacactgtaaatttacatattgtccaatagaatttgtaaaattatatctatatttttttttactaactctcattaaattcacaaactataagaaattcacatatacatgactataattttctcataaaactttcaaatcataacattaatttgttgaatattaacatatatatgactaaacactgtattgaattcagctgtgatgcattcgttaattattatcttttcatcagaaaaaataaacttcaggtaggttgacgaagttttcatttattctattaaaaaaacccgggaagtgactgtactacaaatcaatatcgagtttcttgcttcaagtattcaaacctgttaggagatctaaatctaaatctttaacgggactacatcgatcggaaacttctcgccagttgtgtacatgtgctgtgtatgcctctactctctagtatctatatgaagtataaaaaattgtagcccgatatctcctataaatacacccaagtcacatcaacccaaagtcacacacacaaagaaaaacaaaagaacaaagatgggaatcattggtaagagtgtttctctaactctctttgcacttttgtgcttcacttcctctgttttcaccttaggagtgaatcaacctggttcatcagatcccttccatagccttccccaacaccttcccctacctccaatcaaactaccaactcttccaccggccaaagctcccatcaaactaccagcctacccaccagccaaagctccgatcaagctaccaactctcccaccagccaaagctccgattaagttaccaactctcccaccgatcaaacctcctgttctcccaccagtttaccctcctaagtacaacaagaccctagtggcagttagaggtgtggtctactgcaaagcttgcaagtacgcgggcgtcaacaacgtccaaggcgctaaacccgttaaaggtactcacttatatacattcatgatatgaaagtctatatattatcctaaaaatcactcgaacccttaatatacgcacctgtggaccgtggtatgtccgtatgtgaaaagtccacacttcaatcccatgcattcatactttttttttgctaaaggtatgctgcatgcatacttcatcctttacatttattttaggcatatgttatatgtatcataatctcattgtcggttgttcaaaactttttgtgtaaacttttaactatatgctaccaagcgagattagttcagagccggtcgtatcattctggtcccttcacgaattgataaacataaaatataccatggaaaactaagtaacttctttcaatgcttttgaatttaatttaattataatcaataggtttttggttaagacaatctactgtagcgaagccttgtcattgttttccccaagtttcctataataccaaatttagctcaactagtaagaaaatcttgttcaagtcatgccccttcttaaaaaaagagggtaaatttaccataactaatctaaacaaatacatgctcttgcattattttaaaacaatttctgtataacaaatctatccaagtactatattttcactttttatttcgtttgtgttatctggggatacagatgcggtggtgagacttgtgtgcaagaacaagaagaactcaatatcggagacaaagacggacaagaacggatacttcatgctcctggcccctaagacggtgaccaactacgatatcaaaggttgtcgagctttcctcgtgaagtctccagacaccaagtgcagcaaagtgtcgtcactccacgatggaggcaagggctccgttctaaagccggtcttgaaaccaggattttcctcgaccatcatgagatggttcaagtacagtgtgtacaacgttggtccattcgcattcgaacctacctgccccaaatgagatggtgttataagagctacttaaacttttattaatcaatgattgtgttgaatatgtatcagcttggtttctttgtatgggcttttctggtagtgttaatctttctaatttgcttcttaaataaaaagtggtgacgtttacatattaggtttttcttgttaattccttatcttcgtgaccccaaaagaaaaaagaaaaaaatagtttgctaaataaaagagactctgaatatgttatgtggatgttaatgaacacaaccgttgatatattagcctatatattaattcattaggaatcgaaatgaccaaatttatctccaacaccatcatatcagaacaagtattgacaagtgttgagcaactagtacaataattttctttcataattatactgtacatttgttcattttgtacgaaacctctgatg

SEQ ID NO: 14146 - DNA, 3000 bp, Unknown; identical to SEQ ID NO: 14134
  misc_feature (1)..( 3000): cDNA_ID_2706080_gDNA_ID_2214702_Annot_ID_189700 3000 nt of promoter + ATG

SEQ ID NO: 14147 - DNA, 3000 bp, Unknown; identical to SEQ ID NO: 14133
  misc_feature (1)..( 3000): cDNA_ID_2711004_gDNA_ID_2214702_Annot_ID_189697 3000 nt of promoter + ATG

SEQ ID NO: 14148 - DNA, 287 bp, Unknown; identical to SEQ ID NO: 14132
  misc_feature (1)..( 287): cDNA_ID_2705235_gDNA_ID_2214702_Annot_ID_189692 3000 nt of promoter + ATG

SEQ ID NO: 14149 - DNA, 3000 bp, Unknown
  misc_feature (1)..( 3000): cDNA_ID_2710978_gDNA_ID_2214702_Annot_ID_136891 3000 nt of promoter + ATG
gttaataaattagaaaaatatctctataaattaattaattaatcgataaattaaaacctctataaattaatataatttttcggtcctaacattattaatttatagaagttttactgtaagtagaaagtggtttttggtttaggataaagtgcatacgttttgtgtacagttttggaattagttttatctttttcaaacattttagtgaatcatttggactatgatcattaggacatcatgaacttattatctatggtgggtttgtggaaaactatttgattagagttactgttgcttaataatattaacttcacaaaataatcaaaatatgtttgttgttcctataatacttttccacgaaagacttgggattcttttgatttaagggtccctacactttatgactcgtcgtccttatccatatctccagctctatacccaccttgcattttttttatttccacacttctccctcactgctcacgcttctcatgatcaatggtttgatctatattataacattaatgttatatattaaggtcctttaaagtaggcttatccacatcctaatttccaaagatggcgtgtattttagctctaaaccctggaagttgcatgttatattaaaatgttgtaaaatgacatattaatacataacacacaatttacaattatattatgtattcatgttgtttattgacagagaataataacattttggctaaacgtatcaaattttaacgaaaattctatgtgcaagtatataaacttcatttggtaattaagttatcaattacttgtcaattatttctagtctattatagtatttctctagatattttgtgggtcaaataaaaaatgagagaactagtcgacaaaggaaaagagatatttttacgaatagtttaaaaatgagtctataaattagatgaaggaagccctttagtaagtacttcacacttgacacaattctatccaaaatcaacccaaaaaaagaaagaaatatgtgggatgaaactgtagccggacctaaaccggagcatggccttggccgcctccgcaataagatcaccacccaaccccttgacatcaaaggtatttatttttctttgtcaaccataactccgtaataaacttgcatatacagatctttgtagaaacgtatgatctcataattatatcatgtgatggtttttggaaggtgtaggagaagggagcagtagtaaaactgtggcggcggtggccgggagtcctggaactccgacgacgccaggatcggcgcgtaaggaaaacgtgtggagaagtgtgtttcatccaggaagtaacatcgccactagaggaatgggcacaaacctcttcgacaagccttctcacccaaactctcccaccgtctacgattggtacgtactcagtttctgttattattatctgaccggacggtgtagatcagatctaagatggtttgaccgttgttgtgatcccgcaggctatacagcgacgacactaggagcaagcaccgttgagccgagagggtagagtgacatgagaatgatgtaaaataattatgttctttacgccacgtgtttatgttctgtttcgtctattttggctatatgtgcaatcttttatttgcttcatgtcgtttgtgtttgttagtgaccgttgatttccaccatctgggttagtttttagcttttaacggtggcgatgcgtcttcagtgtcttgtaatatttttactgttcggtaatattacaattagcttctctaatgatttagctaacaatataacttaacttaactataattagcaaaatggaatttaacttaaccatggttgatctcatatcattatttttattttattttatttgttcatcattaaaatatctcaatcatgcatggttagatgaattcgttgtgtcaacaaacaattatgatagtgatttgattaaattttaactgaactatggttgatctcatctcattaaataacaaaaacataacaatggttaaatgcattctttgtgtcaacaaaccattatgatagtgatttaattaaagtttatacatgtctttggatacagttgtaattttttatatatatttttttgtctgatttgatataattatacaaagttacacaaaaagaaccaatccaaagctcagggatcaacctattttaatcaccatggttgatctcatctcattaaataacaaaaacataaccatggttaggtgaattctttgtgtcaacaaaccattatgatagtgatttaattaaagtttatacatgtctggatacaaatgtaatatatatttaattttttgtcatctgatttgattaaagaagaagatagaatacaaggttacacaaaaagaaccaacccaaacctgagtcctgcgggatcaacctattcaaagcacattttcaatacaaggggaatatacaaaagaagtgtctccacctacacaaaaacacacaagttcatagagaagaaagagatctttcaccattaaacacacgttacacaccttgcaaccaagagctacatacaaatggagccgtaaaagtcattagttatactttgtgcaatgagattagctcctttataagtcactttggattcactgccatcttctattcaaaaccttaaaacgagatgataatattaacacatataccacaaaaaagcattgaccatttcacatgccattcgttaatcaattgtaaacaaattttatgaaacaatctacctaaactatcataattttgtcacgattagaccgaaactatcattctaattagttcacactacacaatatagaatctatcatatatatgtagcaaccaattctttatctaaaaaaaagtaaaattttgtaacacccatataaatatttaactttcactctgaattattcatttttttttgtagaaagcaaaagacaccgtagtgaagtgaataattcttcttctgctcggtggcgttgtgggaatg

SEQ ID NO: 14150 - DNA, 3000 bp, Unknown; identical to SEQ ID NO: 14141
  misc_feature (1)..( 3000): cDNA_ID_1376943_gDNA_ID_2214702_Annot_ID_136892 3000 nt of promoter + ATG

SEQ ID NO: 14151 - DNA, 3000 bp, Unknown
  misc_feature (1)..( 3000): cDNA_ID_2710974_gDNA_ID_2214702_Annot_ID_136893 3000 nt of promoter + ATG
aaaccaagatattgatcaactgattctgtgtcagttggcacctgatgaaactggacagcggcgccgactaccttttctgcagcttttttaactatcatgttatgcacgtctttagttagacgaccctcacgccacaacggtttcaacatttctttaatggtttccacaactgcagtccggaatagtctcattactttcattcctgcatctgacctcacttcaccatctatctcatctgatttctttgtctttttatatgaagacccatcacttctatgccaagaatcatgccctgcaggtttgattcttttcaaaacaactctattctctgcagccgtagccgaagaaatctctttgctaggcgttgctgtatcattttgatcaaccactgacgtagccaccccttccactactccatgtgcttccaaactccttgccacggtttcttggtgttgattttgactgcatgaactgcttttatcatcattcttgcaatcccgtgcttggggaccactagcagaatcaccatctttctgctggcaggaacttttccgtgcatgttctcctttacttgacaatgaatcattaagaggtctgtctcctagattctctatatccgtgaaaggatcgtagagggcatcagacgagggaagaatataaggtggaattgtaaaagatgctttaaaaggttcagaaggttcccagtcatctgaagaaactttctttttagtgctagtagtgttggcttctgcgcctttatcagaagaaacagctaccccttgcagcgttggaagtgatccggatccagataaactattcccattttcaaaatcccccaccgtagaagcacgatcattcataggaacagaactggataatgatcctgtccaggctggtccagcagatcccatgtctgtttttaaataggaactgatagaaggtctatgctcatgaacaaagctgcttctcaatgcgaaggaattggcgttattaataactagagacctgttgtcagtgaaatcagcaccatacgtttgcttcaaactctctcttctaatgttttcaaatgaaggcataaagcgcatctcgttattgaacgggaaaactctctgagaacctgggggattcacaaaagacatggaggagaaaactctctgaggattcatgaaagatatatcctctctggtaggcaacgatgtcacaccgttttcgcttaactgggaaactcttacaccttctctgctgtccaaaattcttctttctgaatagacataagcaaaataaattattggttgattcagaaagagtaattaaaccccatagatattcaccggcctctatattgttggaactacctccacatagaatcacaagaataagtattcatggtacaacgtacctagatcagaccggataccaccgtttccagccatactattttccgccagttgttgactagtgcaatttgaattctctttcacatgtagaaacttgcaggacaccccattgaaacaccaccctttagcaaaaaatttgcagggaagagctgcacgtttttgttctggttcattcccaccaccgccagtgaaaaagcttcttggcggtatacccggagcaggaaatctgataaccgaatttgtcagtataaaagcttcaacctcttaacttagtttcagcaaaacttaagcagaaacttttttgccataccttggtaaagtaccattatcttgagcaaaagcttgctcctttatgatttttgattgctcatctaaaggtgttgttacagaatgcctcttcacatctacatgagacaagtttaatcagtacatattagcaaaactgctgttttgaataaacaaaagagattccttacagaaacaagcacaaaactctgagaattgaatttgcttacttggtattaaagccacaatttttacaaaagagcttcagtgaaaatctaattgccaagtctttgaacctctaatcagagctaaatctagtcaatttaacaattctctctttcttctagaacaaaattcatcaattccaaattggaaaaggtgtttccatcaataaaaacacgaacttgacagaattaatcaacaataccatgtaaccaatcacgaatttcaaatactaaccgttgtgggaattggaagcttgaattggtggtttatcaaacaattcagattctcttacaattgtatgtacttgcaccttttgttcgacctcatcatcatcaatgtccatgtcggaatcagacatcttgaagtcttcggcgaggtaaccaacgcagagagtggtaaattgataaaaaaaaatactgcggcgtgatcggggtccgaagctcgctgttgagtcctgatgatctccgagaatacgtttggtatatcgaaaccaccattgttacaaagaccaccgaactattttatatctaatgggcctttcctaaataattaaagctttagtattaaggcccatactaaattccaaattttaccaactatttcctaaattaacacatcgttgcctttttatagtaaccggattaaaccaaaacaaaattaaagagaatcgaatcaaaccgtgaaaatcgtgaagcgtagtggtgctatattgcacgttaactgtctccatcactgccactggtaaaccctaagaatcctccgcaatttcgcaattttgtgaaggagccgccggctaaatttgatggcagaccaaagttcggagatcgtcaatgctctgtcgtcggagatggaagctgtttccgtttcatcaactcaggcatcttcttcgtccgatggattccagtgagttttcttaccaatcatcaatttttttcattttcgcgcttcaattttgatttggattatattatttgattagagtggaagagatgaaaaagctatagcaatttagaagtatggaatttaaaattgaaaagatcttgttatctgcttattggtctggtagatattgaaattttactaattcttcagg

SEQ ID NO: 14152 - DNA, 3000 bp, Unknown; identical to SEQ ID NO: 14138
  misc_feature (1)..( 3000): cDNA_ID_3593822_gDNA_ID_2214702_Annot_ID_136895 3000 nt of promoter + ATG

SEQ ID NO: 14153 - DNA, 3000 bp, Unknown
  misc_feature (1)..( 3000): cDNA_ID_2706071_gDNA_ID_2214702_Annot_ID_136897 3000 nt of promoter + ATG
tcccaaaaacatataggaaaaattcaggctgtatgttaatcacttcgacgtttcttataaccaaaaattaaacgcaggatatgttaattagtaacttttttttggtatgtagattgtcatggaaaaatcttcttaattagtaaattaacttgaaaaacttatagtacatcgaattgtttgttgttgttttttttttcaatcaaaacgaattgtttattgtttcataagaatagatggaaatatagatatttaaatggttgcattgatcgccattttctgattcagccgaagttaagctgcaaaggcccgagcaccaaaacagcctaaacatatattttatattttaattttaagaacaaataaaatactactatatccacataactaaaatatctttatttttttgcttaaaaataaggccataaattgttttgctttggaatccttaataatcttggaccagtccttggaacgagactttgcaatgttacttacagatctagttaacactgataaccgcttgtgttaaatggagatgccacattttgttttgatttatttgcatcctatcacaaagttatgatttataaactaagactgtttagcattgtcccatagtcccattcaatagttagtcttttaaataaagctcacatttagttttttttttttgtctgataaaaaaggctccatttagtttatatttgaaataaatgcagatgaaaagaatcttaatatttcaaaagaaactgaagaattattaatacgttattaaagggaacgatcatcaacaaagaccctcgagtcaatccaaaaaaaaatgaccttaatttctttgcaattactatacaccaccacccatcctgacctcttaaaatttcgtattttccccattaatacatgtttcttttttccgtactattacatcacaaaactcctaaaatcgtgtttgctaatttgattatgactattcctacgtccaaacaaaccatttgctccccatccgaatttaaggccgatgccccgaaggtgaccgagagaatcctcttctgcacagactgaaaatccagaaactacatgattttatttttttgtaatacaagcaaataataaaaacccatcttgttatagttaataaataaacataaaatgtgagaaaatttacaatctttctgtcttgttttaattaatgtttttttttgagatgtcagaggagaaaataataaaaaggagaaaaaatcctagttcagaaccaaacatggatcactttcaaagaatctgttgtttcaatttctgaagaaatttgtgttcgtacgtttgaactgcagaagcagtttggagtttaatgcaagaagtgtaaggaagtgaggcatggggttgcattaatgatcactttgagtttcttcctgtctcttactgttttctatctcagaaattgatattaggaatgtgaataacaaaacaaacgaatgaaataccatgcaaactctaatatggatgtagtaacagaaaatctgtattgctctactaattaaattttttaatttagtaatatgaattcagagtctattagtataaacctaaagtaaacagaaatttttggagtgcgcttcaaatacccttgtaaaattacagatgactttgtatggcaactttttaaaattgctaaaataatttcttataataaatattgaatatttttaaataattcagtacccactctataaatctatataactagtctctctctttttttttttttttgggcacatataactagtctctctatcagttattttcatatggattttggatttttttgtacatatatgaaaaacacaaatgataaaattatttaatggtattaagcattcgccacagggtatgctatcaatttggtcatttgtgagtgagattgatatggtttggggctaattcagtgaagctccttcggactctcaaagtggtttattagacagtgtgaatgcatgcggtcttctatttgtttgcgaggctaaaagaaacgctcatgatacacaactaatcaaatgactgttgaagaaatttaagatttccaaaattgtcttcttctatttgttattgaagtattggtcaatccatcagtgatttaacgttatagcaatataggctactcgtcgactagcacattttgacgtacttaaatactaaccttgtcactctttttttaatactgtaataatgccttttgaatttccattggtgatatacacattttcccactagatgacactaaagggaactaacccctaaaacagtttttattttatcataattgaaccatgacaagcaaaactggattcaaatctaaaatgtcaaagtgctcctcataatctatatataagcgatcaaagaccttctatagaattaataaatttactttttaatgcaattttttttgttcaaaactatttaatgcaagtatgcaactaaatcatactgtttgactgaagtagttaataataaaacgtaatgaaaacagtgttcctattttcttttataacatttctgttaataggatttagcctacttctctaattcatttgattccctaaacaagagaagtagtgatagttttttttgtctttactaaacatatacacataatgatatagatacacatctatacatcatagatagatacatagatatagagagaaagagaaatggtgtatagaaatatgggtgagactttaaattaaatttatgtaaaagagatgaatgaatatatgaaaacaggttgggtaggtgaagagaggctataagagggagagaaagaggtcgtaacccttttgccctattcacatttttatttatctttccatttagccattctgttccctgtctcttcctcctctctttttgacacatcacatcatcatcacatcatcattcaacatcaatcatcatcatatgcatacacatacatctgtgttctgcggatcgagttaattagttatg

SEQ ID NO: 14154 - DNA, 3000 bp, Unknown
  misc_feature (1)..( 3000): cDNA_ID_1034283_gDNA_ID_2214703_Annot_ID_136907 3000 nt of promoter + ATG
taaaccagagagcacagtacctttgagaattacgtgatggttttatcaaattatggaaaatttaaggatactcagtgaatgaatgctgtcaaagagttaacatcaagagcagctataaaaggacccactagttaatgcaatggagaaggaagcatgtgatgaacaacatgataaaagaagcacataataaagacgtgtgaagagcatacacattatataaccttaggaccactttctctgctctcttgtttttttttagatatgtaaaagggactagtggaatttaaggaacatcggcccacaaccctaggaaagttgcaacttgaggatgatagttcgaacagtacacatctcaaaccccttaagaaataaaactcactcaatctcatttacacaacagtgcaacctgccaaaacggtctcatttttgtgaccaaagctacatatataaagttccaccgaccctatagaccatgtggttcaatccttgggagttgggactatggcttcttacacaactaattttcaacatctacttgcttgctaccattgctaccatcactcagaatctccgatcttgttgtcagaattcaagacaaacatatcaaaagtcatagcaatggattcatatgaaaaggtagccattgagaagacatggttcatgtagttccatgactgcttgtaaaatagatcaggaggatattgtgtaagcagtataatatattcaagaatcaaataccatggcattatcagtagagaggacctaaaagacattatatttggtataactatgttgagaaattaacattatagatgtggttctcaagaatgtgacttggaaaggtaaccgagaaaacaaaatagaagaagagatcgtgaaataagctggctcagctagaggagtggaatagattctcatttatctgtgcatgacttcattttacctcttctttctgagttcgagagagatgagcttcttcgatacgccgggttagcatagaaattccataatgtgaagcacttgaagatgcataatacgaggtaactgtcagctgagcaaactttggaagtgcataacctagcaagcattgtacacaaacaaaagttcaggtgctttcttcaaagtaaacatacagatgtatctacatatataccaggtacatcaaacaaaagactacgtgcacaaagctactaacatacccactaccacctggcatttgaaagttttaaacagataagaggaaagccaattctcttgatggtaaaccattaatgtaagtaattcacctaaaggtaaaagttgcaattctacactgtgcagcacaccttgattcgtattctaaccatactattggaaaacttatcgcggcttgtaaactttcttgcattaaaaagctacaagtacaaaagatgctaacagaactacataagttcaaaacacaaaataaagaggttcaaaacacaatgagaaggccattcacaaaaattcaggacaaatcacagacagttaatcactaacgcaggatatatacgaaacaaatattcaggcacaagagaagcgagtgagccaaaaacgattaggttacctccaaaagcagcccctacacctgaatatactagaagcaatggaacctataaggaaaagcaataattgagaagtacataaaattcatacaaggtaatgtcaacagaaaagaggaaacaggaagaattccagaactagtaggtaaggcaagagaaaatacatacccccacaagaaaggaaagccgctttgacccggaaaaccgattttgaagataggggatccctgaaaacccaaagagataagatccactgtagaaatgataagtatttgacgacaagagaatcatgtgatacctgtattgaaagcatggacggcactaagcaagccaccaataccagaaccagcctatagcacaggagacacctagttagaaacagagtagtatagctaaatgcacagcaagataaatcgatttccatgctatccaaaaagccaatacacatcatggtattcccaaccaaaaaataattcccaaccaaaatactaagtcaaaagtcaaaacacaacaaatctgtgaacggaaggataattggagaatatgatggatgctctgcacccaacagccaacacaaatcatttcaaatgaaaaagctaaaacacaaacatcgcaatagaccaaattaacattaacctggaaaaggctatttcagaagtcaatgaaaaaaaggttaaacctttacatgaccaacagaggaaaccaaaaatcacaacacaataccctaagctagaattcaaattctcattcgcaatataattgcaactaaattcagctgattgccaacaaaccaattacccaactaggagtccaaaacaagtatccgtgcatataaagtaatcccataacacataattgaaacggagactgaagagaatttcaaagagatgaatgagatagaaatgcgaaaactgaccactgcagcagcatcgtgtaaaactggagttatcgtccactctcctttctcctgagaaattattaaacacaagaacatgagtctcagacgcttctgacacaaaaccacaaaacactgtagaagaaactttggcaactcactgaattagggtttaagagagaaagacaacgaggacaccgagcagaaccaagaccaggattcatagtcggatcataatcaagattcccacgccgaagcttctcttcgtatacttgtctcgttcccatcctctctttctctccgatcaccgtctctcttctctccgagaatgttccttctccaccgttgctacgccataactgaagcttacaactaataaactactgggccttatgggctttcttattctggcccaaataaagacactacgtcatcgtcatcgtcttcccaaattgagatgccctacaaaattcacactactatcttcttcttcttcgatttagcacagaagctgcagttttatca

SEQ ID NO: 14155 - DNA, 3000 bp, Unknown
  misc_feature (1)..( 3000): cDNA_ID_1815954_gDNA_ID_2214703_Annot_ID_136908 3000 nt of promoter + ATG
ttgaacagaatggcgggtaacttcggaaacaaggcactgatcggtgaaggttcttatggacgtgtcttctgcggcaagtttaaaggagaagctgttgctatcaagaaacttgatgctagttcttctgaagaacctgactcagatttcacctcacaggtacacacatacatattacaataacgattatcttctcttcaaactataatttgttcaagcttcttctcttcaagctataatttgttcaagcttcttctcttcaagctgtttagattaaactactgttattttctaatctaattaatttctattcaaaatggctaagttatcggtggtatcgcggctcaaacacgaccattttgtggagttgctggggtactgcttggaggcaaataatcgcattctcatttaccagtttgcaactaaaggttctttacatgatgtattacacggtacgtaaattttaactctcactactcatattttagtatatggtacatgaaatatatatggaccaattgaatctttagggagaaagggagtgcaaggggctgagccaggaccggtgctgaactggaaccaaagggtaaagattgcatatggagcagccaaagggcttgagttccttcacgagaaggtccagccaccaatagtccatagggacgtgaggtcgagcaatgtcttgttgtttgatgactttgtggccaaaatggctgatttcaacttgaccaatgcttcctccgataccgcggctaggcttcattctactcgtgttttgggaacattcggctaccacgctccagagtattataccataaacccgttaattcatttgtttaaaacaacctgatagttcttgataacgtaagagttttgttgtcttaggtatgcaatgacaggacagataacgcagaagagtgatgtgtatagttttggtgttgtgctattggagctcttgacaggaagaaaacccgtagatcataccatgcctaaaggccaacaaagtcttgttacttgggtacgtacacaaattaaagcaaacattttggaatgactccatatatatcatcattataagtccccttttaataacctttgtattgttgttacaggcaacaccgagactaagtgaagacaaagtgaaacaatgcatagatcctaagcttaacaatgactttcctcccaaagcagtcgccaaggtccgttcttcattttcttcttcaaatatcaaacgatatcttcatttactttgcttggttaaagatattttgatattagatgcatctagatatcatattttgaaaactagggacatatgattatttggtttagctttgtaattttgaaaagtttctttgcgtatggtcgaacagttggcagccgtggcggccttgtgtgttcagtatgaggcagatttccgaccaaacatgaccatcgttgtcaaggcacttcagcctcttctaaactctaaaccggccggtcctgagtctacgtcctaaactaaacaatataccatttctcttgtttttgttcatgttgttgttattatggctattttctccctcttttctgttccaagaactatgattattggttgtaagatgttgttatttaagcgaatgtaacttatatttttcatttggtttaacacccctttcgttttttattgtatctaagccttaaatccaagtttgctctcacaattttgaggagtcaacgcaagcaatagcaaattagttgtgagatttaaataataaaaaaaagtaaatatattaaccattaaagactttcaaattttttactattctcaataaaagatttagagatttatgtagattgtattatacctctagtttcttataagatgtttatttgatttccatctttctttaaggtaagtatccattataagacaactgccaaaacttagacatctttctatattcgttcatctgattccaatctttcttattttgttaccaaattgtacacatttcaatattttggggggctcatctttatttttattcaattcagtaaccaaaactagaagttctttctatcatatgcctatcagataaaaagtccttaaatttaaaactagaagttcgtttttttcatactaacaatatatatcaaataaataaaaaacttaataaagtcataaatttaaaatgtgaagaaaccaatactataataatttattatttatcgtcaattagttttgaattcggaactcgttacccttcatttgataaaataatttatatagtgaattaatattttacaaaatgaaatttagtataagtttccatggtcatatatctcaaatcattgagtaaaaaaacaagagtgatgacaaattacaacataatgacgacacccacacatgaagctgaagtcccaaaaacaaaccagtaaaccacatttcaccaccacgattcaaaatatataaaaaaatatggaaaaaatgatttttcttaattggtccatttgatgaaaaaagaaagacatttggatttttgctataaaaatgaaatcagcggcattaaaaataataataaaaaaatgggatggtttttaccagaaaatctcaagaaagtcacgtactgtaacagtaaagcacattttaggtttatttttttattttatttttaacttttttaacaacacgtcgcctcttttatacacagcgtctctctctctctctcctcaatataacatacttagctgcgaatctcgtcgtcatcgccccgacgaaccctgtttcgcgtctctttcccaatcccaatccaatttcgattccttcatttcaggattcgtatagccgtaaatccgttattgggttcttccgattatccaccgatagatctcgatcgaacgtttttctccgattggatttttgggtgatttcgccggaattcataatcagacgggaggagtcgcttctcttctcttgagtaatttagtccctttttgtgttatggaatcaattggttgatg

SEQ ID NO: 14156 - DNA, 3000 bp, Unknown
  misc_feature (1)..( 3000): cDNA_ID_3021980_gDNA_ID_2214703_Annot_ID_189760 3000 nt of promoter + ATG
ttgttccgttgtgtagggaattttgatttttgcgaagttgatgaggactttgatgtcgactatgtattccgaactgcttttggaggatcccgaggtttctctttttcattcactcatgaagaggatgaacctcgatggcggcatcactcttcaaggttttccaacaactctaacaggtcttggagatcgaaatatcggttagatgaagatgaagaagaagaagactatacttcagactccagtgactctgagtctgagccaaaccaagtttctcatagacaagcacttggcctgagtccctcaggtcccttaaaccttaaagatgtcaaacatgcgtaagtagtttcactgcatgtcaacacacaaaacctaacatatatctttcatcttctcaccacttaacatcaaactctcttttattttgtatatcaggtatcgaacttgtgcattaaaatggcatccagatcgtcatcaaggctctaccaaggtaagatataagatctcctcctctctgttcaatctccatgtaagtttctctttgatttctcgtgttattgaatatgtgattatatgaaaacaggaggcggctgaagcaaagttcaagctctgcagtgtggcttatcaatctttatgtgaaaagctatctgtgaactaagagttagataggtcttgattacttagagatacctcattacaataatttccgaattgtttcattttggctttgttcaagcaaaattgcctttgttctgtctttttctatttcttcaaaatctactactgatgtgtaatttatatatctcttcctcttgaaccagttaattattttcagagtgaattgacaaatatgaatcaaaatatgactgaaacaagcccaattactaattgcccaaccaggaaggcccaacgcgtgtagtgacgaaagcaagctctctgttttgtaaataatctcgttcatttatttatgaataaggacagtccttggagaccaagcaaaaattattgcgtttaaatattccatttctctgtgttttttttgttttccttttacaaaacaagaaaatcttcttttttttctcctctcttctctaatttttttttgttaattcttatgagtcaagctcgagtcacagtggtttaagacgcaatgttgtgcactctccaacaaagatgaacactgccgccgcaattaaagcagcgatttgcagaccgcaaagctattgttctctcctgaaaactgcgttttttcattctactcctgtcttagaacgcaaacgccgttcctcttcttcttcggacggtctcttcactacatgtgtgggttcatctagataatggatttctatcatttattaccaatctctagattttagagtgtgaatacatgttctgatttttttagggttttgactatttggcagaaatcaaatgctcagaagaagaagagaagcaagaaatttttgagggaacatcaagaagcagtgcgtcgtgctgttgaagaacttaaacaagaaagagaagaggtacatgactgagattatatatgatgcaaaaacatgtttaggccctatctatatcacttttgtttttggctggcctctaacaatttgcttcttgcattacctcattgccttttaagtttgaaacttgttgaggttaaagcacaaaaccatttatgtgcttttcttaatcaagtgtattgtctgtttgtttacggatcatgaaacttagtgtatctcattgctcttggtgtaactaaaattaggccgctaaaaaagccaaagaagctaaagaaaaagagaaaaccaaacgacccctgtaaaaaaagttagtgttgtttaatttaaacgttgaaaatgtctagtttaaggtgcagttttgttttgtatacatatatatatttactcttattaagaaaaagcatgtgttccattttgcagagcattccagttactgtgataacgactttgaatttatattccaaaatttattcaaagaatctcgagattcctattattcaacacatagagagaaggaacataattggtggtatcactcttcatggtcttctaattactctagcaactcttggagatcgaaatataacttctatgaaggaggagaagaaaaagatgagaaagaagaagaaaacaaagaagatggctatggttcaagaaaatccagaggctcagtgtttgagtcaattgaataccaagcctctcatagacaaacacttggtctgagtccttggggtcccttaaaactcgaagatgtcaaaaaagcgtaagttattttactccaagttcaaacacacaacacatacattcatgaccaaacgtgttgtttattttcagatatcgaacttgtgcattacaatggcatccagatcgtcatgaggaatttaacaaggtaaaccaatataagatcttcttcaatctccatttatatgtttttatctcttgtgttaatccttgactatataaactgacaggaggcagctgaagaaaagttcaagctctgcactgttgcttatcaatctttaatcgagaagttagcagtcaaataagatttttgtgtaacgcaagagagttagataggttttgattactcttataacaaagaatttcctacagaaatgtttttattatgacacctgatcaaccaatatacactacaatgtttaagcatttgctatatgtattgccctgtgattctttaatgtttgttttctctttagtttacaagtacatgtgactctataacactcactcagctctgcttttgtgtctgaaccggttaatttggtcaaattaaaccggttgttgggtcttagtgaaaccaataatgccggacctttggctaagttaaagagtcacttcattcaacaaatctcctcaaatgtcaaatttttggaacgaaatagattggccatcgagagaggagcttcattgacaaagagtcctatagccggaagtgaagaaatttccggtgcgtataatg

SEQ ID NO: 14157 - DNA, 3000 bp, Unknown
  misc_feature (1)..( 3000): cDNA_ID_3021988_gDNA_ID_2214703_Annot_ID_189754 3000 nt of promoter + ATG
agcctccgattgaaaagatttgatcggtgaaaatttccattcgacgaatcggagttccaaaagctcgctgacgagttctcaatagtaacctctccggcgcttatcgtgaaaaaccctatgttccagacttctcttacgctttccttgcaaaatctgcctcaattttggattgaagacaagagcttgaggctttttctccaatcttaattgaaactttggggtttttctcacggggattttgcgaattagggtttcggattggggattttgttacatcgaaaggactttggagattcagcgttgggctcggtaattgaagaatgcagaattcataaacaccgctctggaattttactttttaggtaatctctcgttttcttctgctgagtttaaatttgttcaattatattatccattgacagtggttattgaaatggttgagtttagtggtataaaaatccgccattgatttgttttttagttttagcgtcttctttatccatatgtttatggttttgtgtgtgaaacttgtttggttctatgtcatgcttcattcttctagtctttaatataagataaggtttgattatggtttcttttcaagcaggataacaaaggagggtcattttatctgttaattgatgggtgaagagatatctagcactgtgaacctggatttgaatctgggtcctgatcctgagttaggtctcgagccagcgacgaattatgctcggtctgattggggtaatggacttgctgctagggaatccgaatctctgagaaggtttagaagtcggtaccggtcacgtttcagacggattgatatgcttccggttcttgctgagacacatagcccggcgatggaattgagtcagttgttgatcacttctggaaatgtagttgctttgcctgctggtgagggaagcatggctagtggagaaagggtcatcgaggactccaaaaagtgcgagaatgggagcaaagtgatggcagaagacaatgtaacagaggagaaaagagatgttgagaagagcgttggcagcgatgggagctttttcgattgttatatatgtttggatttgtccaaggatccagttgttactaattgtggccacctttactgttggtcttgcctttaccagtggctacaggtttcagaggcaaaagaatgcccggtttgtaaaggggaggtatctgtgaaaacagtgactccaatctatggacgtgggatacagaaaagagaatctgaggaggtttcaaacaccaagatcccttcgagaccccaagcacgacgcacagagagtttgaggactacacttaacaggtcaggtcatataccaacggaaatatttagacatttgcaggataggcttgaaagggaatctagtacaggagaaagacgcgccagaccatctcttaaccggtttatgacttcgaggggagttagagcagaggagaaccagtctagtgaagcactggttgaaccttcatcagatgagattaacgatattgatctgatcttaaataatgcccctgaaaatgaagaggaaaacgaaaacctaagctcgtcacgtgctttggcaacccagagacgatgggcacagatgtatgggagggtgtcgtcgtttactttgagctctgctgaaagattagcggatacttatttgataacacatgcattggggaggaaccaagaacaaaacagcagtcctcctgttggtgttgaagacagggattcgttctcaagcatagtaggtgtgataaactcggagagtcaagttgaaacggcggctgagattaattcaatgttgactgtatcgacttcttcgtctgttagaagacatgagaacagttcaagggtctctgatgttgacagtgcagattctcgtccactgaggagaagaaggagattagcttagaagagaatggaggagaagaaagaggaagctagagtaataatctgtagtagaaagcagtgattttattggttttttcagtttgttttttatatgggattttggatttttgttgtttcagtttttatgctaaaagactaataaataaatacatcaataggatatatggttttttcaattcttttgatctggtgaatgaattcggttgttggcagttgttgacttgttgcggcagagttttgacttgtgatagaatataaaagtttttgttgttgactggacaaaacgtcgctttggccgagtggttaaggcgtttgcctgctaagtaaatggggtttccccgcgagagttcgaatctctcaggcgacgaattctattttacatttttatcgacgcggggtttgtaaattgtaaccaacctgtgtccctctgttcatgcaggagctagatagccaattgaagatagaagcaaaacgtaaatttttttataaatagattgaaaaatctgatctaaaaagtttgttaatcaaaatactatctgaaatctagtaagaataaatatttgaaggttgaataagggaaaaaatgagcaaaaaaggaaacgaacttggtgaatctggaacaaacgtcaataacttgtcctacctccttgtttaatttcctatcttggtaaatccgcgtttctttgattaatagaaatccgcgtttctcttcttttccaatttcttcattgattcttcttctcgtgtcgatcaatacaataccaagccaaaatctccataactccacgcttgcaaatttcttcccaggtagattcctccctctccctctctttgatttttcttcatatttgggtgttttatttgttctcaatcgggaaaatccacgagctaaggaattgatatatattttggtttgtgttctatctttctgatctaaatcgcaagacgaatattgtgacgattcttatgatttgcgagtaatactacttgttgattggtgattgatcttgcttttgctttgaatctctctgcagaggaaataaactctctagatcagtagcttatatgcgttactgataatg

SEQ ID NO: 14158 - DNA, 3000 bp, Unknown
  misc_feature (1)..( 3000): cDNA_ID_2706138_gDNA_ID_2214703_Annot_ID_189751 3000 nt of promoter + ATG
agatgtcaacatgaaataaacgaagaacgaaactcaagaatgaaccatattttacagatcaggacgtaagaaagaaaagcaacaaacctgatgaattggaggatacattaaatttgtacaaaccggacattcaaggagctcataaacaccattgctcgaatggaattttccaatggagccactacctgattttgttggtttgctattagcctcaacctttgccatcttaacctcataatctacgcctgtcgagttagattctagagcttctttcaatgcactgccaccaggagccatagagagtccaaacctagccaaaacttgttttatttctaacagcaagtaagtgaaaatccctagtcctctcttgttgcagatgatgtactcctttcgatgatatattcctttggaacttcgttcttctgcaagaaaaacaaatgatggctaaatatacaacatttaaggaaatgttatcaataagcaagcaggtaacatgttagttaaaaaactggagcaaagtaggttaggaagtagatacgtggtgcacttgatcaagttcttttctttctttccggaaaaagggaccaatgatctcttagcagtacaccatactgcaaatccagtcttataccgttgcggtccaagcatataaaacgtagcagccacttcgttaggaaaaaaggatagtcttgtgaattaatgtgactaagttcattcccaatcaactgaaagttgccaacacatctttctttccacgagcctgttgcgtctcaggtccctcgattcttcacaatcctttctaaatgctagcggagtaaaacagttatgtaacaagtcagactttttaattcaaggagaaacagttcatctatgaacaatgctaaaaccttacaagttccaatattttaaatggttataatataacaatcacaggctattcaaacatcaaaaatagagctgtcaaatgaaacgatctgtttttattttgcaagacataacttttcaatgtaaactatacaaaagagaaattgattcaacaggaaaacacaacaagtagaacaaacaaacatcaggtaagttcaaactcaagatctcataaaaatggaggaaaaaaactcaaaaaatttaaaacaagtagcaaattttgaattatgaaaacaaattgaagctgaactcaattttcaaaaactttgtacccacaaaattattcaaaatcacctcatcagcgacaaaagttatttccgattacatgaaatagttaacgaatccataaactaagcaattcaaagacaattgacaagaggaacataactcattcctaaaagacttggccagattcgtcacaataagcacccctgaacgaaaaataaaaacacagaaccaaaaacctagttcttaattcctaagctcgtgtttttttctcgattctgatttaagaacccattaaagaaaaaacccaaatttgaacaataaagagagagagagagataattacccagggagaaatttgcaggcggtggcgttcgagttatcgaggttttactttcagattcacatgaggattgaggaagacgaaaatatcaattaataagagattgaagaagaaatgggctttgaattaggaagaagaagaaacgaattaagacggcagggagagggaggagatagttgtgtcgtgtcttgttgttggtatcgatgaaagccattaatggtgctctgtttttattacagcttttcaatttgaatttcacccaatttcgtttttcttactttttggtcccttttgtttttctaaatagacaaatgtcgtccaaaagtattctttaggggtcaattcatcaaaataaatgtaggtggtgtcttaacaacaaaataacgaaaaaggtgtcctcatctcacaatttgtcaaatgtattgttaattttttctttgtttcattattgtccatcaattcgagtttacaataaaaatcttcatttttgattgatgtaattctcaactctcaagatataataatccacacaaacaaacaaaaaaatgtcaaccttacttattataaatagttatgtatcaaatgattctcttgtatggctatgaagtatgaacaatcagactatgcctcggcaagcagcaaatatgcttacactggatccagttgccaccttcagaatggcatacaaggcccataaattggtccaactgatccagggccagacacatttggaagtcaagctgagtcttgttgtatgattgtatcctatgcagtgtttgtgtatgagctcaaagataagatcattatctgagcattgaaagtttcttacaagttggacaaggccacatcattatgatcaatcaatagggaagagagttgtaaaatgatactctcacaccttcaatggcctgcagagcctcatggaaatgtgatttgttaaaattggaaaaattttaagttctgaaacttttgcatatactatagtaaaaatcggaaaatgttacattgggtcactatcgattacataaggaagaggtaatgtgaatgggcttgtagttacctaccaagtaccaaacagagcaaagtaaagaaaacaataaatgcaaaaaatctaattccttctatttattgaagaaagagtttttcaaatcttcaaagacattctgggtaactctgtcaccacagttgactgtctcatatccccacgcgctaactcctgaacgtcaaactcaccttcctccatctctaaactctgtgttttagccacgcgtgtaatcgcgtgagtaagaaccaccaacaatgggaccaacttgcttaaaaagatttatgggttttcgcttttattacacactctcccaaatccaaagaagcgtttgtgtttagatacgtggtggtgggcaaagaaaagaaccaaacacgccactaggagctaccatctctgttttattgctgcttctgcttcctcttccattactcgtcttaaaacaaaggagaaagagtcaagagac

SEQ ID NO: 14159 - DNA, 3000 bp, Unknown
  misc_feature (1)..( 3000): cDNA_ID_2706134_gDNA_ID_2214703_Annot_ID_189750 3000 nt of promoter + ATG
gtcgtctccgtcgttgatgtatcggcgacgttcacggatggacttgtaagagaggagagcacggtcagagaagcgagaggtggatgactcacgggagtgatggattggtgagcaatggtagtaatgtggatgtgtaggtgaacccattaggctgcaaccagaaccaaatgacatcttctccacgtcatggtttgatggactctgtacatagtaaagaggtctaatcgctgaacgcggcggagacaaagccgctgcgtcgatgcttgttgcctccgagtctgtcttcgcatgcatgtctcttgactctttctcctttgttttaagacgagtaatggaagaggaagcagaagcagcaataaaacagagatggtagctcctagtggcgtgtttggttcttttctttgcccaccaccacgtatctaaacacaaacgcttctttggatttgggagagtgtgtaataaaagcgaaaacccataaatctttttaagcaagttggtcccattgttggtggttcttactcacgcgattacacgcgtggctaaaacacagagtttagagatggaggaaggtgagtttgacgttcaggagttagcgcgtggggatatgagacagtcaactgtggtgacagagttacccagaatgtctttgaagatttgaaaaactctttcttcaataaatagaaggaattagattttttgcatttattgttttctttactttgctctgtttggtacttggtaggtaactacaagcccattcacattacctcttccttatgtaatcgatagtgacccaatgtaacattttccgatttttactatagtatatgcaaaagtttcagaacttaaaatttttccaattttaacaaatcacatttccatgaggctctgcaggccattgaaggtgtgagagtatcattttacaactctcttccctattgattgatcataatgatgtggccttgtccaacttgtaagaaactttcaatgctcagataatgatcttatctttgagctcatacacaaacactgcataggatacaatcatacaacaagactcagcttgacttccaaatgtgtctggccctggatcagttggaccaatttatgggccttgtatgccattctgaaggtggcaactggatccagtgtaagcatatttgctgcttgccgaggcatagtctgattgttcatacttcatagccatacaagagaatcatttgatacataactatttataataagtaaggttgacatttttttgtttgtttgtgtggattattatatcttgagagttgagaattacatcaatcaaaaatgaagatttttattgtaaactcgaattgatggacaataatgaaacaaagaaaaaattaacaatacatttgacaaattgtgagatgaggacacctttttcgttattttgttgttaagacaccacctacatttattttgatgaattgacccctaaagaatacttttggacgacatttgtctatttagaaaaacaaaagggaccaaaaagtaagaaaaacgaaattgggtgaaattcaaattgaaaagctgtaataaaaacagagcaccattaatggctttcatcgataccaacaacaagacacgacacaactatctcctccctctccctgccgtcttaattcgtttcttcttcttcctaattcaaagcccatttcttcttcaatctcttattaattgatattttcgtcttcctcaatcctcatgtgaatctgaaagtaaaacctcgataactcgaacgccaccgcctgcaaatttctccctgggtaattatctctctctctctctttattgttcaaatttgggttttttctttaatgggttcttaaatcagaatcgagaaaaaaacacgagcttaggaattaagaactaggtttttggttctgtgtttttatttttcgttcaggggtgcttattgtgacgaatctggccaagtcttttaggaatgagttatgttcctcttgtcaattgtctttgaattgcttagtttatggattcgttaactatttcatgtaatcggaaataacttttgtcgctgatgaggtgattttgaataattttgtgggtacaaagtttttgaaaattgagttcagcttcaatttgttttcataattcaaaatttgctacttgttttaaattttttgagtttttttcctccatttttatgagatcttgagtttgaacttacctgatgtttgtttgttctacttgttgtgttttcctgttgaatcaatttctcttttgtatagtttacattgaaaagttatgtcttgcaaaataaaaacagatcgtttcatttgacagctctatttttgatgtttgaatagcctgtgattgttatattataaccatttaaaatattggaacttgtaaggttttagcattgttcatagatgaactgtttctccttgaattaaaaagtctgacttgttacataactgttttactccgctagcatttagaaaggattgtgaagaatcgagggacctgagacgcaacaggctcgtggaaagaaagatgtgttggcaactttcagttgattgggaatgaacttagtcacattaattcacaagactatccttttttcctaacgaagtggctgctacgttttatatgcttggaccgcaacggtataagactggatttgcagtatggtgtactgctaagagatcattggtccctttttccggaaagaaagaaaagaacttgatcaagtgcaccacgtatctacttcctaacctactttgctccagttttttaactaacatgttacctgcttgcttattgataacatttccttaaatgttgtatatttagccatcatttgtttttcttgcagaagaacgaagttccaaaggaatatatcatcgaaaggagtacatcatctgcaacaagagaggactagggattttcacttacttgctgttagaaataaaacaagttttggctaggtttggactctctatg

SEQ ID NO: 14160 - DNA, 3000 bp, Unknown; identical to SEQ ID NO: 14154
  misc_feature (1)..( 3000): cDNA_ID_1034283_gDNA_ID_2214703_Annot_ID_189747 3000 nt of promoter + ATG

SEQ ID NO: 14161 - DNA, 3000 bp, Unknown; identical to SEQ ID NO: 14159
  misc_feature (1)..( 3000): cDNA_ID_2706134_gDNA_ID_2214703_Annot_ID_136910 3000 nt of promoter + ATG

SEQ ID NO: 14162 - DNA, 3000 bp, Unknown; identical to SEQ ID NO: 14158
  misc_feature (1)..( 3000): cDNA_ID_2706138_gDNA_ID_2214703_Annot_ID_136911 3000 nt of promoter + ATG

SEQ ID NO: 14163 - DNA, 3000 bp, Unknown
  misc_feature (1)..( 3000): cDNA_ID_3021988_gDNA_ID_2214703_Annot_ID_136913 3000 nt of promoter + ATG
aatccgaatctctgagaaggtttagaagtcggtaccggtcacgtttcagacggattgatatgcttccggttcttgctgagacacatagcccggcgatggaattgagtcagttgttgatcacttctggaaatgtagttgctttgcctgctggtgagggaagcatggctagtggagaaagggtcatcgaggactccaaaaagtgcgagaatgggagcaaagtgatggcagaagacaatgtaacagaggagaaaagagatgttgagaagagcgttggcagcgatgggagctttttcgattgttatatatgtttggatttgtccaaggatccagttgttactaattgtggccacctttactgttggtcttgcctttaccagtggctacaggtttcagaggcaaaagaatgcccggtttgtaaaggggaggtatctgtgaaaacagtgactccaatctatggacgtgggatacagaaaagagaatctgaggaggtttcaaacaccaagatcccttcgagaccccaagcacgacgcacagagagtttgaggactacacttaacaggtcaggtcatataccaacggaaatatttagacatttgcaggataggcttgaaagggaatctagtacaggagaaagacgcgccagaccatctcttaaccggtttatgacttcgaggggagttagagcagaggagaaccagtctagtgaagcactggttgaaccttcatcagatgagattaacgatattgatctgatcttaaataatgcccctgaaaatgaagaggaaaacgaaaacctaagctcgtcacgtgctttggcaacccagagacgatgggcacagatgtatgggagggtgtcgtcgtttactttgagctctgctgaaagattagcggatacttatttgataacacatgcattggggaggaaccaagaacaaaacagcagtcctcctgttggtgttgaagacagggattcgttctcaagcatagtaggtgtgataaactcggagagtcaagttgaaacggcggctgagattaattcaatgttgactgtatcgacttcttcgtctgttagaagacatgagaacagttcaagggtctctgatgttgacagtgcagattctcgtccactgaggagaagaaggagattagcttagaagagaatggaggagaagaaagaggaagctagagtaataatctgtagtagaaagcagtgattttattggttttttcagtttgttttttatatgggattttggatttttgttgtttcagtttttatgctaaaagactaataaataaatacatcaataggatatatggttttttcaattcttttgatctggtgaatgaattcggttgttggcagttgttgacttgttgcggcagagttttgacttgtgatagaatataaaagtttttgttgttgactggacaaaacgtcgctttggccgagtggttaaggcgtttgcctgctaagtaaatggggtttccccgcgagagttcgaatctctcaggcgacgaattctattttacatttttatcgacgcggggtttgtaaattgtaaccaacctgtgtccctctgttcatgcaggagctagatagccaattgaagatagaagcaaaacgtaaatttttttataaatagattgaaaaatctgatctaaaaagtttgttaatcaaaatactatctgaaatctagtaagaataaatatttgaaggttgaataagggaaaaaatgagcaaaaaaggaaacgaacttggtgaatctggaacaaacgtcaataacttgtcctacctccttgtttaatttcctatcttggtaaatccgcgtttctttgattaatagaaatccgcgtttctcttcttttccaatttcttcattgattcttcttctcgtgtcgatcaatacaataccaagccaaaatctccataactccacgcttgcaaatttcttcccaggtagattcctccctctccctctctttgatttttcttcatatttgggtgttttatttgttctcaatcgggaaaatccacgagctaaggaattgatatatattttggtttgtgttctatctttctgatctaaatcgcaagacgaatattgtgacgattcttatgatttgcgagtaatactacttgttgattggtgattgatcttgcttttgctttgaatctctctgcagaggaaataaactctctagatcagtagcttatatgcgttactgataatggataatcacggtcctcgttatccatacccttacggtcagtacccatacccttacccatacccagctccttatagacctcccagttcagagccatacccacctcctccaaccaatcaatacagtgctccttattacccttacccaccacctccatacgcaacaccaccaccatatgcatcaccaccaccgcctcatcagcacacttcgggttcgcattctggaccattagactatagccacaacccacaaccatcatctctcgcggctgctcctccagagtatcacagacattcttttgactaccaaccttctccttacccttatcagccccaaggtaactttggtgcttatggtcctccgcctcctcactattcgtatcaagagccagctcaataccctccacctgaaactaaaccgcaagagcctctgcctcctccgcagcaaactcaaggttttcaagaatatcgtaggcaagattgtctcagtaccgggggaacaggtcatgataatgtaagcaattctggatcttcttatcctcctgtggatgaacttctaggtggtctgcatatttctactaaccaaccaggtccctcagttccacaactatcctcccttccttcgaactcttggcaaagccgccctggggacttgtatggttaccctaacagctcgtttccaagtaactctcatttgccacagttagggagagtagattcctcaagttcttattatgcatctaccgaatcgccacatagtgcggatatg

SEQ ID NO: 14164 - DNA, 3000 bp, Unknown; identical to SEQ ID NO: 14156
  misc_feature (1)..( 3000): cDNA_ID_2706095_gDNA_ID_2214703_Annot_ID_136918 3000 nt of promoter + ATG

SEQ ID NO: 14165 - DNA, 3000 bp, Unknown
  misc_feature (1)..( 3000): cDNA_ID_2706099_gDNA_ID_2214703_Annot_ID_136919 3000 nt of promoter + ATG
aataacaatttatttaccaaaataaagactctaaattaagaagaaagcacaaagagcactcatcaccaggacgaatctcggtatacatgatatgctaacaaacttagacgcattttctgtgaacaatcgccgctccatgttcttcatattcatccttagttatccacatctgcaatatggacatcaaaaaatttagattataacaaccccaaaaaacttacactaattaactttaaaaccacattttatatcatcttatttacctggtgaaaggtgcttagagaagccaaaatggagcctccaatccaaacactacactcactttccggaggaactacaactttaactttcatactcgacggtacaagtgcatttagctctttggtcattctttctttaatcccatgtaacatcgtcgtgccaccagtcatcaaaatgttaccatacatatccctcctcgtatcaacaggacacttcaagatggaattgcgagtcgcctcgtgaataccagaagattcctttccgatcacagacggctggaaaagaacctcggggcacatgaatctctcggcttctatcgtgatctcttgaccatcgggaagcacgtaggttttatcgattgtccaaccctttgttgtcttctccatttcttgctcgtagtcgagtgctacgtaacaaagcttctctttgatgtctcggactatttcccgctcggcggatgtggtgtatgtgtagccacgttcggtcatgatttctatgaggtagtcagttaggtcacggcctccaaggtctagacgaagtataccgtgtgggagtgcgtaaccttcgtatactggaactgtgtggctcaccctctctcctaaatccaacacaacacctaaacacgtagaaacttaacatagtaattaagtcatggattgtttcacacgcaaatacgcaattcatgcatttgcgtgtattatagtgaccaaaaaagttcaacagcaaaaattcacattttagaatataacaacattcgctgtttgcatttgatgttctaacaagatccactgctaaattatgagactccaagcttataaactaacaaaatattaatttctcttaatttatgacattttggattttggttgcttacctgtggtacgaccactggaatagagataaagaacagattgcatggagacgtacatagcaggaacatcaaagctctcaaacatgatctgagtcattttctcacgattggctttagggttataaggagcttcagtgagaagtacagggtgttcttcaggatccacacgtagctcgttgtagaaagtatagtgccaaatcttctccatgtcatcccaattgttaacgataccatgctccattgggtctttaagtgtgagaatatctctgttggcatgaccttcttctcccacataagattcgttcggattcaatccatctcttggacgacccacgacacatggaaacacaacctttggtgcttcgtctccagcaaatcccgccttcaaaatgtttcaccaattaattggcacttaacaaaacgtttcacgagaaatactccagagtataggtcaaaatatggtttattttaatataaacgcataaatagtgtttagtaaaacaatcgaagccttaacgattaaccaaaaaaaaagtgtgtttctttttaacgtacctgcaccattccatgtcccttgtcacacacgataggcttcatgtcctctgatgccgaaataatctaaagtaaacatatataatgcttccacaaaaaattaagtcataaaaaagttcaaacgcagcattaacagcagaactgtaagaatcaaaatcaaatcacaaacacttggggaagaagaaaagggttcaatttgtatcacaaacttgtttctttggcttgtaatccattattgattaaaaacattatccacttttattttactaacgaaaaccgttttaacaaaaaaaatagcaaaaggtaaatcaacttggagagagatcaaagaggaacaatcgttacgaatcttactctcaaattaaggtggtgtctctctctctgtgtcttgttcttcttcttcttccttctctcgtctcgccaacaagaatgtgtttcaagatcctagtacgaccttgttaatttctcttataaagggcatgcaaagactaaaaagaggcatatgtcctacactaagtaggactctctttttttttcctacaaaagtaaatttgcattatttttactttttagccttccaaatagtgcaattctttcctaatctttgattttttttttattgataaaaactaaaacaacctaacaaaattgaaatgagaattaatgtgccaattcagcttataaagactaacataaaaactaaactagcttcaatttattgaaaaattaaaagttactcatttaactcaacaaaattatactagatgaataagacatatcttgttttgaaatcccttaattaatgatttgattttaattatcttcaaattccatatatattatgtgaaagatttaaggggatattgattaatgaactgagatttcactaattttaatttagtttttataaaataaaatagatagttgttataaaataaaataaaataaactaaaaacacgtattggagggtaactcaaattgaatgtttctcattagaactaaaattaaacattctaattaaccgattaaaaacaattaatttataacctttctagcctattaaaaatcattctaatttccaagtggtttcactctgtttgcggtgatatcaacatattcgtgaggcagagaaaataaacaagtaaatagaggaaaagtaaattgttgttaccggcggtaaatattaaaatgcccttttccgggtcagatcgactgagtcaagcccgagtcacgttacccacatcggcttttggtttcttcctttgcaaaacggcgaaaaagacacaaacttttctcctccgatctcacagagatg

SEQ ID NO: 14166 - DNA, 3000 bp, Unknown
  misc_feature (1)..( 3000): cDNA_ID_2706146_gDNA_ID_2214704_Annot_ID_136922 3000 nt of promoter + ATG
aagactcaggggaggtttcaatagccgggaacaagctgtaagacgaatcttgatcgttgatcttgctcttgttgaaacttgcagatacaagaagaggaggaggagtcaaaggtttaagggatggcttgtaaagtgtctttcttttactcatcttttttgtgtgaagagagtttcttggtgagttatggtgaggaggattgttagctactaagctgttggagaaataagagtgttgaggaagagaatctgaggaaggtttcttcttgctacaagtgtttgaggaagaagaagaagctttgtttttgggtttagagtgtttagtcacgtctttgagcttgtggaaccatgcatttgggagcatctctgaaattctgaacttgtaattccccatcttgtctctctctttttcacaaaagtttgtgatatttctcttaagaaaactctgtttttgtttccttagataaagaagaaggtgagaaagcaaagttctctatgtgacagataaagaagaaactgaagattaaaattggaaactagtggggctactactagaaaaagcttaaagaatgtcttttattagtatcatcatcattcatcatcaacatcaacttgagacatcacatttacacgcttgtgctcacataattaataaatttattttatggtgaatttttaaaattggttgactaattgaaattgtatttggtgaaaaactgaaaatcataagaacataacttttatctaaaatattatataattaagggaatagtacaaaaataattataaaacagagaatcagttgcttctgatttctgacagatttctatcatcatttcatggagattttactcttcatcgaaatgataaaataactgaaaaatgtaattagcgaattataaaacagtagcaaatgtaaacagttttaaagaatacacaaaaaggttgaccaaatggcaattacaaaagaaaaatacagcttcttttcctcgaagtatgctttttgattgaaaatattaaaacgtttctaaacggacaaatcaatttaataaataaaaacaaagttttcacaattcaactaaaagtttaacatatgtgaatctatctaggttaaagactcaaagtacacgttataatgaagttcaatagtttcatttcgatgcttctttgaatttggtaaagtgtgaaccttatcttaagtttttaggtagaaataatttagtatagtagcactttatgttatattaaggtgatacagatacacaaatgatgaaattaagataatcaaatatgttccattttctcctctgaataaagtgggatcaacttttgagtcataataatgaatatgagaaattttttggtctactttgtccactaacgccgaacattttgaggacactttttttcttcttctatacatttccactttccagatcaaatgttttggcaactacttatcttttaacttcgagaaggaaaaaaatgatattcaaaaatcaaaataaaacattttccatccttactttaaataagcacaagtgattattcatatttaaaaaatggagatattttcactagacgtgggactggtttatgttcaacaatgttgacctaccaatatatcaacgactttttgagtatacaaaaacaaaactatctcatcatattggattttgtttataagcaagagccaccaaacatttgcaataagaaaaccttttctattctccattgtttttaaaaacttcatgggactccaccatcatgatcagtttcacacccaaagacgtgaactccacgcaacacaagccaatcctctaaccttatacacaccaaaacaaaacaagaagccaaagaggatcacaacaacaacatcatcaccaaaaaagcttcaagacaatgagagtgaaagcaactttgattaacttcaaatcaaagctttcgaaatcatgcaacagatttgtctctctcttccgcttccgagttaaaagacctgtctttattagacctcttcgtgcccgtcatggcaatgtcaaacctagacatcaacatcatcattccaagaagccaatctgttcttgtctctgtttcctcaattcaagcaagaaccataagatgagcaacgccaaacatagaagttcctcttgtaagacaacttcgctacaaaatctgttttaacattgaaattttatcagcttcttgatctctttgttctcttattttgccattgcagttagtgtgaacgatgatgattactccaagtttatgcaatcacctcttacgccagcaacagccaagaagctcttcacttcacccatcacgacaccttactcttcacggaccaggaaatcgctgaacgcaagagatacatttgaagacaatgctgtggaagatgcttgtagaagctttgaaaactatctgattcatctgattgttgaagaagggaaaatagatgacttaatggacatagaggaacttctcttctgttggaagaatcttaagagtcctgtcttcattgaacttgtctcaagattttatggagaactctgtagagacttgttttcaggtgaatgaacagatctagttaaattgatcaaaacaaaaatgttttaaatctgtatctgtcagtacttgtggtttgacaattattgaatacaacatctaaggtttctaagtttaaagttgggaacaatgtgtgaagactataaaagattgtatgtttcggtcaataccggtcggaccggttcaaccggatttacttaccaaactcgtctcttgcaattttattgttgaataaaaaaattatcacaactgtgtggacacgtgtggttctccgtcctcactcctcaagcccctttcattttatcccaactgtgtctggtctgattaatgaaaaaataaaacaaattcgaagaaatataaatgagatttttgtagctagctcctccaaatccaaatcgttgcgttaaggtttcttcaagtttcaatctttttgcaatg

SEQ ID NO: 14167 - DNA, 3000 bp, Unknown
  misc_feature (1)..( 3000): cDNA_ID_1816028_gDNA_ID_2214704_Annot_ID_136929 3000 nt of promoter + ATG
tgcaagctgggaacgtgagccccaattacagctgtgtgtgtgtatcaggcattattgcagtttctatcagttgattctgtttcttacatgccgtcctacaaaatcctttgcatgttaattaattacttaaaaaatatcctaactatattatttatttctaagtatacataaatattagaaaataacatgattatgatgttgtgaccagagaaaaaaaaaatcttcaagatcacgagtttgaataccaatgacaaaacaataactctttaacatgttttggtcccgagtgtgaattaagaatattgcagcttatgtttttggttaaaagagaaaagaagaaaggtgaatcaagaatattgcggctgtttgtttctcatgtgcaacatgtgtggtacgagattgatgattcttgttacgttagccaacatcgcgtgatgacaactattctaagacgaggtttcacatggccgaaacattaaagcttcgcttaatcatatcaaactccagaatttagtatacttgatcattatttagtatgcaattatgcatgtagttcaaactaatcattggattggatgtattagtctagatttcaaacgtaatttttttccaaggttatgctgatttatatgtttgtgacttatccgaatgtttttaacaaccaatatacaaatattcgaaatttgagaatcatcatatcctattatcctcactaccagttaaaaaatgtcatttgtggaattatatggaaacacaataggtgaaaaaagaagaagttcattacgtgctttgaattttatagttgaatttctatttcagttttataatccagttgtacttgtatgatgcgaatctaatctagtggttcggactatccaagtcagtttcatgaattaaattatgggggaaaaataaaactatttattacaaggataagggcaaagtggccctaagttgattatatatctcttttgcatggtaaaagattatttccacatatgaaaatatgcaaaaatccaaaaaaggattatgtctatatattttgctgtcaacaagaaaattccataagtgtataatgaaatttaggataatacatagaataccactctttttaccagacggcgacattttacactgagttaaaacttataagttttttactcgttccaacagtagtcaattactcgataggtgttacaagcctagctatatataaggtcaaaaaagggagtgaaaaaacgtagtaacttaatagtagctcgttgataatatagaagattccacccaaaagagagcgattccaaaagatatggtgtcattttagttagatttaaatttgaactaattagatagaaaagattaaagatttaatgggaaatacgaagtgaatagagcatgcatgagtaaaagttagaacaaatagatgatatattcttgggtagtaacgtgttatttgacagaaaatcacatgcatatataaaatcgtgtgaacacttatactgtatgtttatcatgcgcatggactattggactccataaatagcaaggttatggttaaatgtagtaaaatggcaaaaaaaaaaacataatatattatatatatatatatatattcaattaactacaaatccttcaaaagtattaacaaaaaataaacaaatcctacaaaatatattgtgttgattttttgcatatttctttttgtcgatggtattttcttcagtgtaggaaaaaaaaattcaatttaagcaagaatgaatttttagtttatattccaccaattcttcccatttcgtttgcaagttctctataaatttggtatcttattttggaatatatattctaccataagactacatgtttgatatgaatcgtcaatttttacttatctatcggtctcaatccactctaagttttagggtattcggaactcaaatttggttagaatacatatacagagaatgacgacaggtagagtatatagcatatacatgtacgcgatcgcaaatttctattataatctttaattagataagtagaatttatgtactattattttcttttcttaggataatttttataacttttacaaacttaaattaaaatgatttcttagagtaattgacaataacaaaccaagaaagtcaaaagagaaaaagaagaacctcaaagtcttttgtgcatgtgtgtgttagtgtcatgcatgcactctatatatttatgatttgcaaaaagaaacatatatgtttctattgaataattctttcttttcttgatgaaataatcaatatttccttatataaataataccccaactgtagaaaggaaaatacctataaattagttgaatacatataaccaaatattaaaattacgtcaccatactattttttttccaaaatatatgattcctaccaaccctaaatttcatttctatatatattatataccaaaaaaacatatcttaacaaagtcaaaaaaaaaccaaagtctttcactttgtgtctgttctaaatctctgcgagttttcttacttttcgagttttgtgtgtgtcttcaagtgtcgtgcatgcattttatgcgtttcgttcacttgcatgctctctccctctttctctctctatctcacccataaaagttttaatttttcacatcgataaattaaattgaaacaaaaaaaaaaattcacccaaaaaaaaaaaacctcgttgccttcttcttcgccgttacagtcctctttctttcttcaattcgccgtcaaaatcttctctttctcttcccccgccggtccttcaccaatcctctgatctctctacacacgaacctttgattttgaccaacgtcgatgcatgttcatgactagtctcttcctcaatccttcaatttcatcaattcacgtcgatttcgtatccgattcgttgttctagctctttgtgtggtgttagggttttaagattttggaattggggtttggagtttgtgatgtttgaagtcaaaatg

SEQ ID NO: 14168 - DNA, 3000 bp, Unknown
  misc_feature (1)..( 3000): cDNA_ID_1976561_gDNA_ID_2214704_Annot_ID_136931 3000 nt of promoter + ATG
gaaagctgaaacagaggagaagcttagaggaggaactgagaaaatcagcggaatgagagacgagagcaatgtgctaagagaagagattgggaagagagaagagaagataaaggaaacggaaaagcatatggaggagcttcacatggagcaagtgaggctgagaagacggtcaagtgagcttacggaagaagtggaaaggacgagagtgtctgcatcggaaatggctgagcagaaaagagaagctataagacagctttgtatgtctcttgaccattacagagatgggtacgacagactttggagagttgttgcaggacataagagtaagagagtagtggtcttatcaacttgaagtgtaagaacaatgagtcaatgactacgtgcaggacattggacataccgtgtgttcttttggattgaaatgttgtttcgaagggctgttagttgatgttgaaaataggttgaagttgaataatgcatgttgatatagtaaatatcaatggtaatattttctcatttcccaaaactcaaatgatatcatttaactataaactaacgtaaactgttgacaatacacttatggttaaaaatttggagtcttgttttagtatacgtatcaccaccgcacggtttcaaaaccacataattgtaaatgttattggaaaatagaactcgcaatacgtattgtattttggtaaacatagctctaagcctctaatatataagctctcaacaattctggctaatggtcccaagtaagaaaagcccatgtattgtaaggtcatgatctcaaaaacgagggtgaggtggaatactaacatgaggagaaagtaaggtgacaaatttttggggcaatagtggtggatatggtggggaggtaggtagcatcatttctccaagtcgctgtctttcgtggtaatggtaggtgtgtctctctttatattatttattactactcattgtaaatttcttttttctacaatttgtttctgactccaaaatacgtcacaaatataatactaggcaaataattattttattataagtcaatagagtggttgttgtaaaattgattttttgatattgaaagagttcatggacggatgtgtatgcgccaaatggtaagcccttgtactgtgccgcgcgtatattttaaccaccactagttgtttctctttttcaaaaaacacaaaaaaaaaataatttgttttcttaacggcgtcaaatctgacggcgtctcaatacgttcaatttttttctttctttcacatggtttctcatagctttgcattgaccataggtaaagggataaggataatggttttttctcttgtttgttttatccttattattcaaaaaggataaaaaaacagtgatatttagatttctttgattaaaaaagtcattgaaattcatatttgattttttgctaaatgtcaacacagagacacaaacgtaatgcactgtcgccaatattcatggatcatgacaataaatatcactagaataattaaaaatcagtagaatgcaaacaaagcattttctaagtaaaacagtcttttatattcacgtaattggaatttcctttttttttttttgtcgtaattggaatttcctttatcaaacccaaagtccaaaacaatcggcaatgttttgcaaaatgttcaaaactattggcgggttggtctatccgaattgaagatcttttctccatatgatagaccaacgaaattcggcatacgtgtttttttttttgttttgaaaaccctttaaacaaccttaattcaaaatactaatgtaactttattgaacgtgcatctaaaaattttgaactttgcttttgagaaataatcaatgtaccaataaagaagatgtagtacatacattataattaaatacaaaaaaggaatcaccatatagtacatggtagacaatgaaaaactttaaaacatatacaatcaataatactctttgtgcataactttttttgtcgtctcgagtttatatttgagtacttatacaaactattagattacaaactgtgctcagatacattaagttaatcttatatacaagagcactcgagtgttgtccttaagttaatcttaagatatcttgaggtaaatagaaatagttgactcgtttttatcttcttctttttttaccatgagcaaaaaagatgaaataagttcaaaacgtgacgaatctatatgttactacttagtatgtgtcaatcattaaatcgggaaaacttcatcatttcaggagtattacaaaactcctaagagtgagaacgactacatagtacatattttgataaaagacttgaaaacttgctaaaacgaatttgcgaaaatataatcatacaagtgccagtgattttgatcgaattattcatagctttgtaggatgaacttaattaaataatatctcacaaaagtattgacagtaacctagtactatactatctatgttagaatatgattatgatataatttatcccctcacttattcatatgatttttgaagcaactactttcgtttttttaacattttcttttgttggttattgttaatgagcatatttagtcgtttcttaattccactgaaatagaaaatacaaagagaactttagttaatagatatgaacataatctcacatcctcctcctaccttcaccaaacacttttacatacactttgtggtctttctttacctaccaccatcaacaacaacaccaagccccactcacacacacgcaatcacgttaaatttaacgccgtttattatctcatcattcaccaactcccacgtacctaacgccgtttaccttttgccgttggtcctcatttctcaaaccaaccaaacctctccctcttataaaatcctctctcccttctttatttcttcctcagcagcttcttctgctttcaattactctcgccgacgattttctcaccggaaaaaaacaatatcattgcggatacacaaactataatg

SEQ ID NO: 14169 - DNA, 3000 bp, Unknown
  misc_feature (1)..( 3000): cDNA_ID_3022046_gDNA_ID_2214704_Annot_ID_189794 3000 nt of promoter + ATG
cagcaacagcaacagtttcatgaacggttacaagctcaccatcttcatcagcaacagcagctacagaaacatcaagctgagcttatgcttaggaaatgcaatggtgggataagtttgagtttcgataactctagttgtactccaactatgtcatccactaggtcctttgtttcttcacttagcatagatggtagtgttgctaatatagagggaaagaactccttccattttggggttcctagttcaactgatcagaattcactacattctaagaggaaatgccccttgaaaggagatgaacatggaagcttaaaatgcgggagctctagccgatgccactgcgctaagaagaggtcagttccatatttttgtttcgttttcatagcctctctttactaagatggtgtagttaatctgattgggaaattgacaggaaacatcgggttaggagatcgattagagtaccggctataagtaacaaggttgcagatatccctcctgatgattattcatggcgaaaatatggtcagaagcccatcaagggctctccttatcccaggtatacacttcttgatcatattttgttatgttaagaagtgataaagattgatgtcacatgcaaagaaccatccttttaacattaaggcttttgagttttgatgagaaaaaagagtctaaaaatggctaagagatgacacaagtaagatgagtccttttaaggaagtgttgtattggatttttgtgtgcagaggatattacaaatgtagtagcatgagaggttgtccagcgaggaagcatgttgagagatgtttggaagatccggcaatgcttattgttacttatgaagcagagcataaccacccgaaattgccatctcaagctataacaacttaactctcgtttatctttgcggtccagcataaaccttctcatgtatgttgttctcttttgtgcgcgatgatcggctttggggttgctgcaatgttgtgatatatggatcggggtaagtgcttttgttggggtggatttgcttgtgagagtttgctgcaattgttggattttgagctatatatggggtaaatgtaggattggtcaagactctttttctgtttctcaagtttattggtcttaatgattaaaagtttaatggtttgtttctggctatgtatcttttttttcttctcaagtggctttttcttttatgattggtactgttagaatttggagattgttgctaagtaacttaatcatttagcaaggtagcttaaatctaagatgattagggataaagaatattggattctgttctgagtttagagaatattggattctgttctgagtttagagaatattgaattcatgtatcaagcataatgaatgaaacttattttaagacaaaattgagtttgagattccattttaggaatagacaacaagtctacaaagtgctcacttatgtactaatataagaattcactaagttagtaaacctatcattaatcccgaaaatgttaagtagtttgatgaaaatcagaagtatgcgtaaaataataacaaagaatgagaaaatctgacacgtttaagcgcatttttggtaaatttaatctgaatattcatctcattcttttttaaagaacacttacactaattacattcccttttcttctccatttatcatgtattttatataatattctcatctaaaagatcattctcattaatagtatagattatttaaaagtgggtgttgaaacctacaaaataaaattaaaacacatttcaaaactttaaaatggatgtctcttacatatgtaacagaaatcacattgtccaactatctactatacttatgtgaaaaaaacatacatatgcccaaaattgttatcaaaccaaaatgttctggaaatagcccattggacatctatttataaaattgcatacactttagctaaaaaaaagtacttcagtttgttgttagaatattcaaattcaagaattatttttgaaagaattgtgtgcagaatatcaaagaaattttgaaataattcagaattgtgtacacaatatcaaaaaatccatttcgaaaatgctttgtacacttgtgttttggcttgtatttttattttaaaagtatgatatgtaaaataaataggaagtgtaggattattctttttcttgtctaataaaaaataaaaaataatcatatgcatttatgaagataattaaacttttaaatactttttaatatttcatacatattatccatttctcattccaaaaaaagagtttaattctcagtttcagaataaaatgtgggccttatacagatttagttggcccattaatgtacaggtgacaataatccaccaactcgtttctcctgacacaaaaaatatctcatcatgtcttcttcttcgtattcgtgtctctcatttccttttttgactcttctttccaaaaaggattagatctgactcactattacgtgtcacgcacagttcattaggtacgctcggaaaattttatccacacatctaaatatctgatttatgatcaaatcacccatttttatttttccttttgtagcttctcaaatcttttgtctttattcgatttaaaagttgatgtactctgcatctgattgttttgctcgtgttttattaccacgttgtggttgaaatttgacggcggaagttcatggtggggtatgaagccagttggattcagatttttttgccaagttgattgctttctagctgattcattgaaaataacgttcctttttaaaaacccatttgttatcattgtcttctcaaaacgtatgatctggtttttcaaaagtgagtctggttgagttctatgtgtttgtgaaaatgtctcaatgagtgaaattttgtttctttttatgtttttagtgtctttgtctttggttatatagatgttgatggcttgtgggtttggaaatattgtaggtgaaggcaagagattttatgaagaaag

SEQ ID NO: 14170 - DNA, 3000 bp, Unknown
  misc_feature (1)..( 3000): cDNA_ID_3022050_gDNA_ID_2214704_Annot_ID_189793 3000 nt of promoter + ATG
tttttgcatttgtttctagatatttctaaactgttgggaaataaaaaaatttgcacacaaaacatagttaaattcacgtggtatttatagagatttacttcaaccaaatttggattttgggtcattgttttatggacggataaactatccattagtcaaatttccacaaaaataatatgtgaattagattcgacaaggctaattcccccacaacatacgatactagaacaaacgtacttgactacttgacgtaacaatgtttctcttactgtcttgaaaataacatataactcgttcatcaccaattttcttgtacatgattgattaagtgtgtaagcatctttttcgattaatgatgatgatgttaattggagaaacaaatttttcataaattcccttatagacaaagtcttataattttgttaaattccgcatatattttaccaaaactttgtcgaatggaaagacacgtcaaatgtgctaattagaaactgttgtattgagatttcaagaggaatcaataataaggtactactagggttttatttcaattaggtttgaatcttgggtcattgtgacgaataaattatctacttgtcgattttctacaaaaagcacacatgaattagattcaacgtggccaattcatctaacatatgttactaaaacaagcgcaatagacgagttggcgtaattttattttatactatctataaagtaacgtatgattcgtctatcaccaattatcttgtaaatgatggtaaaatgtctaaattcgtttgtcgcttaataatgatgatgatatacgttactttaattaaaaaaagcgaattttcgatagatactctattaactaagcatgcacatatcacgttgtgattgatttatgcctagtaaataaaatttatctccagcaagaataattgaaacttcataactaattttgaatgctaaaatgttaaattgatatatgggaaacaagttatgatactcaagaagtcaccaatatctagtattggaatcgctgtggtgtttgtttgtagatatttttctacatttagcaatgtattacattatgattgcaagaggaagcaatattaaggtattaataaggtttttacttttaccgggttagaattttgggtttgtttattggatgaagaaattatccacttgtcgatctttcataaaaagcacacgtgaattagtttcgacatagttatatagttctcctaatatacgttatttgaacaagaatacttgactagttgatgtaacgatgttttcttaacgtttcaaaagtaacgtacgattcttccataaccaaatgtcttgtatataatggtagaatatatattttgttttgtcgcctaatgattatgatgtgcgttactttaatttagaaagcggactatttaaaaactgctatattgaaaccgcaagagaaagcaatagtaaggtattaatatggttttacttcagccagatttaaaccaccaacaatactttaaaccattggtcgatctttcaccacaaaaaccacacgtgaattagattcggtgtggctagttccctaaacatacgttactagaacaagcgcacttgactagttggcgtgacgatgtctttcttactaatttaaaagtaacgtatgattcgtccattaccaattgtcatatacctaatataaaatataaattcgtttgtcgcttaataatgataacatgcgttactttatgttaaaaagccaattttcgatagattttctattaattgtaacgttataattcattatacataacaaaaaaaatcttcaacaataatatattgaaatttcataactaatggatgctaaaatgttagattaatagatagagaaaacttataatactcaaaacatttaacaccaaaatttccaatatctagtaatggaaatgtaatgtttgttagtatataaatttctgcatttagcaacacttatgcttaaaaacacatcattgatccgtagaataaaaagacacctcaagtgtactaagtaaccgttagaaactgcgtaaaaaagtttggtaccactttttcttttactttttttgttttgtcaagttacttatcaaaaacttggaaattaactttctctctttttttttaaactcgtgaataacaatgaaacattcgtatatttttatatcataaaagaaaacaatacggtattatatgaacaaaaaaaacttaaagataaaagaggtcaacaaaatgtccgaagtatgatgatgctaagtttgattagttatcttttttatgtcagagaacaattaaatttgttttattattatactaaaagaagaaaaacctaaactgcaaaaataataattacgacccgagtcttcgagtaggacccacctctgaatctgtgacagacgccggtttcgttctctctctctcctttttttcctctctttgcttttccaaaaaataaagttgtctttttttatttataataaaatgatttgttgtttcacagtgtgttgtttgttttggggtaaaaaagaaaatcataaggatgctttcaatatttgttttgttttggttgagtgattgctgaagccaacttaaaagagagagaagagaagagtgactctgtgtgtgtgtgcaagaaagtcttctctttcacacctttcgttttctcgaacctctcctttaaagatggtggaggaatcttgggtttgacaactcattaacactgaccctctttttagctctacaagcatccaaggaacccctcttacttttccctcttcttcattccctctctctctatatctcccaattccttctctttttttaaccttgatcttcttcttataagagactcagagctgttcttcaagatgggattgtgtaagcttgaaacttgactatctgggtctctcccattttctgttctcttttgtattctgagtgaaagttttgttttctgggggaaaaaattagggttcttag

SEQ ID NO: 14171 - DNA, 3000 bp, Unknown
  misc_feature (1)..( 3000): cDNA_ID_1570474_gDNA_ID_2214704_Annot_ID_189790 3000 nt of promoter + ATG
atcggggaagctttcttatctttagataccatgtatttcaggaaataatcacaaaccaaaggaggaacaagcagtttcacagaaaaccacagtaagctcgaatgcggaggtacgtagtttaatccagttgatttgaagataaaaggaacttgattatggattagttagaagcaattgactatgagaattctagtatctttttgtcaaatcacaggacactttcttcaatgggatttgctaacacttgttaatagaaaatcgaatttagaatttgcatccagatagtcatagcatatgctttaattttgtaatgtatgttccatttcctgtctcaggtgaaaatttcagcaagagatattcaacttaatcataaaacggaattccgacccccttcaagtaagagtgaaaagaatacaagggttcaacttgaaagagcaacagatgagagggtaaaggagatcagagacaaaattatccaagcgaaagcctatctgaatttggccctacctgggaataactcccaaatcgtaaaggagttgagagttcgaacgaaagagctggaacgggctactggtgatactaccaaggataaatatttgccaaagaggtgagcacagctgattgattcaaagggagtcctgttccatcctgtaaaaagttttggcctttacttatgaagctaaatcttaatgaatattgtgttaatttagaagagtcatacataaatgttttgtttcttttcagctctcctaacagattgaaggccatggaagttgcgttatacaaggtcagccgtgcctttcacaactgccctgccattgctaccaaactccaagccatgacttataaaaccgaagaacaagctcgggcgcagaagaaacaagcagcatatttaatgcagcttgcagcaaggactaccccaaaagggcttcattgtctctcaatgcggttgacaacagaatattttaccctggatcacgaaaaaaggcagcttttgcaacaaagttataatgatcctgatctctaccattacgtagtcttctctgacaatgttttggcctcttcggttgttgttaactctacaatctcctcatcaaaggtaaatgtttcacctttattctctttctttcaacatgttgtggttcagttcctttatactcctgaatttgatatctggacaaatgctttaggcttctactgtggttagtaccatatataggatattgtctagttatgaaactaggaaaaggaagttacattttgtgtgctctttgttcagtgaataactttatctttttttaaattacagttgagaaaccttgcattgttttatgttttcatgattcaaaacttatgccccatattgcaagcatcttacacttgttaattcaaaactcaggtatcattttaaatcatgttgcaagcatcttaaacttgttaatgcaagattcccgatccaaacttgtgtttttaatgctcttttccgaatctctgctgaagccacatgtcttttaacaaatgatattactgcttgcaggaaccggataaaatagtattccatgtggtgacagattcactcaattacccagcaatctcaatgtggtttttactaaacccaagtggcagagcttcaatccaaatcctaaacattgatgaaatgaatgtcctgccattgtaccatgctgaattgctgatgaagcaaaattcaagtgacccaagaatcatttcagcgctcaaccatgcacgcttctatctcccagatatcttcccaggtctaaacaagatcgtactcttcgatcatgatgtagtagtgcaaagggatctaactagactgtggagccttgatatgacggggaaagttgttggagctgtagagacttgtcttgaaggtgatccttcatatcgttcgatggactcattcattaatttctcagatgcatgggtttctcagaaatttgatcccaaggcttgcacttgggcattcgggatgaatctatttgatctcgaagaatggagaagacaggagttgacttctgtatacctgaaatacttcgacctggtacaacattttatcaccttttagttctctgcatcaaaaattcacactgttaccttgatgagttttgaattcaaaatggttaatgtggcttatgtccgtcaatagaacatcttacatatgtgtatgttgtgaaattgttgttttggttgcagggagtaaaaggacatctgtggaaagcagggggattgccagtaggttggttgacttttttcgggcaaacgtttccgttggaaaagagatggaacgtgggtgggttaggtcacgaatcaggactcagggcaagcgacatcgaacaagcagcggttatacactacgacgggatcatgaaaccatggctggacatcggtatagacaagtacaagcgctactggaacatacatgtaccttaccatcaccctcacttacaacggtgcaacattcacgattgattttttgaaacaagttaccacaaaacttagattcaattcgattcttttcttctttccaaaatgttataattagcttcattctttaaacgatttcttgtgtaaatctttgttctttttgacacaacacacaaaattctcagagcagaatatcagatatagttcacagcaacataggtgttgttcgttctttgggttgttatatattgcaatctggatgcagtttattatgatgtatcagtagagaagagagaaaaagattgtgttggagggaaagagatgaaatatgacacgtggagggcgtcgattggtggagtatggatagaagcatatccaagttagatggcttgtgttggttcgaacagattttttatccaccacatatttatgtttgatccaaaagccaacacaagcaaagaaattaaaagtgttcttgttgctgtagaacacaaacagaacaaacaaaaaatcaattgaagagtctctcagtcgttaggggaagcaaatagagaaatg

SEQ ID NO: 14172 - DNA, 3000 bp, Unknown
  misc_feature (1)..( 3000): cDNA_ID_3022070_gDNA_ID_2214704_Annot_ID_189784 3000 nt of promoter + ATG
gcatacaaattaatggtttagctgtcaaatacaaaaaacatgattttatccacaatgaatctagtaacaatctacaacaacaacaaaaagaatctagtactaaaattggggtcaaaatctattgttaaaacttaatcctcttatttgaaacttcatcttatcttaatcctcttattgctcttttagttgaaacaactctcccacttttggaatttataaataaattttgcaagcttcacatggagtatagtgtgataaccatataaagtcacatgcggctagacttgagagtcgacacatatgtttatgtgcaatgtattggttgggcttcttaattatgaaacaaatgggctttgcaataacaagttaagtttctcgatcaagctaagcaatatctcagctcgtgtgttgattgtttcttttcttggtcaattccatcaagctatatttcttctagtcacggtttcgtaccgttgcctctatccgaatccatgcaacctccccaaccatatataacagataagagatttgcacaaatgacagcgaaatgtgctaaactcgtctggcgtttcctaagaagacgacattattgtgtgaattggaagaagcgtgattagggaaacttgacgtggactttttgggctattgacaaataataaccaactttggcccaaactgttcgtattaatttgtggttcattttgttttctagttgcatcttttcttagcctttgtcccctcggtttagccgctgtgaggtcgggaccgttgttaattattgtaacaccgcataattacataataatataaactcgcaaaataaaaaaaaacctatgagcaactatatacatttatttgcaatatgagtttttagtaaaaaaaattacttatatatattaggtaaaaaattttgagttttttttgcattttactaaatgtatatcatggatatgatctgactagaattagctccaatgccttttttgaattcaggtgtgtagaaattgcatatccttaatcagaaaatagcattttggttctacttaccgaatcaaaccaaaataaaccacaatcctatatgtcaatcctctggatgtaattaaccattatgatcgaaattgttgattgaaactagacggcaatacagctcagggtatttgtacttttgttaatagattgatagcaccatcctcttatggtccaacctatttcctaacatgaatttttcatctgaataatttagacttgtattaagaccttgccttagcacctttttacaaaatttaattattattctctctgaattaatgaaatttatatgtatatcgcctactcatgatctagtggacatctactgtttagctaattcaatattttacattcggatattgtgttttgatgcaaaaccaattacaaaaaagaaatctagggtttggaagtttttgcattaagatttaaacaaaaagttaaacacctcacaaaatttatcacgatactaaaataattttcttatcaaatcacatgttactatgtcagccggagaaaaaagactcacatgacatattatcacatcgattcacagaaacttacatcaaaatagaaaaatcacgaaaactggtaagggtttttaactttttatgaagacccattttgtgaatcttcacattcaaactacaaatagtcttataaaactagtcgcaccggcagaaaattattagggcaactaggcaatgtaagagacgtgagatatctttaaagacgataggaacacgtgtataaacatgattggaagacaaaactgaaactggattctgatggatgatttgacgacgtagctaagccaaacaccacgaggttctaagatgaagcacgaccacatatttggggtgggccttatctatgacatgttcctacttccctaacttccatggtcctacttctctctaatcgtacatccacttttaatttcgtttcttatctgtcaattattcacatgcgttgcttttttttctatattcatagcattgtcttcctttaattcagaatttttaggcttttagcatgtgaaactttaattttgctatcatattctcattaaccaaaccaaaaagtaagattgtttttttctttttgaatgagccactctacaaattgttgccaacaaccaaatatatgaatgatgattggttctcactaatcattatactttataaaattttctaatcatcaccatatgcatgttatgaaatcaagaatttagatccgttctgtacttctggtctgtcacacactcacactttgtcccggcttctatgtccttgtacgatgagattgcttacacatagcagctttatgataagaaagattttcatgttcgtcatattactataatcattgttatcctgcatgttttttgtagtcttttaaccttgaatatcactgtaacatttactaaaataatagttgataatttgaatgtagttagccaaatatcaattagtaaacgttcacttttcttttaattttaattttaatgataaataaatacatttactaaataaaagcgtagtaaagcatgttacttacagagatatgtttattaatgttatctacaaatcaccaagatcgagatctctgttagtctattatcaaaaagttggtgaaacatatatcggtatatatgtggaaggtctaaattacataaaatagccgtcgatacaagtacatatccaaatagggaaaagttaaaaggaaatggtgaaaaggaaagtaaacgacgaagacaaacacaaggattagagtgagttaactaaaagagataataaacacatcagaaaacgacaaataaaaacttagaaaaataagatagaagaagccaatcacaaatattattacattagcaattgggtggattggggggacccatgctaaagaaatttcaatatatagacactctccaattatgcttccatctccttcaatagagaaccaaaaaaaatg

SEQ ID NO: 14173 - DNA, 3000 bp, Unknown
  misc_feature (1)..( 3000): cDNA_ID_3022074_gDNA_ID_2214704_Annot_ID_189783 3000 nt of promoter + ATG
tcaatctctcggatatacccggaggtcctgagatatttgagaaagctgccaagttctgttacggtgttaacttcgagatcaccgttcagaacgtggcggctcttcattgcgcagccgagtttcttcagatgaccgataagtactgcgacaacaaccttgctggtcggacacaagacttcctttctcaagtagctctctctagcctctctggagctatcgttgtcctcaagtcttgcgagattctccttcctatttctcgtgatcttggtattgtccgccgttgtgtcgacgtcgtcggtgctaaggtattattttactcagaactcattctcacttctttgtaagtgttggatctccattttggctagtgtttatgtttttcttttctacctatgtagtagtaactgcaataacccaatctagtaagttagtacagttttaggtatgtttttcaataaatggcaagaatatctggtttagttattccataggtttcaaatacagtaatagtttgaaattgattttaaaatttcatctatcaattttcctaagaaaaatcagtttgagaccattgttcttcacttcttttgttctagtgtttattattaaaaacaaaaatctattttaatattaaagtttagatctatgattactgttgtcagactatgattgcgatttagattcgataggaatatttcatatttaattcggtttggtttccgaatcttaaattgagcaaatcatacttctaccctattccagttccgtgagactcaagtataatatctatgtaatgcaaaatgaattacgagtttaatattttaacatccatgaatttttgtaatgcttggttacagtatctgatacgttttttatatctatttcttttgatatttgaaaggcttgcaacgaggcaatgtttccatgtcgaacaccaccaaattggtggacagaggaactctgtatcttagacgtcgacttcttctccgatgtcgtatcttcaatgaagcagagaggtgtcaaaccttcttccttagcctctgcaatcatcacctacacagagaaatccttaagagatctcgtcagagaccattcaggcagaggagtcaaatattccgatcccggagataacgaatccgacgaaagatcccaacagagagatcttgttcaatctatcgtctctcttttaccttcagacaaagggctgttcccagtcaatttcctctgttctctcctccgttgcgcggtcttcttagacacttccttgacctgcaagaacgagctcgagaagcgaatctcagtcgttctagaacacgtctccgtcgacgatcttttgatcccgtctttcacctacgacggcgaacggttactagatctcgatagtgtcagaagaatcatctctgctttcgtggaaaaagagaaaaacgttggtgttttcaacggtggagacttcaacagaggagtctgctctgtttcactacaaagagtagctaaaacagttgattcttacttagcggagatcgctacttacggagacctaacaatctccaaattcaacgcgattgcgaatcttgtcccgaaatccgctagaaaatcagacgacgatctctacagagctatagacatcttcttgaaagctcatccgaatctagacgagatcgaaagggaaaaagtgtgtagctcaatggatcccttaaagctttcttacgacgcacgtcttcacgcttcacagaacaagagattaccagtaaacattgttcttcacgctctttactacgatcagttaaagctaagaagtggagtcgcagaacaagaagaaagagcagtagttgttctccctgaagctttaaagacacgtagccaactgcaagctgatactacgttagctaaagaaaacgaagcgttgagaagtgagctgatgaagatgaaaatgtatgtttcggatatgcagaagaataagaacggtgcaggagcttcttcttcgaattcgtcgtcgttggtgagtagtaagaagagcaaacatactttcttctcttctgtttccaagaaacttgggaagttaaatccgtttaaaaatgggtctaaggatacttcgcacatagatgaagatcttggaggtgttgacattactaagccaaggagacgaagattctcaatctcttaaaagaaaacgtttgatctaagtgcttttgtgtgttgtgtataactcttttagactagtgtgcttattgttcccttcttgatgcgtgatttttttttttgggtgtgtgtgtttattgtttaatgagcttggttaataaaatgaaaatcgaaaccagattgatttactaattttttgtattaattagcaatctcataaaagatgatctttagttggttaataaaccgttaattaaagaggataattagcggtagacgtactaagcccaatagtattttaatttaagcccattaaggcccaacattgaagttccttatgcccgcaaattctgtttctcttccggcgacgatcaaatcgaaacaagtgatacaccggcaacgacaactgttcgccgttgatttccaccgaatacctgactatctgcgctgcgacggcaagaaattgaaaattatggcttacggttagtcaaattttcaatttttatgttggggatattcatgagtaaagatagattcataaaggtctagtctttttgggatctgatagaattcaaagtgagaagtcgtttggtagactagtgtaggcaaattcggtgaatgtgatataagcttgttacaggaaaaatgggaacttgctatatttagaacatttgaaatttaggtttttgtatgacataggatccaacaatagattaacgaatgataactgttggaaagagccagccttgatctattgttaagagaattatgacccttgaacttatcttccaaccagcttccttgtgatttgagagagaaaccaaatctgattttcatgaaatccaaaacagagctccaatg

SEQ ID NO: 14174 - DNA, 3000 bp, Unknown; identical to SEQ ID NO: 14168
  misc_feature (1)..( 3000): cDNA_ID_1976561_gDNA_ID_2214704_Annot_ID_189782 3000 nt of promoter + ATG

SEQ ID NO: 14175 - DNA, 3000 bp, Unknown
  misc_feature (1)..( 3000): cDNA_ID_3022086_gDNA_ID_2214704_Annot_ID_189779 3000 nt of promoter + ATG
tatagagcacaagaagagaagaactggggaaagccaggcagcaaaaagtcagcaagaaccgtgtggtttggacgcactggcgagtgcagcagtcttaggagacacaataggcgagccagaggtagcgaccacgaccagacatccaaggcacagggctggatgctcttgcatcgtgtgcattcagccaccaagtgggaaaggtaggcacaagcctacatgtggctgcactgtgtgtagcaccgtgaagagaaggttcaagacgcttatgatgaggaggaagaagaagcagttggagcgcgatgtaacagcagcagaagataagaagaagaaggacatggaactggctgagtctgataagagtaaggaggagaaggaagtgaacacagcgagaatagacctgaacagtgatccatacaataaagaagatgttgaagctgttgcggtggagaaagaagagagtcgaaaaagagcaataggacagtgttcgggcgtggtggctcaagacgccagtgatgttttaggagttacagagttagaaggagagggtaagaatgttcgtgaagagccgagagtttcaagctgatatggaaggaaaaagggaaagggtaaaagccaaagtcatagccagttttattaatatgctgagaccaagagtaggagaagaagaagagaaagagagagagagagagagagagagaagtacagttttgtgtttgattctgtcatagttgtaggaaaaataagtttctggttctaaacagcgacaatgtcccatcttttgttttttgtttttgtttttgtatttttatggtatcgtgttgagtttggggtttatagtatgtctccattaatctaggttttgttgtagaaggcaaatggagctttgtgcttggtgatgaaacagttgagttgatttttttttttgtaattgttttcaaccaaatgcctagttggtttaatttttttaaaagttgtttcttataatattgttaaacacaaattatgacagttgttgaaaactgcatgaagtagacttgtaaatggtataaggagattaattaagaggttaaatcattttaccaaaaacaattacgataaaacctctacaaattaataatattagaaacgaaaaattctatatattcataaatatattaatttatcgataattttaataattattaatttatagtgaggtttactaattttgtaattaaaaaaataatatctaaaaaacaattttttctttacaatcaatatatttctaaaacagttacaagtagaaaaacaataataagtttagaataaaaaaacaacataaacttttttacatgtagtaagcatatttgaaatgaactctaccagaattaatattaacttaagaaaaacaaacaatattaagtcatactacactaaagtttttacatataatatatatatatatatgatgtcatatataaaatactattatatattataaatattaagttgtatatatagcaataagtttaacaattgttaatttatgatatgatgagataatatgtttacatagaattttcaaaaatgacttcttaaaattattttattgatttatatcatttatgtcataaaaaattattaatatataaaaaataataattcatcgattattaattgattgaagttttacgtttattgaactaattttgtacatggtacttcgctcttggtcctcatccattaccgataggatagagatatgttactacatgatttaatggctaaacaaagatactttcggtttcttcggaaaaatctaatttcaaaagaaccgtctacttttactttaggtaagtatgtattcttgaaaaaaatttgatttcgtatcaaagttaaaggaacctagatttcgacattaggtaagtgtgcattactttgtttttgctttataactttgcatcatcaatttttcaatttgataaactaattttgtttttcaggtgtcgatttcatccgaatgaataagattataattaatgtggccacctttaatatatgatttaacttcttcaataatctctttatacaaattatgagcttagattgaactacgaggcacttaaattgaactaattatgtgtttgaaaaaaacttaaataccacatgcaaaaagtttagttttattttaaacttttaagcaattatgagctacttctcaactgtccatttaaaatgacatgttatatgttctttttttgttgctcatagttatgttataattgtttttttattattattatgagattgtattaaaagctcaaagagctaatgctatagtttttttttttctttttttgtcatcattttaaaacgagaagtgtagccaatgctatagttaaatattatatttaatactacacaaaaaatcaaggttattcaattcaaaagaaaaccacaatggacaatatatgccacatttgcacctgagaaatgaaatacatccatgttttcaaatttacatttagccccgttataatattaattacatataggacccaattttgacgtatggtgaatctcttggaatttacaaaaataggcttcttcttccaaattcacagattctcttctcctccattagaacttgtctgattctctcaaggtctctctctccattttctctccttttcttctcctgaatctccgttaaactattttttatcttcatcgatagatctagggtttattgcttcaggattcttcgactttacactatccttgttctgcttgtaatttgacgtgttgttattatcttccattggtgcagttcagcttctcctgctttgaattctctcgcattttcgtaaatgaggttccttttttcttctccgcgttgctcttacagttacttttggttttgattggctaagcatgtgatgtgagtttgattcctccatactgtaattgttggttttattagatcatcgtagatcgtgatagaagaagcgagcaaatatg

SEQ ID NO: 14176 - DNA, 3000 bp, Unknown
  misc_feature (1)..( 3000): cDNA_ID_1027695_gDNA_ID_2214704_Annot_ID_189774 3000 nt of promoter + ATG
actctcttcacacaaaaaagatgagtaaaagaaagacactttacaagccatcccttaaacctttgactcctcctcctcttcttgtatctgcaagtttcaacaagagcaagatcaacgatcaagattcgtcttacagcttgttcccggctattgaaacctcccctgagtcttttgtgtatagtttctacgaagaggatgatgatgatgagttcgttgaattttccaacttcaagatcaacacaaagaacaaagctttcaccaagcagaaggtcaaagtgattgattcggtagagaaagcttgtactgcaagcaagccgattaagaaaccgcagaaaagccatctttctgtgaaaatttcaagagatgaagatgataatgaatataaagccgagaagaagtaccaaaggcaagtttctagtggaagaaaaccatctgctgggataaacctcaaaagagtgaattcacctagaattcaactctcaggtactcgtagaagcacttctagaagatcagagagcaaacaagatgttctagagagcttcgctgtgatgaagcggtccgttgatccaaagaaagatttcagggaatcaatgattgagatgatagaagagaacaacatcagagcttcgaaagacttggaagaccttcttgcttgctaccttactttgaatccaaaggagtatcatgatcttatcatccatgttttcgaacaaatctggcttcaacttacaaaaacaaagtaaagaaaaaaataattcttaatgtaatagtagttaacctaatggtgaaagtaattagtatcattctgcttgtgaaattgtagttgttgacttgttgttgatgttcataagaagttagatggaactgtggagattctctctttgaatcccactttttatgtattgttttctttatttatctttttggaaaatgtaagcaaataataaaagttgttatcatattgtcgttttaatacaaacatgatcactaagggcgtgaaaacactgttaattaagacagatttttttatcactaattaaacatattcttgtcttctctatgattatgaacatataaaactactcacaaaagatgatgcttcaagatttgattatttcttagaatatgaagatggattaattgcgccaatatcatttgaatattttgaaaatacaaagttgaaaatggcggtaaacagcaacaagaaaaagacaacagtgaagagacatgaacaatttgaaaacgcaacaagtacggagtttatatatatgcatgaagaacattggataatcgttgaaggtagagagaggaccactgacacataaaactgagatgtgattaaagaagaaagaaacagtgatgagatttaatccttaagggtttttttttttctgtgaagaagggaagaatgaactcatgaagaagaagaagaggaccactgttgcaaattccatcccctaccacagttggcttatgaagtttcagcaaaagacatgtgatatggtatggtttctgacttctgagtgaacataagcaacaaatattcaaatcaatgggcctaaatgatcttgcagttttggattataaagttaagaattaaaaagaataggtgatatatgtatcataattttaagttttaaacaagtatgtcagacaaaattctacattctaattttatacatagatatgagataacctcataaccataaactacaccaaattttcatgaacaaaatatgattcacacgaacttttttctatcttgatcacctagctaacttgacaaattagttgttcgtctaaaactacacaaacattcaaagttcgttttaaattcaatatatttaaaaataacagttaaagttttattaaatggcattccaaatattgattccttctagaaaatttgtgtggttttaaattgtgaaatttggatctagaaaaaatagcaagtgtggtttcttgtgacctatggttgttagtgtagttgtataccattttttaaagttacattgtaatttgtaaaccatttttgtgtggttgacaaaaaaaaaacctatgacaaaattgctccgtttttattttcaataacaaattataatgtaaattaatatgtatcatagtgtttttaataaaaatatttaaaattaggattgattgttctgaaaaaaataacgcaactaatactttgttagcaaatactaacgtttacgtaccaaaaaagcattatgtaaatccattcatccatcattgtatacttgactttctacattattcttttgttgtatcaaatttaaaattaatgaatgaacttgacataataaaacacaaaatatatacttaaattgtacgatataaaagtttgatttacatattttatatctataaaaaagggtaaataaatgaaataaaacttttttttttttttttgtcaaagaaatgaaataaaactcaaattacatttttatgtcgtaatgcgagcacacaagtgagtgcatatccagtattaagttttttttttaataattcagaattgaaagcaaaggaaaaagaagaaatcgaaatcggaaactgtatattgttgttcttcgattcctcctcgctctacgccgcgtcctctctctcaaattcatcggaagcaaccttcttctcccatcatcgcctggttcgtttctaaaccctacttcttctatttcacagtatatcttcctttaattttcaatcgaatctagctttgtgtcgatctcaatgtagatcggaatcaagtaaaagaaatcgatgaattccaaaatgttcccgatctattgcaatgcacgaatcgtagaattatcacctacattagtcttgatctaatcgccctatttcaatttcaaattcgacatcgaagtttaaaggagatcgcaaaacctagttatagaatcgttgcgtttgagttgtttcgctggtgatgtagaaaccctaattttggttgtcctgtgtttggtacttgctcagaatcca

SEQ ID NO: 14177 - DNA, 3000 bp, Unknown
  misc_feature (1)..( 3000): cDNA_ID_2706146_gDNA_ID_2214704_Annot_ID_189770 3000 nt of promoter + ATG
tttcaatagccgggaacaagctgtaagacgaatcttgatcgttgatcttgctcttgttgaaacttgcagatacaagaagaggaggaggagtcaaaggtttaagggatggcttgtaaagtgtctttcttttactcatcttttttgtgtgaagagagtttcttggtgagttatggtgaggaggattgttagctactaagctgttggagaaataagagtgttgaggaagagaatctgaggaaggtttcttcttgctacaagtgtttgaggaagaagaagaagctttgtttttgggtttagagtgtttagtcacgtctttgagcttgtggaaccatgcatttgggagcatctctgaaattctgaacttgtaattccccatcttgtctctctctttttcacaaaagtttgtgatatttctcttaagaaaactctgtttttgtttccttagataaagaagaaggtgagaaagcaaagttctctatgtgacagataaagaagaaactgaagattaaaattggaaactagtggggctactactagaaaaagcttaaagaatgtcttttattagtatcatcatcattcatcatcaacatcaacttgagacatcacatttacacgcttgtgctcacataattaataaatttattttatggtgaatttttaaaattggttgactaattgaaattgtatttggtgaaaaactgaaaatcataagaacataacttttatctaaaatattatataattaagggaatagtacaaaaataattataaaacagagaatcagttgcttctgatttctgacagatttctatcatcatttcatggagattttactcttcatcgaaatgataaaataactgaaaaatgtaattagcgaattataaaacagtagcaaatgtaaacagttttaaagaatacacaaaaaggttgaccaaatggcaattacaaaagaaaaatacagcttcttttcctcgaagtatgctttttgattgaaaatattaaaacgtttctaaacggacaaatcaatttaataaataaaaacaaagttttcacaattcaactaaaagtttaacatatgtgaatctatctaggttaaagactcaaagtacacgttataatgaagttcaatagtttcatttcgatgcttctttgaatttggtaaagtgtgaaccttatcttaagtttttaggtagaaataatttagtatagtagcactttatgttatattaaggtgatacagatacacaaatgatgaaattaagataatcaaatatgttccattttctcctctgaataaagtgggatcaacttttgagtcataataatgaatatgagaaattttttggtctactttgtccactaacgccgaacattttgaggacactttttttcttcttctatacatttccactttccagatcaaatgttttggcaactacttatcttttaacttcgagaaggaaaaaaatgatattcaaaaatcaaaataaaacattttccatccttactttaaataagcacaagtgattattcatatttaaaaaatggagatattttcactagacgtgggactggtttatgttcaacaatgttgacctaccaatatatcaacgactttttgagtatacaaaaacaaaactatctcatcatattggattttgtttataagcaagagccaccaaacatttgcaataagaaaaccttttctattctccattgtttttaaaaacttcatgggactccaccatcatgatcagtttcacacccaaagacgtgaactccacgcaacacaagccaatcctctaaccttatacacaccaaaacaaaacaagaagccaaagaggatcacaacaacaacatcatcaccaaaaaagcttcaagacaatgagagtgaaagcaactttgattaacttcaaatcaaagctttcgaaatcatgcaacagatttgtctctctcttccgcttccgagttaaaagacctgtctttattagacctcttcgtgcccgtcatggcaatgtcaaacctagacatcaacatcatcattccaagaagccaatctgttcttgtctctgtttcctcaattcaagcaagaaccataagatgagcaacgccaaacatagaagttcctcttgtaagacaacttcgctacaaaatctgttttaacattgaaattttatcagcttcttgatctctttgttctcttattttgccattgcagttagtgtgaacgatgatgattactccaagtttatgcaatcacctcttacgccagcaacagccaagaagctcttcacttcacccatcacgacaccttactcttcacggaccaggaaatcgctgaacgcaagagatacatttgaagacaatgctgtggaagatgcttgtagaagctttgaaaactatctgattcatctgattgttgaagaagggaaaatagatgacttaatggacatagaggaacttctcttctgttggaagaatcttaagagtcctgtcttcattgaacttgtctcaagattttatggagaactctgtagagacttgttttcaggtgaatgaacagatctagttaaattgatcaaaacaaaaatgttttaaatctgtatctgtcagtacttgtggtttgacaattattgaatacaacatctaaggtttctaagtttaaagttgggaacaatgtgtgaagactataaaagattgtatgtttcggtcaataccggtcggaccggttcaaccggatttacttaccaaactcgtctcttgcaattttattgttgaataaaaaaattatcacaactgtgtggacacgtgtggttctccgtcctcactcctcaagcccctttcattttatcccaactgtgtctggtctgattaatgaaaaaataaaacaaattcgaagaaatataaatgagatttttgtagctagctcctccaaatccaaatcgttgcgttaaggtttcttcaagtttcaatctttttgcaatgaattgcccagccatg

SEQ ID NO: 14178 - DNA, 3000 bp, Unknown
  misc_feature (1)..( 3000): cDNA_ID_2711040_gDNA_ID_2214704_Annot_ID_136932 3000 nt of promoter + ATG
ggtgttgacattactaagccaaggagacgaagattctcaatctcttaaaagaaaacgtttgatctaagtgcttttgtgtgttgtgtataactcttttagactagtgtgcttattgttcccttcttgatgcgtgatttttttttttgggtgtgtgtgtttattgtttaatgagcttggttaataaaatgaaaatcgaaaccagattgatttactaattttttgtattaattagcaatctcataaaagatgatctttagttggttaataaaccgttaattaaagaggataattagcggtagacgtactaagcccaatagtattttaatttaagcccattaaggcccaacattgaagttccttatgcccgcaaattctgtttctcttccggcgacgatcaaatcgaaacaagtgatacaccggcaacgacaactgttcgccgttgatttccaccgaatacctgactatctgcgctgcgacggcaagaaattgaaaattatggcttacggttagtcaaattttcaatttttatgttggggatattcatgagtaaagatagattcataaaggtctagtctttttgggatctgatagaattcaaagtgagaagtcgtttggtagactagtgtaggcaaattcggtgaatgtgatataagcttgttacaggaaaaatgggaacttgctatatttagaacatttgaaatttaggtttttgtatgacataggatccaacaatagattaacgaatgataactgttggaaagagccagccttgatctattgttaagagaattatgacccttgaacttatcttccaaccagcttccttgtgatttgagagagaaaccaaatctgattttcatgaaatccaaaacagagctccaatgtcggagctgcttcctcctcctcctcctcctcctcctcctcctcctcctcctaggagggattcaggatttggagatcctgcattggtattccctgagtttgctgccaaacaatgcggtctcgaaaaagttatagaggaagaaggagaaggggaagatagtagctatggcaaaggttcttttgatctgagttcaagattctcaagcccttccatttctcgaaacaggtttgatgatgttgaaaacccgaaaaaggcttcgtcttttaagcggcctccttctgcgtcgagactgtctggctttcgagaggaagaagaggccgatcggagtagaaaatcgggttcctttgtggatcatatcggtcaggaggacaagagaatatgcgcctctggatgtttcagaaaatgctgcgcttgcacctgcatgtttgtttctgttgtccttataatcgtcttgttggtaggattgtctgcaaactcttcaatcaaatctatactacctcaggtgcttgtcacaaacctcaagttctcgagattggatatcgccaaatcatcgacagatcttctgatgaatgcgaacttgaacacggtgcttcagctctctaataataatgacaagacggtgctatattacagtcctatgaaagctgatatatcttctgagaacataaacctcggaaagaagacactttctggattcaagcaggacccgggaaatgttacctccttgaagatcctcacaagactcagaaaatccaaagtgtatgatgttgatgctacattgctgacaaacaaagagaagacgcttgaagctttggttgatgtgttcttgagagggaaactgagtgttgattggttgggatttaaggttcatataccaattgttattgcgtgcgagagtgtgaagcagagtgatgtgataaatggtctcaaaccagcgtgcgatgttcgaatcttttccgaatgaaaacaatgagagctattgatacacaaagaccctctgatctttgttttgttctgttcctttttgttgttgctaatttactcgttgtagattgatgaatacatagaaagagagaagtgactcaactttgtttctctaaacttaacatcaagaatccacaagttatctaccttttttttttcttcacatcatcagtctatgttttcttcatcattgacttggcttgtaagtgatatagttacgtccataagtttgttaaaggttggtttgatctctttctctttctatacctagagagatggatcaaaactcgaatcacgatagagccacatgcaaaatcttgggcgttgaagatacgccattaatgctctcttccatatcataccacaattattgagtctttggaaaaaattgtaaaaaaaggaaagacttttgaggagattaaaataagcaggtgagtcataagtagctgtggagttaaagacgtgtagagaaagcgtgttcactttcttggccgcgtttccaattatcaagattcttgtgagaaactaacttcttgattagttttttttgttttgttttagagaccgtgaaaaaagatgattagactaatgaatcatcttcaacggaaagaggtaatataagggactagagaggccattatattgtcacaagcttcttgtcttcttgcatcatctgtgtaaagtaagcttttttctctctgcaatttttgtctcttcttctttctttctgcaacttaccattattttattagcttcattgatttctctgctgaataaaatgtggataaatgcttctaacttatctctagattttctagagatttgtgacaaatgtcaaatgggttgttgaatcttcacgtgtcctcttttctcctcttatctcatctaatttgtttctttagttttgttcaactcaagcacatccgagaaagtcatagtctttgaacatcaaattgccttttgtttgtcaaatgacttaagttcttgatctttttcttgtagggtttttttctctgcactccacggtcatggcttcgtctacggtatgaaaccttcgtgatcttcactatataagttcattagatccttgtgtttagtctcttggtcctaacatttagtcactttgtctgatg

SEQ ID NO: 14179 - DNA, 3000 bp, Unknown; identical to SEQ ID NO: 14172
  misc_feature (1)..( 3000): cDNA_ID_1807153_gDNA_ID_2214704_Annot_ID_136934 3000 nt of promoter + ATG

SEQ ID NO: 14180 - DNA, 3000 bp, Unknown
  misc_feature (1)..( 3000): cDNA_ID_1534667_gDNA_ID_2214704_Annot_ID_136937 3000 nt of promoter + ATG
atcggattagaatcttacaatttatgtggaccaagcttttactttttctctcgaagaatattattttgttcaagaatcatgctcagatgaagggtgtgggtgtgagatagcccaaagtggtggggaataagcagagagatatgcttattcttctcttgattgacggtatttttcgcagccacgaaaaagagatcaggctgggtttgatggattggatcgtgtgtgtgtcaacaattaaaaaccctattcttgaaacatgtcactatacaacaagatatgattgtctttgtgagattctctcaatctcacttctgatcatgaaggaataataactcctatcggtttcttactttctcttgtgtgccacttccctttcaacaatttgccaagattctttcccatttaccacttgactaaagtaaaccagtgattatgagatcccatgtcagttgaagtaagcttagacctagagtaatatgtataggacatgaattaatttactaacgccaattgattttgtttaaagattaaggaacttatttggtccaagtaagatatgttgtccttcatagaatgagaacaatttgagttggaccaagacaatcatcacctcgaaagataaggattagagttagaaatccatgaaacttaacatagttacaaactcagcatatatttggaattgatcttcttgattcttatattaattatatatatgaccatctgaatatctatgttaaccccctcttccattaccaccaaaaagtgcttcccgtaagatcggagacttgccctatatagaaatatttgttttggtttggtaaaaagctttctagggattataattaatgattgaaaaagggttagtagctaagtgaggttatatggtcactcacacgatgaaaccttgaagaagtggccataaaagataatggcaggctggcgataatggctactacaaactcccttataagccatgcatgatcatagattcatagttactctttctctccgataaatttatatatttatgtttcaaaagctaataatcttttaagcagttttcagaagtgagttgtttagctttaagaatatacaagaatttgaatatttagagggttcattttcggatatggtctaaagaaatgggccgggtatgcattgtctcgacgactatgaccaaactgagaagaaaattgaacgtgcaacctcctagctaagtgacataccaatgacttatagaaatctcatatatgtttaataagtcataacgcaaaaattatttctaacaaaagcaaatgggttgattttggaactatatttaatggcatagaaaacttcttcgaatcagaaaagaatataaaatacgtgtgagttaggatgtcaccatagaaaatctccacaaaagcgtgaactcgattctatatatataacattcaatcattcttactaaaaacatctatatatatatattttaaacagtatggatccattcattctgatctgtaccagattgcaaaaattagtaagatatcacaattaaataaatgaaatacaaattgagttattttggattttcagatgaaaccaccaaacaaatacaagttgacttgaatgttctccaacgctatttttttctctattatattttataactaattaattcattaaatcacatgtccaaatatttaatgatgaaacataaagtaagtaagctagtgacgagagaaggacacctcattctcattacataatgtgacgagattgagctgtcgttttgttgtaaatatatggtcgggggtcaattattcatatgcagttttaggtcatttataaagaccattaaaaacgtctttaatatttcaacaatcttataattcaattattaagaagcatctagatatggattcacattagagttcgtattctttgacagcaaattcacattagacttttgatatatatattgtacatttgtaatatagtatacgaaaatattacttgaaaactgatgttatgtgttgccatgatgccattggtccatgacttttccacacgaaggccaaagcatactcttatattatatgagttgagtcattcttttttccttttgacggcaagttgagtaattcaattctcttgtcacttaccggtgatataagagttaatcttataaatagttttctgaaacttaatatactataacaatgtaaaagtcgtcgctttgttatttgaagtgaaaattaagcaatgttatgatatttttactaattaactcaatatgaaaaacaaaaatcctcttaactaaaacagaaacataaaagacgacttagtttttgctttagatctagactcataactcaaaaaacaatttcattataaacttttgtagatcttacaattttaaaataaaatgtacattaatgttgaaaagcaaaatcttaaattagtgtatactactactttttttttatcaccgtgatagatcattagatccttaacctcaatccctagagcctgcttattgcctttaagcattgtgcaatcactaccaaacacactcaaaactaaataaatataatttataacttatcaaataaaataaatactatcaagtgtgtatgaaatcgatgacaatttatttattaccttattaccatttgtgtcttgaagtacacgttaagctatttttatgtgttataaaggcttcttcgtcaaccaattacgaaatcaagcttttgaagcttctcaacaatggcggctattccttcccacaacaaccttcttaccatcaaccacaaaaactccataaccggttcttcttccctaaataccaatttctcagaaatcaattttcccgccaaattccgagtagctacgagagctttgtccagaaccgacgagtcgtctttatccgccgtgatttctcgcctcgagcgagaaaggcgggaaagacaaggtttattaatcgaggaagcggaaggagctggagaactatgg

SEQ ID NO: 14181 - DNA, 3000 bp, Unknown; identical to SEQ ID NO: 14171
  misc_feature (1)..( 3000): cDNA_ID_1570474_gDNA_ID_2214704_Annot_ID_136939 3000 nt of promoter + ATG

SEQ ID NO: 14182 - DNA, 3000 bp, Unknown
  misc_feature (1)..( 3000): cDNA_ID_2706173_gDNA_ID_2214704_Annot_ID_136940 3000 nt of promoter + ATG
caaacagcaatactgaagagttcctggtgaggattagaacagaaggatctaagctcaggatatacgtacaatgtcggataattcttcaatgaattctcctctatctgccagaaaacaatcaatagacaaaatcaaaacagctttcagaagcgtaatccaaaagctgagactaaatcaaacaaaggtaaatccagtaacgaattccagaaatctaatcaacgcaatctgcaatcaagtaacaactcttcactatactatcgccatatccatcaatctaacatccctgagaccaaaattagaaagcgaattgaagaaaccgcagaagtagaagaagctcaccgacggaagtgatgctcttgagccgattcgaaacgaaaacaatcggagctaaaacagataacaatagcagcgagaggatcagaatcctctgccaacgacgaacttgattcatcaatgtgcgtaacttctcagagaacgcttcatatattttatctccgttgcgctttaatcgttctccacgaagaagaagaagcacattcccagagggaagaacacagatctcggagattctctgcttcttcaacaagcaattgaagaaaacgatgagcagattagggttttcagattcttctgcaataggattcgataaatgcgagagtctgtttctacgatttcatatctggagattcagagcttcctcgtgcatgtttagagacttctgctcttttattttttttcgcttaactcagattttttaatatttataaatcaatgtatttatttgatttttatacggagaggattaatgttgagatacagatatagtgcggcgcggtgtacatgtgctagcaaaattactagtttactaagatttgacttcttttgattggcttagtggaaattctcccaagccaccatagatgttttgacacgttgatagaatgtactgtcaatgattttcaagagtgggaaattcacagctttgtactttggagtttggaggaacaactggaatgtttgaggtcgaatttgggaattgaaatttttaacccctggatgagtttatatttgattgatctctctattatggggtgttgaatgttatttacaaaaaaaaaatagtcattgttttatggacgaataaattatctacttgtcgtttttttaccgaataacgcataaattagattcaatacggataattcctaaaataaaataaaaacggttagttcttctaacatacgttactataacaaacgtacttgacgagttggcataaaaatgtatttctactgttttaaaagtaacgtacgattcgtcttgcatactgtgacgaaatatgtaaattcttttgtcgcttagtgatgatgtgaattattttgattcataaagtagaaactcgatacatacctattaactaaacatgtattatgttgtgattcatttttgcctaacaaataaaatttattagcaagaaccattaaaatttcatactaattttggatactaaaatgttagattgatatataagaaaagtatatactcaaaaagatttaacaatttaccaatatttagtattggaatcagtgtagtgtttgttagtacatgcttttctacatttagaaacagttaaattataattgcaaaaggaagcaatattgaggtattaataaggttttacacttttacttcagctagctttgaattttagaagttttatggactattaaattatctacttgtcgatctttcataaaaactgttggctcttgcgagagatatgtgaccttccaattgatcgcgaagtgataagatgtattcgattttttcagcttatgccatttttacaacttttcggaaaaatgtttcaaaatatccattatgaatttgacatccaagttataaattagataaaatttacttgagataacatatggacatatagattttacttatttattagagttcattaacgaaaaattattgagttaaatatagacatctttaaactcgttaattttaaaaagaaataataaacaatatatatatatatataaatattttattttcaaattttatttatttaaagggttttaatttttattaacagttataatatttatgattgtttccggttactttgatgctattttctcgtaattcccttttgtacatatatatttagaaccaaaaattcaatcattgagaagcatactctctgtcaagtgtaattgattcctcctcttcattttttaattcttcatttcttaagttttattaattaattgactcacctcttcatcttgtttatttccaagtaattttcctaatgatgtcaataaacaaaaataaaaagattaaaatcacgcaatatcagtaaaaaaggagagagggttaaatcggtggtggactttgcagccctaaaccattgtttcgcctcggaaaagcccatttacacaattgggaaataaataaaaacagagtaaagaaaggaacgtcttttactctttacggtatcgctcgcttctcttctttctcctcaacacgaagacccctcttgcctctttattagagagaccccttccttcttcttcttcaccttcaccttcttcctcgattcagatcgtctcctcctctgttttatactcaccctattccttcgaatctctctccatttttatccccagattctcccttcttcaacctcgtcgactcttcttcatcactctatttcttccgattgagacttctttcactctgattttcttcgaccctttacggatatattcggtcttgagtctccatcggatttggatttgaatgtaggtatctcgcacgagagttgttgtttaacgtaaatctgggttcttttttttggtgggtcgttgtttttcttctacatgcagttttggggatagtacgtgcgattcatcgatcaatcctcgtttagatagacatcaaggatttaaaggagtcgttaagagagcaatggaaggagac

SEQ ID NO: 14183 - DNA, 3000 bp, Unknown; identical to SEQ ID NO: 14170
  misc_feature (1)..( 3000): cDNA_ID_2706176_gDNA_ID_2214704_Annot_ID_136941 3000 nt of promoter + ATG

SEQ ID NO: 14184 - DNA, 3000 bp, Unknown
  misc_feature (1)..( 3000): cDNA_ID_1383514_gDNA_ID_2214704_Annot_ID_136943 3000 nt of promoter + ATG
atatagaaacgtgagtgtgtttcctgtgacacataatcatatcttgctgtggaagcaagtggattgccgtgaagttagaggagatgagtctggtgacgagaaggttgtggaggaagggactggttatgattatgaacaatggggacttgggaatttcttggagagttggcaattatctgacacagtcttccttgttggtgaagaggaaatggatgtccctgctcacaaggttatattacaagcatcaggtaattttcctttgagatcatctgatggggatgtcattcaacttcgtggagtgtcgtacccgattcttcatgctcttcttcaatatatctatactggacgaactcaggtaatttctcatatcctcttcccttgacgtaattgtcccttttgcctggtgaaatgctttgttaggaacctttttatttatttattagtaaacatggagattctatatcttcgtcataatttccttcaaacttttgttttgatgtagattttggaatcagaacttgctccattgcgggatttaagttctaagtttgaagtgatgtcattggtgagacagtgtgaagaaagtatagaccattttaaattgagcaaaacagcatttgactcctgcagaaaagtcaaactcttgtgtcctatttctcacccgttatctggctttatgttcccaagtgctttccctgttgatgttgggaagctggtaaagttgtactcaaccggcgaatatagtgacataaaaatctacctcagtgaccatagtctcactttccaatcccacaaagtcattctaagtctttggagtgttgcatttgcaaaggtgagaatctcttttagtgtcgcagttctgatgtacatgaatatattgattctcaattttcttatttattctctatgaacatccagatgtttacaaatgggatgagtgaaagccattcatcaacgatttacctaaccgatgtatcaccagaagcattcaaggctatgatgaatttcatgtatagtggagagttgaacatggaagacactgtgaattttggcaccgagttgattcatcttctctttctagctgaccggtttggagttgttccacttcatcaagaatgctgcaaaatgctcttggagtgcctctcagaggtaatttttttcttttcacaatcctctagagtaaatgatacgtctcgctgtcattatcatgtttcacttcttttccagtacatctgttacaatatggtttctgtatgatagagagcttaatgagccgtgaagtgggttgcggtttcaagccttctgaaactaaaagagaaaagaaacgaaataccacattcaaactacagagtaaaaagaatattaatattgtgtcatgtatatattacatgcagggatggcgttccgttttggaagaaggtcatacaacaagaataattcttttatgcgagtttattgggcgtgggagcagacaaacttgagtcttttctcaagctaacctctgaactttgttgcaggattctgtatgctcagttctccaagtggtttcgtctatctcatcatgtaaactcattgaggagatgtgcaagaggaagttctccatgcacttcgactattgtaccactgcaagtttggactttgtcttgttagatcagaccaccttcagtgatattcttgaggtgtgttttctctttcgctaacgtactatttcttataagaacatctgaacccgcttggagacttgcccaaataaactgctacaacgtgttgctcatgcactgaccagtgattagttatcgtggaaatatatatgaacaatggaattgtaatggatatcaccaagagtgatgaatgacgtctcctttcgttatggcatgtattaaatcctggaattgcagtctgcagatctgacggtgacatctgaagaaaagattctgaatgctgttctcatgtggtgcatgaaagctgaggagtcgcacagttggggagtaatagatgagatgatgaactatgctgaccccaaaagtttgttcaaagaaaggcttcagtcacttgatgacctgttacctcatgtacgcttctctttgttgccatatgagttacttaaaagggtaagtggatcctgaccctgtatatgctgaatgaactttgtcattttctgttaaattaatttcgctgatgccatctatgctttgatgatgacgcagttagaaaacagcaacctaagcaaagaaatcccagtattcaatcgtcttgtaagttcttaacatcttctatcgatttggggattatttaatttgtcatttcaagactgattttctctccaagccctcacttattttgtcttgtgtacagttgaaggaggctgctagcttcctaacatccggattgatatccccaggaaatgaaccgatgtatgaattacatagtcatgtatcttaggattgtaaacatctccaggtttatatttccagacttctcaattattaaagcttttcacctctagttcaagattccaacatcggagatcgagtttcaaggagcttcagtacatacgtgatggggacagcaatggggtgctgcactttgtgggtacatcttatggtagtcatcagtgggtcaaccccgttctcgcaaaggttaacctcacttttatcttactttctttattcatattgttggaaatccaattaccatgacaaggaattctgctggagaaaaatatttccttatttgagttctttatgttttacagaaaatcaacattacatcgagtagtcccacatccagattcactgatccaaaggctttggcttcaaaagcctatgcggtatggtccacccaagttcgctcggattatatgactagaatttggcttgaactacaaaattgacgaagcataaaattaattgaagtgaaccttctttcctcttagatacagtatttaaccatatgatttcatttttttggcaccagggtacttcctttgcagggcctagg

SEQ ID NO: 14185 - DNA, 3000 bp, Unknown; identical to SEQ ID NO: 8343
  misc_feature (1)..( 3000): cDNA_ID_2994335_gDNA_ID_2214705_Annot_ID_136944 3000 nt of promoter + ATG

SEQ ID NO: 14186 - DNA, 3000 bp, Unknown
  misc_feature (1)..( 3000): cDNA_ID_2706207_gDNA_ID_2214705_Annot_ID_136948 3000 nt of promoter + ATG
ttgattatatatacgaggtgattggattttacaagtatgactatgggtttcgaatcactgcaagatctgctctcgttgagatcatcatatttatgctagtatctcttcagtcctacatgttttcctcccaggagtttgattatgtgtcgcggtatcttgaagcagagcaaatcggtgctattgtgcgggagcaagagaagaaagcagcacggaagaccgagcaactgcaacaaattcgtgaggctgaggaaaaaaaaaggcagcgaaatttgcaggtggaaaagatgaaatctgaaatgctgaacctacgtgtacagcttcacagaatgaattctgattctaattttggagttgcttctccgcgcactgaaggtctaagaaggaggaagagtccgtatctaattccagatagtggtgcagccagtcctgagattgacggagtggtccacaggaaagaagagcagcctattgacgaggattcacagtatccttttgaagcgcatgagtttccagtgagtaccactccagaagcactagattctccagagtattcatttggagcatctccttgtgagataactgaagttcaacaggatcttgatgtgatgtctatggaacgtgaaagaaagcaaaagtctgagggaaaggagaatccattaatttctgcggtgcaactcatcggtgatggtgtttcccaggtacagtttattggaaatcaggcagtaaataaccttgtgaatttcttaaacatctcgccggaaaattcagatacaaatgagcagtcttctgttgatgatgaggtgtatgatgaaatggaaagtcagaaaagaaaacacacacctttcgaacggtcaacatctctacaatctgacaggagtagtgatggcactagttttcagataggaaggatctttcgtcatatatggtctaggatgcagtccaataacgatattgtttgctattgctgcttcattattgcgtttctctggaatttcagtcttctttccatggtctatctagcagcactgttcctatacgccctctgcgttcacactggccctactcacatcttctgggtcatcatgctaatgtacacagaaatttatatcctgctccagtatttataccagattataatccagcactgtgggttaagcattgatgcacctcttcttcatgaattgggatttccaacgcaaagaatcaaatcatcatttgttgtcagctcgttgcctctgttccttatttacatatttactctcatacagagttctataacagtgaaagatggtgattgggttccttctgctgattttacttcgcgccggaatgcccgtggtagccagaaggatcttacaagaattagattgagccagagaatcttggatgtgtttaagaagctaagagatagtgcgaaattggtgatcagaagcatctaccgatactggatatctctgacacgtggagcagaatcccctccgtactttgttcaggtgacaatggatgttcacatgtggcctgaagatggaattcagcctgaaagagttgaatgtagaatgaatcagttgcttaggcttgtccataatgagagatgcgagaagggaaaccctgatctctgcccttactctagcagggttcacgtacaaagtatagagagaagtacagaaaccccaaacgaggccttagttgttctcgaggttgagtatgcttctcccacaaatggctgttcttcagcagaatggtacaaatcacttactccagcctcggatgtggcgaaagaaattcgtaaagctcaacatagtggacttggtgaaggaactggatttccttaccccattctctctgtaattggcggaggaaagagagatacagacctctacgcctacatttttggtgctgacttgatagtcttctttctggttgccattttctaccaatcagtcattaaaaataaaagcgagtttattgatgtatatcagctagaagaccagtttccattcgactttgtcattattcttatggtaatccatttctataagtctagtttatctgttcacacccgttttgtatcagtgccctaacccgatgaaatgcttttatggcaggttatcttcttcctaattgttgttgatcgcgtcatctatctttgctcatttgcgactggaaaagtggtatactatctcttcagtcttattctcttcacatatgcagtgacagagtatgcttggagcatatatcctacccagcaacacgctgctggcttggctctcagaatcatatttcttgccaaagcaatgtcactagctctccaggccatacaaatccgctatggactacctcataaaagcaccttgtatcggcagtttttgacaagtgaagtatcacggatcaattactatggttacagactttaccgtgctcttcctttcctgtatgaactgagatgtgtgcttgactggtcttgcacagctacatcactgacaatgtatgactggctcaaggtatgtcgtctgatcccatgcatttactttctggaacccttgctatgatcatggatcattcatgttagtttgaacatactgccaagggcttaagttttgttcgtttgcagttggaagatgtaaatgcgagtttgtaccttgtcaaatgcgatacagttttaaatcgagcaacacataaacatggggagaaacaaacgaaaatgactaaatgctgcaatgggatatgtctgttcttcatcttgttatgtgttatctgggctcctatgctggtaataattttcttacaacacaacttttataatgcttttgtaaagtttttcatttggaatctgaattatcaatacgttcttgggatgaatagtactcatgatgcttgtatttataggagaaagaaaaattatgtgctagcttaatccaacaattctctgtgatgtcttacagtttgagtatttggtgagtcatttgtttgttggcaatggctgctttatccttgcagatg

SEQ ID NO: 14187 - DNA, 3000 bp, Unknown
  misc_feature (1)..( 3000): cDNA_ID_2706203_gDNA_ID_2214705_Annot_ID_136949 3000 nt of promoter + ATG
gttctttatatctacgcaggattcaacattgtcctgctttacctctatcaactaccaataaacttttccgatatgattcgttggatagcaagctttataggtctattcagaatctccctggaaactgaaggccctgatatttgttctggtcttttccttgtgttgttctacatcatggtatgtcttttgtttttcgaggattagtattacttggtctcactcaagtgtaaaatgataaactatattactgaaccatataattgatgaactgtttctcaaaacaactgtcaatatgtggtgaccgtgtttggggagttggttatgaacaccaacagccagtgtagtttttccttcaagtgaactgacttacccgccttaatctgttaacgagctaccactatgttatacctgtaacagtcttgacatgcctgtcgttctgctattgcagctatcctatgtaaggtcagacctcgaggatatggactttatcatgtccacgagtgaaaataacttggcagagcggcttcttcctccaaaatattcattttttattcgagaatcaaggtattctatatagatttttgtttagtttcttcctactgggagctgttgtggttttaacatagtatatcagtttttcaagggaaattttagtttttctgtttaattttttcttacttatgttaattaatttatggttgaatatgctcaaagaattgtgttcaagggtcggcactaccaaacgtggaagcctaaacactggacagttttatgaacacaaagttgtgattggtttctctgctaatagaaactatggggttgggtaaagattagtactcccttacagagtacaactagttcacacattctaatggatgttctcttggctgggctgtacaagattagcattgtagatggataatagttacactcaacttaatgtgttaattttttccaaattttcagggccggtgtcaggcacaccaatgttttactgaggggagctgtgtttaagactttcagtattaatttcttcacatatggttttccggtatatatttgtatccctggtattaaagtgtatgtgtcagctaaagcaacataatgtgtcagaaactcacactctttttatttgcgttcatgattgccaggtctctctatttgctctttcgttctggagttttcactttgcgagcttgtgtgcttttggcctccttgcatatgttggttacattatttatgccttcccgtcattgttccagttgcacagattaaatggccttcttctcgtatttatactcttatgggctgtcagtacgtatatattcaatgtggccttttcttttctgaacactaaggttggaaaggtaatatattctcgatgcgcaaaatcttcaactactttaagaaaactaagatgtaaattaacaactagtgtcttaaatatacaggacatgcaaatttgggagatggtgggactttggcattatactatacctggattctttttgcttgcacagtttggtttggggatgttggtcgcgttgggtaatcttgtaaacaattctgtttttctgtacctgtctgaagagagctccagatcttccaatgagagatcttacgttgaaggtaattgcctcatattcggttctgcaaagcaagttatctgatgttttccaacttccagggttgtcggaactgtaaagttgagaaaatgggtgtacttgtttatcgcgatcaacctatcatcttttctgactgaaaccatctaaagacaattaaagagttatcacgctatccaaaatatattttaaagaaatttttgatatagaatatcatggaaaatgttatgtactgtgtgattttgaaggagaaaatcttaaaattactattatattggcaagcttagtttattccgggcttagttttaggttgcgatttcaatcttctgctatttattcaattttttcttaacgactgaaattaccatcaataacagctgatgaagaaacaaaggtgttggtcgtcgcgaccattgcttggggattgcggaaatgctcacgggctattatgcttgcactgatttttctcattgctatgaaacctgggtttttccatgccgtatatggtatgattatccccctcccatttgcttttataacaaggattcatgtatctgggtgtttgtgaaaaacattgttcatgatactgtatcttaatggacttctttcagtgatattcttccttatgtatctgttgagccacaacatcaacagaaagatacgcaagtccttgattctactatgtgaagttcattttgcacttctctacattcttgagattgacctggtgtcgaactccttaaagcaggaaggctctgcgagcagagaagttctatttcagttaggtacgcctctctttctgtatttttcaagttataggataaattcacggatttccctttgaaagttagctgcaaggtgatcttggatttgcgggaaaaaaggattagggaagagttctcactgacaactctctgtatgaatctttgcaggtctccttaggtctgaaagctcttgggacttcttggagatagccttgctagcttgcttctgtgctatccataatcatggttttgaggtgctattttccttttcagcaattgtacgccatacaccaagccctccaattggatttagcatattgaaagctggtctcaacaaatcagtcctcttgtctgtctattcgtctccatcttcaagttatagccaggataataccacttacggtacaacacttccttcttgtctttgaagtgaacatttgaatgagtgacatatatccgtcttagatttttacttcaactccaaatccttgcttccattgtcagctattttttctggcattttgcgtgcatgccaattagtttcctttaatgcagttgccacaccattaatcaaacatatcagttttatttcctggtcctcatattcttttatg

SEQ ID NO: 14188 - DNA, 3000 bp, Unknown
  misc_feature (1)..( 3000): cDNA_ID_2706199_gDNA_ID_2214705_Annot_ID_136950 3000 nt of promoter + ATG
gggcacagactcggggtcgataacgatggcaacttcagaggctcactcactctcccacttaaggaagggtaatggaaacactcccccgatgttgattgtatccgagttttctttctaatcagaaaatgaatctcgcaggtcgttgctggtgatgaggggtaacagtgcagatatggctaggcatgtaatgtgtccctcgcccaacaaaagagtcgcaatcaccttcttcaaactcaaaccggactccggtaaggtccagccgccgcccaccctatggagaccaggcaccccttctcctctggtgatgctagctccggcgcccaagaggctagacgctggcactggagttttcttgccgtggacaccgccagtgtcaagaaaaccagccaagcatctcccgccgcgtgtccagaggctgcgtctcttgtcatcatcaaagtcagtggcagatagtgagtcatcgtcgccagagataggagtgagttgagttggaaagtgtcacacacggaagctctttctttttcctttactttttttttttaaagcagagtcttttggttgtacacttgagagtttagtgggtttttcttgtttcttcctaacattttgctttccttttatttggtcaattttatagaacgaagattagggtattatgctacatcatctactgttgttacatgattcactatttgtattaaaaatctttaggatatgccccaccacttgccattaatttcaaatatcttcagcttcaatcaagaaaagaggaaacttgattgatacaaatattcctgaaactgcttctcagttaaagtaaaagaggatgaagaaggaagcagagagattctggttttcttcttcttttattggataaaacgacacatagcttccactggctcaatttccccatctaacaaaagcgtagaatcaaagcaaacccgatataccactactcatttcttcatatacaccaaaaccactcctcaagcacaataatcctggagagaaaagaaaaatacctttctgtttctgcagtcttctttttgacagagaatgcacataagagaggatgatgacagcatcagctctctgcggcctcggggcatttgccgtcggctgtttcgatttgtggtggctaaactatggatattaggagacaaagagatgaatgaagataagcctgagaggaacaaactgatcaagaagggatcaatgtctgacatcactattcatttcaagcaattagaagactcggaggataacaattcccctgcctcgtcaagtccagaatcagagagagagacaatgattacactagttaatggtagtaacggcccaaagaagaggttacaggagaacggggaaaagagcatgctgggtgagcccagccctaagcaacaaatcactcagcctgaagcagggaaaccaccacagcctcatagacgcctggggcccctactaaatgatataaataagaaatcagatgcttttatcgaaagtacactcgagaagatgaggaaaggcttagcctagaactaaacacatgagcctccttcttctctcgctttctctgtcgaatagaagaaccaacagacactgggatgcaagaattatctatatactcaattcttttactttgtttaaatttaccagctgcattcttgataacaaaacgtatatgtactcccacttgtattttgaacaataattcatctcagaactttaagatttacaagaaatattccttaaggggctagttcatatatcattctagagcaatgttcacattcatttgccttaaacccacgtacctaacacgataagctgaatgaagtaccattctaaggaagaaaagacaaagaatcttcatgctctaatcccatcatgattcacgagtagtccctactctgttctttccagccatccaagctgaagtaagaggcaaaaagtgaaaaaaataatctgagcaagcacatataactatataagcgcccctcaataattaccattcgacataccttccaggcatacatagcaaagaaggcaaccgtgtcagcagaccagacaagagcaaatgatttccaaaagaagggaatagcaacattgagcaaggggacgatgagaaagaggtagttaagagcctctttctctttacttggacagtctcgtgcccgaagagaaggaatagctggaaagaaagtaaaggattaggggcaaaaatgcagccttggaataaataaagttagaagaaagtagagaaggagacatactgaacatccaaatggaccacatgcccatcaacctccataaatcaggttcgctggagggaaagaggaggttgaaagaaaggacacctccgaggaacatcgatgcatagccttgaacctcaaaaactttgtaaagagtagttccagggagagcagggtttttactggcggtggaagctctaggggcaaaggttgcagcagtcttgttaacaacctgcttgaattgaaaagtcataagcttgagcaactctttcaacaggttcaagcactagagaccaatctaacatggtgcattttcattttcatgtcttcctatggtttcaacagaaaaatcgtaaatgatatagaaaaaaggcggacctttttcaagtctttaccgagagcagaggatgaggaagggagaggagattccggcgggtcgtccttgggttctaatccgtcagaggtggcgaaaatacggaaggtggatcttcttctatggcgaaagccataagtgagagctatggaagaggagaccccatgggtgctgcagagagaccaactcattctctcctccaataatcgcgataaggaagaagaaacttgttggctttattgaaccggtccaattctcaaccgaactccggtattccaaattaaaagccagcaatcaataattgaatctcgagcccacgacggtttgattggtttagccatttctcggcgctaaatataatttattaaaatgatg

SEQ ID NO: 14189 - DNA, 3000 bp, Unknown
  misc_feature (1)..( 3000): cDNA_ID_2706195_gDNA_ID_2214705_Annot_ID_136954 3000 nt of promoter + ATG
ttttgtctattgtgcatattatgcatctgctggagtcaaacttgactcttgatcgtcggaaagggacttctccatttatgtattataatggacgtaaacaaaaattgtgagttatcgacacaacttcagaaacacctctcatttatggtatattgtgaataaacgaataagttatccattggaaaaattaaatcagtagctagtagaaacatatatgaaaaaatatactgcgacagacagtatattaactgggaaaggagaaaaaccgagaaagaaaagaaattgtcaaaggaaatcaatcgtatttaattaagaaaaggaaatctcaactgaatctgcccttttttggttaagggggcttcagattaaaaaagagttatcgcttcataatgaatgaatgaatattcagtacaggtcacgacgtcatgttacgtacgactaaaaccgcccattttcagaatcagagccgatcggggtattgtttaataacggatttaacgatcgtgcatgtcatttcgttataattccaagctttctcatcattatcattttattatcatctttatcaacttaaacagactcttctttggcggcccattcacagcccatataatgattcttaagaaaagaaaccactcgctaccgatgtaacaacaaaattattaaaatgatcactagtattatagttttcattaaaacgacaaatccatgtccgtacttgtcaacacacaccacaaaacatatacatatatatcaatctctcaggccagaggattattcaaatcattaatttgtcgaaatccatcacttgaaagtcgggttagcacgagcaatggtggaagaggaactgagcttcatctttgccttctttatgtactcagagaactgatctgatgatctccggccactactacctacgtgagagataggcacatggtggtgaagatgatcatgacgtgtctgatctgtttcatcacttgtctcccacgcatcctccttcatcatatcaccgacattcgtcatcgcccttatcttcagcttcgctttctttatatactcggtgaacctctcgtccgttttgatcgtagtatccactcgagcgatcaccggttccacctttgtaatgggtttggctgccctaggcctagccgatgtctctgcaaatttgacgcgaacagcctctgctggtgaagatttggtggagatgcgacgaacggttcggacaggactagtcactgctctgaagatcttctcgcacactctgttttcttgcttcttcttgctactactctgtgatgatgagttctttgccatggatgtcaccttgggaagtactaaaggtgatctgtgcagagaagatagtgacattaacgagctttttataatgcaaaatctatgtgattttatctttgttaattgcagaataacgtgtttcaacatgcaacaagcgaagaaattacaacttgttgaaaagaggaaagttggaaacttttacaagtttttcaaaaaaggaagagtgatgttagaaagggatcggattctgattccactatgttttctttctttctttcttcttcgttgtttttgtttcggattgttacgttcctgtcaggatttgagaatcatgcatcagctgtcactcctctcaggagggggagattatatctacttgtaacatactaatcttccaataaataagcacttcacatattattaaaatacagtagattctcataattaggccattttccataagcttttgtttacttatttcaatccactagtatgcttttcacattattcttttcctgcaatttagcatgaatcatgtatgcaatttagcatgaatcatatatatgaaacgggggtttactaaaactctatacataaatttctaaaactctaacccactccaacccggttttttctgttcgggtatcgggtccggtttttttttcgcaggccctaattaagacattcaagaaaacaagaagaagcataagaagaggcctaaatgcccagagaattaaacaaatgggcctttaacaatattttaaacaacactgaacaatagatgagatctcaacttcgaaaagctaaagccttaatataaaaccaaacatcaatctctcgccgttaaggttacatctgtcgccgccgctgagaccgccacttaaggccgtctcctccgctctatccatatccaaaacagctataaagataaacttccagagcttggtgaaggagcagcaaccctagttttcaatccctaaaggtgaagtttttgttcttctttttctttgattctactcttttttcgtcacaatagcgcagtagcgatctgggttggcgtttttattgacggattttggtgggtttgggttcgtgttagattttactttcacagattcaggtatgtatttgatcttatttagctttggtaatactcaaaccaactagtatttgatcttaattaggtgacgttgatattttgtgtgttgtgggtcaatcatccactctaggttgatctgcgtctatgtttagtcctaattttgaagaatcattctaattgctgatgtttatttatgacaattttatgtcttacttcgaatttagctaagataataaatctagacgagtgcctttataaacagtttatgtatgaacaatgcttcgcttgtgggattgttgatttcactacatttgattaagaatgtacatactattacaaatgttatcgattaaaaacgtcattttcagatattagttctccagcgagttgacacaaaacccgattacgtttcatccggcgactcgctttgatattccatggattctcagttgaatccttccaagagacgcaagataaggttcgcgtctctcatcttttccccagttttttttcttattcgaatcacttaaggcttgagaaattagtggttagggtgtgtaaattgcgtttgatatagtgtcaggcacagatgcgttgcgtgctataag

SEQ ID NO: 14190 - DNA, 3000 bp, Unknown; identical to SEQ ID NO: 8347
  misc_feature (1)..( 3000): cDNA_ID_1836205_gDNA_ID_2214705_Annot_ID_136955 3000 nt of promoter + ATG

SEQ ID NO: 14191 - DNA, 3000 bp, Unknown
  misc_feature (1)..( 3000): cDNA_ID_2038970_gDNA_ID_2214705_Annot_ID_136957 3000 nt of promoter + ATG
tgttgttgctgttgtttcctgggaattaggatagctccggcaaggacctgaatatgagcatttaccaagggaaagtcctcctcatcgtcaatgttgcttccaaatggttcgtctcttttgttcttttgctattttcttattcacctctaatccttagttttgtgcgcaaacagcggtttcaccgaaacaaactatacacagctcaccgaactttaccggaaatacaaggaccaaggtcattgattatattacggccttttttgttatgcagttgcaagctcatctcctttgttggttttaccatttcatgctctctcgttttcagattttgagatcttggcattcccttgcaaccagtttctataccaggagcccggcacaagtcaagaggctcatgaatttgcctgcgaacgctttaaggccgaataccctgttttccaaaaggtacgtagggatcaagactcttggaacaagtttattatcttattatgttaggctgctgtgacttgtggtatgttcgtttataacaagaaattcataaacatgcacttaacaagtcttgatttgtgaatgttgggttaggtacgcgtaaacggtcaaaacgcagcaccaatctataaattccttaaggcaagtaaacccacctttctgggttccagaattaagtggaacttcaccaagttcttggtcggcaaagatggcttagtgattgatcgttatggcacgatggttacaccgctatcaatcgaggtatccgttctttatatatccaaagtacccatgtaataaatgttgtcattgtcagtgatccgatttccttcttttgttagcagaaagacatcaagaaagctcttgaagacgcttgaaaacaacagacgagattgccaattaacaatcacggttaattttgtaatgtaaattgcagcttttatgtcgaaatttctttttggacatgtttctctgtttagtgtataaaaaaagaattccttttggaagagtaggttgctgttttcaaattttttttccaaaaactattcttaatgttccggagttaatgatcgttattgattgatacaccaccgactcataattaattttagaaattagggatgcatctttatttgtataccaattaccaaacactctatatatcaaataaaaagaaacactctatagagaatggcgaccaatctccccgtttattcatcatcttcaataacctaacatgatatctaacactctgttagccatcatgttaggttaagccaagaaatttgaacacataatagaaagaataaaacagaagagaagagctaacgacattttagacattttaaatttccaatatatcgcggcaaaccaaaaaaaagaagaagaaaaatacatgcatgacaggcattttttgaaataatttatcagagtattgaaatagtattttttttgctgaaatcatgtgtaaaaatgaactcgtaatgaaaatatctgacaacacatgcataacaggttaaagactttacacgtcgattgggcttataagttcaacaggataagagatatgaaaagcaacgggagaaatggagaagtagaagattgagcgaggccggtgggttgcatgggctgatctacgggtcgaattcctgatttagttgtgggtcccgttggtccatccgcgggagtatccggtgcaggtgcctgtgttggtgttgtccccgccgccttggacgctgatcaagtgtgtccaaaagaaaatcaaaccctaaaccttaaacgcataacaataaatatgattgtcgtagctaaattacttacctcccgggctaaaagcagacacctgaggtggtggagcaatcaaaaatggaacctgacctgcccaatacatatatgtatataaatctatgcatggaatcaactggaacttatatacacatgcaaatagtttgttttgaatcttagatacacatatagtttgtttataaaggaaaagcaaactatatgtgtatctaagatccaaaacaaatttatatgcgctcgctttaagaaccactagcctaaaactttgttgttatgtataatagttagttagcggttttcattgtatacctggagctggtagaggagtccccgcagctgtaaatcaagcaatgagtcaatcgtggtgttaaaaaatgagaaattaataaataaaaaagagtatagtagattaaaaaccttgacattgaataggtacaccgcccattttgcaggctcgaggtagagcaagcgccagagtccgattgatgaagccagtaggcagcgggacgttagcagtgaggatgaggcaagcacagcccatgccagtgttggtcaacgtcttcaaggagtcgcagcagccggcggtgggagtgacggaaccgccgctgcttccggtgatgaagttgagacatggagtgaaggtagagatcatggaggaggtgcatggcgtgcttatctgctgaccttgccctcccaacataaagcttgacatcatcactactatcaatgttaagccttccattttaattggcctgcttaatcttccggtgacgatgctttatagatatacaattattcagttttatatatgataaaatgggtgcattggagttcaacaacttccaactaatatcctttctctcaatctcttatcaacacacaatttttctttttatttcattaattaacaaagagaaaccaaataaaaagagaaagtagctgagtttggtatactcctagtaattttgtaacttaagtaattacaatctttaattagttctgaaaaagtatactggttcatgtctacgtggcgttgtatatattgggatgcatctagaacatagatatgtttgataaattaaagccatataaaccatgtaaagtaggtcatccaaccagacctgcctctttgacattttctggtcagttcctcctataattaaaccaaagcaaaaacaccaaagttgaacaataataactcaaattatg

SEQ ID NO: 14192 - DNA, 1705 bp, Unknown
  misc_feature (1)..( 1705): cDNA_ID_2711048_gDNA_ID_2214705_Annot_ID_136960 3000 nt of promoter + ATG
taaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctagaccctaaaccctaaaccctaaaccctaaaccctagaccctaaaccctaaaccctaaaccctagaccctaaaccctagaccctaaaccctaaaccctaaaccctagaccctagaccctaaaccctaaaccctagaccctaaaccctaaaccctaaaccctagaccctaaaccctaaaccctagaccctaaaccctataccctaaaccctaaaccctaaaccctaaaccctaaaccctaaaccctaaacccgaaaccctaaaccctaaaccctaaaccctaaaccctaaaccctagaccctaaaccctaaaccctataccctagaccctataccctataccctataccctataccctataccctataccctaaaaccctataccctataccctaagtccctaaaaccctaaatccctaaaaccctaagtccctaaaaccctcaaaccccaaaccctaaaaccctcaaaccccaaaccctaagtccctaaaaccctcaaaccccaaacccacagaccctcaaaccctaaaaccctaaactcacaaaccctcaaaccctaaactcatacaaaattttatggttagtgtatatcaacatatatgtttgtttgagtgtcgcattttgaaaattgaagttataaatagatttacttgtgtgaattgacatttcccattaataaacccttttaagttggacaatttacttagcaaatattttaggagtcaaagaaagaacattcaatgcgagtggaaacattgatgtcgaagttcccacagatgtttccaccaaagcaaaccacttgagctgttcaataaaagccttgcaacacttgccatataatcggaaaatagataacaataaaacgaacctctgagatattcgacaaggtatttcttaacttgagtaaggtctgaaacgatttaactactctacctttgatttttatttttggttttgagaagatgattacagttgtgattttggtggagacaaaaatgtccatctctgtatgttgctagccatcttttgtccaacaggccacctaacactttggaaaaacccgttcaatcttaaatgggccatgttgagccactaatgggcctcaatactatgagattttaagtgtcaagtgttaacctacgcagcagctagggcgcacgttaacaaggaccattcaacaataatatcatcagttttttttttctaggttcgtgtgtgaatccccttcttccgcatcaaaaaaaaaacaatctacagacagacaatcgtcttgtcctggattagggtttcattttctccactgtctagcaaacccacttcttctgattggggcggggattcaatgcctgcgagttcatctggggaacctgtcaccgaaaatcctatacactcccaatctcgcctccggttcttgctttacttggagtgttagaattcgcttctttacttgatg

SEQ ID NO: 14193 - DNA, 1705 bp, Unknown; identical to SEQ ID NO: 14192
  misc_feature (1)..( 1705): cDNA_ID_3022115_gDNA_ID_2214705_Annot_ID_189820 3000 nt of promoter + ATG

SEQ ID NO: 14194 - DNA, 3000 bp, Unknown; identical to SEQ ID NO: 8341
  misc_feature (1)..( 3000): cDNA_ID_1397961_gDNA_ID_2214705_Annot_ID_189819 3000 nt of promoter + ATG

SEQ ID NO: 14195 - DNA, 3000 bp, Unknown
  misc_feature (1)..( 3000): cDNA_ID_2038801_gDNA_ID_2214705_Annot_ID_189812 3000 nt of promoter + ATG
tacaagtagatataatctccccctcctgagaggagtgacagctgatgcatgattctcaaatcctgacaggaacgtaacaatccgaaacaaaaacaacgaagaagaaagaaagaaagaaaacatagtggaatcagaatccgatccctttctaacatcactcttccttttttgaaaaacttgtaaaagtttccaactttcctcttttcaacaagttgtaatttcttcgcttgttgcatgttgaaacacgttattctgcaattaacaaagataaaatcacatagattttgcattataaaaagctcgttaatgtcactatcttctctgcacagatcacctttagtacttcccaaggtgacatccatggcaaagaactcatcatcacagagtagtagcaagaagaagcaagaaaacagagtgtgcgagaagatcttcagagcagtgactagtcctgtccgaaccgttcgtcgcatctccaccaaatcttcaccagcagaggctgttcgcgtcaaatttgcagagacatcggctaggcctagggcagccaaacccattacaaaggtggaaccggtgatcgctcgagtggatactacgatcaaaacggacgagaggttcaccgagtatataaagaaagcgaagctgaagataagggcgatgacgaatgtcggtgatatgatgaaggaggatgcgtgggagacaagtgatgaaacagatcagacacgtcatgatcatcttcaccaccatgtgcctatctctcacgtaggtagtagtggccggagatcatcagatcagttctctgagtacataaagaaggcaaagatgaagctcagttcctcttccaccattgctcgtgctaacccgactttcaagtgatggatttcgacaaattaatgatttgaataatcctctggcctgagagattgatatatatgtatatgttttgtggtgtgtgttgacaagtacggacatggatttgtcgttttaatgaaaactataatactagtgatcattttaataattttgttgttacatcggtagcgagtggtttcttttcttaagaatcattatatgggctgtgaatgggccgccaaagaagagtctgtttaagttgataaagatgataataaaatgataatgatgagaaagcttggaattataacgaaatgacatgcacgatcgttaaatccgttattaaacaataccccgatcggctctgattctgaaaatgggcggttttagtcgtacgtaacatgacgtcgtgacctgtactgaatattcattcattcattatgaagcgataactcttttttaatctgaagcccccttaaccaaaaaagggcagattcagttgagatttccttttcttaattaaatacgattgatttcctttgacaatttcttttctttctcggtttttctcctttcccagttaatatactgtctgtcgcagtatattttttcatatatgtttctactagctactgatttaatttttccaatggataacttattcgtttattcacaatataccataaatgagaggtgtttctgaagttgtgtcgataactcacaatttttgtttacgtccattataatacataaatggagaagtccctttccgacgatcaagagtcaagtttgactccagcagatgcataatatgcacaatagacaaaatcgatcgtatatttaaattaaaaacaaaaatgaatacgacgaatctcatgattggcccttatgcaatttaaattcaaattaagtaataaaactacattcatatgtcaactaaatctgacgttaccaaactggtttgaaaaggaagaaaaaaactcgaggacgcctagtgtttagactattttacaatttagcaaacgcagacaaattaatgttttgtttcctacattttattatgagcaatcgggaataatttggtttgataaatcaagtagtcgacatggtgtaagcgaggcactggacggtggcacgataggtgagtcatgatgactcaagaaggcctcacgttactcacagtggctggatcattttattatataattactctctgagttgtataaatcctaatctataattaacaaatgtatagtctatatataatttgtctgttcgttcactcagtatctatcgtcaatgcccttacaaaaggcaggcacaaaaattacgaacaaatcaatgacccctcagtgacagagagaccaatcaaaatcgctttatttatttatctggtgaactcattgtgctcttcatacataaaaaaaagagttttatatattgagaaaagaaaagtttactacctacacgtggaaaacgtagagggaagtcgactttatggatgattagaaaaaggtgtagaaaaattgcaacaggtcttgaatctttctttaattgagtaaaaaaaacgtaggaaaatgttttggaaccgtgaaaattacgaaagagagagaggcagtcatattatagcagattaggagacaataataaagatatatagagagaggcaaggccagttatggtagataattagttccaaaccatgcatctctgtaaccatggatggatggatggatgatacgaacgaaaacggcctagtagagaaaagaaagagatttttgtcttttccggcaagcgagaggactcttctcctgaggggcaatgtgggaagaagaaagctaaatgatatggccacaacagactcgatcgaaggacttgttctcctcactttcctccaacttaattttatttttttaagttatggtttagtcaataattacgatggagtcgagtcgagttgagtttgtccctcccccccccctacctatatttaaacatcatccatgcctagagctttttacttgtattattaattttgtggctaaaccaaaaccaaagaaacatttattattacaaattttagtatccaacaaagcattcaagcccttaaaccccccaaaacctcctccgatcccattctttcgttaactgatg

SEQ ID NO: 14196 - DNA, 3000 bp, Unknown; identical to SEQ ID NO: 8350
  misc_feature (1)..( 3000): cDNA_ID_3022131_gDNA_ID_2214705_Annot_ID_189809 3000 nt of promoter + ATG

SEQ ID NO: 14197 - DNA, 3000 bp, Unknown; identical to SEQ ID NO: 8343
  misc_feature (1)..( 3000): cDNA_ID_2994335_gDNA_ID_2214705_Annot_ID_189805 3000 nt of promoter + ATG

SEQ ID NO: 14198 - DNA, 1145 bp, Unknown
  misc_feature (1)..( 1145): cDNA_ID_1808527_gDNA_ID_2214706_Annot_ID_136961 3000 nt of promoter + ATG
ggtgagcatgtaagtatcaccctcatcgcataaaacctccttagcttcaatttcgaaaagggaattgttatatactgattgaacaaaataaagatattctatagtaaacacatgttatatagaacaacatttgagattgatattgtaataatggagagaggtagcttctaatgagtatactactaaagtactaataagaaaactaaatttggctgtcacatcttatctatttgtttatgtggcccaacatttccaatatatattacaaaataataataatggataggcattgccaccggttagattataactcttcgtttgagtgcgacatatttgtaaccagagacaataattaggataaggattgaaccaaggaactaaacaaaaatttgaggatgaaacatagtccaaaacaaaatccatttaatttttgggacaagaacatagatatcataacacttaaatatgtgcctcaaattggtccaaaatgctctcgtgaatgaacgtggattttgcaccactcaacttaattacttactttgtcccatttaaaaaaaaaaaattataaaagcaaaaatattaaggaaaatttttcattataaaaatatcatctaatattttaatttaaaaccctaccataaatcatagaaaatactgcagcatataaataatcataaaattaaatagaattttacagtgatttcatataaaatactacagaagataaataatcataaaataaatataattttgcagtaatttcatagaataaaatgctccagaatttaagtaatcataagaaatctaataagcattttgtaaataaaaaaatccaactttgtctccaattgaattctgcaaaaaatccaactatactgcaaaacaaattccaattatgtctccaaaacgaatttgaaaacaaattgtgaagaaaaatatcattatattttttgtaaagtaaataaaattaaaaacacatttatggtccaaaaatttagttttttttgtttttttagttaatgtgtattttggcatgatataaagtgcgtcgtgtctcgactatatcatctctcggtttcactattgaacgtgtaacactggtcgaaagaagacgaacataaactcgtctccggtaaccaaaaatg

SEQ ID NO: 14199 - DNA, 3000 bp, Unknown; identical to SEQ ID NO: 3118
  misc_feature (1)..( 3000): cDNA_ID_2142994_gDNA_ID_2214706_Annot_ID_136962 3000 nt of promoter + ATG

SEQ ID NO: 14200 - DNA, 3000 bp, Unknown; identical to SEQ ID NO: 3108
  misc_feature (1)..( 3000): cDNA_ID_1819534_gDNA_ID_2214706_Annot_ID_136965 3000 nt of promoter + ATG

SEQ ID NO: 14201 - DNA, 3000 bp, Unknown; identical to SEQ ID NO: 3109
  misc_feature (1)..( 3000): cDNA_ID_1819530_gDNA_ID_2214706_Annot_ID_136966 3000 nt of promoter + ATG

SEQ ID NO: 14202 - DNA, 3000 bp, Unknown; identical to SEQ ID NO: 3110
  misc_feature (1)..( 3000): cDNA_ID_3022153_gDNA_ID_2214706_Annot_ID_136967 3000 nt of promoter + ATG

SEQ ID NO: 14203 - DNA, 3000 bp, Unknown; identical to SEQ ID NO: 3111
  misc_feature (1)..( 3000): cDNA_ID_1819518_gDNA_ID_2214706_Annot_ID_136969 3000 nt of promoter + ATG

SEQ ID NO: 14204 - DNA, 3000 bp, Unknown; identical to SEQ ID NO: 3114
  misc_feature (1)..( 3000): cDNA_ID_1819514_gDNA_ID_2214706_Annot_ID_136970 3000 nt of promoter + ATG

SEQ ID NO: 14205 - DNA, 3000 bp, Unknown; identical to SEQ ID NO: 3113
  misc_feature (1)..( 3000): cDNA_ID_2143028_gDNA_ID_2214706_Annot_ID_189849 3000 nt of promoter + ATG

SEQ ID NO: 14206 - DNA, 3000 bp, Unknown; identical to SEQ ID NO: 3114
  misc_feature (1)..( 3000): cDNA_ID_1819514_gDNA_ID_2214706_Annot_ID_189848 3000 nt of promoter + ATG

SEQ ID NO: 14207 - DNA, 3000 bp, Unknown; identical to SEQ ID NO: 3111
  misc_feature (1)..( 3000): cDNA_ID_1819518_gDNA_ID_2214706_Annot_ID_189846 3000 nt of promoter + ATG

SEQ ID NO: 14208 - DNA, 3000 bp, Unknown; identical to SEQ ID NO: 3116
  misc_feature (1)..( 3000): cDNA_ID_3022153_gDNA_ID_2214706_Annot_ID_189844 3000 nt of promoter + ATG

SEQ ID NO: 14209 - DNA, 3000 bp, Unknown; identical to SEQ ID NO: 3109
  misc_feature (1)..( 3000): cDNA_ID_1819530_gDNA_ID_2214706_Annot_ID_189843 3000 nt of promoter + ATG

SEQ ID NO: 14210 - DNA, 3000 bp, Unknown; identical to SEQ ID NO: 3118
  misc_feature (1)..( 3000): cDNA_ID_2142994_gDNA_ID_2214706_Annot_ID_189839 3000 nt of promoter + ATG

SEQ ID NO: 14211 - DNA, 1145 bp, Unknown; identical to SEQ ID NO: 14198
  misc_feature (1)..( 1145): cDNA_ID_1808527_gDNA_ID_2214706_Annot_ID_189838 3000 nt of promoter + ATG

SEQ ID NO: 14212 - DNA, 3000 bp, Unknown; identical to SEQ ID NO: 3113
  misc_feature (1)..( 3000): cDNA_ID_1819510_gDNA_ID_2214706_Annot_ID_136971 3000 nt of promoter + ATG

SEQ ID NO: 14213 - DNA, 3000 bp, Unknown; identical to SEQ ID NO: 7036
  misc_feature (1)..( 3000): cDNA_ID_3022241_gDNA_ID_2214708_Annot_ID_189857 3000 nt of promoter + ATG

SEQ ID NO: 14214 - DNA, 3000 bp, Unknown
  misc_feature (1)..( 3000): cDNA_ID_3022237_gDNA_ID_2214708_Annot_ID_189858 3000 nt of promoter + ATG
aacattaaattcaaaaaaaaataacttgaattttgtagaagttttgatccatcagaagattacgtaaaaacatttaggatcattgaaacaaacatggtaggtgaaaaactaaactacttaactttgggttggtcgtttaaaaactgaaaaactaaaaattataatcaaagcagtgattatttattcgttatacatatagatatatacaaagtggcagatcaaattgttttaatgaaattaaaacatgaaaacgaagtgtatcatgaagataaataaaaatctctacttctatccatactaaattttaaagaacacttattgttctacgccattgacggcttagttttctcagcccaccggtgaaaaggcttatattcacttggctataaatgaatcggtaatcgctgtttagcagcatgtatattcttctttaaggtatcatttaagtgatttctcaaaatcaatttatcgcttcattgatttcaaaagcgtcactaattttgctaacatctatagaccaattgttatttgcttccatattttttatatttttttttgtcacggccaggaccaatgttataggatctacattctcgtaactcttaaacgtttttactttttacattcaaatccaaaaaaaaaacattcattgttagacgaagactagttaacaaatatcacaattatgaactcgttaatggtttcttgagctcttgcatatttgtatcgaaagttataagaatgataaaagagaggttgatgagaaaaccaagtgtccaactatttccagtgagaataatctcaacaagtacataaaaggccctaagcaacaaattcgtatataagaaccgagttttctactctttggtcaaaaactgaaagtaacaaatccactcatgccgctggagcataatcttagataatgtcgtcatcatcgtcgccgttttccacatatgcaacctgagggtattcaaattctccattattgtaagtaacatctcctcggatgaatgtttcaccaacttggtcccatttgcacagaacaaacttgtaaatagaaaacatattttttttggttaatgaagaaaacaaaatactaaataaagcaaataggaaacagaaagaggtttatgaggttggtgaaggaatatgagatatcgctgggatatttatatatgcaacaaaactcacaaaggttagaaattttttggactcattgtgtctctggtcaacctcagtaaagtgtgtgatatgcttagaaacaagtgtgcttggcacaaaatacttcttttataccaacacatgtaaagctagcagcacttattcaattaattacactataaaaaataacattagtttatggaagaaaccaattggatcaagattgaactcgaatatggaagtttcatccctcactaaagcttcccctactactagaccacaaatacttcggcgacaaacgacattatgttgccacaacaaataatattctcatgagataaaaagctttaacttttataactttccttcttttaaagtagccaaacaacaagtgtaaaccaatatgtgtgggcggacgtgtcagaataaatcccatgtgtcaaagagtgtagtgggattcgtaatttttattgtgctattccacaatttataccagcatgtcacactccttattgaggtcagtagaagacggaaacgagtccaaacatacatccacttttgtttcacctataaagagtccaatgatctcttgttttctcatcaaactcaaatcaatcttttttgttttgcattttctcttcgacgcttgataagcatttcgtttccaaaaaaaaaaaaaatggtttctgtctccgaacttgttctctacgtacatgagaatgtctacgaaacatgcattggagtcaacatcgctaacaatgatcaagtatttgagtatgctcaaactgcatttgtcgaaaacggtgacaacgatgatgacgttatctatgattacgctccagcagcatgaatgaattttatctctattaggctaaagcgtagtgaaccaaccatgattttgtacttcgtatattaattatttaacggccctagggcttcctttatgttttgtctacttaacactttcactataaatcgtcgagcattttattctctcaagctcacttgatttcactttatttattttaatgaaaaaataaacgaaaatagtgcagtatcattacatatagcctgtaaattgtgatgatcatggtagttaaagtatcatgataccatttaaggagtcttctagaaaccaaaacttcgttttgccaaaaaaaaacaaaaaacaaaatccttctttaaaattttaaaatataatattaaaattaaaaaaatattttgataaatcgaattacaatattatttaattttaaatgcacaattgatacaaatatataaattaacatattatgcttgtcacacttgtttaggtttcacacgtattgattatcagtttttttgttgtgccaaaattctttaaaatcttctctttacaatatcttttcattagttatatgcgagtgatgaacataaataattctttttactttgccaaaaaaaaataaaaaaaaatctttttactgcagtgataagagttatgcaattttttttctatatatgtaaattttagagttcatcttctaaccatcacaataattgaagataaatcaaaattcaaaatatctatctaacattaacatagattggaatgttatattgtacactaagtatatatatagtataacttactataatgatctaaattcaggattgtaataaactcaaaagtcaaaaaagtatgaaaagacgtactaataatattcacgtagtttaattagatgaatcaagttttatacaataagatttactcaattagcttgggcctatgatagagaaatattgtaacagcaatatggtatgttttgattcaacaacaccaaattactaaaagaaatg

SEQ ID NO: 14215 - DNA, 3000 bp, Unknown
  misc_feature (1)..( 3000): cDNA_ID_3022193_gDNA_ID_2214708_Annot_ID_189871 3000 nt of promoter + ATG
tgtcaaaccggatcaaacccaaaaaagctgaacgcctatctgtaactttgcagataaggttagtttgcataccgtcccattatagggttacgtagatattgtgacaggcactccatagtatttacccttctctttgatccacataccataggaatagatcaccagatgcatagccacatgaaatttgtcggtccctactaggatagtctgtattttgttttggagagaactttatatgaaatttggcagctgatacaagaaacgagaacaacagtgtagagggaagaccagcggcgacgtcttctaggatttggaggaggatagctttctccccaaggttaaaagttttttccaacaacaaggtttttttttatcaatcctaattgagtgttctctctctcttgagtgtttctttccaagcaccctgatgatttagtgaatagattctcaaaatactaattttcatgctcaaattttgggttttttaaaattatgtgcagtaaaagtaaaaatttattccttctttatccttatctagtttggtcatgagaatatatttttttttttttggacacaagattggtgagaatatgtttgttatatgattccaaatgaaaaagattaatcacgtagaccttatatagatcaatattagttctatttttggtacaaaattaggaatatgacggaattatatcaaaaattacgttaaatagtaaaacaatttaggaatattgtacaaattcctcctaatttgtttccttagtaacatcactaattatagcaacaaaaatcttgtttgtcaaagtcgtgtactatgcgttaaataaattgccattttcatgctccaagatacaatatttacgcacctaaatcaccatgtaaagataccaaaaaacgtgtttataaactctaaacgataaactgatcatcctcacatcaaaaacatgacggcattgagaagaacaatctccatcattttcgttttctatctctcatgttagcttctcactcagtcactctatatactacatatctcttacattttgattaatcgatctataagacctaataaaatatggtatgtgtttgcaattaataggtacgttgttcgtgaatatctttggagttcaagccagaaatttatgcaagacagatgaagattgtgtgttgcgatgtcaagatccaggtgcgaactgtattcttggaatatgccattgttcgcgccaacaagttgagactgagctgaccaaggtgataagatgcaagactgatcgtgattgtcctgattctcatcaatgccctaaagattattattatgcttgccttaataatggagaatgtacttgtatctctgtttgagaaaccttaaaccactctaacaaataaaagagaaaccttaaaccatgattgttcagattctcatcaatgccctctattcaatatactaaacctttaaatagaactaaagctcaccctatatacaatattcaaagaaaataatagggtgggttaaaccgccagctggatgcttgaagattaacacggatggtgcgtcacgtgggaatccggggctggcaaccgctggaggagtgctacaggataatgaggggcgatggtgtggcggtttctctttgaatattgggagaagctcggcaccaatggcggaactgtggggagcatattacggtctctacttagcttgggagaggaaatcatcacatatagagttggaagtagactcggagatagtagttggttttttgaagacagggataagtgatcatcatccactgtctttcctggtacgtttgtgccatggcttcatatcgaaagattggagagtccgaatttttcacgtgtatagggaagctaatcgttttgctgatggattagcgaactatgttttttctttaccacttgggtttcattttgttccgaatgttgttgatttattttggaaagaggataaccttggggtaacatgtccaaggcaaatcccagtccattaggtttgttttcttaagttactttgaatagaacgggaggctccgcggcccgatcgcttaccaaaaaaaaatattcaaaaaaaataattataaatataaaaatcaaaaaatatattataaaatcagaacgttaaacagaaacatccatgtgaaaatcaatataatgttaaatcataaatagaagttaaacataaatattcattcaaaaaaatataaatctttataactatgtatatgaagtccaaaaatataaatctttataattatgtatatgaaaaagttgaagaaaagtgtaaacgaatgaagccttttaaatcagtaaatggcttcatttttttctctcccttgttgaacatttgtgcatgtttatttggtttgagttatgtgtaatttttttgtcctttatgtagcactcagtttcagtttcggttaagacctatttcaatctatacaatttttgtcatactttttttacaccaactttgatactcttaacatgaacgtgttttggtgtggcaaatttttattcccatcatatcgatctctaatttgtttaacaaaaattaataagaaacttttattcgacctaatttttactagcacggaacaaatttatatatatgcacttggaatgacgtaattgaatatatgaatggaagttaggataccaaaataactatgtagtatttgaatcttactagctcactcgatgagaatggaagtaggggtaccaaaataaaaaatttggtccaccacaaccagattggtaaaattcgaccggacatttattccggttagatctcaaaaacaatattaaataaatacccaataaggaaagtcgaaattaatgcgtttgataaaagatgatcgtctgaattagatacgcactaaaacatcaaagagtcactctaaactcatctctctcgccgaattctccccaacaatttccgccggaaacaaattctcagattccggtaactctaaaactatg

SEQ ID NO: 14216 - DNA, 3000 bp, Unknown
  misc_feature (1)..( 3000): cDNA_ID_3022190_gDNA_ID_2214708_Annot_ID_189872 3000 nt of promoter + ATG
gttgcgtttaggacttcaaatgcaactacgcaaatcaagacttcgtacttatcagatgaggcaatccatttatatgcagaaaaatgttattataaagctcacacgtacaggcagcatcggttcccaaatgatcttcttggcttaaagatccacaagttggagaaagttctgaactctttagggaatggaacacgacaaacagtgagttctgtaacagctaaactaaaggcatcaggaatggtacggtttcagttagagatcgagagaagtattgggaagaatgagagtgtgataagtaaaaaagtagcatggagaacaaaaccgaagatcgaacgggtttggtttgaagtaacggcgaaaatcgaaggagataagttgaaagcagtgaggctgagaaaagtagtgcctttcattgaagtggatacagaagcatggagcagtttgatgtctaacatgtcattcacaaagtttccatcattacttgttcctcaagaagctttaacactcgatgtcaaatggtaggcgcaacacttttatacgtttgataatcttccataaggcagaaaccacagtgtaacgatggattgtatttactcgtccttgtatgtatgtatatacttctggttctgtaaaggattatttatcacgaaaactggtgaaaggagttgttacgaatcattgcatattttgcatgaacaagttttggattttgagcatgtgttaattttacatattttttcttcacccctatttccatttcaaagtcataataaaaattttaaccgaaaaactaaactgatctagcttgaaataattaaccaaatatgtaaacataaaggttcactctccttattggtccacttgacaaattcattatcttaagatgaaccaatatgtaaacactaggcctgacccgtgccagtgttttatattttaagaaatatgttgtaataaaattttatttaatattgatttattttgttgttttggtgctatacattgtactattgtagtatatagtataaatgataatgtacaccgaaaagtgtagaatggtatttataatttttatgacacaatagctaatgttgtgcataagtcaaattttgaactttgaaactgaagagtaaattaaaaaaaatcttagattgaaatataatataggctagaatgatgtaaacaaatgtattttatttagtatttataacccaaacgtttatttttcagtttggttttaatctagtatattaatgttagaatatttgagctaatatattaaaactaaagacaaccgttgcttggatattccttgcgacaacaagtagatctagggttttctactttctttcttcttcgctgctgcttttcattcacaggttttgagacttcatcttgtctatgattcaggagttggtgggggagcacttctccgtctgcggtggtgtaatttttgtcatcgatgtggtcgttgctcaagattaacgaaggtggagtctcgaggtcgtggatcccggttgatgacgtcgtggtgtgcttcgaggatccccatggctcaacttttgtgcttgttgctaattttaaaaccgatgatatataattattgtttcttgaagtttacaattcataaaactaaataagaaatactgcatataatacctaagaagtaaaaactctatctttttgatgcaattagtttttttaaaacatctactattatttaggaacaaaaggagtaataaatttagatttaagacacccaatcttttttttttggtcttcctaagacaataaagacaccaaacatctttttttaaccaaataaaattaatttgtttaagatttgttttcctaaatactgtttaataatttttttttttaattgatttttttttgtcttgatgtaaaattctattatatgaagtacaattttgaaagttagtaactcacgagatcatgacacgtgtcaattttttcacgatcttagatttttgacacgtgtaaaataaattttcctttatttatttagaaaaagtatttataaggaaattaaatttatatatatatacaattttaaaaggtaaagaagacaattataaggaaattatatatctaattaaataaaatacaaaaaaattatttttatgtattatatcatgcatacatgatgacaaaaaataaaataaaatcatgcatacatattaagatcatgcatacgttggaagatcatacatatgttatatttatatgtttacttaaccaaatctttctcatatttctttcaggggtgttattggattctaatttatttcttgatgactttaataaaatcatagaaagtagtgttattggattctattttaaaaagaattttgataactttaataaaatcatgaaactagataaatgaaggattataaactattgattgagagttttttataatcttgttgattaggttttttataatcttgtaaaatttcctaaccaatctctctatttttatgatactactttttatgactttattttgtgaataaaagtgtagaaagcataaaccaataatacaataatttaattgattaacattcaaagattcttttgttttagttgaataacataaaaaaatcagtgattttattaaagtatgaatccaataactccaaattaataaaaaaaattgaaaagtctttttacaaatcaaaaactaataacaagaaactttaataaagtttaatcatattttgattgaataacacaaattctaaataatatttaaagtcattaaaacactatttaaatcccaaactaataattcttctttagtagatatcatcaactaaagcgaaatcttatttgtcaaagtcgtcctatgcgttataactaaattgtcgttttcatggtcgaatacacattatttaagcatctaaaccaccatgtaaggatatcaaaaacgtgtttatgaattctaaaccataaactcatcctcatatcaaaaacatg

SEQ ID NO: 14217 - DNA, 3000 bp, Unknown
  misc_feature (1)..( 3000): cDNA_ID_3022205_gDNA_ID_2214708_Annot_ID_189867 3000 nt of promoter + ATG
agaaaattaaaacgaaaaaaactaatacaaaactacagtcttatagatccagaattgaagtgatatgaattttaaaagaaaatttgatttgtgaaaatagttatgaaaacaaaagagcataaaactcatagataagagaacaaattgacatctagctaactccaataatcgtctctatcttctccttatcgtactccttctcgttcttctacttctttttctgcgttcttcttctcctgcgtacatatatggcttataagaatagttataagaacgtaaagattcttcgtcgtctgatgtttcgtcgtggtctgattgttcataatcttctaagttcgggtaagtatcttcatagatctttgacttgagtagctttgaatcgatgacgttaatatcttctacatggtctgctaaagcgtagaatctactacaatctttctcaaagacgttgtctacaaagacgcagactctactcctattgcccgacgcttcatggtattctccaaaacctcgaatttcaacacattgaagagtattcatttcagggttatagtagaaaatatagaagggttgcttagatgtataatcagccatcgacaaaacaatttcacccgtagcagtcactccaactaccgaaacataatgagccaaaaatatatcatcccacaacacgtaggcatatttcgaccattcatttttctcctcgtcctctagaacccaaagacgcaacttaatggtatcaccatcgtaatcatcataaaaaaccaaacccaactttcctttgtaatttatcagttcacaatagcttccagggtaaagaaagctgaatgtctcatacctcacatcaaagcaaactaccacaaaagaagtcaaaacctcagacgtatcacccaagtaatacacaaccccattgatgcatataccttcactcataatttcatgtcttaaggtacgttttaatcttctccaactcatttctccacttccaagtttcagaactttatgatgatcaggactacatgggtaagccatgatcatgaacaataccttgaattgcttgtcaatcggatcatacccgaaaaagctaaacgcttgtctaaaccttgcaatagcaggcaaggtcgcataatgtcccgttatagggttacatagcacaggcactccatcgtaatcatcctctttgatccgcataccatagaaatacatcataccagacgcatagccacatgaaaaccgtcggtcgttacgaggatagatctgcataccatctggagggaacttcatatgaaattcagcggtttctacaagagacgacgatgaagacttctcatatggagtaagatgctgaggcaacgagaagaagcttcacaagccattattttcgatggcgaataagagacgcggctgagttgaggacctggttaggaacaattctgtgaaatatggacgactaagcattgatgcccattgcttcgacacgcaatgaaacctagcaattgactttgtaatctcaacaatatctcgaggatgagttcattggggatggaatctgaaatcatgatcgttttatttgctggtcgaacacaaagagagagatatgttaaaacgtattatattaagaacaagacaaacctagctaccatgaaaatagagagaccatacctgaaaataaaaggaatcaaaatatgatttttttttgtttcttcaccaaataaaaaaaacagagaatttttaagactatttaaaactcacctaagagacgaacgcagtgtcttcgagggtttggaggagatagctttctagccaagcttaaaatttcacctagattataccaaccagggttttactgttcctaatttatatgtcgtgacaagtagaaaagtaaaaaaacaaaagaaaagaattctgaaaagccttggtgaaaataaaattaaaatagggcggtgctaacctaagtccaaaccgaaaaattaaagtcctaacctaagacttcctacttcttagtggttaataatagttactttgtacgtaaaagaacgggtgaatttttttattgtaccgttttctgtccttgctgatcgacgcaaaccttgttcgtcattcgtattacgggtcactattttgatttgctcatccccttcacgagaagcaatattcgttggaggtgtttgctgctctagtgaacgaggacgagtgttagtaaagttccatgaggctgacctcatttgtttctcaaaagaagctgctcgcctgtgagcctccgagacggttgtagggtcgaattgtgacaaagaattttgtaactgagagcgtaattcaccgatcaatcttgaaacaagttgtgtctgactatcattgatgtcattaaacgtgagtagtaggtagaattcttcagcatattcttccacagaccgtgtttcatgtctcagattttgcaacttgttatacattatttgaaggaagtggctcatattgttcttaaggaatgtcttaagtatgggagagactctgaagcattcagagggtttcatttcatgagttagaggaagagccaggtgagaagcacgtgtgttgactcgttgaagctgcaacggtcaatgagggcagttcggtaatttcggtgttcctctgcaattctttatcttcttcttctcttcttcgattctgttagagttgttgttgagtttgtttcgagagtaaagagagagagagattagagtgagaaagctctgagattgagtgattatatgatactttgttcccattaaagttctagtggattccggagataaactccgacgagatgtagcgttttccggtgaaggaaacgtgaactcgttaaacctctgtgtcaacattcttttactttctttgttacacaaatcgattacaaacaagagtcaagttcgaatcgagtgttagtgagctgagtttatagttcaaatccttacaaattgttattagagcttaaggtcgttaagcggattcgatttcgagatg

SEQ ID NO: 14218 - DNA, 3000 bp, Unknown
  misc_feature (1)..( 3000): cDNA_ID_3022213_gDNA_ID_2214708_Annot_ID_189865 3000 nt of promoter + ATG
ggttaaatattagtttaagtttatgaacgagtttagattttataatttaatgaggtaaaatgttggattcagtttataaaaaacggttaggggtttaaatttaataataaaacaaggttaaatatcgatttggttttataaaagaggaatatagtttagattttgtagttaaacgagattatatgtcagtttggagtcattaaaaattgtttaggattgaaatttttgacaattaaatgtgattaaattattgttttgtttggataaaagaatgattagagattagaaattagatttacaattaaattagtttttcttataattaaatttaagtgtttgattctgatgggtaagaataaaaagggtgaagaaaatgtttagtataaatatttatgtatagtcctaattatgaatttatgtatttggggagtaaaaacataagttgtaacctttaaagtgtaacaaatattattaagatatcattagaaaattgtaatagtgtaacgatagaaattcactaaataaatacacaggtcatgggtcataattcaggtttataaagatctacaaagattacatacagtaaaacatctataaattaatagtcgataaataaataacctctataaattaataaattattccgatctcgagttgagaccagtgtaaaaagtgatacaaatcgatacattaataagataataattttcctgaaaatcctatgtaaatatatggtctcatcaatatcataaattaataattatataaatgtatcaactacatatatatatatatatatatatatatatatatataagaaatttctttgaaattatatttctaatatttgtttgcttaaatttgtatttgttcttatttgaatttagttctaatattttacagtatcaaaaaattttggtgttgttttctaaacagaataattattttttactctaagctacctaaagtatttataataagtagggtctatacagtgtataatatttgaaatgtataagaataaaattatatatagtatgggtactatttcaaaatcaaagtattaaattgacctaaattatgtgtattttaaataaaagtatcattaacaaaaacaacaaaatgatgtttaaattcatgagacggatatatagggtgggacaggttttgatctatatttattcttcttcactaaacaaaacaaacaacaaatacttctagattaaaaatttgaaatttaatcaaattatatataatttaaataaatatattagttgaaagaaagaaaaaaatgatgtttagttatgacgagacgagtttatatggcgggacgagtttggataagacggatttatattgcaagatgagtttggatggaacatgtttggatgaatattaatatgagacaatatactacaagtggaatcctataattaacaatcaaattacaactatacaatcttaaacactattttttgtaatcttttaaaaatcaacattatatcaaaataagtgttaatcttctttgacacatctaaatgtgtaattgtaatacaaacttactaaattacaataattctacaagttaaatctataaacactgaaagttttagttatatatttttgatacaaaaatgtgaatataacataacagattaatattattttgtcttttaagatttgacccgtgatacaccaaaagataaacttattaatattgtaaacttatttctcactaaaaataataaacaaaattatcgagaatcattaatcaacacaaataacaacaaacattatacataaaaattcattttataaaaatcaaacataaataaaatatttgaccacgatatattgcggatcctatcctaatctctctctataaactcctaattcttgtgagaattcacaacccaaatgtgaaatcaatttattgtaaaaccataacataaaaatagaatacatttcaagatccaagtataaatagtcttttttttttttgtcgtactactacgtatggggtgtgttgaatttttggtgttgataatccgagatttgggggatgttaaaagccaggtcgaccacgtgagaactgaatacgacagcgtttcaatcagcgccgaataaaaacacacataacggtgcttattgctgcgagaacggcggaacatttttttttatatttttatttttattacttaataaacaaacaataaaaaaaaacaaattaaaaagagacagagagaagaaagagaacctcctcaccttcctcctctctttgcgcgttttctctcttctctctctcctacggctgttgaaaccaatggcatttctccacttcgccggaatttcgatcggaagatgaatcgtctccttcgtctctcttcgcttaatcgtcgatcttcttctgtcgccgtctaattgcaaatccaaatcgtaaacgcttcttctcttattcttccttcccccattgttatcgtttcttcgctcgatgtgatcatattcgattcttagagttttatcgcttctttcgatgagataatctgcgtttcacatttccagatcatttgattgcgtttgttttttgtgttcattcccgattttgaactttttatatgttttcactggatttatccgcgagcgacggagaattctcgaggacgcattctgattttgaatttgtgttgctcaaagaatttgaagatctaattcatgttttcttcgacgagatcgtttttttttcagagtttttttagtttgattctgcaatgtagatcggaatgttattgtaatttcacgagtatagattggatttatacattgaatttgactaacttggatttcaagtttcagattgttcaaatttagaggttctgattcttgaatgtttttttttcttttaattgtgtatcaggttttttgtatggtatagagatttggtgaagaactagacgcagcttagaggaagcttttatatttattgaagcttagggggaaaca

SEQ ID NO: 14219 - DNA, 3000 bp, Unknown
  misc_feature (1)..( 3000): cDNA_ID_2711121_gDNA_ID_2214712_Annot_ID_136977 3000 nt of promoter + ATG
tactcttcactatgtcttgtctcaatcggtttaggcgtcttaaacccttctcttcaagcctttggtgcagaccaactcgaccacgacctcgataagaatttcgatctttcctcgggtgatcaaaaggacgcgaaagctacccgaaagactcagtttttccaattgtggtactttggcgtctgcaccggcagccttatgggtgtcacagtcatggcttatattcaagacacttttggttgggttctcggtttcgccattcctggtatcgtgatattcctgtcgattttggtgttcatgtcgggttgtggaatttatgtttatgctccgggcgcccgtctgaagaagaaaacaactactacaccttttgagaagattcttaaattcattaaagggagagtagtgaagcagagaagcatatatacacttgcagatgagaaagatttggatgctatggagcttgagtaagttcggaaaaaccacgatatctcatgaaactaattagtcttttaagttttttagcgactaatgattacctgtttatgtaggctagaggagaggcctctctgtaaatgtgagaccgaagacattgagactccttcaacaacctccaaaggattggaagatgacgagagctcgaaaacggttttctctggaattgataatgttaagttagtgattcgccttttccccatatggatgatgcttctcatgttcgcggttatcttccagctaccagcaacctttttcaccaaacaaggtgtgactatgaagagaaacattgggtccaacttcaaaatcccacctgcaaccctgcaaagcacgatcacattatcaatcatcctgcttatgccattatatgataagattttgatacctattaccaagagaatcaagaaaaacggtacaggtatctctgtgatggagagaatgggagtcggaatgtttctatccatcattgccattgttattgcggcaatagtcgaaaggaaaagactagccataagccaaaagatgaagactttacctgattatgatccagaaaccgtcccactgagcatcttctggctgctgcctcagtacatcctcttgggaatctcagatatattcacagtcgttgggatgcaagagtttttctacagtgaggttcctgtaagaatgagaacaatgggatttgctctctacacaagtgtttttggtgttggaagctttgtgagcgccgcactgatctcaattgtcgaggcttactcgagctcaacaggtgaccgacaaaactggtttgcagatgatatgtcggaagctcggcttgacaaatactactggcttcttgctcttacaagtacaataagctttgtagtctacatatttctatgcaagtttttcaagagtagcagtgatcaaggcgatgaaaaagaagaagcccctaaatgaaagaagaaaaactttgattcctttgacacagtcgacttagataaccgtttgccataagattccacgaatgatctaactgtagtagtagctttagaactaactagcaaaccaaaagagatagacaactgtaagatttttattcataagaaacagtatcttataatatcaaatgcaaaagattcaacattattattatctcgtgtgtttgattacatatcatcattaatcctcccattgaccaacaacatttctaaaatggacagattcaaaacagacaaaaaaaaaaaagtctgaaactttgatttatacctttaatcatgtgagctgtttccattgagaccaacttctttagctacgttgctctcttctcgaacctcgtcttcttcatcagagtcaagtgtgaaagtacttaaattctccaactcagctccgagaggtcgatatttagaatgatcttgacggagataaccattcttgttagcaatgacagagaacaaaccagtagccacaactaccattagagccaaatgacagttaaattgaagagtagctatagcttttgctcggtgataatcaccgtgtcctttgcacttgatcgtgaaattgcctctgctcttctcgtgaaacgtacagttattagtgatcaaaccggtaaaaaacgatacacccatttgcagaaaccatgttccttgcagaatcagaccgatcccacgacctaatttcgcaaaccgatgcgtgctagagtcggatttgagctcaaaaaccgtggagaagacgcagatggcaatgggcacgagcatgagatcgtaataacgattctcgattccagaaacatctttcttttgcaggtagaacattaagaactcctcaatgaagccaaagagaagcaataaagttgtaatcgaagacggaagtgcaacaaagacagcgtttttggagttgaccagatatgttagaatggcgtaatataggaatagtactgccactgccacgatctgtaactggatcattgacccgacccgatcgcgagatccgattgagctgaagaaggagaaaaacgagttcgcaataaacagagacgaaagcaaagctacggggatggaagatgatccaacagattttggcggcgaagctctgatctgagccataggggaagatgaatcagcagtaccagaagatgaattcggatccaggttcgatgagtccagtgactcccacgcgccgattactgcaaatccaccgccggcgacggcgtaacttaatatacccatgactccaatcttcacaatctctgcgaatcaggttatacttctttcgaggaaatttggatttttccgccattaaagcttaacagaatcgagcttctgatctgataaaccggaaagatccgacccgacccgaataacccaaaatgggataggctagtagcccaataactcaatatgggcctactggggtcttcaaatagttcatgtttaaatattctaaccatcacgtgacaatcatgtgacctctatggatatgctgctgctgcatatagctccgcttgcgtaatccagtttgcttggagaa

SEQ ID NO: 14220 - DNA, 3000 bp, Unknown
  misc_feature (1)..( 3000): cDNA_ID_2181660_gDNA_ID_2214712_Annot_ID_189912 3000 nt of promoter + ATG
cacataaaaaaatacgtatcaatttgtgttaaaacgttaaagaataaagtattttccaaaaaagaaaaagaaaaaagataaaataaattttgctgccagtaaccgaataaaagaaaattaaagcatccataggaaatgacgtgtatttatcgacgtggaaaagaacgtgagacacgtggcagtatatatcagagcgagagagaaggttgatgcacggaagctgttcccttttaaaaaatttggtgcaagtctacgttgtggcactcactcacttaataaactccacttttctccaaagttgattttatcatcctttttccttttttaaaccattattggattcttataatttataatccgcatgaacatttaattaccataaattaatctctactgtatatcgtctttagtagttaattgtaatttcatcttaggtattttaagtctttctgtaaatcgccaaatattccggaaactatatggttctgagaccatcttatcttttactctcttaattatttcctacttttctatttatagagttaatactttgatagtcagaaagtaataaatctttatctctcttaatttttcaaatctctgctcagtttataatttctaccttctcattttctccgtactctctgcagatttggcctaatatattaagttttttttaaaaaatatatatatatatatatatattttttcgtgactggaaaaatgcagatctaatccaacaatgataagcctctttgataataaatttcaaacaatcgaggtatgagaggaaaaagaaaatgagtcctggtttggtaactccttggatattgaggaacatcggtttaaggccaacctaaagcttcgatggatatatttgcatcaaagattcgaataatggctcactgaagagcaagtctcggtaatacttttgctctaaacaattcgatcttatctcattcctctcttaaatccaccctataatggcaccaccacccacgttgcataagtttgtatataggtgtttctttcacaattgttttttataaaaaagaaaaatgtttttttcaaagaagaattttagataaatttaaaaacctttcgacaaaaaaagaaagattaaatttaaatattcaaaagaaaaagaccttaatccccaaagtcggtcaatgaggcaaaaaaaggttgttcaaaaaatgatagcacacttttaatggatttttgttttttgtgtcacgaacactttgaatttaaggaactaaatcgtaagaattgaatactataacgttccactacagtcagttttacaactatagaacagtttaaaaaaaaaaaatttatctataattccttaattacagaaccacctacaagtgttaatatgcatccgtttttatatgcgacgcctggcacgtatagagaaaacgtgttttgttcacgtattcgctattcgcaaaacgtatgccacgtgagatctacatgacgacatacttacttgtattgtatgtaacctcttcgtacatgatacctactaaattgaaatttaagtttgcttgaattttctttaaaaaacaattctaatgaaatttatcgaaatagaactatcattttttgtaatcatattaactttcatgagcttttcaattcgatactaattgctactaaatgagttgatctatcattaatatattactttagactttttgtattttttgatgtggaattctaacaaaccaaaaataaattaagttaaaatatagactaaacacttatcacgaaatgagctcacatcaatattttgataatcaaatgattttttctttttttaccaagaacaaaacgtttaggaaaaatagagaaattagaaacaaagaaacaaaagaacaaccttgtataaggaaaaagaatcgcaaaaaagggaatgcgaaaattatgtatataaaagagtatcaaatacgccaaatgtaaatgaaaggaacatataactttaattatagttatttctttttcatattgtacaagggtgaaggatgaattcaatgtagctaacagatagaaagctaagagctagatggtccattttagtgatatatactgcatgattttgcattttatcgacatatttataaaaaatttcctctttttctttcttttgtaaaatacgttaaacctcaatttaattaaaagggtgttgacctataaaaaaactaaagggtaagagatatataatagacttaatagtgtttaattataatagaacaaatctgcaaaaaaaaatggtttgcgcaacggttattaaagatataattcaaactagggtgcatacaaacctattgaatttcctaatctacttaaaccaggtttcatttaaaccattttcatgaaactttccaattcacatatttctttaagaattcaattagttagtttattttggttgacatctacaatgagtgtttttttcccctacataaaactccatcatttggtaaaaaaaacttttactagcttgtacctttcttcgttaaatgtttaattttcactttttaactcatccgtattttacaaacgaagagaataaaaatcaatttgaagtgtatatttggctatatacagttttagtttaattcgtataaaattggaaaacacatcttttgaagaaacagaagaagcatggtaagaaaagaaggaaaaactatttaataaatacataaatccacccacataggtgtggagacaaagatatagaattccaaatatggaaattaatctctgccattagtggaagttaattctcataacaccgaaaagctaacgattttcaactttttttttttgttactcagaagattttaaacctttataaatacgaaaaaaccaatctcacaaatcatcaacaatcaccttgatctccactctcttacatataaataaccaaataatttctctcccctcttctctctacacacatagacaataaacacataaagacagtttcta

SEQ ID NO: 14221 - DNA, 3000 bp, Unknown
  misc_feature (1)..( 3000): cDNA_ID_2181693_gDNA_ID_2214712_Annot_ID_189901 3000 nt of promoter + ATG
cactccgcagatgaatccaacttttcgggtagagtttgaagtaccttgtgaatatgaaacacacacggcttgtttagcaagaaacatttccacgtttaaaaaaattctgtttatgcgtttttgtttgcgctatagtcataagaatgggttttctcgttgttaaacatttgaaatatctcttgggcaagatttactttgtcaaagtgtttataaatgttatcaatggatttggatgccttgtttttcaagaaatttattgaaaaagaatcctaattttgatttgagatggtttcttgtaacccaatctcccctagataaacctaccttttcgccggtggctccaaggaggaaatgaatattagtggcggtaaggtatttgccgtaacagctttgaagacggatcacattggatccaggtacgatctcaaccgtccatctagtgttttttgttgtgccgcgacgatcttgatgaacggattcttgatcttcatcggcacttaggtatttgtcgttgtggctacggagacgtacaatcgttgcctttctaaatatctccatccgagaacaataatgatctctttctaaaaaattaagaattaggagacaaaaggggatggatctataagttattcttcattatcgtgatgcaacgtaggctaatatggtttgttgacctgagtcttgttttttaattcgcttgatttgagtcttttatcgttaatggtttgttatatgtttgatccatgtcaaaagtttgttgaaccgtgggattaggattgttcagattataagaccagatttctaaatagtatgacaactccgaagaccagattctgaacctcttccattaattgaactatttggttaaataaatcaaactgttctatttgtttctatgattccatctctgtaaacggtcaatgtatatgtgtgagtcttttataattcgaatcttctgctcagatatatgaatttattctcatagattacaagaatctctgaagtctgacatgtgaatttctcataaaatcatcaccgcagaagaagaaattatccaaaacgaaatttgaaggaaaatactaaaaaatcgaaagaaaagaagagagatcagagtttggttaagaattttttcggtcacggttaatctgaaacacggaccaatttgttgatcatcatatctctcgtttcaaacaaaacaatcaaaacagaagaaaatcaaatcgaaaaagatctagttgaaaacgattaagatcatcagagacttaaatactaataatcacaaagattactccatcatattgttgcagtattacctcatcacctgatctcaattttgcattatctatacggaccaatacatcataactcgaaaaccaaagatctaaagaaaactaaactgaagataaaatacgaacttgaacagagaaccctaaactgacttgataagagcttgatgtctgtcaaagtcatgtgtggtttgtatataaaggtccccaatggcggcgattcttaggtttctcgaggaaaaccctaacgcttatgggtcgtatatgagcttcataaggcccattataataaacctcttttgacccataaaaaccccaaaccaatactcaattagcttatatggatgggcttgactgaaaatttacaacttctcatttttggtttgattcaagaaaaaacaaaatattaattttaaaaaaaaatatgtacttggaacaaaataatttgtaagaaaatctacatctatttaaggcttgaagtcattggatcctattttaatggaagacaagatcaaaatttatatcctttttttggggagtagatataaacttttaagcttaatttagcatgttttgtagtaaatccaaaactggataaaatctaatttcaaactcaactaattctgttcattttatctttaaacaagttcaaacacttgaaacaatagcttcatacatacgcaaaagaaacaaacacacaacaaaattgatagaataaaataagtttggtattaaagaagatataatcgtaacaagattcaaaacttaagtaatgacatcgctacaaagatcagctgtttcgttccgacgtcaaggttcttcgggtcgtatttggagtgatcaattcatcttagatcaaaaaaatggagcaattcttcaaaatcatctagaacaaaccggaagaaatagtaatgatcttgaagataaaaatccatcacagaaatcaagttcttcgtcatcttcttcatcaccacctccatacttttctgaaatacgtagaggaccagacatctcatcttctacacgaaacaaactcgcttgtggtttatcatcacttttccgacaatgtatcggttcttcggctcgtgcttaattttgttcaatgcttgacgcaaatctgtacatatattttcttgttatatgaaaaattcatcacaattttttccgaccaaacagagttcttgataaatgggcctattattttaaaaagcccaatagatatttgagtgtccggcccaaattgaagtagaataaaagataagttaccaatttaccagtagttagcagcaaacacacagagaaagtgaaacatcgaagagaccccagaatgcaaaatctctctccgcctttttctccttccttattcgaaaattctcagcgtctttgttgcaaactcctctgaaattctccgtcttcttcattcgttttcgactctgcgttctactacttctcgtctcctatcagtatcatcgcaattcatattcagtctagtgtgttaaaccggagaatttggagtctcgccggaattttcctctgtctatgtatgattgccggtgatcaaagcgcttcttaacgattctgttctcctttgagagatctgagtatctgatttcatctactacatatgttttctcgagagtgatagaaagtaggtctcatacatatttttcctctggagggaattttgatcctctgcttcgttaattaacttgtg

SEQ ID NO: 14222 - DNA, 3000 bp, Unknown
  misc_feature (1)..( 3000): cDNA_ID_2711093_gDNA_ID_2214712_Annot_ID_189923 3000 nt of promoter + ATG
tgcagtttgatttaccagtcggggaacacatcgggagaagcacgtggatgcttttgcgcggatccgaggattcctattcttgagaaaaggttgaagctttggcaacagcaaggcaggagaaacatgtgcagtcattgctactaatgctttttctgctgcttcacaaacaaatcgcttgtcttgggaagatttaaggaggagttgagtaagctgtaagaagggaattcggagttactgttataagaacacacaaatgtccgctatttgaggagaattccaagagtatctgcaaaagatgatttaccaagagatccaattgatcgattgtatggtcattatatgagctgaagatgtcagcagatgtcatacatgcggttttacttacagcacttcttgggttcttcagtgatttcacgataaacaggatcactttctccctgtaagagctgacagcgtgagactagaaaattctctcgacgtgtaactcgctctactaaaactgatcataatcacgagtagaaagaaaatgacttacagcatatgcagcatttcttccttgtggaatatggaaagacgacgaatggtattaagagcatcacagaccaaaacccaatccttggagtctagctcggttacaagtgactggaataataaagaaagcagttccagaatggtattaggtaaacaacttacttccaatgtccaaattctaaacagatgaatataattgcaaatttgcaaggcagcattacaaatgagaattcacagtaaagcataggatactagcaggaaaaaacaattgataccttgagaactgcatcaacttgggttacattgttcaagtctttggattctatatactcaatttctacgataactctctctgcctcaggtttctcaatctcatcgcctttaggatgattgtgatcaaaggggacagagttttgtggtggtttatcttcagctgttccattcattttgccaaccaaaagctttgttttatagtcgatattcctctcagagacaggaagattcttcaaatcttttaaagccttggcagccatgcgtacctgaaaagtaacaaagaagacgccattataagtacaaacaacataagtttagcatctgcgattacaaaaccaaagataagattatagatgaattttcgacctctagcttagtattaagtattcccaatgaaaccctttcaaagtagaaatggtaagataaacacattactatgagagttcaacagcaataacattaaagagcagagatctatctacattcccaaatcttatttcaaacaattacgaaatttactcaaaacaaaagcaaaaaacctcgatcccactcaaggactctaaaaagttcaaacaaatcctcgcagtccgaaatctaactccggcgccgtaaactactgcaaccgcgaaagatcgaaaacgcagaagaatagaaaaagtagcggcgagtcaagcggtatcgatgactactaacttgaagagtaaatagtgaagattatttgactcgcgtacctctataaattcgaaatgccagagaaaattcagggagagaaagagtcgatgaagacgacgaaattgatttccggccaacagttcgcaactcgtagtagagtcgtcgtagtcatactcgtttacaccgacgtcgttttatggatccaacggaggggacccatttgtacggcatatcttgggcgaaattaatgtttttcttttccttctctctgatacactttggttggttattgtaaattcctcaaataccctcggactagatatgcatttttatttttatttagatatggaattggtatatacatattttttaatacgtaaaaacttggattggtgtggaaatattttattttctactaaacgaaataaattgaacgtataaagtacatcacatgttacatgcactgatgcacatgaggagtgcaaatttgaaaatataagataagaaacatgttgcaaagctgccacccaccgtatccaattgctactatttgtatcaatcagttacaaactgaaaaccaaaaatgaaatgactagaacaaataatgttaaaatgcacattgaaatagttaacaaggaaagcatacattgatcgataaaacgaatccaccacgttccaaaatattttgtcgcagatgttgcagacttgtagctaagttgggccggtagatgtaggtgacaagtgtttacaaatctgttaactgtcgctgtgttcctcctacttttgattttgtgttacactattcaaaagttggtcgactcttttaatcggttgattagactagtacttagtaaaatttgttgttaaaacttaaaagggagaagaagaagaagaatactgctttaattcttaattaatttttttttaaaattagtagtatcattaacgtgtttattacaccttcctcgagttactttcctcgtgatgccaatggtttttttaattctttaccttttcttctgacacagagtcacatatttgactacggaggagatctattgcttcctagttcctacttatctttatcgcgttgtaccaacatcaatataaaagcaacatcttactttataaacttccgtaaatttgataacaagtacaatcaagtttaaatttttctaaagttaacataaatttagcatcatacaataattaacattttttttaggttaaacttttggtgcgttacgtgagtagcagcatcttcgaaaatatgtttagtagtagtagtgataggaattaggaaaaggcacacacaaaaaagaaaaaaaaagggtaaaaggattcattcacgtttttttgttttctctctccaaacagaacttcgggaaaagtggacaaaaaaaaagaaaaaaatttaataagaaaacctctttttctcgcaatttggttttgttttcaatcttcttcttcttcttcttcgtcttcaatgcaaacaatgctcgattccattaacctaatcgaata

SEQ ID NO: 14223 - DNA, 3000 bp, Unknown
  misc_feature (1)..( 3000): cDNA_ID_2711101_gDNA_ID_2214712_Annot_ID_189921 3000 nt of promoter + ATG
gacagaataatactcaatagtcaatactaatttataaaaaaatattggaagaagaaacaaaatgccatctcattttggtctcacacacgacaacataaaaagtcgagcgcgtggctttcacttgttatcaatgtcgctatcgaaatcaattgagcatttagtggaaaccggtaaggaaggcgcagcgaatctcatcgagtaatctcggtacgggaactcgtcgtcaaaatgtccggtttgatttccgtcatcgaaatttaacgagtagctcaactgatcgtaccggaatttaccctgatccgatgaccggttaggcattgcaccacctccgcatcctccgctgctgtttccgactctccctcctcctcctccacagcagttgctgcgtccgaaccggcggatatacgtcttccatctaggtccagcgacgagctccgaccactccctcatcctccgccaccctcggatccaccatcgctcgtcgggttcgagtttgtcgacggtcgtgatccgttgccaccacacagatccgccgcgagttgatggctgagatgaggcaaggcagggcatgaggaaacaacaacctcgcttcgcgaacaacgcctcgtgcatatcgtcggtggcatcaacttcagcgatcggcggcgattgatgactcattctcagagagaaacagaaacgaaggaaatatggaatttcgtcctgatctagctactctcttttgtctccttagatcgtcgttcctcttctcatctccaactctaaaccctaattttctccctctacccaagagatttctatcaccttctccaatcaacgcgtctcttgagctgtaactaaaacagaagagcacaaaacggcgtaaccgccaacccggcaatattggttctcattaaccctttttaaccgctttggttttatcacatctaaccgggaatttcagctgttgatgctattaatttattaaaccacatatgaatgaaggggttcatatacgtaattgacgttagcacatttggttccaagtattgatcgatacattaaaccgcaataaaattggtccgtttctctctggcccaaaattggttcgatttctccataagctgaaattgataactcccagtggatgtaatgtatctaatattcttggaacagattcattgcaagtgaatgttctaaccaaaatcacctaatctttttgcaaaatctaatatagtaagtaggataatatcttacttttgcaacaagccactcattcgtaaaaaccggacatactttaatgggataacctacaagtctacaactcatctggaaactatatcacaaccgatggtttagtatagttcttcaagtaacctttttatgaataccaatatcaatcagaagaaggataccggtcagcagtttgtttcagatcttcaagctgcgtgagaacatattcaagcttctggaagcagatctcattggctattctcgcgttgtaatcgcatttctcaaagggacggtactcgcaagcgcttttgatctcttcccttagtgtcacttgtatatcctgcaagtttcacaagaacttcatcttattatggattggcgataacattatagcacatttatgtacagtcaaagatcaacaagttcatgaaccagacaatgaagctgatatcttcaaactttatgattatctctagaaaaaaagcagaatcaaaagctttttacttgttcacagaatgtaatgatccctaatctagacatgtgtcaaatgagagcccaaatgttctttaaacagtgagattccatccaatatgaaaatatcagcatccatcactcataaaccttaagcctaagaataaaggatcaatgtcaaatcctaagaaacaggaaaggaatacaaacctagagattgtgatacatgaacccatatgttaactagtcacagaagaatcacaaaacgagaagcagcggccatcttgaagactaaaaccaaaatcaaaattctaaacaaagcccttaactttgatcaggaaatgtaatgaaccctaatatagacttgtgtcaaattagcccaaacgatcaacactcgagaaaagataccaattccccagagagattgagtcagcaagaacactaatctagctagacttgtgtcaagtgatccccaatgttctttgatcaggtagtttattaatacactaatgcaaaagaaatcagaaaatatttgaagaagagatagagtaagaaaccttcatagattgcataaactctcggcaatggctgttgacgaactctttcttgggaccagaagggctcgcgagttcttccatcactccaccagctagttccaaaaccttaacaactctctgcccggaaaaccaaaaataaaaacacaaaaacacattcacatcaaatcgtccaataaaatctctaaggaaagagtgagttttccaaaatttcacattctcaacattctggagtcgctgcaacgaagtgttctgcgtctgcggatccattggactctccacgatttcttttagaccagagagagagaactccaaactgagatatatcacaataccgtcaaatccactcatacacataccctaaatactcaaatcggagcagtgggagtacctcaatcgaacacggcgacgcgagacagtgaagatggcagagacgatgaaataacacggagaatttcgattggaaacggcgtgcttatgatcagcaacggagggaagattttggggaatcggcgacactcggcaatacagatcggtgaaggaaaaagcaaagaagatacaagttttttttgtcacgtaaaacggcacgaactctactttatcaattcaggaacagcgagtagttaaaatattgaattacgaaaacaccccttggttcagataaaatctttgtgatggccgcttttctcatttataacggataaaaaccgtaaacaatacacaagaacagaggctgacacctaaagcttactctctaactgca

SEQ ID NO: 14224 - DNA, 3000 bp, Unknown
  misc_feature (1)..( 3000): cDNA_ID_3022296_gDNA_ID_2214712_Annot_ID_189920 3000 nt of promoter + ATG
gctgccttgcaaatttgcaattatattcatctgtttagaatttggacattggaagtaagttgtttacctaataccattctggaactgctttctttattattccagtcacttgtaaccgagctagactccaaggattgggttttggtctgtgatgctcttaataccattcgtcgtctttccatattccacaaggaagaaatgctgcatatgctgtaagtcattttctttctactcgtgattatgatcagttttagtagagcgagttacacgtcgagagaattttctagtctcacgctgtcagctcttacagggagaaagtgatcctgtttatcgtgaaatcactgaagaacccaagaagtgctgtaagtaaaaccgcatgtatgacatctgctgacatcttcagctcatataatgaccatacaatcgatcaattggatctcttggtaaatcatcttttgcagatactcttggaattctcctcaaatagcggacatttgtgtgttcttataacagtaactccgaattcccttcttacagcttactcaactcctccttaaatcttcccaagacaagcgatttgtttgtgaagcagcagaaaaagcattagtagcaatgactgcacatgtttctcctgccttgctgttgccaaagcttcaaccttttctcaagaataggaatcctcggatccgcgcaaaagcatccacgtgcttctcccgatgtgttccccgactggtaaatcaaactgcactcgatatcataaaaccagtcttgttcttttgttttggatttgtcatgtcatcaccatgacaaccaatttggatccagtccatgttcccaccaacatcacctttctttggctgtgtaatcattagggcattgaaggcattagagaatatggaattgagaaactagtccaagcagcatcgtctcagctcagtgaccaactcccagaatctcgggaggctgcacgggcagtcttactggaacttcagacagtgtacaagaaaactactaatgtcgaaccgaaggaggagcatccagagccagtcacttggcaaatcttctgccaatcaaacctctcacctcttagtgcacaggctgtgatacgtgtcaccaatgtcgcaggtgtggctcgagagggtcttgttgcgggttcatgacagtcacaagccctcagtttgatattgtaagcctctgtgagtaaacgttgtacgaccactgtttctctatctttggtttatgggtttgtttctttattttgtgtgtgaatatgtcgatgtggtaagataaatctcaacgactcaaccgttagttttaggcaaaaagttagtcggtttatttgatatatatcatgttttagtctatattacattggttttcttaaaactttttttttttttggccaaatgttttcttaaaactaagatttcaatattaaacatttagtgcatatactcttctttctgtatctttgattgaaaaattaaaatccaattcgttataaatttgatcatattttggtctatacattacattttttttttttgattactagatctcaatatttttccgcaaagattacaatttatgaccacagagttatcaaccatgtaggatcatcaatagcaagtaaaccggtataaaccgaaccaggatcatgccattctggtcattacctcttgaagaagaaactttgtatctttataacacgattccgtctctgctaagttcttcgtcttagctgcatcttcaagctgtgtcgaaacaccaagaaaacaacaaataaacatataggatatatcagaaaagagaagaaattttaaaaaaacaatagtctcttcggtttgaacgaaccaggacttcattagtacacttaccttttcgaaattgtcgaacaatctgttggctaaatcagtgagaggttgcttgtcttcagaggcagcagcagagatgagattgtcgaaatcgtaaaacaaaaatgtggatttaagcctcaagtactttttcacatagtttaaagtatctggtccgatcaaatcctccattgccaagagatcaaaagcattctttttaactctatacattcttcctttcgtcccgatatccgctacatacactcctttctttatgaatgttctcgttcccgtcttctcattcacgatatctgtatattcaaatcgaggacgaattcaaaaccggaaatcaaatgattctaccaaatcgaattctcatcttgaatagttgtatggctcaaaatgttcaaacatttgaagaaagaaaacaatcaagaatataaaatggcgcttactgttgtaaataggaggaattggaagaggaccatcaatccaaaacccattgtcttgtgccaaggaaacattattttcgccgagaattccggtaagacctattgagacagcaaatcctaatgtcatccgtcttgtgatctgtaccgaatccggttcttgaaattcttcagttctcctgcaagcaaacccgctggatttcccggttttacgactctcgggtagtttcggaagagacggtaaagtgttggtgagactgttgaggtctatgaagtgagccattgcagttagagagtaagctttaggtgtcagcctctgttcttgtgtattgtttacggtttttatccgttataaatgagaaaagcggccatcacaaagattttatctgaaccaaggggtgttttcgtaattcaatattttaactactcgctgttcctgaattgataaagtagagttcgtgccgttttacgtgacaaaaaaaacttgtatcttctttgctttttccttcaccgatctgtattgccgagtgtcgccgattccccaaaatcttccctccgttgctgatcataagcacgccgtttccaatcgaaattctccgtgttatttcatcgtctctgccatcttcactgtctcgcgtcgccgtgttcgattgaggtactcccactgctccgatttgagtatttagggtatgtgtatg

SEQ ID NO: 14225 - DNA, 3000 bp, Unknown
  misc_feature (1)..( 3000): cDNA_ID_2990679_gDNA_ID_2214712_Annot_ID_189919 3000 nt of promoter + ATG
ggaaatcaaaccggacattttgacgacgagttcccgtaccgagattactcgatgagattcgctgcgccttccttaccggtttccactaaatgctcaattgatttcgatagcgacattgataacaagtgaaagccacgcgctcgactttttatgttgtcgtgtgtgagaccaaaatgagatggcattttgtttcttcttccaatatttttttataaattagtattgactattgagtattattctgtcattaccaatgtaattacaaagaaaagcacctttcatccaagaaaaaatttaaatatagaaataattaaacaatttttttttcaaaactctagaaaaaaataaaaaattaggaacatagggagtaaaaattttcaaaccatcaggaattaggttcataggatttggattagggtaaagcgtgtaagaattagtgtaacactaagattatcaggatttggattagcgaaaatcgtgtaagaattagtgttccacaactacaaggatcactcgttgatctgtttttttataggatcgcttgtgtagccacctctttctccttttatggaattcatgatgatatatgatcaatttttctctgatttttgtagttacccgtaaccatccatatttgcgactctttatttctttgtcaaacaaactacaatcttatcttttcttttgaactttttttctgccacgtatgtttccttgtagttgatttgatcttaccctatcatgaatttggaaaaagtttaccttttcgagggactctatatatatttggaaatcactgacatcatcaagcactttcaccacttttgtagattcggaggagtagaattgctcgaatgtaatttacctgtttcaagtctttgaattggatttttagtggtgcgtttggttggatcgcgttaggcttaaggcagtaggctatcataattttttggtggttgaaaagtaatgttgatagttcttgtgatagatctagtgtgcgcgaccatatggtgtttacaattttttcatattaattagtccatggaaacatgcatgacatgaccgaaacgaacttttatataaaatgaccaatttatataaaatgaccatgacaattgaatcttaagtgaaagaacgaagctattttaacccaaacgatcacgtgaaaattttatttaatccaagacttatctacatcttaatagttgtcatttgctgatgtttcacatttagttatcaaattgttactctttgatcttttatttattggatcaaatccagttacgtataatttgtaaactccgacatgatcttcttcgaatacagttcacattccacagagaaaagatcaaacatgtttggtatctacattataataatacgtgacgtctatttataatttggtttttattatatagacgtcatatatagttgtcaaggatatattaattatgaacctggttgaataaccgaaaagaaccctaatcccaagagtttacttgtatgacttttattatgatgaaattaaacaataaatcataaacctataaatttagaattatcaaccaaaacttaagtcgtacgtttgagtatatagacgtcatattaattataaacctggttgaataaacaaaaagaaccctaatcttgaattacttgcatatatgacttttattatgatgaaaatcataaacttaagtttagaattctcaaccagttaagtcgtgttcgaatatatagacgccatagttgtcaagaaaaatattaattataatttataaacctggtggaataaacaaaaagaatcctaattatcgaagagtttacttttattatttatgataaaaacaataaatcataaacttcgagacgatttagaattatcaaccagtaaagtcgtgcaaattaagcaaccaaacagtggtaaaaaaacctattgaatattgtctggtcaaccaaacttcaggtgtcgaaatttttatatatactataatttattggtattaattaattttgagtaacacgcacgaaaactaacagaaatggtattattttaacatttcatccaagacattttgagatttggtctgtctaatatagatatatattataaagacaaattactagtacatacatagatatctttaagagccaaagattcggacgttttctgatatacgtgcagagagagactgattcaatataaaatgttcaaatagtataaatcaaaggagtagccgagtaggactaaactaactaatctaacttgtctacggaaacataaaaaatattagattctaacacgtacctgatgatggctctatatatcaaacttattttattggatcattctttttccttattttgaagcaaaatggcaatcttttaatctttgattgtgttcaagagcggaccttgggtaagggaggaatgggttggttaaccaacccccattaaatatatacatatatgctttaatgcatgtagaaacttaatttttcttaggtgatgacacccccactttagaacaattcagtaacagtttctattatataactatttttgagaataaaattaaggttcatattaattcgagttgcagttaacttttataatagataaccattccgatacaacacaggatacccaaaaaagaaaaagaaagcgtatgtttaatatttgagacttgtgtttatacctcaatgataacgcagtgacatatataaatcacaatgatacaaagttaatgagtcacattttcaaaattttaataacaagaaaataatgataatgacttttgtatatatatattttttcaaaacactcaatttgaatagtcttctctttttttttatatatatcatggcttatgctttataaataggcaactaacacactaaggttttcttacaaccctcgcaactctatttaaacatttatcttgtgacgtttcacataacaagatatatctacaataaccccaagaaatttaacagaatg

SEQ ID NO: 14226 - DNA, 3000 bp, Unknown
  misc_feature (1)..( 3000): cDNA_ID_2994430_gDNA_ID_2214712_Annot_ID_189918 3000 nt of promoter + ATG
actttattggaacccttttatgcttccctatatccttctttatcatctagtgtttgatcctttggatgaccactatatcatgcatgattcccaacccgatataagtagagtgtcaaatacttataataattattaatttggcttcacaatagttttacaaataaacaccaaggaaatcttttcctttgtaaattacaaacaaatctttcatattgtaatgggctcggttgttaaggctgataagtgatatgtggttttttattttcttactagagtacttgtttcattattacgactgaaaatttattcacattatgttgagagaaaggaaaatataataatataatatatggatttcacaaatatgtttggggtaacaaatattgcaccaatgttgtatttgagatatatttgtgcgcacaaatatatacacgttcgacagaacatgtgattcaataagttgtttgtaatcccgttttgttataataaaaaataatgtatatgatataaactttcataccatttgaagtacttctttcattattaaaactgaaaatttattcacatgacatcgagaaactgccagaatgtgcaaaacgttttgagtttgacattgacattcaactacaaaatagctgaaaaacagttatacgtccagatttattttaaatcattagaaagtagaaacgacttaatatatgatgtgttaaggttttaatggggtttaacagtgtctatatatgtatttttgatattaaattaaattttattttatcaattttgttaaatagtgagtttgatagtaagtaaataattatatatatttatagagtttaagttagaaaacgtgttaaattggtaaacaattatcaaattttgatgggatacagattacattttgaataaaataagataaatattgatttttcatggttttaataggttttttatttataataatgtctatataggtatgtatttgatgtaaaatcattaattttattttatccattttgttaaatagtgagttggatagtaattaaataattatgaatatttatagagtttaagttacaaaaaatgtgttaaattggtaaaaacaaattatcacattttgattggatacagattaaattttgtataaaagaagataaatactgatgtgtcaaggttttaatggtttttattaataaaaaatgtctatatatgtatgtatttgatattaatcattcctttatattttatcaattttgttaaatagtgagttggatagtaattatatacttaattatgtatagatttatagagtttaagttagaaaatgtgttaaattggtaaaaatttatcaaattttgattggatacagatttgatcaaatctctctttatcacctttgatttagtataaaataaaaccaatatacattctagacatataacatttatagtttgagtcttctttgtagtattgtgctcctcgtcttaattaactaatcacaaaaaaaatgaaaggtgaaaagagagtcaaagaagtgatttgtctttatagtcgtggattatactatttcattgccttgagagtatcattacaaatcctcttagacattgaaccccctagctatatgcccgtatacgtgtaaggaaattcttgttgtatatagatttgatttgaagtagttatttggatgatttttaattgtattatgtctcatcatggccagatacacaactctgagggctgcgaatattccatacattggtatggtaatttggtgcttgtgcaaagatgttctagtcccaagatatcaactaggaccggaggggcgggcattcttcttcttggccgtgatgatacttatgtattgcatctcgtataatgtccaaggcgtaatgagcagagtagaggggtccataattggcgtgtgtcttatactagcggggatttcgatcgtgcaactctcttgtccaataaaagattttacagttacacatactctgtccaccacttacttaggagctctgtttgcaatcctcggttggttaggcacatcctcatggtcctactttattggaacccttttatgttttcctataaccttatttatcatctacatgttggttgatcctttggatgacaactagatcaggcatgattcccaacatgatatgagtgacatatatctataataattaagatggcttccaatatttttacaaactgtaaacaccaagaacactgttttccttcgtgaataacaaacaaatctttcatactgtgaagggctcagttgttaaggagaattattaagagtttaagaccttgttataaaatagctatatgtggttttttattttcctactacagtacttaagtacttgtttcattattaatgtcaagaaaacttgattcgtataaatcgtgttcttggggtttaagttacaaatctatctgccttatatattgactacaactcaagtatagagcttaacttaggagtaaatacttaactaataatccataactaataattcttaatatatatatagagagatcaatattcaggctgctaaaatataattggaaattctaggttactcatgaattttgtgtaagtggagtataacttgtgaatatattaatgtaatttccactaaacggcaagtagttttatttgtgtgaaatggaacggcaagtagtttcgttcgtgttgaaaccgtaatattctattgggctttttcacacggaagcccatctacatattttttctcgtggtccgttgttgcatcgcaagagcactaagtttgaaattcgaaaaccaaatcgtctctctctcgctcgatgcgtgttgcctgttcggattctggatctctgttgaattgctttctggggacttgttttagtttggtatttgttcgtttggcttaggttttagggttctgtgattttgataactcggggttttgttgattcctgaagatttgggggattttagggttgatg

SEQ ID NO: 14227 - DNA, 3000 bp, Unknown; identical to SEQ ID NO: 14219
  misc_feature (1)..( 3000): cDNA_ID_2711121_gDNA_ID_2214712_Annot_ID_189914 3000 nt of promoter + ATG

SEQ ID NO: 14228 - DNA, 3000 bp, Unknown
  misc_feature (1)..( 3000): cDNA_ID_2711117_gDNA_ID_2214712_Annot_ID_136978 3000 nt of promoter + ATG
cacaacactctcctcacaaagctgtagcaatatcgacacagccatctctttctgtctctgtgttcccacctctactatctccaccagcaccggaactcctccttcctccacaatcgccggtttcgattccggcaccgacattaacagactcatcacaaacgccgatttatccaccatgtttgatccgaaatccgccatcaattcaacaagcggcttcataattcccgattgcacggctctgattttgttctctttagctgagcacaacgagtacagagccgtcgacgcgtccttcttcgctctgaatccgcctgtttctagaaggttcaccaacagaggaatcgctccggatctcccgatggcgactttgttctcctcgatctgcgatagacggagcagagcacaagcagcgttctctttagcagtcggtgttcccattttcaaagccctgacaagcggcttaatcgcaccggaagaagcaatcgactctttgttctcgtcgcagagagatagattcaagattgcagtgacaccatactcctgaagctgaagatccgaagaagagatcagagaaatcaacggcttaatcgcaccggccttggcgattttgatccgattctcaggtttgttcttggataagagcctgatctccatagcagcttgcttctgctcatcgatcgaataggaggaatcaagatgcgacacgagatgattgatgagatcatcggaattctcagaggcgcaagagaggaggagacgacggctctcggaggaagcagtggggaattcgccggatctgtcgctgttacaatcgctgaaagcagaggagtcatcgttgagacttaaatcgctgaatttgcggcccatgtaggtgaaactgccggggcggtgattctccatctccatggatatgagatcagaccatcaatacaaaaacaaagaacgtggatgcttttagtttagggtttggtctgtcttacgagtggtctggtctgtcaggaatatttgtttggaggcaagaatgagctaattcagagtctagagagagagagtggaataataataccttattataaaattaattaatggttttcattcatgtataaataaatatatattttatgttttgtaatggcccggtcccattattattacgaggctccgcgtgtctcatggttactttgggctttttgtagataagacccattataagaatgggcttcaatgtctattaaaagtgggcccactgctgatgttaatcatacaagtaccgagagcagcagattagatagacgtgttgatagatcctcgattttctctcttctctcttgtcctcggaatcaacaaaggtaatgtgtcttcttctcttcaatgcgatcggtttcagttttctatcggaagtcaaactgttttgacttctttcggaaattccggtgattcaacgtggtaggatcgttgttaggatggtgttaagagttttgatttttgtttgaatatcaactaatttatacatggatttcacttacttggtgatcttagattctaattaatccttttttcgggatcttagatctatctgattctcatcccaatttgattttccacttgttttgcttccgacttatggattgctagagtaacagatctgctttgaattatgggtaaattatgtttctctaatcctgttatgtccttaagttagtagttagtcagtctcgtaattcatatgatcggccgaattagtgatcagtgacagtgagattatgtgtaggtttatgagcaaaattttaggtatgttttgcctttatggaagttcaaatttttgttgtttaggttttcctgatgcattattggaccttatatattaacagatttgtttttgtagacttttgtgtaataaagcatggaatccaacagaggtcaaggttcgatccaacagttgcttgctgctgaggtagaagctcaacacattgtcaatgctgcaaggaccggtaattttaagttttttttttcctttgccagtttagttttcatatctgaaactctataattacttgtcaactttagaactgaaagtttcccaacactaatatctacatccaattacattcttgggagcctgcatattttatggaaatgaagttgtagttatgtgtagcacttggagcataatgcataggtttgattatatggcttgaaattgatttataacctgtttattggttgcagcaaaaatggcaagactgaagcaagctaaggaagaggcagagaaagagattgccgaatacaaagctcaaacagagcaagacttccagaggaaacttgaggaggtaaatgattttttaaaaagagaaaattgttcttagacaacctaaaatgtagtgtcctcactctaattatcatattgttgaaaacagacaagcggagactctggtgcgaatgtgaagaggctggagcaagagactgataccaaaatcgagcagttgaagaacgaagcatcgaggatttccaaagatgttgtcgaaatgcttctgaaacatgtgaccacagtgaagaactgagagatatttttataagaaagtaaaaaaaaagtttatgaaaaaagtgggagtcatttttgagtgatctgctctctttctcttttgtgagtatttctggatttgagagactcatcttatattattgttgctacttattctctgcttttttgtaatttatctctgtactcttctttttttttttttttgaacaaccatctctgcactcttctttgtattcatatatttggaacgttgtaataataatttgagcgcagaggaacacaattggattatttatgtttctaaattgttacaaaaagaaataaatctcaactggattgggcctaacttaacttatatcatagttttgttatatcgtaagctgaaggtttgggctttagttctgagaatagtgaacactgaaaaatggagatttaacaaaaaaatccaaggagaaatg

SEQ ID NO: 14229 - DNA, 3000 bp, Unknown
  misc_feature (1)..( 3000): cDNA_ID_2994430_gDNA_ID_2214712_Annot_ID_136981 3000 nt of promoter + ATG
cccttttatgcttccctatatccttctttatcatctagtgtttgatcctttggatgaccactatatcatgcatgattcccaacccgatataagtagagtgtcaaatacttataataattattaatttggcttcacaatagttttacaaataaacaccaaggaaatcttttcctttgtaaattacaaacaaatctttcatattgtaatgggctcggttgttaaggctgataagtgatatgtggttttttattttcttactagagtacttgtttcattattacgactgaaaatttattcacattatgttgagagaaaggaaaatataataatataatatatggatttcacaaatatgtttggggtaacaaatattgcaccaatgttgtatttgagatatatttgtgcgcacaaatatatacacgttcgacagaacatgtgattcaataagttgtttgtaatcccgttttgttataataaaaaataatgtatatgatataaactttcataccatttgaagtacttctttcattattaaaactgaaaatttattcacatgacatcgagaaactgccagaatgtgcaaaacgttttgagtttgacattgacattcaactacaaaatagctgaaaaacagttatacgtccagatttattttaaatcattagaaagtagaaacgacttaatatatgatgtgttaaggttttaatggggtttaacagtgtctatatatgtatttttgatattaaattaaattttattttatcaattttgttaaatagtgagtttgatagtaagtaaataattatatatatttatagagtttaagttagaaaacgtgttaaattggtaaacaattatcaaattttgatgggatacagattacattttgaataaaataagataaatattgatttttcatggttttaataggttttttatttataataatgtctatataggtatgtatttgatgtaaaatcattaattttattttatccattttgttaaatagtgagttggatagtaattaaataattatgaatatttatagagtttaagttacaaaaaatgtgttaaattggtaaaaacaaattatcacattttgattggatacagattaaattttgtataaaagaagataaatactgatgtgtcaaggttttaatggtttttattaataaaaaatgtctatatatgtatgtatttgatattaatcattcctttatattttatcaattttgttaaatagtgagttggatagtaattatatacttaattatgtatagatttatagagtttaagttagaaaatgtgttaaattggtaaaaatttatcaaattttgattggatacagatttgatcaaatctctctttatcacctttgatttagtataaaataaaaccaatatacattctagacatataacatttatagtttgagtcttctttgtagtattgtgctcctcgtcttaattaactaatcacaaaaaaaatgaaaggtgaaaagagagtcaaagaagtgatttgtctttatagtcgtggattatactatttcattgccttgagagtatcattacaaatcctcttagacattgaaccccctagctatatgcccgtatacgtgtaaggaaattcttgttgtatatagatttgatttgaagtagttatttggatgatttttaattgtattatgtctcatcatggccagatacacaactctgagggctgcgaatattccatacattggtatggtaatttggtgcttgtgcaaagatgttctagtcccaagatatcaactaggaccggaggggcgggcattcttcttcttggccgtgatgatacttatgtattgcatctcgtataatgtccaaggcgtaatgagcagagtagaggggtccataattggcgtgtgtcttatactagcggggatttcgatcgtgcaactctcttgtccaataaaagattttacagttacacatactctgtccaccacttacttaggagctctgtttgcaatcctcggttggttaggcacatcctcatggtcctactttattggaacccttttatgttttcctataaccttatttatcatctacatgttggttgatcctttggatgacaactagatcaggcatgattcccaacatgatatgagtgacatatatctataataattaagatggcttccaatatttttacaaactgtaaacaccaagaacactgttttccttcgtgaataacaaacaaatctttcatactgtgaagggctcagttgttaaggagaattattaagagtttaagaccttgttataaaatagctatatgtggttttttattttcctactacagtacttaagtacttgtttcattattaatgtcaagaaaacttgattcgtataaatcgtgttcttggggtttaagttacaaatctatctgccttatatattgactacaactcaagtatagagcttaacttaggagtaaatacttaactaataatccataactaataattcttaatatatatatagagagatcaatattcaggctgctaaaatataattggaaattctaggttactcatgaattttgtgtaagtggagtataacttgtgaatatattaatgtaatttccactaaacggcaagtagttttatttgtgtgaaatggaacggcaagtagtttcgttcgtgttgaaaccgtaatattctattgggctttttcacacggaagcccatctacatattttttctcgtggtccgttgttgcatcgcaagagcactaagtttgaaattcgaaaaccaaatcgtctctctctcgctcgatgcgtgttgcctgttcggattctggatctctgttgaattgctttctggggacttgttttagtttggtatttgttcgtttggcttaggttttagggttctgtgattttgataactcggggttttgttgattcctgaagatttgggggattttagggttgatgggttccacaatg

SEQ ID NO: 14230 - DNA, 3000 bp, Unknown; identical to SEQ ID NO: 14225
  misc_feature (1)..( 3000): cDNA_ID_2990679_gDNA_ID_2214712_Annot_ID_136982 3000 nt of promoter + ATG

SEQ ID NO: 14231 - DNA, 3000 bp, Unknown
  misc_feature (1)..( 3000): cDNA_ID_3022325_gDNA_ID_2214712_Annot_ID_189898 3000 nt of promoter + ATG
accaaatagttcaattaatggaagaggttcagaatctggtcttcggagttgtcatactatttagaaatctggtcttataatctgaacaatcctaatcccacggttcaacaaacttttgacatggatcaaacatataacaaaccattaacgataaaagactcaaatcaagcgaattaaaaaacaagactcaggtcaacaaaccatattagcctacgttgcatcacgataatgaagaataacttatagatccatccccttttgtctcctaattcttaattttttagaaagagatcattattgttctcggatggagatatttagaaaggcaacgattgtacgtctccgtagccacaacgacaaatacctaagtgccgatgaagatcaagaatccgttcatcaagatcgtcgcggcacaacaaaaaacactagatggacggttgagatcgtacctggatccaatgtgatccgtcttcaaagctgttacggcaaataccttaccgccactaatattcatttcctccttggagccaccggcgaaaaggtaggtttatctaggggagattgggttacaagaaaccatctcaaatcaaaattaggattctttttcaataaatttcttgaaaaacaaggcatccaaatccattgataacatttataaacactttgacaaagtaaatcttgcccaagagatatttcaaatgtttaacaacgagaaaacccattcttatgactatagcgcaaacaaaaacgcataaacagaatttttttaaacgtggaaatgtttcttgctaaacaagccgtgtgtgtttcatattcacaaggtacttcaaactctacccgaaaagttggattcatctgcggagtgggagccgctatcagacgatggtgtacacgtacggttcaagagtcgctacggacaatatctgagggcaaacaaaggtgtaccaccgtggagaaactctatcacacacgatattcctagtcgtacggtcacacaagattgggtcatgtggactgttgacgttcttcagattcgagttatcaaagatgatgcagagtctacccacagttcttccactttttcacggattgaggtactactactatatacactacacatacgtgccaataccattcttctgaaaatactagtactaaacattcatcgatacatgatcagtcagatgattcgtttattgtgagtttaccactcaagtccgaaggaaggctaatatattacgagaccggagatgatagtgggaacataaataaggaaataggagaaaaatcattgatattccatggaagcgagttgatagaactaaagaagaagcttgaggaagaaacagagatggaagatgttatgatttggtgtagaaatcctttgaacgaaaagctttgtcctcttcaattgcatcttcctcctaacaacgcaactatgcacatcatcgtctttccttcttcttgcggtactaaacttacctccttcttcattgttaccattatctataatcaaaatattgtttatgcattcctaatttttttcaattgaggatttcgatttccaattaaaactttaggtatattcgagacattgggagtccagagttgttgtttttccgatttcttttggtcggaactctaatgaaaaatccgacacatagttttcttgaaagtctcattattcgtcacgtcagcacaaacttttattcatcccaagtttaactattttaatacagcctctaattgtgtttttgattttttgattttttttttttcgcagagattgacaagtgattgtcaataatatattatcaaattataaccaacttgggaagaagaaaaaaaagattattttgttatttgtgtacgaagaaagaagtcattgtgaagctaatttattcttcatattccaatatatgatagttgataagtacatgtatagttgtatatacaacataatgatctattcgtttaacatttttcttttaaaaatcttggaatgaaaatactgtatgttacctagaattcaaatagaaatcacacctaacgaactagttggtagtagaatcttataattttgtttaatacacaaaataaagtcagacaatctgaaaatgacacataatatgtttttgggtggaacctttttaactctattatgcaaaaacataactttttgggaataagaaaagttgtaaagcaaccaaaaagctaaatgacatatattttttctttctcttaattactgcatattctagaatcctactactagatcttatccttccactttttttttttgttacatattaatttgtcttaaccaaaatatacataggaaaaccttatagggacattatatctatttatgtaacattgatggacgacacacacaatggaccatgtgatattttagttcatatatcaataataaagttttgatcattattattataattatatttgctcgaccatgatagtgtatttaacgtcaagtgtgggtccaatttcggtccaaggatgctgactagaaattagcatttttatagttttctcctaataatatactatttaatgcaaacggcctgtgacgactgaattgtcctctgtctggccccgtgagcttcaccgcagcttttagatattttctttccccgttctttcggattttttttttctccccctctcaagcaaagcattatcgctattgctctgccttgtgagctgcgatcacctgtttactggtaagtctctcctcgtcttctccttcttcttctctgggagatcttctactgttctctctgtgagctgatttgtttggtttcctccatagagctgatcatatcatcatcgttgggaactgacgagatttagtctatattggtgaattatttttgtttatctggttttgattttttgaatctgtgactttagagagaagaacactgcgacgtcgttaaaagtaggttgagagcgagaaaggccgagagaatggagatg

SEQ ID NO: 14232 - DNA, 3000 bp, Unknown; identical to SEQ ID NO: 14223
  misc_feature (1)..( 3000): cDNA_ID_2711101_gDNA_ID_2214712_Annot_ID_136984 3000 nt of promoter + ATG

SEQ ID NO: 14233 - DNA, 3000 bp, Unknown; identical to SEQ ID NO: 14222
  misc_feature (1)..( 3000): cDNA_ID_2711093_gDNA_ID_2214712_Annot_ID_136986 3000 nt of promoter + ATG

SEQ ID NO: 14234 - DNA, 3000 bp, Unknown; identical to SEQ ID NO: 5727
  misc_feature (1)..( 3000): cDNA_ID_1829116_gDNA_ID_2684091_Annot_ID_189939 3000 nt of promoter + ATG

SEQ ID NO: 14235 - DNA, 3000 bp, Unknown
  misc_feature (1)..( 3000): cDNA_ID_2991881_gDNA_ID_2684091_Annot_ID_189954 3000 nt of promoter + ATG
attacagtagatatatgaagggaatcttatagaatagagactaacagattgtttatctgaaatgattgctagatcagtcatttcgcatagccccaagcttgtagagagctatctcaagaaccagtcccaattgtcatcattttctatctcgactacagaccaagcaatacggacaattcgattgtcaccatctcttccaactgtggctaatagatgtccttttatgtcccatttcagaaaagctccatctatccctattacaggtctgcaagtttgtttccatgactccctttgagcttgaaaacaaatatataaccggtaaaatctctgcttgcttccaatcactgctcctgcaactgtctctatgttgaactctgtccccggattccgcaataacacctctgcttgataatcccatatcctagcaaaatgagaatcatgactagcacgtctagctctcaaaacttttgtctttgccttagcacattggtctggagtcacttccaacttgtattctcttaagatctcagcaaccatctcatgtttagtgagttttggattcactctcaacctttcttcaaacaaaaacccaatagatgacacctttaacatcttcgaatgtcctgacctcacacaagtatgctcattgtaataagttcgtatttgcatcttatgttttctcttctcataagagcaacggactctgcacggacattcaacaccctcatcactaacatacacacacttagcagcaacaaccatagcttcagaattataaagtttaatgtcataccttgtctttagggaatacatcaaaagagcaagcttgaaatcttcaggagagttataagtcttctccaatgctagtaaaatctcaggatcaccaagatcatttcgagctgcctctactctatcatcatcttcatcatcagaggacaaaggatctggaatcttgtcttcatcccatatatcatctaccctgtcattgtcactagcttcttcttctccattagcctctggaaaatctctttccatgtctaagttaccatcttcttcgacacctaatccagcagtatcatcttcttctctattagtatctactgcatcatcaacctcatcgcagtcttcatctccttggactgcacagtcatcgtcttcatcaagagcaggaacttcagcctctaaatcctcctcttcttcatctctgattctccttcgtttacttcgtctaagtggagcacgaacttcgactgcatctgtcacatcaacgcctgattcttgagcttcatcgtgagcttcctcttctccgccacaagacgtttcacctaaagcttcctcttcctcttgtccaatttcacgacgagttgattcttcaactgcaacatcagcttcctcttccaatctattttgccttcgtttacttcgcctaagtggagaacaaactgcggttgcatctgccacatcaacggactgacctcgagcttcttctccaatttgatttgcttctccttccggcattggttcaactgcatcgtgagcttcttcttccaatctgatttgccttcgtttacttcgcctaagtggagaacgaacttcggccacatttgccacatcaacatttgatactacattcgcttgacctcgagctttttctccaattcgatctgcttctctttccggcgttggtttagctgcatcttgtgctccgtcttctccgccacaagactcagataccacattcgtttcacccccaacttcttctccaatttcatctctttctcctcgcggtggtgcttcaactccatctcccaccaaattctctgattcgtgaagcattggagatccaatcctcataacgacgccattctttctaactaatggcatttcagaaaacgaattgaagcaattagggtttcgattttgattttgggggcaggattaggtttcgatttgggtttagggtaattgattttgttttgagaatttctattctcgattttgatttctctttagcacgaaaacgaggtcgtaagactataataacagatgcttaacggattaaaacggctgtcaattacgctgttagaaggagttttaacggtggttaattagaccgagtcaacgcaaacttgaaagtttaaaacagaagtcaactttttgttgagagttaaaacggccatttctcgagttcacggttactttggccattttttgtaaattgaagtattaaataacattttttctaattaaacttaataaactacttaagaaaaatgggaaaataataattggaaccgactttaatttcacaatgactcttttgcccttccatcgttgacgacattgtttctccttctctcttccacccatttaaaaacgcaaacttggaaaatggagaactgtttaactacgccaacgggctgttttaatgacaaatgttagactgggctcagtaacggatgttgtttcttgtcactaaagaatacgattcatagatttaaaagtaatccatttactttgcttttactttttcatgtgaagagaaacaaaaaaaagttttgttggtgatcaagtttgtagtgtactagtaaaatagtaccatagtatgtgtgtgtgtgatgtggaaacaaaagaatatatagaaaattttatgttttgggtttcatgtattttcttttaacataaaaacaagaacagataagcataatgacgtaagcagtggcctaagcatctcttaaaactccatttaaaaaaacatatcgaattgaataacattgagttgacttgtttaacattcacaccttgcttgctacggtatcttagcttccaagattcaattaatttttcattttttatgttcacagtcaatagtaataagacatcagcatcgcatacaaatttcttatataactcgactagtttactctataaagaatcagcgattggagtatagaaaaggtttaagcaaaatccatcaaagaagagttccttttcacaata

SEQ ID NO: 14236 - DNA, 3000 bp, Unknown
  misc_feature (1)..( 3000): cDNA_ID_3040786_gDNA_ID_2684091_Annot_ID_189960 3000 nt of promoter + ATG
tatgtgtctcttctatcatctgtcaatttggtcgccaatcgtcatgccagtgaagccaccatacactgacaacttctacccaaaacgatatatttatgtgtctatatttgcatattcgttttggacactattgatcatatattgatcattgcataaattattcatctacttaaatcagaataatttgcaacattagtaggaatacactatatattgtctgattttatatgttttttgttttgtttcctccagaatctgaagcagtaccacaacaagtaccagctgcagaaggcgaagcaacaacgactgctcctgaaatcacaacaagcaacaccaaagaacctatttcttcttgatctctctctcatttcccaatttgtacaatcttcacatttttacctctctctctctgaaaaaaagaaaacagctaattcatttatttctcaaccagagcaatgacttgagccccaagaagacagactcaacactgtcaaacttaaaaagacggctcaagataaatctcttgtcatattttgctctttttctgacggaatatatataaaaatttgagctattcatattcttttttactcatttattttatttctaataatttcaattttttgctacatgattcgtattcaagctttttcatatatcttttttctcctttatatccactttttttcttgggagtttcaatatggatatgtactcataatttataagatccaagtgagaagaacactatagattattgcaacttgtaagtacatcttttaaaattgtcattaaagccagcccaaatgatagtggaaacaaacaggccttttctaatgggcctatttggatacggaaagcccaattaggtcgatctaatcgtgtgacatgtaaggactttattaaccaccgtttcaaaattcacgtacgatgatcccaacggtggcgccgaagcttcttccgccaagcgccgccactccaccaccttctctcttaacctctttcccttctctccgtccatgagctctttaaccaccgtctccactctctccctcttcacctcctcgccgatctccatcccaatcccccaatcctcgcaacagaactttcgattcgtcaactgatcagcaaaaaatggccaacagatcatcggaacaccggcgtacaaactctccaacgtcgaattccatccacagtgagtcaaaaatcctccaatcgccggatgcgaaagtaccttctcctgagaacaccatcctttaattaacattcctcgattcttcgtctccgataaaaactccgccggaagaatcgaatcatctccgtcgaccataccagatctcaccacccagagaaactctttcccgctcctcgctaaaccccaagcgaactctaagatctgctcactagtcaaaaccgttagactcccgaagttgacgtaaatcacagctttctcagctttagtatctagccaatccaaagactccgtctcttcttcccagagattcaatcctagctttctgatttcgctgttcttatcgatttcgcgattctccagaatctggaacggtccaacggagtagatctgagggagaagagatcgcagagataagagaacgttatgctcgagtttttcgaaagtgttgatgaagatcgcagaagctcttttgattcttccggttacatgaaggatgaaactaatcatcggatcttgaggattcgtcgtggtgacgaaatctggaaaatccttaagcttaatcttcttcatcgacggtatccaatcaatctccgtctctaaatgcttcttcaagtcactcgaatctgatggaattcgaaattgttaattgagaatttttcagttgatgatcttcaatcgattcgtacctttgaggggaattatctctttctcgatgagtttttggtaatggagatacaagattaaagcagtagcactgttggtccagaggagaactaccggaattttaagctcctccgctgcgtcaattgtgaagctcattgaagcgtcggagatgatacagctaaccggtggtatatcagaaccggagtttaaccggaggatgaggtctttgaatggagctaaacagttgtttattgtggagtcaataagcttgagcatgtcttgcttagcgtcgacgtctgtccaaggaagaccgtcggggatagtctcgaagcgaaacgaggggagaccgttgagagcgtgagggccacgtgattggaggatacggcggtggttgtagtcggtgttgacgaaagtgacgtggaagcctctagcgtggaggagcttggctagtttcagcattgggttgatgtggccttgtgctggataaggtatgcacattgcgtgaggtttctgtgagctagaaccgccatgttgttccatccttttgacgatgacgatgatgatgatgatggattccgcaacgttgagtcactcaacttgagtgtatcgtcccataattgatagtggaagaagagagagtgatactttggaacctcttggtatagttttggatgaggaggaagaatacttgtcggtttgtgattatataatagccgccataaggctcgtttcaaaaaaaaaaaaaaaaaattgccgccttaaggcccataattgaaagactacgtgtcgttttagttatctgcgtcgtaaggcccataatttagaacgtcgtcgttttatttattgaggttcccgagttttgcgtttcctctttttatccttttagaaacgatttgcgtaagctaaacgcgaggttcttatcagattctatcgttgaaacgacgccgtaacttaattcgatatcgttaacgcgtacaacgtgcgccaaagcatttacgcgcactcggtgacgaaacgaggactcggatcatcacgcgccaccgcgtggagaaaaagcttgagttttcaaaattccaggtagtaaaaaagcaatcagatcgcagagagagaaatcgaaattccattgaagcttatagccaatg

SEQ ID NO: 14237 - DNA, 3000 bp, Unknown
  misc_feature (1)..( 3000): cDNA_ID_3040772_gDNA_ID_2684091_Annot_ID_189964 3000 nt of promoter + ATG
ctatggagccaccgacatgtaaccgcgtttcaaaatgggacccactttccccgttttatcttaccttttttccttcaaagtatgttgttatttatatggagctgatccaataaattctattcagacattagaatgcaaaaacgaattgttattttggaatcttgaaataatcaccaatcatattttaaggacatatacctgtatctgtatgtgtgtgtttacaaataaatacgtacacactacgatggcataggatgcggctatgagagccgacgattgtgtaattaattaacttctgatttttttggctgattaattaagaaacctacttgtttattttgcatttatttagctaaaagtggttatatatatcggtgtaacccgtttgaataaactaccagttcagttttgaatgatgacatatatgacattttacgcaaaaataccacggtattattagttttgtttaagtttgaagttttataggttaactgtatgtttcgttatctcttcgtttgtttgttttgtgattaatcatacatttcccaaaacacaatatattataaatgctgaatggtaccttgtgtctgtttgcatattggaaatttctggagcaacctgatcccttctctatcaaagaatttaattgataattaatcgttggcgatagcacttttacaaacattttccctttacttgtcaaaaataattatcaagcagaaaaaaaggaaataatgaatcaatttcgagaatcattgaaacagatagtaacaatgttttggagttgttttgtttttaatttctcttcaaagtgaaggctaaggacaaacgctatgcggaatagttttctattgcgtatatatagtcgataataacaatataacatggctaattttgtgttacatcaatcatccaatcttcatatattgtggcttattctatattacattattacaataacatatattttacgtggcttttatgttcgtacgttgtttttatgtgatgatgctatgtcaaatcatccgtagtatcttttttatttgatgagtacaaacatataaaacaaaattgcaaatatttcaccaccctcttacactttatatatttaggtacatgcagatttataaatccactaaataaatatgcatgagctgtgaaacaaaacaactcagtgactcactcgacttatatcatacggaatataagaaaaaatcaaatgaaatttaccaaatttaccataaaatacagattttgaagatcaaataaaagtagaaaatcttatcgtgagtgggatatttaaaagtacaaaatttgcctcgtattgacacaattttaaccttatcgtggttggcgtgtacaagtgggcaactggtctcctaataatgcgtttggtaataaatgatcgtgattcttagaaatatctttttcgcaaaaacattagtctatggataagaagataaattaaccaaatcgatgagtgtaaaaaaaacaaaaccaaatcgaggacatttgtgaagaaactcgtcttattccaattaggggacgatcactcgttttcttgcgagaggaacttggcctaaaccgaccatttttttctcatggaatttgatcatgtgttttttgtcctcctttaaacagttcaaaatttgatgaataaactacaaagtcaacatttttacacattcagatctgcatccaaaacacccatattgtaccttctatattcatgattcttttggtcataatcatgatgttttgtttccactaaactttatgatgtttatataaattccattgacgctataaaacaagctcgatacatctaccttaaaaaagatcattaacttttctacataaaaaaaaaacagtccccgtaaaaaaaaatcatttactatcgacaaaataacctttaggaaatctcatgtttgacctaacacattttttcaaccggttcattaattctataaatgtcaaaatactattattgaacatcttctaatatttttggtcaactactactataaagcatcttctaatttttcagtcgaccaattagtgaacttaattaaaagaaataaatgtttgtttttatgcaccgccaagatttcatatatttttttatgggaagaagaaagagacagaaagagaggtaaaaaacattaaaaagtagaaagaaaacagagcgtgaagttaatacgattatagtactagtaattagcagtagatagtactaattagacatgtacccatgggaagcttctcttcgttctccccccttaaatacgcttaggcatctcaactaatttactctctttcttttgtttatataccaaagccaacggaagtgtttcttaattcattttttgtttgttttggtttaaataattcagtgtctcacgagctgtgtcgagattggatccatacaaaatctgcacgacgcctgcttcttcactctctcccactgttccagcttcaactctcttgatatacagagagagatagagataaagagagagagagtgagagtgatagctctcggagaaattgaagaagacacaatctgattagtattctccaatattccatcaactttttgctgagggaaatctccagatttataatcgtttgtatatatatatatacagagcagcgtagaaaagtacgatttttgcttcttttcctcactcttattcatcttcttgattttgattcgatttggtgtttattcgcttgattaatttaagggttgttggggttttttgtccaatttttctgggttttcgttcgatttcgatttccacgagtttaccaatttcgtctctcctcagaatttgtggatctgcttatgtaaaaattgagtctttttacttgttttgttcgaatttgtttacaaacgcgtgatctcgagtttcagagatctcaaagcttaaatttttataatctgatggacttgttttttatttacagggatcttagatttatagcagcaacaaaaaa

SEQ ID NO: 14238 - DNA, 3000 bp, Unknown
  misc_feature (1)..( 3000): cDNA_ID_3040782_gDNA_ID_2684091_Annot_ID_189961 3000 nt of promoter + ATG
atttaaagcaatgcatgctccctaacatggaaaccaaagcgaaagttctaagaattgatgattttgagagatacttataaagctataaacaaaagagtacagattcaaatagtaggattcaccttccatattagttctctcatctcaggcttcagaacccaaagcttggatagccaggctctcatttctcgttggcctacagagttccccattgaccatgggaaattgtaatgatctctttctttatcaagaaatgaagcgaggaaatcgatatcatatgaaaatccattcttccacatattatatctcttcgatactccattcacatcctcttcgcggttttcagtctctccacctccattcatccgtgtcctcttctctttcctggtaaggtctgaatagctcaaagtattatcttcttcatcgtgtgtttcttcttccaaatcttcagaattttcatcatcaagagcaagaagcccagcacggcaaactcctttgtgatggtaaccaggcgccatatccaagcacacgaacccaaagttttctttgttcacaaaattctgggtaacagccactgttggttcaagattaaggatacagtgccaccaaccacttggaacataaatcgtttcgccaggtagtagtgtgcactcaatcggtttgtcttcgtccgcaagaaggggataatagtctagccaccactgtacagggattgaaaacattaagagggatacagtaaagacgaatcaaaatggcagtgcttaaacagtttagcaatatacctgcagagatgagggtgtatcaatgctgacatcaccctcatcttcattgacatggactgtaacacctagaggcacttttccagggggatacaatgcccacctatttaaaacattatgacatcatcatcagaatgagaataatattgcaggaaaggaagaaaaattatttgtatttttgtccataaaggtgtctaccttttccgaccgcaaagcagggtgttccaggcgctggtaagagctgggtcaacatgccaagatgcaccagacctctccggaccaactataagccatctgtatggaggacgactttccttgtctaagatctcaaaccaatcttcttgaaacaaatggggcacactatagtctttcaataattctggagcagcttctccaaactacatgaaatgttgaatccttcaaatattctcaccacaaagtttcggtactactacaactctatcactgacgtgaatgaagtctaatataaatgacaaaactgtttctcgtaccttgtcatcgaaaacgtatagaggatcttcatcccgctgagttttcatatatgcgatgtaatccttgaacttcatggaaattttgttggggctcctctgagatattctaaacgggacttcaccatatttctctgagagttggtcgatagtccacgtattactggctggccaagaatcagcaaggccagaaagcaaaacctaaatcatagacaggaacaacatcacatatctgaaaatgttttaacagatcaaaatctcatgtactagcaaagattggaactttacaggtttcttggcgtcgtattccttagaaaactcatccaaggagatatttctcctacgttccacattcccattatcaaaagagaacccgtcaagagatgtattacacctatagaatcgtttatacaagtacaacgacatgaatcctgtaaaagcgcagagtaagtgagcaaaaaaaaaaaacgatcatatcataagagtatggaataaaccaagtatctaccatcaaaatgaaaacattttctgtatgcgtcattttcttgagtaactccttctctgtatatcagaaaaccaatcagtcattacaatttaaagataagcaaagcaaaagtcacatatctaaagacaatttgtatgtatcattgaacatggtaatttcaaagtacttacagatgcaatgttgtttttttccaagaacctttgtattcaagaggaccttttgctcttctgagacacaaactcatccacaatggttcttcattacatagaatatacatcacactgtacatcaaacatatacacataacagattaatcacaaacaatgcctcaacaaaatcctcatctgttcataataagaccaaaatcctgacttgctaagaattcgaattgatctagttagactctagttttgatcaattctttgatgttaattcgatcaataagttaatcttaggaagagaattatagaaaacctgctgacacaagcgaggtgagcaatatctcggggagcaaggtattcgagaagaacacagatggtctcatctggtagaacactgagactaccgagagcatctggtcggcgatctctttgtcctaacgtcgtcattggctataagcttcaatggaatttcgatttctctctctgcgatctgattgcttttttactacctggaattttgaaaactcaagctttttctccacgcggtggcgcgtgatgatccgagtcctcgtttcgtcaccgagtgcgcgtaaatgctttggcgcacgttgtacgcgttaacgatatcgaattaagttacggcgtcgtttcaacgatagaatctgataagaacctcgcgtttagcttacgcaaatcgtttctaaaaggataaaaagaggaaacgcaaaactcgggaacctcaataaataaaacgacgacgttctaaattatgggccttacgacgcagataactaaaacgacacgtagtctttcaattatgggccttaaggcggcaattttttttttttttttttgaaacgagccttatggcggctattatataatcacaaaccgacaagtattcttcctcctcatccaaaactataccaagaggttccaaagtatcactctctcttcttccactatcaattatgggacgatacactcaagttgagtgactcaacgttgcggaatccatcatcatcatcatcgtcatcgtcaaaagg

SEQ ID NO: 14239 - DNA, 3000 bp, Unknown
  misc_feature (1)..( 3000): cDNA_ID_3040790_gDNA_ID_2684091_Annot_ID_189959 3000 nt of promoter + ATG
attggttgattagctataccaaacacttcactgttcctttggttgaattttatgctctgatgctttcattttaagttgaaacttcaaactctgacgagatcattaatttaaacctgtaaagtgtcaaatgactaacgagtgtctattgcttaaatagttcttttgaaatgtatttttatttttatataatcaaattgatgattgatttcagaccaggtaaagtaattggctttacgcagtccaataaactagtccgcttttaaaattaaaaattgataaacaatcaatctacgcaacaagataagagacaagagactttatgatcttcaaattgatgagaaaagaaagcaagtttcgattacacagacattgaaatcgataacaacaaagaaataagaaaagagaaaataaattaaaaagagataaaaagatgattgatggttcagacttgccacaaatatgatgaatgaataagcttttgaagatgagcgaaatggcaagagcgacctcttagatggattaagaaaaacatatggacgagaaagagaagaaattccaaaccctagaagaaaactagcagtttcactcaaaagatcactgctgttcctcggtcggttttggcgctgctgcttccttgatctcatccgcagcatcatcctaatataatccccaccgttacagaatttagtcaatggaatgcgaatcatccataacagaaacaaagaaagaacaaaggtgcggggattatatgaacaaacctgcatatcagatgtccagagagtgagattgtcacgaagaagctgcatgatcaaggtactgtctttgtatgactcttcaccaagagtgtccaactctgcaatcgcctcatcaaaggccttgacgatacataacaacaacaaaaccagtcaaatttatgtccaatgaggtcaagtgttaaaccaagtccaatcacattatcataattgaaagatgagtagattgaaatacctgtttggcgaggttacaggcacgatcaggagaattgaggatctcgtaatagaacacagagaagttcaatgcaagaccaagacgaattgggtgtgttggagcaagctctgcattagcaatatcctgcacagataattacacatagagactataagctcaaaacctagacaatctcaagatcttattcgagaatacacaaatccctaatttaagtctcattatactggaaatctaacaaaccaccatccacggatcacacactagactcaaataaactagatctgagattcggaatcaaacctgagcagatttgtaagcggcgagtgtatgttcggcggcgtctttcctctcttgaccagtcttaaactcagccaagtacctgtgataatctcccttcatcttaaggtaaaagaccttggaatcaccagaagcagcggcagggatgagtctagagtcaagcaacttaaggattccgtcgcagattccggagagttccgtctcgatcttagacctatattcacggatcgccgtgacgtggtcatcgttaccacggctctcttccttctgctcgatcgatgaaatgatacgccacgaggcacggcgagcaccaatcacattcttataagcgacggagagaagatttcgctcttctacggtgagttcatcgccatcaacggcggcggagactttctccataaactctaccatctcttcgtacctctccgcttgctccgcgagcttagccatgtatacgaactcttcacgcccagacgccattgttgtttctagagagaatcgatctaaggaagaagaatcaaagagggaaagatctgagatctgatcaaaaagagagaaacggtttcgattagagaatcgggtgttgtaggtcaagcgagagaggacgatgaatgagtttttgtgtttaatgagggaaagtgataaatgcgttttagaggaaaagagtgaaatttggaaccaagatctaatctgggccgttggatttgtggccggtcctgctttttaaagggggattttttttcacctcaaattaagaacaacataaatacacttttagaaaaattggtaatgtgattattggataaaatttggtcaattaacaaaataattggtaatgtgattttgctactattagtataggcaccttaaggaattataaaattttgggtctagtggttaaaataggggctagttttttgtagatttgttaatatagttatttactaattgtgaaaagaaattggagttgtgagattgatacaataatggaagcaagttgggttaacaaaaatggagacagctcagagggacacatgtgtgttgtgagcatgtcaggggatccaatggaccctttcttctccaactcagctttcacatttttgtgattgctcaaacggttttttttttcttctttcaaaatttaaatacttcggaggttgtctattcttcaaatcttcaaacattcaactaagtacgtaggcgattcttacgagctttttaaaatcattatgttcttaattatgtggttgtatttgtactgaagtaatttattaaaatactacaatatttgtttttcctttttccgttttgcttaatccaatgcttatccagttatcctaatccatgattatgttttttcctatcttactcctttttgttaatttgttttatttgcattagttttcttgatgattatgttttacattcaatgaaataataagattactctatacttttctagcataaatattaactatacaataacatgtattcattgaacgtatagtcatgatatatctaaagatcatacgttagaaaaaaccgtcatataaaaaaggcgaaaattcggatatgttcgaaaaagatttgtggttaatctagctatatagcgtacgcaagtagatcaaaagtttttgataagtattgagataactcctaattataattagtcatttagataatgatgatccttatctaattagctttcttatctct

SEQ ID NO: 14240 - DNA, 3000 bp, Unknown
  misc_feature (1)..( 3000): cDNA_ID_3040810_gDNA_ID_2684091_Annot_ID_189950 3000 nt of promoter + ATG
aaaatccaaatttgctactatgataatagatttcagacgattttttttcttttttcaatcatagagtccacacgaatatttgcaagttactatataaaacactataatggtcaacagataaaaaaaaggcgaatgaagatatgttacgtaaaaagaaaatactgtaattataaattattactttaaaaagctttaaaatctggccacatgtttttaaagagtggtgtgacgtaacgactagagtcagcacaatccattattgtatcataaatattctcatctataaattacctaaacccttacaggtagtgtcccaaccaaacaaatcgagaaagacgaacacttacaaaaaaaaatctctttgtgagctttagcgatcgtaacaatggcgaacgaggtgattcttcttgatttctggccgagtatgttcgggatgaggacaaggatcgcattgagggagaaaggtgttgaatttgagtacagagaagaagatctaaggaacaagagtcctttgcttctccagatgaatccgattcacaagaagattcctgttctcatccacaatggtaaaccggttaacgaatctatcatccaggttcagtacattgacgaggtctggtctcacaagaaccctattcttccttctgatccttacctgagagctcaagctaggttctgggctgatttcattgacaagaaggtatcttatttcctttgtgcccttgattgaataatgttgaaattgaacttgggatttcataaaaattgaaactttagttgagtttgctagtgattggctcaaatttagggttttgcttgtagactcgtctttgagcttgtatgggtttgtctgatgttataatattacttgagtttgtagttgttagggttagagatctcacctccaaatttcagatttttcttgtggactcatctctgagctagtcagggtttgtcttcttagatagtttaatgttatgttacttgtgcaatttgaggtttttacatactagtttcgctagtagatatcatctttgagctttgtttgggttcatcttagatagtttgatgatatgtttcttttgcaatttgggggtctctaggactggttttgctttgtagacatcatctttgagctttgtttgggttcgactgagttctgacatagcttggtgttatgttactctgtgcaatgtttcagctgtatgatgctcagaggaaggtgtgggcgacaaagggtgaggaacaagaggcagggaagaaggatttcattgagatactcaagactcttgaatctgagcttggagacaaaccttactttagtggcgatgactttggctatgtagacattgcgttgattggattctacacatggtttccagcatacgagaagtttgctaacttcagtatcgaatctgaggttccgaaactgattgcttgggttaagaagtgtttgcagagggagagcgtggctaagtccttgcctgatcctgagaaggttactgaattcgtctctgagctcaggaagaaatttgtacctgagtaaatatgtttctcttgtcatatggttcggacttaagatgctctctgttttactttcgtgtgttgtctttcttaaataatgcagagcatctgtgaggtggtttgagtgtagagaatgtatgtctttgctgtagcagattcctgtgttttctggatttaatggcttgtcctagtttttatgcattgtaactatgagtttaattaatgatcgttaatctataatgattattaatttgttactttgatatgtaattacgccaatacgactcttctacctgaccaagcttatcacgccaatgttgctgtaaaagacaatagtgcagtttggcgattaaaacctccaacatcgagaatggtaagccggtctggatctaataagcccaaattggcatccataagcccaaattgaaattggcatccataactccatattgtagtcaattggaagttatgtggttgatgtgatcattagtgtcggtatgatcagattagccacgggtttagtgtttcttgccgaatttgaattcggtagatcaaataacattactatgatccgcacagttcatgggatttgaatttgatttacgattacaacaacgatattaacacagaactatcctgtaatttttgggatcgattagtaaattttaaaatattatttcaaaggctttatatatataaagaatttagagtataaacatagataaagcattatgtatttataaatcttatgctgatattgaaaaaataatggtgtatgtgatatatttaatagagtgcaatactctctcaataaattagtatagctgttatcactccttgtgtaaatgcgtatttcttgtacatgcatggtaagtagcttgtcctcgtatgtaccggattgtaatgtttgatatcaaatcaagggaatcacgtggtaaatgtacacccacctaactgagagataataatacaaacaactgtgagtaggtggccacgccaaaagtagagactgatgcagcaactaagcaaagtattacttcactcgatcaactttttattttgttaccttcttataaatcaagtcgatttctatattgtcaagtactaattccattctaatctcttacatatacgtttaaggtttgaatcagagcaaaagataatcacactcttttatattaagtgatgttttcactagttgcacacatatgacaattatttaacaaagttgcaaaatacattttaaatcgttacgggtaaaagcttactgtttaaaagatttatatatggaccataatatgctttgaaaaaagctgatgtgacgtaacgggaatcaaaatcctttccacatcattttcttcccctataaaacaaccgtcactcactccttctctactataacacacactcgcttgttcacgcacaacaaaaagcaagaatatataccactttgtgaacttcagagatcctatagca

SEQ ID NO: 14241 - DNA, 3000 bp, Unknown
  misc_feature (1)..( 3000): cDNA_ID_3040831_gDNA_ID_2684091_Annot_ID_189943 3000 nt of promoter + ATG
gaggttgacgttgaccttgaggaattgatggtcatggaagcaatatggctctctgttcaggtaaaattatttgtttgtataacttttgatattaaatttttcagttctctcatagctttttaaactgattctaacaggaaacagggacgcagagaaattcagcttcaggggaaattacctcttctaggcagtatgtaacagataatcatagttatgtttcttcaccaccacgagtgactccaatcgtagaaccagcaacaccgtcttcatcatctggtgggctttcttgtgcaatctccgcacttgctgaacgccaaatggttggcgaatcctccagtcacaatcataatcacaatgtcaacgtttcttcatacagtatgcttcccggaaattgtgacagttactacgacatagaacaagaggtagatggcatagacaaccatcatcatcatcgtcatcattacgagatgggagaaacaggaagcagcaacagctatgtaagttcttacatgacaggcgagggcttccacaactttcctcctcctccacctctggtcattgttccagagagttttgaggaacagatgatgatggctatggctgtgtctatggcagaggttcatgccacgacgacatgtgcaccaactgaagttacctggcaataaataggataataatggaaactcatgggtctgaatctgatgatgattataacttcattcatatatgtctgttcctataggaagaaagaaaagaaacgaaatgatttccagttttaatagaaaaaggttgggttgtgttacagcttctttaattctttgtggttcttctttttcaatctgcattgacaaaaaatttgaagatcacttgttttgtgtctctttgattgcaaatttctaaatggagaagagaaggtcaaagttggtgattgttgaccaaagcagtaattaggggtttagggttctagagtcggcttttgtcaacatatatgtcttctagagtctttgtatgggttcgttataagatggaaattataaaagataattaatggattatgatttatgactagcagctaactaattttcaacatttaatatcttgatttgagcagctaatgtttgtgttagtgtgtcttatggggtttcttactttcttctatgaatttatgttcgaaaaagagaataatggacctctaatttcacaactcccaaaactcagtatcttgattttttttgttcttttgggtactgattgatatgtagtactcttattagttacttgaattatcaacaacatcatcataaaaagaaccaaaagttaaaggtagatgctacttacaatcaaaaatcatagtggcgctgaattttacttacaatttgctctgtactattttcaattgtcaacttttactttatactacaaaaatgtagtgagtgattaatgttatgtaaaaaacataaatagatagttggcacataaaagtgaaataaaaataattagtagtgattgatatttcatcttgaacacagattgttacggggttttgtttttcaacattgtgtatgggtttctttaatataaagcttgaatgttgtacattatatccattttcatatagtagtgttatgatatttaccattaggaatcccaaatttgaagtacaatgaaacattgaaacctaaaataatagatataaaaatgggtatattcatacattaagcttaacatatatcaatatattggtttacggttttataaagtaaaaaaaataaaaagagaacgattggaatataaaaagaagaagagaaactaaaagaaaagagtttgaactttgttgaaaccgacaaaaagaaagaaacaatgtcagaccgattgataagggtacccacacatgcgtgtaataaattatttatctcttaaaccattttttgtctttataaatagaagtaacatgatttgattcaaaattttatatttagctcgtatgttaggtttagggttcttaacttcttgtgtaattgccttgtttcccattttttggctgtcgtttacgccaaattttgtactacattttgtgaaattcagtagaaatccgttagaattttttttaaaaaaacctccaatgaacgaaggaattggtacaatttggcaacttttataatcaaatcatgcaaagatacggaatcttaatgtagtaaaagataattaaaaacaaaacattatgattacatgtaaatgtgggacatcaccctccaagacatgtaaattacacttttgtcctttatcttcccccaaaggtcattcactttcaccagctttatttcaaatcttccaacgtctactttttcaatatctctctgcttcttgaattgagagtctctctctctggacataaagctacgacctctcttttctccacattttgggttttcttgtcttcgtgttcttgtttctatcaacaaaattaatcacaccagcagcatattcaaaaacaatttcctctttgtccttctttattatttctctgcttgcattacttgttaagactatatcgcaatcattcttcgtattcaattccacaggtgaaaccccagaaagtactctacattatcctcaaggttagtttctacaattagaccaacccatttacttatgtgtgtatgcaagataagaaacttttcctcaagagaaatctgattcaagtcttggtgaaagattgaagtttgttatcttagatcttctaaagcgtttggtgaaagattgaagtttgttatcttagatcttctaaagcgtttttgagtaaaagcaaaagcaatgtgttgttatatctcacttgtgtctggtttgactccaatagtggaatctgtttaagagtttctcactctcacttagtggcgcgtggcttaccagttcatatatctgctttattctgaggaatgttttcgttttcatcagatcattaacctttggagagtcagcaactttgcataaatcagaatg

SEQ ID NO: 14242 - DNA, 3000 bp, Unknown
  misc_feature (1)..( 3000): cDNA_ID_3040819_gDNA_ID_2684091_Annot_ID_189946 3000 nt of promoter + ATG
tggtgttgatgattaggttgatcaaatgatcttagtacttagtatatatcagctttagctctcttcctgtgtctttgggtgttcagatgttttgtagatttatatgcatagttgcatacttaggtatttatagagagattaaagagagaaagatataatctctgtggggtactgaagtgactcattcaagtaaattttttcgtattctttttgaaacgattttataatcgtaatcttgtcctacatgaaaacatatgtgacgacctatttttttcttgttttttttcttcctgacgtcatgatacattttcgacgaccaacgttttttatcatattcgttgaattcctaataaatattttcctaattattatattggccgaaaatatttacggctctagtctagaaatgcttaccaatgaattttatgaatgaagaatttttttgactaattaaagactttttatacatctgttgatgaaacaattactgcattctgtatattctttagaatttaacagcaacggtaaacttaaaacaattttgaaactgcaagaaaataacttaatagtaattatttaaaatcaaagattaactacatataattatttttataacctattgttgagaatattaaacaaggtaactatttgttatacaaagcaacaatcattcaacatttactgagatcaatcgaaaagcacatggctttgtgcatagataggacctttgatcattaagacatgttgaccgttaataaaatctagcagccttgaaggaccaaacattaaaatttatatatcactatcaccatcaaaagtattaaaattaccaaaaatcatagtgtattttcattagattgggtcaaagcacgccttctttgatgaaatcctgttacatcacgtgaaacagcctaagaaaaaactactgaaaacttaccaagtatttacacgtgagtagaattttgcacgtccccccacactatttcgttatgacaaaatataatcgtctttgattatgcttctagaaaatagtaaggtgatgtcatttttttcttcaaaaggtgatgtcttttttttccatcgacaaagaaaacactaatggctttagtttattttttcaagataaaaatttctaatcaaaacatcccaaatggggcttttagttaataaccatgttttccctttttccacagccaacagcatatgaaaattttatacggtttaaaacataaaaaataggaggtaacatatactcacatcattgtaaggtaaattttaaatgtttgcatcttgaattatattgatatatagattttattttattttaaatattgatataaatgagtaatggatcatatttttgtagattttactatttaaaagagattagaaaaaaaaaaaaaaaaaagagattagaagttcagcatgatgcacaagaagtcactgatagttacatacgatgtttcatggggagtttcataaagggacccaatcattcattcaattccctgaatttttgttttgttgactcagactttcactaacaaaattcttctcagaaattgcaaattagttcattgtacggttgtacttttgcgatagccctaattattttcagttgttaccaaccacacaaaaattatattggctttaccaaaattttcatatgaagaataaaattatatatggatcagtttaagccttaaggtaaatacaaatcaatccgttatcatttatcactacactacaacttttagaagttgatacgtaattatgtatagtctattttttgtttgttgataaaatttggtgcagtacgttattgtacgtacagttttgatatcaatattaatagactgatgaacatacaaagggaaagtcaagtttggctataacggatcagagtaaggttttgactacaaatcttgactcaggaacctgactgttttttatttgatcgcctttgaaattaagtatatacaaagtttgaacagattagttattttatctcagcttttaccgccggtaatatatagttaactatttcgactggggtaagttatgtccatttgagtttcagcattttggaatttaactttgaatgaatataagtaagtaattaactattgttctgtttttatagcagataaaaattcaccgaagatcaatttcttttttttaaacaatccgtaatattttactttacaaaattaaattccaatcagattcgaaactatgagtttagcttgttacatcgtgtagagttgtgtcttgagattagcccagcccatgtagcacaagttattgggtttgttacaaaagtgaagcccatatttcccaaataaaatatgggtgtttggtggcgtgttctgttgggtgggtgttatgctacatgggctaatctaaaaagttattcagacccaaattgcccacataaattatccaagccctaacacaactatacacttataaacaactttttagtggttttaattcaaatatttaatacgggtgtgatattttccatgctatctatggtatgtacaacttgtttttggtaaccgatccaatttggttgttgtaattcgaaacctaaattactgcgaaaacactgatcgatccgtacagaagcaatttattgataattttgatccacaaattgttcgacaagattggaacagtttaccttatatactattattctgctcatatttaaggaatttttaaaatataccgttataatttagaatcatatcagcagtcagaaacaaatcaattggtactcttatagaaacacattaattcagaaataaatcaatctgtatgattgacgaaaccattaaatttcaacccaaaatttcagccactgatgtaggtttcttatagaagtgtctagagatcgcactggtatataatacgatggaacacaatacgatactatcattctctcaatcataactactttttttttgtacattgtcaattatcaaaaacaaagaa

SEQ ID NO: 14243 - DNA, 3000 bp, Unknown
  misc_feature (1)..( 3000): cDNA_ID_3040749_gDNA_ID_2684091_Annot_ID_189949 3000 nt of promoter + ATG
gattgttatgcattagtccccggcaacgagtttcttgaattttagttatacgtatatactgtgattatgtattatgtatatactatgatcaagtgtccaatgatccaactgtgtacaaagttttgtagtaaagttttaatttacacacagaatttgttagcataaaaatttatagatttgatcaaaactgatttattaaagatggttattaaagtagattaaagtggagttattgttataaacgatgagaaaaatgcattacttataaaaatagctaaatatagtcgacacactaaacttgattatcttagaaggtttatgctgatatcttttctatattatgtaagcttccccaaatatctctgtgagctgcatgtgaatgaactgtgtagagctagagaagcttcttatagaaggaatttgaccttcgaaaatggaaacccgaaaatatctcatgtgatctctgttttgggaatgaggtctactttaatctttctgatcgttctttgtcttttttacaattatcaacaacttttatttatctgctcgtttttcgtctgttcgttttttgttcttcttgcaataattggtattacaaattacgaaattaccacaatacgaattattgtttttttattcttcttcttttaaagtaagaaatccatatccctatacttatatttcgaaattacataaaaaaactaaccttgtattttataaaatattacttaggaataccattagaaatagaatttaaaggtccaaactaattcagttcattaaaataaacaagtcaaaactttatttatgcaatttaattataaaccaaaaagatgcatttatgggtttaacttgttgacagcttattttattcatgaatttacgttgaggttgttgcgatttctactttaagcaaacgggaaacatctcacagttttgacttgtgatcttttatcctactcttattggttctaaagtgcatacacgtaagcgtatacataagcactcgcatttcacagtagccaatcgattgattctaatctttgaacatgtaatacacttcatggccactctttttttccgggaactatcttttttttttgacatggaaaaagaccattttttgatttataacgtgcatactgctgtgtcttttttctaaataaatagtttttatcaaatatgtaatcatactagggaaaatctcatcaagatcatacgtatttttgtacatgacttttaaatagtatattcgccgaaaaatacgttgatgtctcggaatttgacgcctcaaaaacattagaatatacaaaatcaagtaacgagtttgtaggttgaaactaaaatgccacgtaatacagtgcgtagggtccattcgatgtttctagatcaaagtctacacactatagagacttccagatacagatacacattcgaaatcatcaatgaaaaataacaatttaagtatcttcttatcctaatgtgtgtgtgcttttttttagtcaactattttgtgtatattgtaagatgtatcatgttatgacatgagtatgttgctacgtgtcgtgagatatcgaacccaacgcagatatgagtatgttgagctagtttcttcttatgaaacaatcatatatgtctataatgaatagatcacattatctgcctgaaaaaaatcccgtatattactcgacgaaatataaatacccaatgtagctgattttgctttctctggtgacatatccaatttggctaaatttgttaactagtctattataggtttataatagatctagctatgttaaagatactaaagcatcagttacataaatttttggcgcgagtttatatcttttggaattaaaaataagagaatttaaaaataagaagatcattttgtttggccacaggagttctgaaaggtcaggtatgatttttttcttgctcgctcttatgattttgtttttattaatgggttttcaaataagaaaaactgtttttcgaagcccggttcagatccattgttttttgtaaaatataggcccaattcaccataagtccatgaccaaaacaaaaataagatagaaccaatactgaaccaggatcttctctcgctttcgtgatcaatgtcgccaagcttctcgagatcatgtggtcacgtcaattgtataaatacaattattgacgtaacacaatctctacagttccatcgaaatatctcgaaaatttccagttaattctggtaacgtgaacgtatcttccacctcttcaacctacacagctttctagaaatttggctcgcttttctaagtcctctgtatttttttgcacgtttttcaactaagtttcaatatgaatcatttcttctataaataaatgatattttcatcaggtaatgatacattgtgccgaaataaaacgtcaatactcattagtcaaattaattgttcacataatttaaaactgtgttaatccatccagttattttcttacaacaaaataatcttttccatcaacttttaaaataattaaacgcagtgctaagaaatctaaaatcttgatttagaaatccattatggtttctggtcaactgaaatccataatttcctttaacatccaaaatccaaatttgctactatgataatagatttcagacgattttttttcttttttcaatcatagagtccacacgaatatttgcaagttactatataaaacactataatggtcaacagataaaaaaaaggcgaatgaagatatgttacgtaaaaagaaaatactgtaattataaattattactttaaaaagctttaaaatctggccacatgtttttaaagagtggtgtgacgtaacgactagagtcagcacaatccattattgtatcataaatattctcatctataaattacctaaacccttacaggtagtgtcccaaccaaacaaatcgagaaagacgaacacttacaaaaaaaaatctctttgtgagctttagcgatcgtaaca

SEQ ID NO: 14244 - DNA, 3000 bp, Unknown; identical to SEQ ID NO: 5726
  misc_feature (1)..( 3000): cDNA_ID_3078217_gDNA_ID_2684091_Annot_ID_189940 3000 nt of promoter + ATG

SEQ ID NO: 14245 - DNA, 3000 bp, Unknown
  misc_feature (1)..( 3000): cDNA_ID_2729791_gDNA_ID_2684093_Annot_ID_137025 3000 nt of promoter + ATG
aggatgaatggatggggaatcttctggtgagttaacagaactggtttttgatgatagtgatttgacatgggaaatggtaagccaagtatctgaaaagctaatgagtctaactattgtactaaaggcaaaagaggactagcatcgtcttcaagtagaactgaaaagggaagaatacagcctcatgctccattccaactccaagaacatcttagagcacgtcttcaactccaatggctttgattgatgaggatgatcaaattgaagaggatttcgaaaaagaagataaggataatgaattgtgtgtggaagatgatgaggaagagttttagagtttcagactcaaagttttatctttgtcggattggattctgtttgttttcatttttatgtttcagagtttcaggctcacggtttagcttttgttggatttgattttcttttttcacacttatggtttaagtttttcttgaattttctttttcagacttttggtttaagttattgtttggattttctttgttatctcttttttagactcacaaattgttctaaaatggctttatgtatcaatgaatacaactaagctattgttttttaagttgcacctcatacggcaaaggctctaaggctcatgcgcctagactcgaggctcaaacaagcacctcaacgccttacctcaccttgtgctatttaaaacacagtttaagcctaccttgaaatagtcaaagttgttcatcagggacaatcgagtgagagtgatatattacaatacaatggtgtccatatccttgtttctcaagtaagttcggtttcccatttatacctaacaactacctccctcttgtgaatctggttgaacctaatcaaagctcttttggcgagttctgtcaatggcctatattttcactcggcacccagactttcaagtagatttcttgccaaagtacgaggatcttgagtcagtgtacttgactctcttcttctacctcatcaagacactaagcaagtctccataaagcttgtctgcggctgaactaaccaatgctcaaaaccaattgacagaactgaagaaattaggcttcaagctagactggttgaagtcaaagctcaaggaagtttccttggagaggaagaaagcagttcccgacagttgtcatgtcctcgaagaatgggtcagaaatgtgaaacttactttgtcggatctccaagttaaactggacaaggacaagatcaaatatgttgatgttgctgctagagtttttttgtttgggttcatcagttttcttacctcttctcaatatgaaaacacttaactcactagctatgtgttttttttatggatttattgcgtggacatctttcacattcaacataaacaaggaggaggattctctgattcacttgttgtcacttcataaacatgattcacgcaccagctcactttccatttccttgctctttttttttttctttcttttaattcaaattatctatcttttggtgattcgaaatggagtttggtatttttgacacttgtatcaatccgctaaaaaaaattacttacattcttcttaattaatagattctacaatctctcacgtaaagtttacgctaaccatgaatctctctactagtttcttattgaattacttccctacctatagctgtagacattaggtatctccatgatttcaaccctagaagaatccataacaatattaagtaccttaagtattttgtaaaattttcttgtgattgaaatagatcttaactacttcaaatttttatataagaatatataatatttttgaaattttattcgctatatattatgtttggaaatttgcgaattcgaaattacatattatgtttacacaagatgttgttgtgtctggatggacaaaggaaaatcgcagttgcaggcgcaggcgccgcctaaatcctgacgacattggaactaaaggtgcttaaaaggttgattgaaagtgaaacagacatcaacattaggataattcatgtattttttaaaagttgcatgataaagtggaaaagaatcgtttttcactctaaaaaaacttttcaaagagaaagaaactttttcgatcaaagtccaaatcgccgtccagtttttcactccggctttgtgcccggacaaggtccggttccttttccagcatcgatcggctttcatggcggtggtggctggcttgagagcggttttcctttgcttcgatttaatcattttggtttttaggaataataccctcgactttatttaaattcaagttcaaatataattttttcagccataagtccggttccttttccagcatcgatcatgatcatattttttcgacgttgatttcgttcaccagaatcagagtccaagcaggtagaagacgatgaaaaagattccaacatgtggcattgttatagcctaatagcttgtcacgtttgtgtagagaagagaatctttcttttttttttcgatattgaagactgggctttattgggctttcatgtttgtaaactcaatgtacttatagttgaaacaaaaaaggaatttattataagaaaaaaaaaaagatgttgttgtgtccgttcaactaataaaagcccaagtactttttttttttgttgcgttggttatttatacatttgcaaaaaaggtcccatatttatttcctttttcatttcttatcaaacttttgacaacgatcatccaggtcccactctgcttcttaaccattctttaccaaaaatcaattgttctctccctctcagcttccgaagtcttcatctttctcgacaatatctaaaccttgtctgagaatcatttgaagaagatctttcatcatcaccgatccactttctgatgtaagaaaactacagtcttccttccttctcacttctcttcttatcttgctttcatggttagggcaagtttgatttaagcttatgtggatgatagaactagtgtttatacttgtagttaggtca

SEQ ID NO: 14246 - DNA, 3000 bp, Unknown
  misc_feature (1)..( 3000): cDNA_ID_3015786_gDNA_ID_2684093_Annot_ID_190052 3000 nt of promoter + ATG
tctcttcactgtattatgaactgaatgaatctctcaagaacaagcgatgaatagcttatgtctttgaaaatagggattgcaaagaacttgataaaaggaacttaggtctaaacaatgacctctaaaactatatataagacctataatacgtccatagactaataatgcaaataggaaagtcttctggggcaaatacctgaaaagacacaaaaagactcaagaaataacataaagattcaaaatcctacacctaaattatagataaattcagtaaaaatagagatatatcaaaatcctacactcctggtgtcgatcgacacttcctctgaatctggaatccgagatcgtccttagcttccttttccttagcttttgctccaaaatgtctcctcatctccaatgttgtctcaatgcataaaatacctgaaaagacactaaaaagactcgagaaataacataaagactcaaaatcctatacctaaaacatagataaaatcagtaaaaatagggatatatcaaaggtgaagagaatctaaactgcaacatcaaatgagagaagtgatagagttaaaaaccaatttagaagttaaaaccttttatgagaataatagaaaacaatatagagcaaaaaaaaaatcatagaaattcaaaagaagagtttattgacttgacgtagctacctctcgacgaggtggacaaacaaaatttactaacaaggaaaggaatgaatttcgaagaaaagatatgaaccatgttaaaattttggaaggtatggcacgtactgcatagacaaaatcataagatgatggaaagagacaccgtatgaaagaacaaaacaaagaaaacgagtgcctacaaaaaaaatagaaagagtaatagctcttcaaaaaaaagttgtgaagataaaaatttatatagatattaaaaaaaatgtgagaaatatgagttgttaaaaagaacgtatagataagcttatgaatatatttgtgtatagaatcttgtttttagaaaagctatacttactaatccattgaagataaacaaaaaaacaatagtaaatttgcggataccaaaatgagaaagtcgtcaaaaatattcctcatacaacaatttatttcatgagattcaatcaaaatttcttacgtaaaaagacttgatcatccaaaatttcaaaacgtttacaacatttatcaaaatatatgagccaaaaaaatgttcttttgataattgttgtaaaacctaaaagttgtattagagttatttgtaattacatatttaaattgagttatttgctatgctaattttaaaactcaagaaatttaaattattaacaacaagtagatatattaaaacatatatctcaaaattttcagtaaatattttaaatcacacaaaaatttattaaaagtcgcgtgggtctattttaaaatttcttaagaattttttgtgtgattaaaagtttttattgaaaattttgaaagatatgtttttatatgtctacttgttgttaatattataaactccttgaattttaaaattaacatgataaatagttacaatttaaatacataactaaaaataactttaatacaaccttttacaatatttatcaaaagaaatttttttttggttcataactctctctttagcttttctgaaggcgattttctgggcgatacgccccattcacaccgtttcgattctccacaacggagtttccttccaaccaccggaatccgtgttccttttcctttttttgttggcggttatactctgccattcggtttccatggcagttcggtttccccttcttttgggggataactaccaatttaaaccgccatggcaacgactctatataatcttcctttcttctcttctagttccacaatctcaatccacttcaccttaaacaaattcatccgtaatcatgagtgacaaacttcgaaaatcggttcaagacttgactctgggaattgatgatgaaccggtggctctcacaccggaattttgttcacaagccgctcatgtgaaccgcttttcccttgttgtgacgacggtgaaccctcgtaaacagaatctccgtgctttgatagggcagatgccaagggtctgggtttccctgattcgtgtgttggtcggattctggacagaggcaaagtccagtttaagtttcagacagaagaagcgatgacccttgtgcttagccgcggtccgtggagtttcaattactggatgctctcaatccaccgatggtatccaaatatcactgaagctgaaatgaagatcatccctttctgggtgcagattacgggcatccctcttctttttctcaccaatgctatggcactatgtgttggaagtagattaggacatatggttgatgtagactttgattaatattcgaatcatccgggatttgttagggtgaagatcaattggaatttagaagatccacttcgtttccaaagaaactttcaatttgcagatggggaaaacacagtgattaagtttcgttttgagaggctaaggaacttctgttccaaatgtggttcattgaagcatgatgtcaaagaatgcactcttgcttttgatgatgaagatccagccgtgatcagtgaggatgatgatgatgataatgatgaagatcatcaagatgacaacaaggacaaagacatgagtgatacagatactctacaaacggtggaccctgctacccttatccctagacttcaagcatcgattccaagggagactcaaagtaatgtcatgaaaaggccgatctcttcagcatttctaagagccttcgaggacacagacctcaatgttgaacgactccgctaccttcatgcgaaattggcaagagtcagaacacacacacccgttgaaagcgatctccttctagattcctctgacaatgcactgaatcctttcgtcttcatgaagaggaagagagttcagtttgagcaactgtttcaagaagttgaagaagcagaggag

SEQ ID NO: 14247 - DNA, 3000 bp, Unknown
  misc_feature (1)..( 3000): cDNA_ID_3015811_gDNA_ID_2684093_Annot_ID_190043 3000 nt of promoter + ATG
acttttaatagttttttgtgtgactaaaattgtttattgaaattttaaaaaacatgtttttatatgtgtacttgttgttaatattttaagttctttgaatttcaaaattaccatgaccaataattacagtttaaatacataactaaaaataactttaatacacctttttacaatatttatcaaaaaaacattttcttggttcataactctctctttagcattagatatttaggataacgatatctttttacatatggaagaaattgttgtatgggagataactttatcgactttttcattttggtacccacaaatttactattgtttttcgcttatcttcgctgcattaatgagtatagctcttccaaaaataagatactttaatatgtatatgaatttctgtttcacaatttcttacggagagctatcactctccctatttttttgcaaacactcgttttatctgtttcattctttcttacggtatctctttccatcctcttatgattttgtctaagcaatatgtgccataccttctaaacttttcacatgctccatattttttcttcgaaaatctcttccttctcttgttagtataagtatttttcaagctcgtcaagatgtactctgtcttgttttctgttattctaagaaaatgttttagcttctaaattggtatttaactctatcacttctctcttttgatgcagtttagatcctcttcaccttcacgcttcccagactgaaagacctcaacttatatctttgagaacttgattcaaattgataccatcaaaaacactgtactcggggcgatgaagtgtatgatttagtcataattatgacaatttcttacgtcataatattgtaattactttacatacaaaattattgtaacgtttttatttagtcacgataacgctactatttggtcatagtattgtgactgtattaaaagtaactgatttttgtcactaatcatgacaaatttcttacaaaataaatagtcacaaatataaatatagatttgtgaccaaatcttgtaactaaaatattaataacgtaaaagaaaacttattgtgaacaaatcatggcaaataagaaagtttctatattctaaagtagtggtttatgtacaaataaccatctatagatcatctacttaacatttttgaagtacaaaataaggaatttttcggattgttttttttttgggttttacccagttttttacctgtttttttcggcccatttgttgaatctctttactatttggtccacatcctataattttaaatgttaatcaaatcttaccaaaatttacaaatcgctttaaatactaattagttacaattaattatttctcttattgtcgaccatattgaattcgtaatatataagaatatctcaacataatatcttaccataatattttcttagatattctatcgtaacctcattttcttaccgttttcttttcatttaattcaaatgccgatatttactcgcttgaaatcttttgtgtaattaagattaagcaacacacatatcttccgctcatatacaaaatttctgcatttattcgccgagatttattcagttccatttggaaaaaatccaattacagaaacaaatttaagactacagaatgattataatcaagcatattcaaaaatgaaaacgtttaatgctaaatatttagttcaatattctctacatattcgaattaaaaattgcctaaatcttttacaatattctatcataactatattgttatcatttgatttcttaatcttcccttaaaaatttatgttatttattgtgattgatcgtataatctaatttgtttaagaaatataagattttgtacttgctttccaatatattctgaaaccgattcaactttggaaagtggattaatgagctctctcttattgatataggttttaaaggaaacaagtttacttggagaagaggaagggaagaaaggaatgttgtatggaagcagttagatcgggttttgtgtttcccgcatacccgccttcagtggcaggaagccatggtgacacacctgccctttgttgcgtctgatcatgcaccactctttgtccaactgtcacctggggtggctgggaacccgaggaggagaccgcttaggtttgaggaagcatggcttaaacacacaggttttcaggagttgttgtctgcgtcttggagaaatgatattagtacaccgaaggctctgacaggtttgagagagacgctccgcaggtggaacagagaggtgtttggagatgtgaaaaagaggaaggatgagttaattagtgagataacaaagatccaagagcagctggatagtgctcccacggttgctttgttagaatcagaggcttcccttttaaaggagttcgatgtagttctagaacaagaagagttgatttggttccagaagtctagagagaagtggatagcgctaggggcaggaataccagctacttccatacttctactgttattcgtcggagaagaaaccgcattgagatgcttaagaataatgaggatatatgggtgacagagactcgtgagttagaaaaaatggcgatcgagtattacagacgcttgtattcccttgatgatgtggatgcagtggttgagaagttaccgcaggcaggttatgtcagtctaacccgcgaagattgctttcatctagataagcctttctccggagtagaagtggagaaggcgattagaaacatggggaagtacaagtctcctggccccgatggtttttaacctgtgttctatcaacattgatgggaagtcgttgttgcatcaattgttaagttttctatggacttctttaattccggtgatcttccgctgcatacgaatgatgcacttgttgttcttattcccaaagtggttaaaccggagaagattactcaatttagaccgattagtttgtgtaatgtcttgtttaagactatcactaaaactatg

SEQ ID NO: 14248 - DNA, 3000 bp, Unknown
  misc_feature (1)..( 3000): cDNA_ID_2160091_gDNA_ID_2684093_Annot_ID_190037 3000 nt of promoter + ATG
ttacactctgttttcttttgagaatggttttttatatgagtgtgcactcaagcagggggagagtattctgatgtgtcgtactctgttccggatgatgtgggagatgaggatgtggaggaagaggacgatgatgatgagttagatgacaacacttaattgcttagtcctggtcattttttttttagttgggcattgtgttagggggagtttgtcactgattgtttttgtgtgtttgtgaaaactccctgatcttgttctttatcggcttcttatcggatcttctgtgtgtttaatgattagtcttatgtatagaaccaagaactcatttctgtttcatgtttaaatggttatgtcttttggcagtagttgcttaaacttgagcctttggtttctatgtttggtatggaatattgcttggcttgtattgtggtctctactcttttgcagattacttgaggtgtcacactcaaataaaaagggggagattgaagaaacagagtgtctgaagttctacaggcgtgtctgaaacaacacagagcagaacagaggaacagaggaagcgggaaagtagcagttgcttttgccagcgtggcatgttgattggagtgaaggaaaggcgtatcgctttagacaaaggagacgaagtcgtcagacataggacgtgtgcctagtgtcaagataatgatgaggagctacacttgaacctgatggataaagtagagcatcctgccttttccgagaaactacataagagaagttttggtctcttattagggttagccactttacttgagaaaagtggaagagaagaaaagttaaatagaacttgttcttgtggtttcattggtgagtgaacaaagagagcacacggctgttgctgtgtttgtgagctgggtagttttaggttttgacaagagcaaatcaggttgttgatgttgcataacactgtccaaacttatctgtgattgatcagtttgaaagttgttctaataaagtgtgtttattggagttgtgatctttatcttgtcaaagtacttaggattcttttacttcatatgttagatataatattttgcttaattgaatatattttacaatgttcataagctataagatcattatatgatgcatacgttttatccaaccatatcttcacgtaaccaacttcttctcaattaccttaactgttcacatgtttatatatctaagcccatatttttaggtgttatacatatatatatttatttactttttgaggattctggaaaattgaaagatatgatacaacagttatacgatatatatattgaatttaaaactttaataattataattttaataatttgaatagacactgtaaatatagttttagtcggacaaaccttactcaacattcaatactaatcatataccaaaacataattgttttatctaatttagagaaaagaaacatgaagctatttattatcattgtggtgaccagtttaaccatctcaaaggtatttgacaaaacacttgtcaccattgaagcaagaaatttgaggaagatggaccgtcatgagcatttcaatgctaatgaagatttcgtggaagcaaaaatgttaaagaaaattgacaataaaaataatctaaataatagatgtataaatgattttgcgcctactaatccaggacataattctggtattgggcatccaaaagttataaacaacaaatttacaaaagattttgcgcctactaatccaggacatagtcctggtattgggcatctaagagttgtaaacaacaaatttacaaatgattttgcgcctactaatccaggaaatagtcccggtattaggcatccatgagttatgaatgtttaaggattgtaaatcttattatataaatcttaaagaaataaaataaaactaacaaaaaaacaaatttatatgtctatatctcaaatgtttttaacttttttttctgaactaaaagaaaaattaacaaatttgtttttatatgtgttattggtcaaataaattaggatgtatttatatttatttgaagaaaaaattagcatgtattaatttttttaaagtcatttaatttatgtgtacaaaatattattttacggttttggtgggaaaacgttggcttacagttgttgcgggaaaacgtgatttttaattttggcggaaaatactttttgtgtgattttggcaagaaaacactttttgtgattttagcgggaaaacgtggttttacggttttgtcgagaaaatgttggtttacggttgtggcggaaaaacgtaattttaatatttaaaccaaaaactgaagttaaatagaataatttagttttactaaggatgactaatagaaaaagaaaaataaatagacttaattggataccaatttatttatgtgaaaccttatttaataaatgagtttagttggcttaatccatttaatctcatttaacttgtttttcctaaattaatttaaatgggtcaaaaactcttactcataaccattaattaaataggatttgcatacccaaattaacatcactagtcctagacaaaaaccaaaatagaaaacaatatttttatccatttttacttttgctcatcgaccaaatttgggcctagtttgctacaagctaacaattgaaaagcctcttaagacacatgaaatagtaacgacgtcgtttactcatgaagcgaaagacggcaaacacgaacgggtttacgtagaccgtcaaacgctcctccgtccgacggagaaaaaacgagacggtgaagaagaagaagaagaagaagaagaagaacgactcaaagatctcatcgatcactctctccaagatctattcacgcatcgtcggaagaattttcgcttccgacgacgtttctctcgtctgattttgtctccgaacatcctacctaatcgtattcggtgctggatttgaatccggtgaactgaatctgacaatttcgttcccggaggtgtttaaaaatg

SEQ ID NO: 14249 - DNA, 2359 bp, Unknown
  misc_feature (1)..( 2359): cDNA_ID_3077109_gDNA_ID_2684093_Annot_ID_190035 3000 nt of promoter + ATG
aagcttttccctgtcgttgcaacgacctctcctccctagattggatgctcttctccttcaattaaagtgttttacctcgaggtcatccgaaatcttctcctaattggttggcatgttttgatctacttactgtggtatgcggtcatcgcgtaataatcgtgtgcaccaaattacttttaaatttgtcaatgctttgatttgggaggctgaactaactgtccgaaattgaataacaagccctttcgccaatcaaattcccatcgagcttctgtaatgcctcagtttgatctccttcaacctccattatcgacttttcttctctgtttcatcgattcttcatctcagcttcatgaaatccgtacatgattactctccttgggccatatcttttcttctacctactgttggggttttttgattcaaaattggttctcctttgaagtgtgttgggctacttagctattggcctatgcaacattttaattctcatgtttttagtagaatgtcgtttatcccaaaaaacatagcagactaaaatattttacatttcatattagaattgctatgttataatgtttttaaaattggaattgtttttaataacattttttaaaacaggttgttttaggatgttttaaatatatattgtaattgtttaacataaatatttatttttaaacataatataaatatttattatatccagccagattaattatttcgaataatataattaatttgtttcatgaaaaacaacgtttttattttaatcaaactattatgtgattgtgtgaaccatttaacttaaattatatgtcttttaaataaaaaaattatttaaaaaaaaagaaacaaatgatctttaattctataagacgagattatatggcatgacgggttttggtaaatattaataagagatggtatactactggttgttttggtataattaacaatcaaaatacaattatacaatcttacaaaagaaaacaaacaattaaacaattatacgagacaaagttatatggtaagacgggttttagtcgatattaatacaatacggtatacaacagatgaaatactagaattaacaattaaaatacaattatataatcttgaaaaaagaaaacaaattatattaacaaaataaatacaacttttaaatttagttataaagaaattaacctgcggtgtaccgcgggtcatatcctagtattagaacgttttagtagtcctatgatataagcacctaacagagcatgaaaaaggacttattacataatttagaaaagctataaaggggctctaacaaagcattttgttaatgctatggtgtaatgctctatcatagcatgccgaaaaaacgctatcgtatatgggaagtctaccataacaggggcataacacaacgtttatgaaaacgttattgatgacatataatagctcttctctcatgctaataatgttgatattttttgtagtgttattaagtataatcgcactttagcacgccgttactagaggaaagacacacttgatcctatcaagctacaagatattgacgattgtaatgagtggttggtaggatgaatggatggggaatcttctggtgagttaacagaactggtttttgatgatagtgatttgacatgggaaatggtaagccaagtatctgaaaagctaatgagtctaactattgtactaaaggcaaaagaggactagcatcgtcttcaagtagaactgaaaagggaagaatacagcctcatgctccattccaactccaagaacatcttagagcacgtcttcaactccaatggctttgattgatgaggatgatcaaattgaagaggatttcgaaaaagaagataaggataatgaattgtgtgtggaagatgatgaggaagagttttagagtttcagactcaaagttttatctttgtcggattggattctgtttgttttcatttttatgtttcagagtttcaggctcacggtttagcttttgttggatttgattttcttttttcacacttatggtttaagtttttcttgaattttctttttcagacttttggtttaagttattgtttggattttctttgttatctcttttttagactcacaaattgttctaaaatggctttatgtatcaatgaatacaactaagctattgttttttaagttgcacctcatacggcaaaggctctaaggctcatgcgcctagactcgaggctcaaacaagcacctcaacgccttacctcaccttgtgctatttaaaacacagtttaagcctaccttgaaatagtcaaagttgttcatcagggacaatcgagtgagagtgatatattacaatacaatg

SEQ ID NO: 14250 - DNA, 3000 bp, Unknown; identical to SEQ ID NO: 14248
  misc_feature (1)..( 3000): cDNA_ID_2160091_gDNA_ID_2684093_Annot_ID_137027 3000 nt of promoter + ATG

SEQ ID NO: 14251 - DNA, 3000 bp, Unknown
  misc_feature (1)..( 3000): cDNA_ID_2729778_gDNA_ID_2684093_Annot_ID_137031 3000 nt of promoter + ATG
attttgcttcaaatctctataattcttggcattacactacttatatcactaatctttgattattaagaaaagttttctgaataaaaattaagattttttttatgaacaacaatttaaatggtgttacaaatttcgttgtgattatgatttttaaaaaattctgacacaatttattaggtagaggtgcaaaataggtattaaacaaaaagtttgagatgcacaaggtatgtgtatacaaattatgtatatgaactatgcaaataaaaagaaaaaaaaaactatttctaagaatgttagagaatattgactcaaatcatctaatttctgtttgtcatcttactaatattaatgttgataatatcgtggtgtttcatacattcttcatcatctataagagttaagcacttggtccaaatatttaagttttttccttaattgcttattacatatacattacatatttgtatacttacatctattttcagttatttgcctcctaacttaataaataatattctttttttaggcgaaataaattatattgttattgttataaaactgattgtacaatgaaattagcaacactaatgaattttgtcgtccaaaatttaatgatttgagttttttatacacaaagtttttcgtggtagtaagagaaaggtgatacaagcgtttgagatattatttgcatgtaaggcaaacataatttataatcaaatgtcaaattacatgagtcaaagataaacaaaactaaacacagtatctagctctctataaataacttttccaaaggcaactaaaccctaaatctaggaatgttattttacttagaacaggaaacaagaacttctagtattttaaaatgatcaatctttttataaatttgctttattatatgtacaatatgtctctctagatttcaaagtttcatttatgatcatcgaaatacacacacaattaaatcacaagaaatatcaataagaaatataaggtattagctatgctcgacggaagattttaaatattcattttagatatgcttttacattaaataatcattatttgatgcataaataatatatgctacaatgtatcactaatataaagacgaggctggttttttttccttctcttccttaatcttctcctggagttcacggaggtaggctttgtgtaacataatcttccacatgagcttttgaatcataccgaatccaccacttataggatcttctgtccaagcattaccttccatgattatagaagttgctagcatttgttttttttcttcaggagcatgctgcatcatcgtaatgatatttggtgtgccaaacaattcattagcactttcatattgactttgcctaaagttaaaagaaattaatatcaactaaaacatttagcaaaagagaataataagcaaaaaaagtaaaaataaataaataaatatacaattcatatggaaagtattctgcatattcgcagaatctgggacaatttctgtttttggtgatacatacggagcaaggacgacggtttcctagaggttccatatttattcttttagagataaattttgattaagtaattgaaggatgaataaaattacattatcaaataagtatttatagataatgtttgcaaaatgcagtcaaagaaatttattagaggtcaaaatatgaagatgtgcttaaaagagcaacacattaattttctttattctgttttggaaataaattgagattacatttgacttttaaaaaactaatattatcttactttaaattttgggattattgacttgtctaccacttttgaaaagattctttccaaaattaccacaattgcattgatctttctaaaactaccatattttatggcactatactattttattgacaattttacccctacaaggtgtgaagtttgtattagagaaaaatggcaacttgtgcccgagagacagctttgtgtgagggaagaaggacaaaaacgctgctttaaaccacctcatatgacgaaggacaatcatcaaaggcaattgtccgcgaatttaacacaatgttgaatttaaaaaagattatataaaaagtaatagacattgttcccgatctaattatattactcattctacacggcatgtcccccaaatatttacacgtaaaaacattaataccttttgtcgggaacaagttcaaatcgaatgagtaatataattatatcggggacaagttcatattgaattagtaatagaatttgatcggggacaaattacaatcgaatgaataatagtagatcgaggaaaagttcagatcgtctatttaccttttggaaaattattactatggtagaattcaagtgagaggaagaaagagagaggtaatatatttcgagagagataaaagaagaaagagagagaaaacagaaaataaaataagaaatgatatcttatataataaagaatggatcctattaaaacacgctaccaaaaattgatacgtgtcatttgagaacttaatacttatccaaaattattcaactataaacaataaatgaagatcaaataatggaagtcttatcataaaatcattaaaaataattaagaaaaaacatctcatcgaaattataaagggaaaaatgccttataaatcctcaactttttcattccgttgaatttaatccccaactcgaactaaaacgttttaaatactgaactttagtttgactttcaaattaaataataaactttaattgacgaagttgttttaagcacgacgttaattgtataacggaacaattaaacagagttatatttctgttaataggtactgttaaaccttaatgaggtcatttccttcacattaaaacgacgtagtgtgctgcaaataataaaaaccccattatcgatttgattatccccaactaaagaaaacaccaaattgaaatcaaatccctaaccatataaatcgaaagctttctctgaacattagattcgttgta

SEQ ID NO: 14252 - DNA, 3000 bp, Unknown
  misc_feature (1)..( 3000): cDNA_ID_3015494_gDNA_ID_2684095_Annot_ID_190058 3000 nt of promoter + ATG
aataactacaccaagaagagttcctctcgatttagaaacacaaaactaagtcaaaaactgactggtaaatgaacccgtcatctttgatagggttaagacatgggagaaactaacaaaacacttaggatcagcttaacaagatgatgcacatcacgagaagctagagtcttccctatacaaaaggatacagtgttttttgttcttcaaagatcttgtccctgcaaaaccaacaaatgcagagaccacaatgaatcgaaacctcaaacaaaaagtgaatagcatgcaaagaaaacaaactaaactaatcctacatacactttaatatcatactcacaattttaattttgatctgaaaaggaagtaaatataaataccgtgaagcagttgcatgtacaagcttctgtttcaaacctttgtcgataatctcctccaacaattgcaagtctttttgacgtccctcctccattactgcaatgcgaacataaacatatcaagcttaaggctctaaccatccccttgtttatttgataaacttagtccagaataagtttctagagccttgaaatgttcgtttcagaatctagagtcacctaaccatcaatatctaaatacaagctcggagagcgtcgaaactatacagaaattgcatcaaactaatacgtagaagcatttcatcgaacaggtggtgaacatccccaagagagaacacaaaccacgtaactacactttaaatatgagaatcaaattggtttccaaacgaaaccctatcaaaaatacattcaaatacagagaatccaactcgataaacgagaaggaatctgaaaatcacaaaattagaggtacagataacagcaaaggtccaagagtatttgactcacgagtcacgagcaaagagatgaaataggtccagacacgtcacgaccgaacgacggtgattcttttggtgacagtgatgttgaacgacggtggttgtgacggcgagtggcgacgccgcgacggtgagggagacgaagaattatttggtggttttacaatttgaccgctcgagcacagattatttaaaccatgcgaaccggtttgttcttacttttggttttaatttcaagtcctttgtaatataattaccttgcataaaggcccacctactttttaattttactattttacgcccaagattttcaagactcaatcaaactggctaaaaagaaacaagagcagaactatgaacgaacttgggatgctatataatcttcaaacaatgtaaacagagaaaccatatataacaaaaaccttaaagatgcatcaagtttcaaagtgaaacaaaaagtgctcaataaaaccccatttgatgatatacaacttcttcttcagctaatacgtttccatgtccattcaccgagtttgatccgcacaacgcaccattactcagcatccacaaccgtaaccgtttccatgattggctgagtttcacctctagaagcttccatactataataaactcggcagctaaaatagaacactgcactcatcatcgaatctataagtgtcacaaaggaatacatcaacaccaaaagaggtccttcccataacctcgaagagccatctccataactaactttcttcactctgtgatcaaacaatccttccacaaacgccaatcctaaagttgatccaaggaacatcaacaaaccaacctgaatctgccctttgatcaaatcactagctctcatcaatgctcctaaccctgaaacatcttccaaaaccgagatcacaatcgcagtgttgcagattataatcgcgttagcgaaaactacagagaaggctaaaccaactagcatagctccataaacattgaaatctggagagaagccgagaacagagaaggaactgcagattgctacaagaagaacgcaaaagaaagtgaagcaaccaacaatcagaatgcaaatccaaacgtaagtgaacacaactctcctccatatcttctgcaatataaccaagaacttgcttatatcaactacttccctcgagtaagaacaatccactgagtaaaccacagctgctttagacaacagagacacagtgataaacacagggaaacacattgcagacgaaacagcagtttcagcgaatttctgacaagaatgtttgacaaaaggctgcaaaggaagaccacttgatttcgccactaaaagaagcttcactgtgagtttattcactaatgattgatcaactaaaaagtttggtaagagcaaagcagagacaggacagatcaaaacagcagtagttaacattaaagcaccaagattgtaccggagaattcgaactgtttctcttaagatctctaacgcatttgaggagtgaaattgtttgtgactgtatgattttagctccggtttccgtaaaacctgattcgtttccgtctccatgtttccgagagtgaagtgtgttttagctgagttcgagattacataccataaaggttgatttcacaagcagcggagatagaaatcgaagcaaagagaagatctttcagataacccaggaatcaaattgaaaaaaaaagacgaatcttggaacggatcttgtctacgttccaacaataattttgattagagaaaacaaaaaatgtaagatttccaattttgtcggtggcacaagtgaacgtgcttttgtcggaggtaatcttcttctactccatcgcgaacttgaagctaaaccgctaatttaactgaaaccttaaaacactaaaccataaacccggtttgaaaaaattgatcaatttggttaggcccaataatagcttaatgggcttctttagaggaataaaaagaagaatatttctatggaaaaaaaaaaaaaaaaaaagagagaatctttccggtgaatgggaaatggcaagaagaaggatacgagtacgatgaagttgagttagagcgggagagagagacataccgttgaccactaaagacgagagctttagagagagacgcaacaatg

SEQ ID NO: 14253 - DNA, 3000 bp, Unknown
  misc_feature (1)..( 3000): cDNA_ID_3015436_gDNA_ID_2684095_Annot_ID_190074 3000 nt of promoter + ATG
ggggacgcatcacagttgaagagaaaagacttctcctttgaattgaattggatcctatgttactctaaatgtgcacgtgttcatcatctccacctctcattatcattaccaatccttattcttgatttaaaacggattttaattttcaaagaactcaatgtttacttgcattgactactaattattgaggacatctaaaatatctaagaaaaaaaactcttgttaatcaataaaaaaagatcccatatgtaagtaattttatttctttgcttttttattcttagtctaagatcactaatcacataacatattacatatagatggatgccacgtcagaaaagagtctatttgaaagcgaacttttctttcgagtaaaacacaaacctgaccaaacgtgtaacaaaattaaacattatcgtacaaggggacattgtaacacatgaataactaaggttgataaaatttgtagacggacataaagaattccaagaaaagtgaattaggtgaaatttaaatgggctatggggtcaaagaatggtcgagaaaataaaaattagattatgtcagacgagtaaaattgagctttggattaattccaacgttttagtgattccttattacacatttgatgtatttttgtgacaaactgacaaaagtatatattaatgctatgttgaaaaaggtatgttcaagcttgtaatcaattttggactgagtcacgcatggaccgtagctaatatatccaccgaaacggattgaccatgagatcgcaatctattttatacctcagataatttttgtcccctcactatatgagctttacatacatctgtttccagagtaatttagttgcttattctgttagtcactccctaaaacaagctactacactcgatcaagcagtaacatcaaactcctttaatcttccaagttagactctcttcttacttttcaaggtatgtttaaatatttaacatgtttataaataattccatgtgtaaatagaacatatgtttttaataacttagtattttagacgaaagaatcgaaaatctagtactagtctactggatataaacaaagtaacaagatagattcatagcccaaaacaaaagaacaaccaaatcgaagtcccactttagctagtggctctacttacaaacaaacataattaatagtgtgtttcaccatattttatttcatcatttcattttaaacggtaaaaaaaaactgattacaatttttataaatgtttgttctgcaaaatataaaattaaataaagctgcataactttctgtttcataaaattatatagttcatatatacttcttcacccaaccttttatttcatatttcatatataatattaatgtgtatttcaaagtgattgaccaattaaaaagaaaatatgacgaagagaaagagagtttgtagtgcgttcggttaaatctctgtgcagaggatcgtacagttctgagaccccttttgtatctgtatttatcccatatttaatggttacgtctgccaattgggatttctggtcaaatacgaaaaggtcttaaaagttatttctttacatttttactgttcattctcattacttatacacacttccacacggccacattcctcatgtatgtgggatatttagggttgagagtttttttgaattggcattgtaatatctcgttattaaaaaccatgagactgctacaaagaataaaacagtcaaaatttcaagattatttgatacaacatgacaaggagaaaatgagtatattgaagcgatgtttaattaagaaaaaaattgaatgaagaaaaaagattgtggttaattttttaagataagagagggtttcacagaaacaaaaatggtagtaaaaagtaaaggaatgaaagacaagtggagattaagagagaaagaggtaaattttaaggaacccaaaatgaaatgaaagaaaaagctgtctgagaattggttgtgctaagaagagacccgactcattccccaatggtaaactctctttttgccttcatccttttttggtagttagttctgcttcagctttttttctttcatctcattagcttttattattttcaccttgcacctataaaacatgcattgattaatagaggataaatttcacctaataacggtaagattcatttcggactcgtccaagatattctctacattcattgttttttaggtcgacactcccaacattaatttattttgtcataatccattggttttcattaaataaaagaggaaatactatcttatacatcaaactaagataaacattaattattcataaaagtaggaaatttgtataaggaaccatagagaagcagcgtaattaatgttatcgtttgattatgaaccctaatacgactataaaactattgcatacttttcaattactatcaatctatggacatggaaaaaaacttggtcttcaaatcttagttacttttaaatttaataaatgatttatcagaaaaactctttaacttctatgaaactaggtacacctgaacaaatgtataacagtccacagcaaaatcgaatatcgataatacacatttgtacttacttattacagtagtgtatatgtaatatatataataatgtataaatgcaaagaactctgtcgtttgaattagtccgtgacgacggtccataaccctttttaacagtcgtcagaaaacacggtcgcgacatgtacatacacgcacatacctaaagccatacgtaacaaacacaccattatatacaaaagatattctattatttttaaaaaataatatttatgacacacatttacgtacgtgtatatataatatgcaaatgcactcacataagtctttctcctccgatggtatatgtctataagctgacgtgacatctctcttaattctcaataacacttctcttcttcttcctttctcccaacactaactccatgtttataacggaaaaacaagtgtgg

SEQ ID NO: 14254 - DNA, 3000 bp, Unknown
  misc_feature (1)..( 3000): cDNA_ID_3015482_gDNA_ID_2684095_Annot_ID_190061 3000 nt of promoter + ATG
gagtgtttactaatcgttttagcttgtttacgatctgacgagttctgtagtatctgggaatgtaatttacttggattggtcaagtagttttgtgaagaaattaagactgaagataagatcataagaacctagttatgtagctgcagaggtttattgagttggtgttttttttcatttgtttgtcagtctatggttaccactgtctttcttggagttatagtacatagacatgcatggagttgttacattttgtggtgccatagaaccagagtagaggtttgattagatattgttgtgtgcttttatagaggagaagaaggggaagattgctgagatcaagtctggaatagacgaagctgatgtcttggtatttgcatttaacttgctttaatgttgttaccgttctgttctttcttttttaaaattaatatatatgcttctgtggtttttttgtagatccggaaaatggatcttgaggcaagaagtttgcagccgagtgctaaagctgtgtgtctttctaaactaagagagtataaatctgatctgaaccaattgaagaaggaattcaaacgagtctcttccgcagatgctaagccgtcttcccgtgaagagttgatggaatccggaatggcggatctgcatgcagtaagcttctaactcctaaatagaaactcttgttttctcattatcttagttgtcttaattgacttgcatcagttaggcttctttgtcctgaggggaccctcctttatattcatcttcacacaaacttttagatggcaaagactttgctgtgatttacattattgtccatgttccaggtatctgctgatcaaagaggaagattggcaatgtccgtggagaggcttgaccaatcaagtgacagaatcagggagagtagaagactaatgctggagacagaagaggttggcatctcaattgtccaagatttgagtcagcaacgccaaaccctccttcatgcgcacaacaaggtaccgtctacaattgctcggtttggtatctatcagtgccaatgatttgtttgaattagatcattgagaagctaacttttctgattttgaatcacagcttcatggtgtggatgacgccattgacaagagcaagaaggtgttgacggctatgtcaaggagaatgactaggaacaaatggatcattacatcggtaatcgtggctctcgttctcgccatcatcttgatcatctcatacaagctttctcattaatatactcaaaaaacattattcatcgtgattgtgtatatatatatgatggttgatttactttgtaatggcccaagtggttacttgtatttttaagtacgatgtttgtattgaagtggcaacacttttaacattcataaggtttcccaagtcttttcttttttgtctttttttccaaaaaagtggtactattttatataaagcagatgtttcaaaagttacaactgtggaaacttccacttacatctcaagtccaacctttgaaaacttacaacaatgtaattccaaaaagaacaaacactccattgctcaaaacataaggttttccaagtctttacatgagccaaagatctatacttataatgttttaagaaaactaggacacctgacacatccttgccggaccaatcatcttgccgtgatcaccagtcgcaggcaggagacccactgtcacgtcagagcatgaaacaaaggcctctccttctatctctctatttaaaataacatcaaacattcacgacaccaaaaaatacacacaagccaaacataacaagtaaaactatccccgaaacaaatagttttatgcagtcccggcccgtccataacgcagctagagcatgtgtttctgtcgtgaattatgttttctatgatctcagcccctgttatgttttaaaccacacgttctggtcttcaaactcgttaacccattccaccctataaatcccttcttcgtaagcagggatagattgacgagtgattgaaaataatctttaatgatcaagaatttcctcccattcgccggaaataattcacttaaccaccaaatgaaagagttttgagattaattaatctactctttaaaattttaggcatatacacttgattgatgtgatgacaaaatgatttgagtactaatcaagtacaatcactacaaaaaaaatgtgtgtttttacatcatttattttatatatttttattagttataaacttataattgatggcaagaaaaacatttacatcactaaaaaaagtgacttttgaaagtagtgatgcaaatattttgtatcgattcttgtaaatcgatcttaacatatatcaattacaaaaaataatgttaaaattcgcatcatttaatttaaatgatgttaatatttgtaacatatataataatttatgcatgccaatatttctattacttgtaaacaattgatgttaaattagttatcagttttcataattgattcaaataattgtgtgatttgaaataattaatttctacattaatttaaaacattgtaatttcataattaatttgtagatactagtgcattgaaaagaagcgaaaaaagacgtcagcagtctataagatggattagcttcatctccaaggcatataaacccattcgtgtcaatcacaagtcacaccttacaatttcaaaaaaagtttctgaaacttggtcttttgtgctatcattttgattcttgtgctaagattcttcacgaagatcaacaactctaaaaagaagaggaaagataactttaatggatagaaatggtgaaggagaggtcgaaaatctggctttagataaagtttctgtaaaaaggtgttaaagaaaaaaaaactagtcagaaacattaaatcaaaactattcaaccatcaatgtctacctcgagagattcaagacgtagaagaagaagacaaacgtgaacgtctttaaattatgaaacctctttcttaaagttctcaagaggtgctcaaca

SEQ ID NO: 14255 - DNA, 3000 bp, Unknown; identical to SEQ ID NO: 5348
  misc_feature (1)..( 3000): cDNA_ID_2686636_gDNA_ID_2684095_Annot_ID_190085 3000 nt of promoter + ATG

SEQ ID NO: 14256 - DNA, 3000 bp, Unknown; identical to SEQ ID NO: 5343
  misc_feature (1)..( 3000): cDNA_ID_3015409_gDNA_ID_2684095_Annot_ID_190084 3000 nt of promoter + ATG

SEQ ID NO: 14257 - DNA, 3000 bp, Unknown
  misc_feature (1)..( 3000): cDNA_ID_3015413_gDNA_ID_2684095_Annot_ID_190083 3000 nt of promoter + ATG
ggttaaagatagcatcatttttctaaagtaactgacattagcaaacaccatgaattttgcgtgaagaaaaaaaatattgtagggccaaatctttatcattttctatagtatgaagattccaagactgaggttctcgcccgcacgagaagggcgagcttgaggtgtttatctgcaaggagatgggtgacgacgggtctaaagttgggtgggtttgtagatagaaggctgaggaagcttcggtaaccaccgctccatggagacgggtcattaaaaccatgttttgattactgttaaaagccatgttttgattaagcacaatgcatttcatgcataagcggttgaacattttttttttactctttagcaatatcgtgagccatttgtttttgttataacatgtacataagagaatgatgttgagctatcaaaaatcagtaaaatatagactcaacgatatataggataaagatgaggtaaaggttgatgaagaagaggataatgatcggttggtgaggaagaggataattaggttgatcaggtagaggatgatgatcattgatcacaatggatcgttggtaatagattgcccttcattaacagatgtggacttagttgacgtttgggaagactattgcttgatagagaatatgtcttgccttgatgtggcagacactggctttgttcctaatcccgataccaagtttcttagatctctttcttctgatgtatggatttgcgcttgaccaaatcaatggtagccattttatatatctctctctctctcgtattccttgttgtttcttcaactaatcttcgttttcctctatcataagtcgcgtgttgtagcgccattaacttctctctgctcataacgttttattttcaaacacaaaattccgtagactggttagaaccacttatgtttttgcttcaaaattctctaaaactgaaaactcttatgatcaacgaaaacacggtaacaagcgcatccatctaattttgatgaactcaacattataataaactgtactgataccaggacttcgagggtctccaaccttcctggaaccagtcgagttctattcccacatgcctgtcaactcatctagagatctttggttggaaagacaatggaagaagagaagatgagaaacaatttagtgacatacattctcgcaaactcaaagtgtttaaagacagtggaaatctccctcatagcagccttcaatcttaaggagaggcaaaaggagttagttaccatgcctaggatttcaacattatctaggcttctattccccatccaaatggaatgggagttcaatgaaacaactttttcattatatatattgtcatatacagtatatgctataactactcaagctgtcgtttacagattgcaatttttttgccttattaactcgaaaactctaattcagccaactttttactagtcgagatgaatttttttttaagcatatacgtacaacaaggctagattttttcatcatgagtaagtttaacaaagactgtgtgcttgcaaagtcatcatgagtaggttgttttgagtctcttatgtgaattaaacaaaacaaaaaaaacaacgtgaacatttcagtccaattttgtttgtctccctacgattcaaccagcaaaagaaaaaagcacataaaagcaaaaaatgggaatcaatatattgagacgttaattatgactggcatgtgtatgtatattgtatggtggtgcgttacaaatgaaagcaccctcatatctctcgctatcacgacttgggaacttgtttttaccccttcaagtttcgtttgccaacttttacttactgttttttttttaccagttactttattttactttttgcaatcaaatgtaactttgtttatttaaaaatgatgtttctagagggtcatcaaaaatatcagtgattaggcataattgtcaaatcttgataattcaaagatctcgtttatatgtgtttagtaatttagtcatagactcaaccaaaaaactttagtgatcaagtgatactttttttttttttttatcttcttccaaagcatgcaaacagaggaaatcaaaatataaatgtaatcttttaaaactacggttgtaattaaaattacttttttttttttttttgtcgtaaattactaaattagtattgaattaagttagaaactatttctgtgtattttcttagagtaccttgtgtataattttgtatgaaaatagctaaagaactatcggtaacttttcttcactttacagttttgttttttacctctacagtttttacaattttcgttcttgttttacagttaaaaaaaaatagaaagaaacatgaaaccaccttcgctttctctgctggtggaaggtgcttcgatactacgacaaagagcagcgaactagtaaagcctcggagatctgaatcccatttcaatcagcaaatctttccgtctctacttctctgtttgccggtgtaccggattctgattccggaacagacattgcttaattttgcttccctttggcctgtaagcagattttcaatttttgctctgtgtttgattttcttatatagttggtttagtaagttcttctatgaagtgagaacaattctgggcacttctgattttttagtctctagtgattttaactagtctattgtgattttgttgaatttcaattttctcagacttaactgataaaaatctgattttttttcttcttcttattgttaagctttgatgatatttttggatcttgttaatatttagtataaagttcgtgaatctaacattatcatggttctgctgaatctatacttaaatttgaaaatgacttatgttgattaaaaaccataacttttttttttgtgtttcagggattgattgaagttaaaaaatagctacattgtactgtaagattgaatattgatgatctcgccgcgcgatttctcgtttgagtgattttcggctgtgaaaaatg

SEQ ID NO: 14258 - DNA, 3000 bp, Unknown
  misc_feature (1)..( 3000): cDNA_ID_3015432_gDNA_ID_2684095_Annot_ID_190075 3000 nt of promoter + ATG
caaccggttagattgatgttcagctctggtcccttatgattcatccaccattatatggttttaccgggtttaccaaacgttagttgtttttctattttcgagtttcttaaatactaaatgatttaaaatattaattaaaaaatacattgtaagttgtgcctatgtattggctgaataatcttaggacactgcataatttgctctataaactgcaacaaatatttgtttgcaaatgaggaaaatagaaatgttagttttatcaaatttcttgacatggtaattgattttctcaaaattattcttaacagatatgacgttgcttttctttttgtttacctcgtatttcttgacatgtatgctttgatgactatacatctttcctgtgctactccaatttgattatagatctctctaggacattaatattatcgggtatatgtttatttactcttatgtgacttaattgttattagatatctcagacatttcttttgcatgttcttggtcattagccgtagtatgtcatatatatatatatatatgccttgtatcaatcaactcatgtgcataccaaaaactactaatcacattgcaatttatatttttggtagtgttgattagtaagatacttggtggtacaccatttatcgcaacaataaagagttatcaatcagaacagaaatgggagactgctatatttatctcgaggtctatcttatatacaaacacctaattactttgaactctcgaagacaatgagaaatattcttacgaacacattagctgtagtattgaccgcgatctttatgctttccatgaattggtgaagaattgcttccttgtggtcaaaatgtatgtgcacaagaacattcgccgcttgaagcaagaaatcatgttaggtgtcgatgataaggtttttttacttcttccggatttacatgaataaagcggtgaaccataccatattcatatgattggggaaggcgatatacccaaataaacaaaactgtgaatcattatcacaagatcgccttgccattaaggtcgtgatgaatgtgtctttgacgtgaattcagattttcatggttataagaataacctaatctattatcacacatgagaaactaaaaataggtaaccacaaattcaaacacaaaattattttattttattattactaaagtaaatgaaagggaaaatacaaatatcttaaatatttttagatgactaagaagcccaaggaaaacactgaggttggcctccatcacgtctatcacgacaaggagctggctcataaatactccatatacattcgctgcaaactccatatttaccgcttggattatcgtctctatcagctctaaaaatatcaaacgtagctgtattgccgggccactcgaaactgcaagtgtatgttgttgttttacggagattgacacgaaacctgaaatcaaaacgatctagagggttgagtcttattacccctaaatcttcccctttgttagtacaatgtacaatcaacgttgcacgtgtgaccaatttgttgatgatgataacatgtttacgtgcgaatggtaaaagcccatcgggggacgagtgatttgttaatgatgctgacgttttgaggataaagaaaaataagaataatacaaaaataaaattttgattggttgagaaagccatgagtgtgttttacttttaagaatttgtgagataataatatttgttctgtttcagaagcaagaatttatagatgaaaatacattaaatgtgttattatttttaatgcaaattatcttctgggatatacgtataaatctttagtttgtaacgtaaaatacaattacaagcatactaaataaaatatatatttaatggtttctatatcattattctttggcaacaaaaatggtcaaatttatggaataatgcaatgttagtatgaaatggtttctatatcattatatttaattattaacaactatgcaatattagtttgaaattgtaacgtatgtgatactaaataagtgcatgaatcacgcgaataaatcaaattattttgaaaaactgttagagcaagatctaccttaaaccacaatttattgatttcttttctagcaacaaaacgtcttttatcactctaaaccagcttcaaacacatcgtgcacaacaatgtgtttgtatctcacgatcacgcatgtgagaagctaaattaccaacgttgtaaatttttctcctattagataaataatatagagtaagagtaaaaataaatggtccaacatggtaaacatagcactttaccaagattttaaccaccgcaatcttgatatcatctcgaggagaatgatgattgttgtctcgtcgctagggatgacaaggagaaaatagttatcgatattttagttatttgtatagaaattagtttttataatcgatgttttggttattcatattgtaatatctgattttgcttaccctagcaacaatttttttagtagtcaatattttggttattcgtatagaaaccaaaatattttgtactcattcacaaaaccacattggaacatctgtaatatagcattttgaactgatgtatggcagctggcatttttgtaaatgttttcgcattattgtatttctaattttctgtatgaatattccaaaagaagttgtacattttaatgagacgtggctgacaataaaggaggcaaatctttttagtggcactgaaagagagatcaaaaagagcatgaaaagagatagcaaaaagcccacttttttgcaacatgtggctctctcatctcttcatgtccctctctaagctgacgtgtaatttctccattttctctgtctttatggcttgtggctctgtgtgatccgttattaatttaataccaacctcagcctcttatacatactcttgtctcagacctcaaataaagaataaacacataacacaaatctaatctcatactccatcttcttttctgtcttatg

SEQ ID NO: 14259 - DNA, 3000 bp, Unknown
  misc_feature (1)..( 3000): cDNA_ID_3015490_gDNA_ID_2684095_Annot_ID_190059 3000 nt of promoter + ATG
gaagcttgttttaagcaactctttacatgatattcattgctatttgcacgattcaagagtgacatatacattttatttaacaataacagtgtaagatatgtgattgaatacttgtggaaacatagagttacacaggctgcgatagtattcgacattttaactggttttgacattacacgattttgtattccttgcacaaagtctggtaaaacagtaatagcaagaaaaggtcaatgctttcctttgttgaggaactggaattagtgtatttgtcaggagattattctactttgagaatctgatgatagtaccaagccaatcttcaggaacactatctctcaaatcaccgtttagtgctctctgtgaatgagttgtcgcagcctgtttgaggagattgaaaaaaagagcatgatggcggttaaaagctccatctttatctaagatatttagttggttaaaggcaaaagttgtctataatctaccttcacaatgtagacatcgactccaagttttgcaatcatagcagcttctgatatcttcgtttccattccaccggttgtatcgtgcgccgcaacagagtagtcaactgtttgattccaaaaatcagagaggtttgaacttttaacaaatccctcagacttattgtattgcatagttttacaacattggttctttcgtttacctttcttgtctgtgtgctccaacagtggattcacaaccttccagcttccatcttctccaacagctgcatgaactgttagtatcaggccaagtctggaaaagatataaaaaaaacaaacagtaaagtttgaaactaaccgatctctttcaagagcacagcgtcgggctctgaaggtgaaggtggtcgatcgtagacacctagtacatctgtctttgtaaagagttactcagataacaaagaatatataggaaagagggagagagaacacaaattaaatttccggtttatactatgaataggatacgagaaagacaacatattctggcttcaaatgatctgcaagatgacggatgataacatcaccactcaatatggtgcagccctgttcaggacaagattttcaactgttcaaattctaaacggacaagaatctagatagctatttggtatctctggagagcatattaccagtatattgtccagcactgcatctccatggagaacctggccatgacaaaaattactgtccaaattacagtcaagagactttggtaaacatctacctaatttcactggtgggatcaaaacttacagggacaaatcctgagtctatggttttagctacggttgctagatctgcagaagccacctaatgcaaaaagcagtctcattgaaatctaaacccacatgcttcagatcaggaaatatgttaagaagttcagttagctcttacatctcttttggaggttgaccaaccacatgaaaatggagacatgcctatcgtaggaatgccctctgcaagagatcataatgtttagcttcaaaattcatcttttcctcttagccagagtaggaaaagagaataagcttaagagatacctcgggctagtgctcgtacaatttcaagattaagatttgtcacctgcaaaaagaagttgtagactatcagaacagctcaagactatcttacgtaagagcatcagatttagctaacagtctcacagatatacgagtagcaacgaaaccagctttgacaataggtttctcaagtcctcctttgtgaaccccagatctactggcctgaaagtgcccaaaggaacctaatgacaaaaatcagaacaacacataagaaacccaaaaactaaataacagctcaactaacacaagcaggtcaatgatctgtaagagctaaatcaaaaatgtattttgatccttcattataagatttaagcagataagaatcaatctccaactaaccagcgccatgaaccacaacaaatttactaaactcagaagacttttgatcccctatgtcatccacatcacaagaaatctcagagcttccaggtctcttgctccaatccatgccaataaccttgcttggagctgaaccctccaacatagcttgacgtaactgacacgccacgacctccagattttcatcgtgaatcttctccagctcgtttttgcaagtaattgccgcacctcctatcaaatcatttagacattctgctgttacaaagtctagacaggtaaaattgatgggaaatgaataaaagacagatctttaaagtctttcctcatcttcggtattcaatagtcaaatcagaatcaaacccataagacagaacaactaaaatgcgatctaagaatcgatccagcaagtattttaatagggatcaaaagacaaaccaagtttcacaatgcaacgaattgatctgcttcgactctcggaaatattcagctccattgttgcgtctctctctaaagctctcgtctttagtggtcaacggtatgtctctctctcccgctctaactcaacttcatcgtactcgtatccttcttcttgccatttcccattcaccggaaagattctctctttttttttttttttttttccatagaaatattcttctttttattcctctaaagaagcccattaagctattattgggcctaaccaaattgatcaattttttcaaaccgggtttatggtttagtgttttaaggtttcagttaaattagcggtttagcttcaagttcgcgatggagtagaagaagattacctccgacaaaagcacgttcacttgtgccaccgacaaaattggaaatcttacattttttgttttctctaatcaaaattattgttggaacgtagacaagatccgttccaagattcgtctttttttttcaatttgattcctgggttatctgaaagatcttctctttgcttcgatttctatctccgctgcttgtgaaatcaacctttatggtatgtaatctcgaactcagctaaaacacacttcactctcggaaac

SEQ ID NO: 14260 - DNA, 3000 bp, Unknown
  misc_feature (1)..( 3000): cDNA_ID_3015486_gDNA_ID_2684095_Annot_ID_190060 3000 nt of promoter + ATG
tgaagattatatagcatcccaagttcgttcatagttctgctcttgtttctttttagccagtttgattgagtcttgaaaatcttgggcgtaaaatagtaaaattaaaaagtaggtgggcctttatgcaaggtaattatattacaaaggacttgaaattaaaaccaaaagtaagaacaaaccggttcgcatggtttaaataatctgtgctcgagcggtcaaattgtaaaaccaccaaataattcttcgtctccctcaccgtcgcggcgtcgccactcgccgtcacaaccaccgtcgttcaacatcactgtcaccaaaagaatcaccgtcgttcggtcgtgacgtgtctggacctatttcatctctttgctcgtgactcgtgagtcaaatactcttggacctttgctgttatctgtacctctaattttgtgattttcagattccttctcgtttatcgagttggattctctgtatttgaatgtatttttgatagggtttcgtttggaaaccaatttgattctcatatttaaagtgtagttacgtggtttgtgttctctcttggggatgttcaccacctgttcgatgaaatgcttctacgtattagtttgatgcaatttctgtatagtttcgacgctctccgagcttgtatttagatattgatggttaggtgactctagattctgaaacgaacatttcaaggctctagaaacttattctggactaagtttatcaaataaacaaggggatggttagagccttaagcttgatatgtttatgttcgcattgcagtaatggaggagggacgtcaaaaagacttgcaattgttggaggagattatcgacaaaggtttgaaacagaagcttgtacatgcaactgcttcacggtatttatatttacttccttttcagatcaaaattaaaattgtgagtatgatattaaagtgtatgtaggattagtttagtttgttttctttgcatgctattcactttttgtttgaggtttcgattcattgtggtctctgcatttgttggttttgcagggacaagatctttgaagaacaaaaaacactgtatccttttgtatagggaagactctagcttctcgtgatgtgcatcatcttgttaagctgatcctaagtgttttgttagtttctcccatgtcttaaccctatcaaagatgacgggttcatttaccagtcagtttttgacttagttttgtgtttctaaatcgagaggaactcttcttggtgtagttattgacaatactttgctgttctagtgaaatctaattcggttgaaatattcttgtttccttgacggttactcccactccagctctgacttgcggaaaaacctagaaactctggagaagaatggtgtaaatagtctcaaaacaagggtcaaccttggttcagaagtttacatgcaagctgaagtgtacgttacttatagctttggttctttcgtttaattttagtcaagtcatttagctatgaaaggtcatgcattgtctgcatacaatgaaatacactgtctccatacacagcttaatgcaattaagaagtgtgcttttactgtgttctgtatgttagaagctagttatgtattattgagcagaaaacgtttaataaatggggattaaaataggagatgctttctaccaggtttgcttctgatttcgtttcacttgacttgggtgtttgtttgagttcaggccagatactcggcacatattcatggatgtaggcctcggcttttatgtggagttcacacggcaagaagctcttgactatatagcacaaagggaggaaagaactcaaaagtaagagaaatctttgcttttctagttttcttgctccatgtacaaggaaaatatggttgtatcattgtatatgatgaatgagttctccggtggaatgcagtatagtgactgaatgttgatgcaatataaatgtggttttttttgtttttaacagacaactagaagagtatactggtgttattacgcagatcaaagggcgcatcaaactggtaagttcaagttcttatcttgctttgtgatagtagtcaatcatttgtcttatgaggttgaattggactagaaaatcactattgcgtaggaaccctgcatcagacggatatatgaaagtgtcatcggataagtattaatgttaaattaccattgcaggctcattaccagattcagcaaatactcaatcttcctgaagagaatccgtcatcccggcaacgtgcgttttagtacactacctagtggaaagttgaggattttctcttgcagtcttatcttctcgatttgttctgcttactgttttgagtttttaaagcagagaattaacttagtttgttcaatactaactctttctccggaatggaccaaactgttggtgttagataaacatatcgattaagcaatcaaaactttatagaatgactattgttgtgggggtgaatagtgaatcgcactctgttaaatctgccatttctattttaaatattaataatcacatgttagaacttagaagatcattaacagtttaacacagctgatgaagaatgaaataaaagtatgaacgaaacagatacaagataatgatattccacgtcagcaaagtgtccaaatatcttccgcttccctgtcttcgtcggtcccttttcggttttcacggtaaggctcggaggaaaacctaattcgtccggagaatctccacctcactctcgccaaacgcatctctgttgtaggtaagtcacggatcttcattctacgctaattgttattgttatcgttattcttgatctgggcgtttttgtggaatttgcatctaaaattagaaatttggataccaaaatccactccaattgaataaggtttctgaagaattttcgtttgattttgagatcgaaaattgcgttttctcgtttttgttttgttatcgctaacgcatcaggtcatatatctcaagtttatattttgtggcagcttgtg

SEQ ID NO: 14261 - DNA, 2620 bp, Unknown
  misc_feature (1)..( 2620): cDNA_ID_3015646_gDNA_ID_2684096_Annot_ID_190105 3000 nt of promoter + ATG
aagctttagatgagctttttaaacgaacctgaaacactagtgtagataaaagaatatgagacatgtatctcttactcttagtatcaccagaaatctccacaggaacaaattccgtctttaaaatgatgaaacctatttgtatctctaatgaaaatctctctacctgcgtaacttgatataaatttaatgactgcatggcaatcgccgcatatcctaaggttctttatgacctgaagaggtgtgccgtctggtgtgttaagaagaccgaaaactactgctagtttctcactgtgtccccataacatctgctcttgctcttgctcctccacatcatgcagagcaaaatctaaatttgggcggtgacctgatttcctcatctctttgctaatctcatccatcttctctgttatttgatctatctgcggatgcgacttgtcaccagccagaagcgtgtacactctgttcttcacttgaatccagctgcatcccgggttcttcttcagtcccagactctccatcttgtttctaatactgtctacttctgtccacatgcctttagcggcatatatattggacaagagaacgtaagtccctgggttttcgggttctaaatggaaaagcttttctgctgcgatttcagctaaatctacattgttttgaagcctgcaagaatttaacaaagctccccagacgcaggagtctggctcaaaaggcatctcttttatcagatcatatgcttcttgcaacttgcctgcgcgtccaagaaggtttaccatgcaagaatagtgttccaacctcggttttatcccatattcctctgacatcattttgaaatatttccacccttcatctgttaaacctacttggccacatgctgataataaactggtaaagctgatgaaatcgggtttcaacctggttctcataagagattcaaatatgctcatgacttccttggccttcccatgcatcgaaaatccattcattaaagagttccagcagactaagttttttgtaggcatcatattaaagacaatctgagacaagttgattcttccacatttggcatacatgtcaatcagagcactccctacatgaacattatccaaaaggtggacccttactgcaaatccatgagtggatctcccatgacccaaagctgctatatttccgcaagctggaagcattgaagggattgttacatggtttggcttcacccctgcaacctgcatttctctgaacaattccaaagcttcgatatctttcccgttctgagcacacccagctatgattgaagtccatgacacaacattaagctccatcgtttgctccttgaatagctcaaacatttcaagtgccttgtcaacaagaccatttcgcgatagccctgtaatgtaggcattgcaaacccctgcctccatcatctcaaattgattgaaaagacttatgattccataaacatgcccagatttcccatacatatcaatcattgcactaatgacacatttatccttaagcaaaccctgtttaatcacatatccatgaatcagcctccccatattcagcatctctgaatctccaactgaaggaagaacacttgaaactgtaacttgatcaggacaaaaccccaaatggtgaatcttctggaacatcaccactgcttccttgtgatacccactccgattaaacccactaagaataccattccaagacacaatattcgcctcaatacctgaactttccatctcagagaggatacgaaccacctcttctaagcaaccctttcgcgcataggcacaaagcaaagcactgcaagtgacaacatctttgtcagacattctatcgaacactttgcgtgcatcacccatcctaccacacctcatgtacatatgaaacatagacccctgaacaaacgcatccatatccaacccggaaacacacgacacacaatgtatctgtttacccactttaaaagccgataattcagcacaaaccttgaacaaattcggaagaacatgactatctggaatcaacccatgagagaacatccgagaaaacacaccaatcgattgcgtaaaaagcttagcctttgttaaagcgtatataagagaagagaaagagtaaatagtaggatccggaatcgattgcaagacgagatcagcatcgttgaaacaattatagttcgagtatgaagcaatgagtttagcggagatatagccatcgttttgagctccggatttgagtatacgagcatgagcttgtgttgtcttcgacaacgaagaagaccaatgatatgatgaagattctaagaatccaacgatcgattgaggaattttctctatcagtggaagaacttgttttgtcattgcttaactaaaaaataaaattttcccgcttaaccttaatcattcacttattaatcttcctacgtgaccagattattccacgtcaccacaatcagaaatcaacggctgaagatgaaggactgggtctcactcagcttctgagcaatcttagtcgttgattatgtcttcgagaaatcttggacgttgattctaccttctccgagttttataatctgttttcttaagaaaatttgattgatacagagagagcgatg

SEQ ID NO: 14262 - DNA, 3000 bp, Unknown
  misc_feature (1)..( 3000): cDNA_ID_3015630_gDNA_ID_2684096_Annot_ID_190110 3000 nt of promoter + ATG
aagctaagatctgaagatgaagaaggagaaggagaagaagaagagagtttgctacatgatgttatgcctaattgatcttctgcttttgtccgagtctctaagtaggagtttgttctaaatgcttccttgtactcttcattaacacttagcttcgacgtcaagctacgacaacattccttgtcggactttcctgctccattgacaaaacaacaatttagcagatatttttacaatctttttctgtttttctaacaatgaagaaaaactatctctggttaattagagaacaaatgtataaatttcagaagttaaaacatttaaacgttctttgtagaaaaatattcaagattgaacaagttaagagaagaagagaaacaaatcattcaaattttttttttgatattttcttgagtaaaagtagagcacagaagaagaaaacgaaccttttcttgtagggaaagactttaatctagaaccaagaaaattcttcactttcaacatcttcgatggaactcaaagagagaggcgatttaggtgaataatagacaggcttcttgtttctttatatacataagtctttttgttgattggttagacaaagatagagagagagagaagaaacaaaagaagaaggaagagaagattgagaagcgacagctagagagatggtggacgttagcaccgctcgatagattttgcttagtgaatgatggcttttggcgcaagttagagggaacgacacgttgtgtgttgacacgtgttgtactcttggggtcgagatgacttgttagtttggagaagaagtttccttttacggttttaccttcgtttgttgtgttctctttactttttttttcaattgattaatcatgaaaattaaaattgattgatattaaaagaaacaatttcgttgtgggaaattagcatggagttcctcgtacgtttccccaaaacgagtaattgccacgtagacctttctcgtttcaatattatctggtttgggaatcttaaattgtttttttttttcacttttttttgtttatctttttgcaatatgaatgggtcaatgtatcaaaaagaaaaacacaagtcgccctcttctttaaactgcatgcatgtaattgaaatatatctaacgttttggtatgacaataactaatctcatgcccttgtttcactttgactacaacggtgctgaatgttaacgtttatttttaagttcgtgtattcaaactaatgactaactaatggagtttgaataaaatgactacctagtgaagttcaatatgtaccatattatacatatacttggttttaagtatatagaatttacttcacattgataccaaaaaaaaaggtatacaagtgtgtaattcttgttcattacacgtttgcctcactgtattactaaaacattatctcacatctttctatttctatgattgatgaaactcgaatgaaatttggaatatataattgaaagtttatatcaataacaaaatccgatgtcgtccagcggttaggatatctggctttcacccaggagacccgggttcgattcccggcatcggagcttttttattatttttgaattgaatttatttgggctttaagaagggcttagcatatttctatctggggctttgtttttaaaaggctagtttatgactagcccaaattcattgttcttaacatttaaacccaagtcattgatcaagtcatacgtaaactatcatctatagtttggtttctctatagaagaattttgcaagattagtctctttcggttttcttaagtgtttgtcttctttaagctcaaagacattttcattagaaaaataactgctcaaatcgaaaggtgagtatgcaaagttccttaaaaccatttttttttttttaaatggtttctacactcactaagatacaaagcacacccaaacaagaacggaacggaacttttttacttttgatagacttatttgggattatagagactatcggtgggcctttcttcactcggccgaacttcagtttctctgtgttttttttgtcttatattagacaatagaaatcaagatcatgcgatggcaatggcatatatgactcatattgataatacatactttcccaaagtagcacgagcacgaccacgagcacgaccaccagcacgagtgcactccactaaagtggtcggctacaatattccattcttaaaatcatattttttgttggttttgcgatatactatataaaaaatgatatgatatcgactatacatttgtttacctacaagcctacaagcatgctttggattactaggattcgataagagtggaatgtgaatgtcatttctggcttatcaactctgcaggcccgcaccaccctctccttttattggctactcaatccaaaatcctttgatctaattttgtcttcgaataaacattttaaggtaacctattgtttattattttttacttaaaagttaagagtcatattgctaaatgatactaacatcaggtccatcaccatgacattatatgaacacacatataacttcatactttggaaactttaatgaagaactttcagacttatttagtctcaatcaagaatcctctaattagtggacactccttccccatcaaataaatggctttatcttgatttgaattttgctaaaatatgggatgaagtaatcattttgttcattgtctttggaacctcggaaagaagaagaaaaaaacatgtggagtacttgtgatgtaatgactcaaacagaagatagtggtccgatcactaccctattctatctccactttttgcccaattcagaaacccaccaatacttcaaagtgggataagcaattcaaccattaacgactcataattcttttgatctatctatagcttccagtgtctctcaacctgtataaatacccttttcttgagttgaggtatgtgaataagtctttccagtgattaggaaactacaaagcc

SEQ ID NO: 14263 - DNA, 3000 bp, Unknown
  misc_feature (1)..( 3000): cDNA_ID_3015638_gDNA_ID_2684096_Annot_ID_190108 3000 nt of promoter + ATG
ttatttgccgaacttacttgaagtgtccattttgcctgtccttttcatacttctgacaccacctcttaccattaccatcgatctaccttgtgtttttctttgctacatatgaattttgttctttttttaacccttcaattgttactgtttcaaaagaataaacagcaagatgacttgtctaaaacattatactttgcagttttgtaggtaccttttctatctcgggaagattcgtactattcagctcgaatatacggacgcaaaagagagccttcttcaggcggccaggaaagcccctatagcagctttgggcttcaggatccaatgcaataaatgggcaattctggttcgtctactgctgggtgagataccagagcgttctatcttcactcaaaagggtatggagaaggccctcagaccctacttcgagctaacaaatgtgagtccactttcataatcttgctgctgtgacatgtattcattaatttatgagcggataactaaactggtattagtatgtggtcacttgtgatcttgctacttcacttctgattttaaaccggttcctacttttcacttactggcctatacacctcttctgttaaaatctctctgtggtcacttgaaacacaattttgttgctgctgttgttttctgctccttcgaattatattgaacatgaatttctggctgtttactgttgctttttagagatatatgatgcaactggatagttgatactgattttgatctgaggcttactattaaagctctgttttgattttacaggcggttaggattggggacttggagttgtttaggacagtccaggagaagttcttggacacatttgctcaagacagaacgcacaatctcatcgtgcgactccgccacaatgtcatcaggactggactgcggaacataagtatctcctactcaagaatctctttacccgatgttgccaaaaagctgaggctcaactctgaaaaccctgtggctgatgcggaaagcatcgtggcaaaggccatacgcgacggagctattgatgctacaatcgatcacaaaaacggatgcatggtctccaaagaaactggggacatctactcgacgaatgagccacaaactgcgttcaactcaagaattgctttctgcctcaacatgcataacgaagctgtcagagcattgaggtttcctcctaacactcacaaggagaaagaaagcgatgagaagaggagagagaggaagcaacaggaagaagagcttgctaagcatatggctgaggaagacgatgatgatttttagacaaaggtcatctatttcttataagagttgactctccatctgtctcactttttttatgttcacaagtttacttggtactcttctcatcgtctctaagtgtttctttattgaggatttttatcctcaggaacctttttattactctggtttcactttaggaaaagatatttatcttgttggtttcagaagatcaaattcaacttcgtttaattgtgtttgggagattttcgcattttaagaattgaacacttgtagttatagctagctgtattaggtgggtcattattagaaattgaccatgtgaaatgctatcatctccaggcgatgcataccattaaaatccacattcataatttacattaaatgatagataagcagtcataaatatctaaagaatgaaaacaggacatgtgtattgaccattatgtgtattgatacattagtctatctctgccaaactaggtctcattttcttgaataaaacaatctcatgttatgcttttaattataggtgtttctggttcgattcattaacttcttaataatgacaaaaatctgtagaataatacccgggctctttgatagctacaactgccaactatttaatccatacaatcaaaatgtaattttcataattgtagatttgtaatgggtcaatatattcttacactctaatcatatccaaacaagctcctcaattccttaatcttgttgtatccagtatccatattttgttttcttactgcggaagttacttggtagtgtagtctggatttcggattgcagactttgcagtccacgatttttcatatgttggtgacaacgaacaagtgttaagttgacggaagtgttcgtaacaaacgacgtcgtgacggtgatcttcatcaactttgattggaaatcaagttttgagggacaattaacccaaaaaaataatcataatgataatgaaagagatttggcgtgttgctaataatgtaggacaagtgagcatgtgagagtctgtgaccgatgaacctgctcagaccaacctgcacatgattgtatcacaaacaaaaaactctcatttgtctttctttcgtcttactttattcattttaagcaaaaattaaatatccaccgcgttgcacaagaaatcatttacccatatgattattctcttagttttgaatttttgatgaccatgctgatttaaaatttgcaatcttacaataactttaacttatgtataaaaaaaaatgctgcatcaaccaataaaacaaaactttaggattacaaatgtttggctatgagtaaatcaagatattatctgcttcaagtctctttttcttatataatttcagaggaaaatgtttatatatagttcaaagcaatattagtgtaaccaaaggtaaattttgtatgaactttttggaggaatagaaatccatctgcagcattattacaaacagagtttgcagatctactgtctttttttggacttatactgttactaacaaaaatacacatgtaagagatttgcccaaataaataaattaaagatacacacaggctagataaagataagaccacatgtaaggtttttgttgctatactacattagtttacactcgcttcccacctttatttaaacaactctcacctccttcactcgatcatcatcatcatcatctctttcttcttccaaaagtcataatc

SEQ ID NO: 14264 - DNA, 3000 bp, Unknown
  misc_feature (1)..( 3000): cDNA_ID_4264581_gDNA_ID_2684096_Annot_ID_190132 3000 nt of promoter + ATG
atgtacaaataacattgttaacttcttatgaaaattttgcaaaaggctaaagaattactgtcttatgaaaataagactttggtttcatgttctataaagttaactacttatgctgttatgcatcatgatgataaaacatgttagttatatgagtagaaagaaacataatatgggcatatacttatgtcctttctcaaattatgaagcagtgaattgctttcacgcccatagcaaattccacaaccatagggacacacttatttctgatttcgatcggttaaacaaagttgcatcaaaactactcggttaaacccattcataccaatattttcataacattttcatcgttagataataatacaaagccaaaccgggaaaagattggtcgacaaaaagaggatgaggggtattgctttgaattattaaagcaaagtaaaagtaacacagaactgaaacaccaacgtctatattggtgatcggtagatattcacaacaacttcacaatgacccactcaatgtaaaaatatggggccaaattttaaatggcgttgaagaattcattttcagatgtcgattatattcaaagaaaaaaaacaattctactaaaactcaatctctctttttttgttgttttcttttggtttcacagatttgcattcattcatattttgggagaaggtgccgaagagaaggcgttggaacttggaacttagtggaatgatgcgggaagatggaatgtattagctaaggcttcaccgtatgatgggcaattcgctgatcctcgatggtctactgtggaatccttagacttcagtcttccataacacaagtaagttgattttttcggagactggtacagtatgtgttattataagttattgaacacaaacacatattgaagagaccaaagttattataggagtaaaccataaaattttataggttgtattctaatattctttaagaaccagtaagaaataaatgatgatactttgctaaaagataataagcttctatcatcaaacatgtagtaagtagggggaatattataacagcttggtaccaaaaaataaaagattatgtacagcaaaacatatgttcaaaacaaacaaaacgacttaataggaatttggttacaaattaagacttaaatccatttgtcacaagctccttggttttatcattgtagtctccagacgagaaataaagcaatcatatgatatagttacttatctttctttaaaacttcaaggataagcttaaggagtttgtaaccaatgagtttaagtccaatatgttatcacttcatgtaagtcttttggtttgctttaaatagtatgtttagttgtatacaattttatgtgagaagccacagtagagaaggcactggaacttattagaggtgacgtgggaggatggaaatggaatattgtagatgataaggttatgccgccgccatgcacaacaataagatgttgctccccagtcaccatgtacgtaaatttgctcttgatgatttggttcaatcttatttgtaaaaaaattaaacctctcactaattttcgttgagaagtatataagatgactacggagtagattataacaaacttacaaatttgatttttccacataagattatatacagcgaaacatgtattcaaatgaccgaaaaatcttacaggaagtggtaatagattaaactaaacttaaacctatttgtcacaattttccttaaaacttcaaaaataagtttaaagagtttgtaaccaatgggttaaagtccaatctgttatctcttccatgtaagattttttgtttgctttgaatagtatgtttagttaattagttgtatattatcttatgggagaaggcactgaaactcagtatgtgtgacaaaatattatggttgttaatattatgccgccgccaggcacaataataagatgttgctcttgattcttggttctttcgttttttgtgacaaattaaaacctcttactaaactctttggtgtttaacttgtgatacaatgcaacttctatttttttaaaaaatattacttcagtttttctttcgttcttgtctacatgttaaaactaagcacaataatcatcatctgtgttcattattatccaagagtatgagccgcgtacgattcgcataaacaaagtaagctcattaatcatcatctaatcaatttcatcgatttatctggaaaccaatctcactctagaacaaacaataaactctatttggatcaacaaattgtactataatgctatgttaagtattacgaatttgtaattcaaaattaattagcaaaaagtgaacttggaatcttggcacaatttggtgtccaaatttttgtcacgtggcagataattaaaaaaaaactgccttaatgggccgaaattaagtgatctgacccattaaatccgtaactagcccgtgagtttatatgacatcacttatcactcttatcatattgaatttttctttagtcacaatcaaatacaaaatttattttcaaagactatcacaatcctagtatctagtttataatctgaatattggtatatttataggaagtaaatatctgtttcccataacaattaaataaaagacgtggttgttggagttgactaatgaatgattcgtaatgaattttacaggtaagtattacccaaaaaaggattaaacatcaccacaactaccaatagggaccttgtactctccacattgcttccttcccaggcaaggttacttccgtaattacgaaaacaccataaaagaaacagatctcgtcccgcgttggtttgattgatcagtgtcggtgtcctaatcacaatttccttatttagacaaaatctgttacttccctctcttgaatcgtcgtcattctcgaatctctagatctagccaaaacttttgccatctctaaaatgtatctccattgacattttgagatctatctagctctgtttttctttttagaacaaa

SEQ ID NO: 14265 - DNA, 3000 bp, Unknown
  misc_feature (1)..( 3000): cDNA_ID_3015578_gDNA_ID_2684096_Annot_ID_190127 3000 nt of promoter + ATG
tcaaatatttatgtaaagaaaatatagattatgaaaagctcctaacaaccccttacaatgtgtataaataagtctataaatacgagcatcacaatcaaacaaaacacatgcaagacaggctataagagactttataatatacaccaaactatgcaaaaaccatttcagagagctcatcctaacacacactcgcactccttcaccattcatataaacgaaccatttaatcatcatcgttacttggaccatcatcataatcacaataccttcataggtttatcttcatcaatgaagctcttctccaaattccgcaaaattttcatgaagatcatcttcgcgcttccttcttcctcctccgcaaccgtacgtcctcacaaaaccgctgacttcggcaatggttgtgataggctagagacgccgaagatatcgtgcagtaattcatactactcctcacaatctcactacagtgaagctatctcagattgtatagactttttcaataagtctcaacaagaaagtgaagaccggattgctcatgatcacgaccgtttttacgtttagtcaaacttcaaagaaaaataatgatctcatgtcttttcttcttctagataactcaaaattttcttctcttaagctcaaactcttattaatctgtattcacagtctctgcatgtttccctgaaagtaaatctcgagttcaaataaccaaaatggacctcacaattgttgtcttccatgaatgttagagaacatcgagacttatatttgttgatccgtttccaaccaattttaaaggaagcaggttgtgtttagttctttccactatcattccaagagaccaagagttgtaactgtaagcgttgtgtatcaaatcatatgatcgtggagtcaaaacgtcatcacaactaaaatctgaattaacattaatgcttctttgctatcaaaaacttttaaatcatacgagtgtctcaaaatccctaatcattaaacctctccacaagctcaagcactccattttcgcagagctttttacaccacaccagacgggagtcgaagaacgagctgtccacccattaaactgttcccaaaaacagaacaaattctaaatctttagacattcaaaacatttcaacaatatcgcgattatataatgggcgtggaccaaacgttttttacctctgaacatagtaatagcagaaatctgcaagaatgaaggtttggactatttcagagatgaggaccattacaggccacagtccagaccctaatgcagtcagtaaccgccctcgcgtatccaacacctacaagcgtttaaatcatttttagaaacattacaatatggagatatgtgtagcctaacaaggataaaaactccagaacctgaaggatccagtgtgcacaactcaagaacctagcaattcccaaagcaaatacgtaatgtgcagtgaatggttccacaatctgcgaaaaaagacataacattcaagaaagattcagactcagcactgtggtagcaaaaagctcaaggctttaaagcgcagtagtatcgagtaccttagtgttctgcatgactcttaattgaggaagaactgaaacagcttcaagataaacacagaatgcccaagaaatcctgtttatgatgtggtgacgtgttgatggatgaatgaagaaagacagaacagcacatgggattacctgaagcaaatcagagtaaagctctcaaaacaaacattacatcgccatgaagattctcaacaacaatcaatatacaagttccaaagttctttttatgatataaactaaccaagttgaaattgtgaactcatacattattctattacacaagttcaacactcaaaaacacatttaacataatctatcaacaaagagtttggtaaacttacgacgaaatagatagcaaaattgtctttatcttccatataagtaggtctaagcttgaaacggatcatataaacgacccaaagagtggtcaccaaagtagctgaatcaagaaatgtatgaagatcaaactccattacaaagctacaatacaatctcacagccagaaacaaagccgttagctcctgtgtcttgagagatatccctgttttaaatcatcaattttcaaaatgtcaaaatcaatgaaacaaattagcccatcacatactttgagaatcaaatctaatcaagccattcttaaaacctaataccagcacaagtcttctcctttgtgagcttatagataagaacagcgataccaacggcatgtacagcctcagaagcgacgaaaagattgtcgtgttcatgaacaatcaccctgaggagaacaagcaccgtcattgccgttaccacgccaagaaaagcctttacttttggcggttgccggcgaatccacgccattacggactgaatcggattcttctccgccttcatcgttcggacaagatctctttctctctctccctcgctcagatcaaatgtgtgattaatgaatgattatcacacaacttcgtcttcgtattgaattggggaatgaatgatctgtagaattcttaacgcaaccatacaatggcaatgccattactttcgcgaggaagacacgtggaagctgttaggtgagagactgatagtttcttgttaactttggcttcgtctcttcttgtctgatgcatctatcgtatttattacactaaaccggtttggtttgaacgaaagaatttacaaaaccagtttaactaatttggcacgtgtgatcgatcgtgtggtgaagaacgagcccattaacggcccaatgaagagcgcgtgtggctttaaaactttatatgcaccgaatctctcttttttttttctggtcttgcaacttctaattcttctaacggtcttatatctctctagaaaatctctctctctctctctacaatttttttcttcttcttcttaaaattcttctgtgaagtgtgcttcttcaattggtaattcgaatttgggttttttgagatg

SEQ ID NO: 14266 - DNA, 3000 bp, Unknown
  misc_feature (1)..( 3000): cDNA_ID_1690384_gDNA_ID_2684096_Annot_ID_190126 3000 nt of promoter + ATG
gtaaaatgactaagataaaaaagtgttaggtggggtgaaaaaaaacagagaataaaaacctcgcaagcgagggaagtgatgaataacagagacaattggttatattagctgtcactcccatctttcatattccttcaccatctctctctctctcgatcttgtgaaccactacacacactaacacaatgagagagatccttcacattcaaggtggtcaatgcggtaaccagattggttccaagttctgggaagtcatctgcgacgagcacggcatcgattccaccggacgttacagtggagacactgcagatctccagcttgaacgtatcaatgtctattacaatgaagcttcaggtggaagatacgttcctcgtgctgttcttatggatcttgagcctggtactatggatagtatcagatccggaccgtttggtcagatcttccgtcctgataactttgtctttggtcagtctggtgctggtaataattgggctaaaggtcattacactgaaggtgctgaacttattgatgctgttcttgatgttgttcgtaaagaagctgagaactgcgattgccttcaaggtactatatatatctttttctgaattttccattatacgcaaattttctatagtgtttgatgtcgtgcatcataattcgtatatttactggatttagtttgattcaataatcatttcattcgtaatttgtctgacgtcaccgtatcgataatcgtttatcaccatagatctcttcttgtaatatagtatgatatctatctacataattagtaaaattaggtcacggtttagtaagtgtactatagtatgttttttttattctttttttttttactttgatgatcttgtttatctattattggtgtgcatcagtgcatgtgggttcttattcagtaatacgatcaatcaaatcgtcttatttaatgtaattgcaagacagcaacgaaataattgaaatgcaagtgctgttttctgtggagtgggatgttagcacttattattggtagggccaagctgttttgtatagtattgagatatttttttgtcaagtttttttcttcatattaaagcttcagagataagatattatatcattgtgatgtcgtgatcaaaacattttcaaggcaccgtgattacgggataaaagatggagtggtcctactacatcatatagatttcttggaattttgtagtaaaaagttaataaaaatctcttttgcctttagagtttatagataatgcttgtggagcccaaacaacaatctcacgtgattcgtttttttagttacttttggtcaggtctcacgtgattcgttttatacattgattatttaacttcaattataactatgagtctatgactactagtgtgcattgttattattggggagaaatattttttaacgcatattgtagattcattgattattgttttaaagcattgtagattcacataaacattatagttgatttagttagcaaggactagtaacaagatgtttgcttgactatatatgaacactttttcgtctcatcgatggaaccaatactatgtgaatcatggggctgcattattttacagggtttcaggtgtgccattcgttgggaggaggcacaggttcaggaatgggaacactattgatatcgaagatccgagaggagtatccagacagaatgatgctcactttctctgttttcccatctcctaaagtctctgacacagtcgttgagccttacaatgcaactctctctgtccatcagcttgtagagaacgctgatgaatgcatggtcctcgacaatgaagctctctacgatatctgcttccgtaccctcaaactcagcactcctagctgtaagtacacccaattcttatcctccattaacccaaaatgtatttaaaactaattctgatacattgcatgatgatgtagttggagacttgaaccatttgatctccgcaacaatgagcggtgtgacttgctccttaaggttccccggacaactaaactctgacctcaggaaactcgcggtgaacctaatcccattccctcgtctccatttcttcatggtgggttttgcgcccctcacttcccgtggctcgcaacaatacatctcactcaccgttcctgagctgactcaacaaatgtgggactccaaaaacatgatgtgtgcagctgatccacgtcacggacgttacctcacagcctctgctattttcagaggacagatgagcacaaaagaagtcgacgagcaaatcctaaacatacagaacaagaactcgtcttacttcgttgagtggatcccaaacaacgtgaaatccagcgtttgtgatatcccaccaaaggggctcaaaatggcggcgacgtttgtgggtaactcgacgtcgattcaagaaatgttcaggagagtgagtgagcagttcacggctatgtttaggcgtaaagcgtttctgcattggtacacaggagaaggaatggacgaaatggagtttacggaagctgagagcaatatgaatgatttggtcgctgaataccaacagtaccaagatgctactgctgatgaggaaggtgagtatgatgttgaagaagaagaggagggagattatgagacttgatccaccaaatcaaacattttacttaaaagacaaggaaacgactcttggaaatctctctatttaaatttgattgaaaaacattgaaaaaatgggaaatttgtttaaatgtgttttttgtttgagtaatttgttcaaagaaagtttgaagtttccatttattttgggtgtcttgtattttccatttgagataatacgtccttgcttctcaagctactgtgtagtatataaattttacacttctctcaattgtcccacatcgagtaaattagtataaaggaagctaaacttttgcctctataaataaagatacttcatttcccaccgacttttacatttgggcttcttaaaaaataggcttgacaataa

SEQ ID NO: 14267 - DNA, 3000 bp, Unknown
  misc_feature (1)..( 3000): cDNA_ID_4378600_gDNA_ID_2684096_Annot_ID_190125 3000 nt of promoter + ATG
tgatggctgaaaaccatgtgccaggtctctccaggagcatcatcagctgtgattttggtgttgagaaggcattttccagtgtaaggctcttttggtctgtacctgttaacaatcacaccttcctcgttcttctttgacactttctctactttctttgcaggagtaggagtatctgtttctgttgtgatttgtgcttttatggaaaacactcttttacctgtcactacattgttgcttttgtagtaaaaagcacccttttaaacacacccaacaacaaaaccagagagacctaatcaagatcccatcaacagtacattgatcttccaaaagtttttggtcatatttgagaaaacccagaagcacatttatccaaattccaaaactttacttaacatgttacttacaagacccagaagattattagcaaaaccataaaagcagagcatctctagactctcgactacacaactttttttgtgggatcttgactttatcattatccagttgagaaaagcttataaagtaccttagtaaacctgatcctttcaggagcaatggcacaacttgtagcgggaaaagaagaagagtttgaagatgtgagagaaacagcagcattcatggtagtcgccattgcagagcaaatgagatcaaactgagagaaaatatcagaggaatataaaaaggaatcacaaggagaaagataagagaaggattacaagacatttgtgtttgggtggatgaggttttaagaagagagtatctcgttcatcaaagttgtggttatcgttatttgacttgaggaagctatatatctcttttgttttttttcctctaaatatcttgtgtgtataaaatacgaaaatcaactcaaaacataagttttaacacatgttttttttatattaaaaccccataattatattgttttttcattgctttgcacttttttattttccagaactattttaccctcaattaagtttcaaatctcattagacacaatccaattgtatttaaaattttaattataaagcacaccaaaaatatgatgtggtcaagctttatacaagggccctttcctttaaatatactttacaatgttttatttttggacaagatattatcacccataactttcctacctgatcaaaattatatcatattttaccatttcacttttcaatcaatgcctatatatccacatttgcaaaatgatgaatgtatatacaaaattgaagttgtggattgttttgttttagggaatctagtttacatatggagatgatgtcacttccaagagagttggtactatccaacgctctctcttgtttccaagatgtttcgtctatcggttgcatcacctgaactatacgcgagacggtcccttttagactgtcccgaatgctatatctatgttttcatgttgaacctcccagctaaactcagctggtatgttctcgaccggaaaacatcaggtcctagtacagctaagagctaacaatctcttggtggctgttcccttgctccacttacatagttatatgtctctacgttcaagcttagccgtcgttggttcaacaatctttgtcatgagtgcttgtctgtattgctcatggactgcccatctaacatgtgtgccacgcagatgactgtgtctagtagcatagaaaaaacttgtgtgtaccccttgattgtgtcgaataaaacagaaagctcaaagtttacatgaattactaaattgtttctctttaaaatccttaaactatgtaccatatatgcatatgggattaagataattactacgcaataatcgaagtctaattcagggagactaatccaagtaattcacaatcttgattaagagatcattggtagttagaagtttcagtgcataacagtttctcaattggtcaatgtatttactttattgtttcggtcatctccacaaggtcgtcaaaccatatacagatatactataaagtagtataacacaaccaattccataaatctcttttctcaatatgaaaaacgaactagattaactacaaatcaacaagagtttggattaaaacaaaaacaaaggagatttgggaaagaagaaagtttatcatcagagaggagtgatcggtacatcaatcggccacaaaaggcctcagacgaccgtcgtgagaattttagatcaaatctcatcacttgaatttaacttcttcacatcaaaaaatcgattactttagcaaagtaaaacaatatcaaagatgaaagctacaaaaacacgaagaaaaaagagacgaatatagccggcgattatgggtactgaagactagtttgcctttttatataggatgatggagcaaatctagggtttagtttgacaattaaagcatacgacaccgtttatttttaaatgggctcgtctatttatctacatgtctggcccatgtatgactttactagatctagttctgaaattgaaagttataaatttttgtatagattactttcttcttccttatttttaacacacaatttattatatgaaaacaatttaactacattaatgaaaaaaatacaattttttcaataatacaattttgcataacgtgctcccatatctctactctacaactgggaaaaaatatattataaagcttgtttttgtatagacatattcatgtgtatacaacatgtcaacaacatacattggcaatatatgcacatgcatgctccaagttgctaattaaacactgaatctgaaatctgaaattatgccaatctaaaaacctttcggcggtaaattttgagtgaataagacaatgtaaaatgactaagataaaaaagtgttaggtggggtgaaaaaaaacagagaataaaaacctcgcaagcgagggaagtgatgaataacagagacaattggttatattagctgtcactcccatctttcatattccttcaccatctctctctctctcgatcttgtgaaccactacacacactaacaca

SEQ ID NO: 14268 - DNA, 3000 bp, Unknown
  misc_feature (1)..( 3000): cDNA_ID_2992752_gDNA_ID_2684096_Annot_ID_190124 3000 nt of promoter + ATG
actaaaccgtgacctaattttactaattatgtagatagatatcatactatattacaagaagagatctatggtgataaacgattatcgatacggtgacgtcagacaaattacgaatgaaatgattattgaatcaaactaaatccagtaaatatacgaattatgatgcacgacatcaaacactatagaaaatttgcgtataatggaaaattcagaaaaagatatatatagtaccttgaaggcaatcgcagttctcagcttctttacgaacaacatcaagaacagcatcaataagttcagcaccttcagtgtaatgacctttagcccaattattaccagcaccagactgaccaaagacaaagttatcaggacggaagatctgaccaaacggtccggatctgatactatccatagtaccaggctcaagatccataagaacagcacgaggaacgtatcttccacctgaagcttcattgtaatagacattgatacgttcaagctggagatctgcagtgtctccactgtaacgtccggtggaatcgatgccgtgctcgtcgcagatgacttcccagaacttggaaccaatctggttaccgcattgaccaccttgaatgtgaaggatctctctcattgtgttagtgtgtgtagtggttcacaagatcgagagagagagagatggtgaaggaatatgaaagatgggagtgacagctaatataaccaattgtctctgttattcatcacttccctcgcttgcgaggtttttattctctgttttttttcaccccacctaacacttttttatcttagtcattttacattgtcttattcactcaaaatttaccgccgaaaggtttttagattggcataatttcagatttcagattcagtgtttaattagcaacttggagcatgcatgtgcatatattgccaatgtatgttgttgacatgttgtatacacatgaatatgtctatacaaaaacaagctttataatatattttttcccagttgtagagtagagatatgggagcacgttatgcaaaattgtattattgaaaaaattgtatttttttcattaatgtagttaaattgttttcatataataaattgtgtgttaaaaataaggaagaagaaagtaatctatacaaaaatttataactttcaatttcagaactagatctagtaaagtcatacatgggccagacatgtagataaatagacgagcccatttaaaaataaacggtgtcgtatgctttaattgtcaaactaaaccctagatttgctccatcatcctatataaaaaggcaaactagtcttcagtacccataatcgccggctatattcgtctcttttttcttcgtgtttttgtagctttcatctttgatattgttttactttgctaaagtaatcgattttttgatgtgaagaagttaaattcaagtgatgagatttgatctaaaattctcacgacggtcgtctgaggccttttgtggccgattgatgtaccgatcactcctctctgatgataaactttcttctttcccaaatctcctttgtttttgttttaatccaaactcttgttgatttgtagttaatctagttcgtttttcatattgagaaaagagatttatggaattggttgtgttatactactttatagtatatctgtatatggtttgacgaccttgtggagatgaccgaaacaataaagtaaatacattgaccaattgagaaactgttatgcactgaaacttctaactaccaatgatctcttaatcaagattgtgaattacttggattagtctccctgaattagacttcgattattgcgtagtaattatcttaatcccatatgcatatatggtacatagtttaaggattttaaagagaaacaatttagtaattcatgtaaactttgagctttctgttttattcgacacaatcaaggggtacacacaagttttttctatgctactagacacagtcatctgcgtggcacacatgttagatgggcagtccatgagcaatacagacaagcactcatgacaaagattgttgaaccaacgacggctaagcttgaacgtagagacatataactatgtaagtggagcaagggaacagccaccaagagattgttagctcttagctgtactaggacctgatgttttccggtcgagaacataccagctgagtttagctgggaggttcaacatgaaaacatagatatagcattcgggacagtctaaaagggaccgtctcgcgtatagttcaggtgatgcaaccgatagacgaaacatcttggaaacaagagagagcgttggatagtaccaactctcttggaagtgacatcatctccatatgtaaactagattccctaaaacaaaacaatccacaacttcaattttgtatatacattcatcattttgcaaatgtggatatataggcattgattgaaaagtgaaatggtaaaatatgatataattttgatcaggtaggaaagttatgggtgataatatcttgtccaaaaataaaacattgtaaagtatatttaaaggaaagggcccttgtataaagcttgaccacatcatatttttggtgtgctttataattaaaattttaaatacaattggattgtgtctaatgagatttgaaacttaattgagggtaaaatagttctggaaaataaaaaagtgcaaagcaatgaaaaaacaatataattatggggttttaatataaaaaaaacatgtgttaaaacttatgttttgagttgattttcgtattttatacacacaagatatttagaggaaaaaaaacaaaagagatatatagcttcctcaagtcaaataacgataaccacaactttgatgaacgagatactctcttcttaaaacctcatccacccaaacacaaatgtcttgtaatccttctcttatctttctccttgtgattcctttttatattcctctgatattttctctcagtttgatctcatttgctctgcaatg

SEQ ID NO: 14269 - DNA, 3000 bp, Unknown
  misc_feature (1)..( 3000): cDNA_ID_3015586_gDNA_ID_2684096_Annot_ID_190123 3000 nt of promoter + ATG
tcttcttaaaacctcatccacccaaacacaaatgtcttgtaatccttctcttatctttctccttgtgattcctttttatattcctctgatattttctctcagtttgatctcatttgctctgcaatggcgactaccatgaatgctgctgtttctctcacatcttcaaactcttcttcttttcccgctacaagttgtgccattgctcctgaaaggatcaggtttactaaggtactttataagcttttctcaactggataatgataaagtcaagatcccacaaaaaaagttgtgtagtcgagagtctagagatgctctgcttttatggttttgctaataatcttctgggtcttgtaagtaacatgttaagtaaagttttggaatttggataaatgtgcttctgggttttctcaaatatgaccaaaaacttttggaagatcaatgtactgttgatgggatcttgattaggtctctctggttttgttgttgggtgtgtttaaaagggtgctttttactacaaaagcaacaatgtagtgacaggtaaaagagtgttttccataaaagcacaaatcacaacagaaacagatactcctactcctgcaaagaaagtagagaaagtgtcaaagaagaacgaggaaggtgtgattgttaacaggtacagaccaaaagagccttacactggaaaatgccttctcaacaccaaaatcacagctgatgatgctcctggagagacctggcacatggttttcagccatcaaggtagtgattccattacttgattctcacaacatgtttcttactttataatgattcttttcttgatggtaattgaagtagcatttatgtgtcttcgataggagaaatcccgtacagagaaggacaatctgttggtgtgattgcagatggaattgacaagaatggaaagcctcacaaggtcagactttactccattgcaagcagcgctcttggagatctcggcaattctgaaaccgtaataaaccatttcctttacaaattttacgaggctttgttttgtctggttaagtgaatgaaggagttgtttcaggtttctttgtgtgttaaaagacttgtttatactaatgaccaaggagagactgttaaaggagtttgctcaaatttcttgtgtaagtactaatgaataagtcttgtgtaagtttataacttattcacttattcaactattgtgttttcttttactttatttttcaggtgatttggcacccggaagtgatgttaagctgactggtcctgtaggcaaagaaatgcttatgccaaaggatccaaacgccaccgttattatggtctctcccttaaacctcaaatatcttgacttgcttatgactaaacctctataggttctgtttcttgaaacatcattaaacactagtaaacatccttcttcttcatgaacaccacagcttgccacagggacaggaattgctcctttcaggtctttcttatggaagatgttctttgagaaacatgatgactacaaggtaaagtaaatgattatctttttgattttgaccaaaatgtattaaaatctaacatctttgcaatcgttggaatgcagttcaatggcttagcttggttgttcttgggtgtaccaaccactagctctttgctctaccaagaggcacacacacgctaactcttcttctggtttcattcttcaaatccttccaaatcattaagtaaaatcaatcctcttttttttttgttttgaaaatcaggagtttgataagatgaaagcaaaggcccccgagaacttcagggtggattacgcgataagcagagaacaagcgaacgataaaggagagaaaatgtatatccagactcggatggcgcaatacgcagctgagttatgggagttgttgaagaaagacaacacttttgtttacatgtgtggactcaagggaatggagaaaggaattgatgacattatggtctcattggctgcaaatgacggtaagaagagctaattaataacactccaattcttgaaacattcattgcataagcaataacactctaatgactttgtggtggttttaggtattgactggtttgattacaagaagcagttgaagaaggcagagcaatggaacgttgaagtctactgatcaaaaagcctttgacatttctgtagcaaagtatagctgaacaaaactgtaattttcgcttctgaatttctgtattttgaagataagttttttagatatgttatactaaaaaaagagttctttaatcattatcatttacttcttcccattattttgctttaagttaaatgacacattgatatttatccatctaaaaaaaatgtcattttctttaactaattgataaggaaaaaaacaaatggttaatgaattgccttcagttgacagcaatctgtattttatggtagctaaccaatcctttaacaatatccaatcttattcttttatgcatctatttaaacaaagtaatggtttcttaggacacttgaatacttgagtcgttagttgattttgggttggactactaattcatgaaggttataatgttacctccaactccaagccataaaatatcatgagaaaaagaaaaagaatctcgattgaagatattttcaatttctatgaagacaatagtatggttgagatttttacaatttctatgaagacaatagtatggttgagattttttcttgaagccgaccaaaaaaaggagaaatctagcaggctaatgtttattctctcttttctttttgtcagaggctcatttgtcagtaaccatttgatcaacggctaaatcctatatccactaaaattcaaccacgtcatcagacataccaatatacagcaacacttgattgtagctaataaaaagatcgtcaacagaattaactctttaaatcacttctctgttatacctctctgtttcgctccctgaagaagaagaaacagagcgttcagatttctcttcaacataatcatg

SEQ ID NO: 14270 - DNA, 3000 bp, Unknown
  misc_feature (1)..( 3000): cDNA_ID_3015592_gDNA_ID_2684096_Annot_ID_190121 3000 nt of promoter + ATG
tctacgatgtcagtctcgtcgacggctacaatgtccagatgctggtggttcctcaaggcggctccggtcagaattgcagcagcaccggctgcgtcgtcgatttaaacggatcttgcccgtcggagctaagggtgaatagcgtcgacgggaaggaggcggtggcgatggcgtgtaaaagtgcgtgcgaggcgtttcggcagccggagtattgctgcagcggcgcgtttggatcgcctgacacgtgtaagccgtctacgtactcgcggatcttcaagagcgcgtgtccacgcgcctatagctacgcgtatgacgataagtctagtacatttacgtgcgcgaaatctcccaactacgtcatcactttctgtccttctcccaacaccaggtaaaattcctttaatacccttcttctatttactttcacccatttcgttaaaaggtgattaggaaatatttactctttcataagtaggatttttttgcttgttgtataatcgaagttactagatactcaattccattgataatcattaattttgctatacaagttttgtttttctttcaagagttttatgatagacattgtttgtcaggctcctataaaagagagacacgtgggaactaacttcattcacttattcctttatttgcagcctaaaatcagctgaggaacacagcacagagacaatgacgacgacaagtccaagttccggcagtacgacgtcgtcgcagatggtctacgaaggtgctctggacgaaagcagtggttcaccatctacgtatcacggcgtatcacgagcaatcacagtcgttcttctctcgcttgctttttgtcgtatgtggtggttcttctgaccagagattatttgtcttagtgtctgccacgtatgcgcagaaacaagaacgtatgggcctttagaaggccttttctcactatagtaaaaatatttctaaagtttttccacataatgtcaactttttactccacatgaccaaacgttgaatgattaaaccattcttaaggaaaatcaagaaagtaggctatattaaagcattaatattggtagtattttagattagtcttaagtctaaacatagtttttaggaataattttataattaattttaaaaattttgatgttaaaaaactaaaattttggcaatatacaatggtggtttttaactaattttttttaatatatatatatatatatatatatatatttatatatatttatttatttaaaaatagaaatattttaattttaaataacttaataattattacaacattgttgtagcgtcatcaaagcttggaaatggttggcgatgcttaatcatgttgatgttgttatcaaatttggaatttaagtcatttaaaacgtacataatcagagttcgatctgaaacaagggtatcgatattatcacacaagtgtttagtgaggcgattgctggcaatgaagatatccagctaccacatctaaaggaaatgactttgagcgtcatgacaaataaagacaaaaacaatcacctcttttacgacataacatgggctattcctcaacgtagggtattaatactctttaaattcaactacaatgtttataatccgtatctttaggcatagttctatttatgagatcgtgtagggcggcttcatctacattcataaaattatcatcgaactcctccagcgcctaaaaggtgtcgattttatgaatatcacccacccaccaaatgcttcatattatacattttttataattaatcatgcttactaatcagagtttacaaaacttgatttataatatgagattattcattctttatagaagaacataataataagaaaaaaacattagaaattagaatattatgtaaatatatgataaaactaaatatttcttagtttttgctcaactagtcctttaactaaatgatgtaaccaaaaaaaattcataagtttttcctcaaatatttttcaaactttatgtcaccatagttattatggcactagctactattaaatctaattctcatttttaagctttttataacccttctaaacaaacggaaacatttctataatggattagaaagaaaaaaaaaaagaacagatggggcaaaaattatactcggatctagttcggctatagaaaggatatggatacccggattaaccttattgattttcacatgtgcctctcgtgctttctatccttttgcaaatgtagaccaaagtattttgatattatatgccaccacgaggttgaacgccaggctatcatgacaagtcttaatacaaactaggccaatacccgcacgtttataacaatttacctcgagtgtattaatttgatttaactaattcgataaatatttttttttggtgtttttaataaccattttgataatatctgatgacaaaattaaaaaaaacattttcatttacgctttaaatataacaaatttaattattattaatgttaaggtaagtaattagaattaaatgttaacaatataattaaaataaataagtaaacaaaataacaaacgaattattaacttgagagtcagaataatttattagtggagaacagatggaccaataatctaaatttaactaatatatagaaaagcaacatgaatatattcctgaccttggtgtggacaaattttccaaaaaaaaagataatgtcagaagtggggtttgaacccacgccctcttacgaggaccagaacttgagtctggcgccttagaccactcggccatcctgacgttcctgattaaagatctcataaattcatcatatagaagaatcggatgatttagtgtcaccaattattttattaccaaacaaaagacacttgattgaatgaatcgccgggatcgaggagattagtagtaagcacatcatcatcactcagatctagtagttccacaaactcacattgggtcgttgaccagaaaaacacacagagaaaggagaaaaacatg

SEQ ID NO: 14271 - DNA, 3000 bp, Unknown
  misc_feature (1)..( 3000): cDNA_ID_3015619_gDNA_ID_2684096_Annot_ID_190113 3000 nt of promoter + ATG
tctgattggttaatttactgtatcagtcctccaatgtcattactcctgcttcaatttctctgaccactcacatgtagtccaatcggttcgttgttcattatgtattttactaccattaggtccaaacacttgaaacgttatgttatactgcgcctggaaccgaaacagagcggtttcaagttgacctggtcttcttccatggtaattgcaaatcctctgattcgaatcaatgaatgctacaatggtgtaaaatactgtgctacaatggtgtaccaaatttttaagctttcctttcatattcaattgattcaattaggttaagtatcataaaacgctttaatattcttgtccacacttgttctttctcgagggtcgaggctgtgtttattcgagttgtttttggaaaatcatctcgtattttttttcttttgagagaatagtgtagaaactgtggtcttatagttttagagggtaatacgaaaatgagagtgcgattagtaatggataactgaatttaagaaaagttcaaagtgtgtgaatgagaaggagtcgtaagagacaagcatcttcttcttataaccatctaaaccacatgcttatgtccactttttttctttctttctgagtgaaaaacactttagtctcccactctttatattttgtagcttcacagcaaaaattctcttttacttatcagacagataagatcatatagcaaatatgttgcaagatagagtttctggttctttgtctagttcgaaaatatctcgatgtgttttgtttctctcactcttttgtttcttcctcttgacgatgcatgcttcagcaaaccgcttacagcgagttccaaatccagggccttccccggcaccagagcctaagccatgtccgagtccagggccaaaccccgcaccagcgacaactaagaggacacataacactacgtttccggcgatcttcgcctttggggattcgatcttagacacaggaaataacgattatattttgaccttgatcaaagctaattttcttccatatggcatgaattttccagataaagttcccaccggcagattttgcaacggcaaaatcccttcggactttatcggtgactttcctctcctttatcatatcatgagaatgaagatacaaaatattcatgcttgatgcttctatatagtatgtactatattttcaatggaaatattcttatgaaaggttgtttttcttttcccgaatttcacagcggattatataggagtaaaaccagttgtaccggcatatttgagaccgggactgacccaggaagatttgctcactggtgtatcctttgcttcgggtggttctggctatgatcctttgacaccaatcgtagtagtaataacatcattgctttgaatttggaaattatctccttcatttttaatgtttccatttgatttgatttggttttatatctgttatcaatgttataagtagagtgcgataccgatgtcaaaacaattgacatactttcaagaatacatagagaaagtgaaaggctttgtgggaaaagagaaagccgagcacataatatccaaaggcctagccattgtggtagcgggcagcgacgatctggccaatacctactatggtgaacacttagaggaattcttgtatgacatagatacatatacctcttttatggctagctctgctgcaagttttgctatggtacgtgaaaccaatcctccgatttagttgtttataatatgaactagtatatcaaacctactgaatatgagtttaattttggcagcaactatatgaatcaggagcaaaaaaaataggatttattggtgtttctccgatcgggtgtataccgatacagagaaccacaagaggaggacttaaaagaaaatgtgctgatgaactcaactttgcagctcagctttttaattccaaactctccacaagtttgaacgaattggctaaaaccatgaaaaataccacattggtgtatattgacatctactcttctttcaatgatatgattcaaaaccccaaaaaatatggtaacgctcaactactcactctacaatggtgtttttgtgagaataagtttgagattttttttaaattcttttttggttttttgcaggatttgatgagattgatagaggatgttgcgggacggggctactcgaattaggtccgctttgcaacaaatatacatcacttctttgcaagaatgtgtcttcttttatgttttgggactcttaccatccaacggaaagagcttataaaatcttaagccaaaagtttgtagagaatgacatgggccctttctatgacaattaaatgtaaaatttaagatgacacatttgagatgaaatttggctaaataaaagctgtatctcatttggattagtgtcttcaaaaacatgtttattgtattatacatataaattgacatggagcgataaattgagttgtttttctaaagatttgatattattgtgctttgacaataatcggacagacaaaagtggacgactaaaaccaaaaataataaaaacagagtgtaaaatgctattatattatgtgaatttagccgaattgacacaccttcttcttgtttcacttgatcgaatccatctcattccaacaaaatattaactaaatataatttaaatcatggccattaacgaaagtttaaaaagaaggccaatccgctagaaacttctcaccctcagacacagtcgcacaggcatcagctttgaaatcgcgtaacaaaattttgtgggaagctattacatagacataaaccctaactccaaatccaactgtagttactttgataaacttttctggttaagtcaaagatagggaagatttaatagagtttattcctcatgagtttctatggattgagaagtcacgaaagatgctagaaagagtacttaagttcctacttgaaactggagaccgaatataagggaagtcttaaaacgtgtgatg

SEQ ID NO: 14272 - DNA, 3000 bp, Unknown
  misc_feature (1)..( 3000): cDNA_ID_3015623_gDNA_ID_2684096_Annot_ID_190112 3000 nt of promoter + ATG
gaaacgtgtgataaaagaagccttgagacatacgtacgcaactttaatttaatacggcacaaaaattgcatgtccaattccaaacagagattaaaaatgtacacacatacataatgacatcattagtggtatacaaacatatgcaaaatagtatcttaacatttatttcatctttatatttttgttagagaagctttttttccagagattgatgataggtgtagaagaaccatgaaatcgatattaattggatttgttttctttcttttatcatcatttcgtagcttcttcgtgaccactacctattcccaagtgatccatcaccgacgtctacggccatggccaccgccagaatctgggtccggcccatcacctggcccatctccatcaccacataacaaaaccacaccggcagtgtttttctttggggattcgatcatagatacaggaaataataataatctaacaacagaaatgaaatgtaattttagtccttatggtaaggattttccactcggagttgcaactggtagattcagcaacggaaaggtcgtttccgattatatatgttcgtactctttctctccctctctttctttctttcctcttcttttgtgccggacttggaagatttgtttatatcataacatgtattatgtgactttgaacataattggtgatagattgataatatactaggttatagtatatattatgattatatgttaaattttatgtttgttttacagctgaatatttgggagtaaaaccaattgtaccagcatattttgaccccaatgtacaactagaagatcttctcacgggtgtatcatttgcttcaggtggtagtggctattaccatttgactcccaaaatatccgtaagatgaaaattaatcacatatagatttatatctaaccatttatcctaatcatttgggtaaaatataaacagagagtaaagtcaatgttggagcaattgacatatttccaacgacacatagcgagagtaaagaggttagtaggggaagagaagacggatcaactgttagccaagggcttatccgttgtggtcgcaggcagcaacgatttggctattacatattatggtcatggtgctcaattgctcaaagatgatatccactactttacttcaaagatggcaaattccgcggcaagttttgttatggtacgtaactcatccatctttttcttttagagagttcatatagcttcactccaaataaagttaaaagttcatgcaatacgttcaatgatttcaaaactatatattatgatttattgtaaggtaagaagacactccaaaactatcataataccaaaaatttgcatgtaatgtatttaacattaaaaagtgacatttgtcaaaggtagtaaaattaacttgttagaagttaggactttagttttgcttcttaaaaataatcttacttttgttcaaaacaaaaaaaatcttagtaaaaaacattatagctattgatgtaacgaatttaatttttaacaaaagagatctaaggtactcaatagaataataatgtagataactagatgtacataaacttgacaaccaacaatattgaatttggtcatgattaatgtttttttctttttgggataaaatgtgaaattactaccaaaaggaattattgttttacaaaggttttaaactaaactaaatttgttcatgattatgtttaatatatggtatccatacatacataaattacaatttccttacaaagattttctttactggactaacgtaaataaattaataacaataacctatctatatggatacacttgaacagcaattatacgaatatggagcaagacaaatagcagttctaggaacaccaccacttggctgcgtaccaatactaagaactctaaaaggaggtcttcgtagagagtgtgctcaagatataaactatgcttctcagcttttcaacgtcaaactctccaacattttggaccaattggcaaaaaacctaccaaattccaatctcatttacattgacatatactctgctttcagtcacatcttagaaaattcagcagattatggtaatattagaacgtgaatatttaattcttataagtactaaactatacaagctcatgtatatataacttgagttgagaattaatgcagggtttgaagaaataaagagaggttgttgtggaactggatttgtggaagctggtccactttgcaatcgattcacaacatttgtgtgctccaatgtatctgcttacatgttttgggatagtctccatcctacccaaagattctataaaatcttaaccaaaatactttttgagaaatacatccacaatttaaattgagtagtgtgatcaaatgactcacattgtatgcttttatttttcttaaagcttgtgcagttgttataaattgtacaaaattattgtaagtcactatattgattaccaattgattttaagagaaacttttatcactcttcacatgctttcaaagatcaaatccatatcaatcagttcatttgatcgacagctattctgtttatgtaatgattatctttttctttttaggtcatgatgatgtaataatattatagctctctgaagtaaagtaatcaactagataacatgaaatataaccaaattatatgatttaatctgcacattgttgtgggggtaaatcagtcaaataattgaataagactgagtggtaagacttgatttgctggattggctaaatatatattatcagtccagtgatacagggaagagtgttgttctttaaccacaaaaacaaacaagtttcataccattattcaagggactcgatgaactctctcaacccttcttcacctttgtataaagtatgacgataaagtaaacaaattctttaaaaaaaaagaaaaactaaattgaaactaaaattcgaaacaaaaaaaaatactaacaaaataaaacctaaaatttatttgagatg

SEQ ID NO: 14273 - DNA, 3000 bp, Unknown
  misc_feature (1)..( 3000): cDNA_ID_2993154_gDNA_ID_2684096_Annot_ID_190106 3000 nt of promoter + ATG
atcaccactgcttccttgtgatacccactccgattaaacccactaagaataccattccaagacacaatattcgcctcaatacctgaactttccatctcagagaggatacgaaccacctcttctaagcaaccctttcgcgcataggcacaaagcaaagcactgcaagtgacaacatctttgtcagacattctatcgaacactttgcgtgcatcacccatcctaccacacctcatgtacatatgaaacatagacccctgaacaaacgcatccatatccaacccggaaacacacgacacacaatgtatctgtttacccactttaaaagccgataattcagcacaaaccttgaacaaattcggaagaacatgactatctggaatcaacccatgagagaacatccgagaaaacacaccaatcgattgcgtaaaaagcttagcctttgttaaagcgtatataagagaagagaaagagtaaatagtaggatccggaatcgattgcaagacgagatcagcatcgttgaaacaattatagttcgagtatgaagcaatgagtttagcggagatatagccatcgttttgagctccggatttgagtatacgagcatgagcttgtgttgtcttcgacaacgaagaagaccaatgatatgatgaagattctaagaatccaacgatcgattgaggaattttctctatcagtggaagaacttgttttgtcattgcttaactaaaaaataaaattttcccgcttaaccttaatcattcacttattaatcttcctacgtgaccagattattccacgtcaccacaatcagaaatcaacggctgaagatgaaggactgggtctcactcagcttctgagcaatcttagtcgttgattatgtcttcgagaaatcttggacgttgattctaccttctccgagttttataatctgttttcttaagaaaatttgattgatacagagagagcgatgatgattcgaacggcgttagtgttcgttgtcttcttcgtcggaacagtcgtacaagcgcagctgatacctccggcgaggcgtgatggatttttgtatccaccgggtcggaaaatcgaccgggatacgatacttatcgaggcgtatattgacccggtttgtccggattgtagagacgcttgggagccgctaaagctagcgattgatcactatggatctcgcgttgctcttgttcttcacctcattcctttaccgttagtgtttgatttctcttcccttcaatttcagttttcaatttctttagctagattgagaaattagttgttcgatgtttcaagtaattgtctaaatctatgcatgccatgaatatttgtagtgatttcaattgataagtagtttgagaaagtagcagattttgtttatgttgccatatctgttgtatgcaaattgttttattattgtgtgatgatgagcttagcttttggatcttgcagcttccatgacaatgcatttgtagcatctcgggctttacacatcgttgataccttaaacgccaatgccacgttcaatttgctggaagggatcttcaagcatcaggtttgattagtgtactaaaaaactaaactttgctgagattaaacagagaaaatgtatatccggcggttctatttcttgaaatgaatgtttatccatgcactccatttgatcagtacatatggtttggttgaaaatttgctgcaacagacattgttctacaactcgcaaacacaactcatgtcaagacctgcagttgtggaagaattaatcaagcttggaacagttacgttaggaaactcatatcattctcctttgaaatctggcttcagcaactcaaaatctgatcttgccactagagtttccttcaaggtgatcccttcagcttttccacttctcagtttcacttacttgaacattttcactagtataggtatttagattgcttattcaatttgttcctctgtattcgagttcatatcttcaactagataaccaaatggagtgatatggatctttcactgcattgtcactagtcattatctttgcgcagtaggagaatttcgggttctgtcacttgatttctagtagcttaccttaccttctatcattgctttgcttttgttctctttgcagtatagcgtctcaagaggagtctccgcgacaccaaccttctacgtgaatggattcgagctgcctggtgctggttctcccaaagattatgaaggatggagagacaccattgatcctctggttaaaccacaagaagtagacatacgagacaccttcctttcattcctcacgcaaccatcttactagtttgtactttctatgatgtgccaaactcccacctacttagttgaaaagtccagaagcataactctcatacatgttcatattgttacatcttcaactgtcttcatttgcagcttaatgtataataaaccaaaaattcttcaaatgcttctcatgttttgtataaacgataaaaattaaagtattaaaagttttatactgatgacaaaaaaaaaaagaaaaagagaaagagaaaagataccaatggttattgctggtctaatcctcgatttgatatttaaccggtttaaagtaaaaacttaaaaaccggaaatcgattagggcagttcactggtgcatgggtttgtggaagagaagttgtgcggctgttatatatatcagagaagcgccttcaacaaccgcctcttagggcgtataaaatcagaaacagaaacgagacaagaattaattctctcgtccaaatttcttctgggcagaaaccaacatttatccttatccgattcttctagggtttcggaagatctaaccagaaccttcgcaacaaggtaagcattcaagcaatttactgaggatttaagaaaaccctgtttcttctaaatcgtggattgaacgagaaaccttagtttccatcgctggttacatttttttgagaaggactcttctgattttgtgttgcttttcag

SEQ ID NO: 14274 - DNA, 3000 bp, Unknown
  misc_feature (1)..( 3000): cDNA_ID_3015642_gDNA_ID_2684096_Annot_ID_190107 3000 nt of promoter + ATG
aaaagatgatctggtattcatggttctatgaattggtgtagtgatgagatttggtacagtgtagattatctatatgatataattgtaagttcaaaaaatgcggtttcataatccagttgcatttatgttatttggatgcatcttggtgatttatatcaatttcttacgtttcgtgtcggatttagtagaaaacttgtacatgaatttgctttctcaaaagtgcaagttattgattaactgttttctttaattactttctcgctgcttgctattcaaacttttttagtacttagtcatgtgattagttgattttttgacatagaaattttgcttttgcttcttcttgaaacttttgtttttgtaacggaagttgttttgttatcttataggaaaacaaatcgaatgaagttatcttcaaggctatgggaagagctatcaacaagagtgtgaccatagttgagctgattaaggtattttctggttttagtctgtttcctgatctcagagttgtagttcttttgtgtatctgaagattatattgttatccttgatgcagagaaggattcctggtcttcatcagatcacatctattggatcaacggacattacagatacctgggaacctacagaggaaggccttcaaacgtatgtggtcactagactttagtatcaagtttattgttttaagtgtaccggaacacatgtaaccatgttgtattcttaattttgttactttgacctgttatttattaaaactcatctttttctcctgaagaattgagaccacgaggcatgtgtcgatgataaccataacactttccaaggagcagttgaacacatcctcagttgggtgagtttctaggactggttgttttgctatttctcgtctattctcttattggggattttgttgttttgtgtctagagaggtacattgtctccaatgctaatatatcttattaaataatgctataggtaccagtgtccgattcctattgagatggtgaagccattggctgagattgactacgaagggcaaggtattttagagtctcactcttaatgacgtttttaagctccctgccctgctgtcttttttaagtttttaaattatctctttcttgtagacggatctcctagaggcagaggaggaagaagaggtagaggaggaagaggaaggggaaggggaagaggtggtagaggtaggattactttagaaattgtttatacagtgtcgtagtttcgttgtaagcttttgcatgtgatttgtggataagcgtttgagtggactgtgctaattccttttttcgacttatcaggaaatggacctgcgaatgttgagtatgatgatggaggaaggggaagaggtggcagaggtaggatatctttagccaaatcgtatttgagtatagatttttgcatatgatttgtggataagggtttgaatgtgttgtgctatttctttttttgtttgatttaccaggaaacggatatgtgaacaatgagtatgatgatggaggaaggggaagaggcggcagaggtagaattgctttagaatatttctttccaaatcttagttttaccttttaacatatttgcatgtgatcggcggacaagtgtttgattggcttgtgctatttcttctttcggatttgccaggaagtggatatgtgaacaatgagtataatgatggaggtatggagcaggaccggtcatatggcagaggacgcgggcgtgggagaggaggtggacgtggtggtcgaggaagaggaggttacaatggccccccaccaccttactatgaagctcaacaagatggaggagactatggatacaacaatgttgctcctccagcagaccatggatatgatggtcctccgcctcagggacgtggtacgttgatgattttgttacactaatgttttctcattaaataatgatgagttgtaaatgtttaaaaattgttggaacaggacgtggccgtggaaggggaggtcgtggaagaggaggaggccgtggtggattcaacagatcaaatggagcacctatccaggctgctgcatgagcgaccagggtcattgaatgaagttggatctttcttacattctcatgtttttgtctctgttcttcaaagcaacttgttgccgtagaataatctttcgttcatgtcgctttaggttatatatatcctcatttattttatcatggatcttggattttcaagtttttattccttcaagagttttctagttttgtctcttttttgagttttggatatttgtttgactccaattacattcgtcggcgtattgacactaacaagtaaacaaccccctttggcattgcctttttccattggttcgtatatcagttgattatatattctaacaacataaaaagataacaagaaaaaataatgaataataaaattgtaattccaagttccaacgtgttttgagacaaaaagaaattaacccaacttgcgctggttgtgttttgggctattcgaagaaagcgtacgaaaataagtgagagaggtccaaacaaaactagtaaccaaaaagttaatcgccgttgccggggatcgaacccgggtcacccgcgtgacaggcgggaatacttaccactatactacaacgacatttgttgctcaatcgtaatgtagaagatataaatactaatatggaaaaaagctgtcttgaacaaaaagaaatatactttttttgttgtgtccaaaaaaaggaaaatacttaggaaagaaaagagtctcagcagcatcagctcgtccttaaatctgatccatcatcgtcactttctcccggcgaattccgttttatcgatttagtaagctctctgtctttatctctccgtctttctcagtcaacaaattggttgaaacttcaatcggttccttgaaatctcaccggcttagttgcatacttctgcaaaaaccctaaccttgtttttgtctttgtgaagagtaacgagatttgtgcaaag

SEQ ID NO: 14275 - DNA, 3000 bp, Unknown
  misc_feature (1)..( 3000): cDNA_ID_3015683_gDNA_ID_2684097_Annot_ID_190163 3000 nt of promoter + ATG
ataatatttagaagtttgtgctttttgatagtccggaggagtatgaatgatcaatgaaccctttcaactgtgaaaatttcgagtagattaatattaataagagtaaaattttcattaaagaaaattttcactaaagaaacaaacaaaatatcaaattaactaaattaataaagccctcttttatcagaaaaggtggcctacttcaaatgttagggtgtcttattggtttgtgatttaaataaagtttttgtaacttaaagtgttatgtaaaatctgttgttattcaatcatttttatacaaagattttgatgtagtttagtgttatttgtttaagattttgtaaaaagtaatttaaaatcttcataaatctagaattattggattcatacttttataaaattaataaagttttgtgttgttaaattaaaacaaaaaatctataattgttaataaattaaattattatgttattagtttataactttctacactttattcataaaataaagttataaaaaatatcatcaaaataagagattgtttggaaaacttacaaaaatattaaaaaaaccaatcaacaaaattataaaaaataagtctctaataattatttaaaatctatttactttctataattttataaacgtcatcaaaattatcctcgtattagttttatctggtgactttgggcattttccctttctcataaaagggcgcgtgactcaaaattaatgtatagatgtcccataatttcattaagaatagattgttattttaaagtaacgtatcttttatttatgtagacaatattgttttcacgcatgtcttactaatgatgataatatataattaataatgaagacatttattaggtcttatcaattatcaggaaaaaaaagaaagacatttattaggtcaatttgctgacgctataaaagaaagaccttatcatttgattccaacacaattcatacaaacatcttccaagtaagtgatttggttttgatcaatctttaacaattttctcgtattacaacaccatcaaactaacaagtaacaacaatcattttttctattttatttgatgaaaagggaaatagtttggtgatttctcgtaaagatgtttaagaaaatggataaaaaagcagcgcagagaattgcgatggaatacagagctatgatctcgaaagaatctttgttcagtattggttagtagctactttcctttgctatatttctaaataatcatttgttaattattagttatgttgtaatatattattaacatgctcgattaggtatacatctttttgagaaatttatttgcggggtttgtttttaaataacatgctattgtttaaaataacatgctattggcaaagcggattatttggcacaaaaaatttgtgcggaaccactacatatcatttttgtaaacaatgtttttcaaaattggctcgtttgagtcttaaacaatatctgatgacaaaaaaaacatgttattgtttaaaaatcattttaaaataaaactctttgtttaaaataacaggctatctagtgtgtgaaaccttattaatattttcatttgtaacaataaccaaactaattaaattattttaacattttatttgttttgtctgaattataacaatactatttggtgatgaaatgttttttatataggtcaaaactcgaacaatatatacgaatggactgcagtgatccggggtccagatggcactccctatgaaggtggcatgtttaatctcagtattaagtttcctacggattatccttttaaaccacccaaggttggttatacacatatgctattttattttttttctgaaaattgtttcctaaagattttgttgtttataaaagtaaatatgtttatgtatgtattacagtttacgtttaaaactccgatttaccatccaaatatcaatgatgaaggatcgatttgcatgaacattcttaaagacaaatggactcctgctcttatggttgaaaaggtttcaaactcgattcagatattttgtttattgtttttcgaattattttaggcatttaagtattaattttggttcataaataattttacaaacaggtgcttctgtcaatacttttactattggaaaaaccaaacccagatgatcctcttgtacctgaaattggacagctcttcaagaataacagattccaatttgaccagagagctcgagaattcactgctcgacatgctaataattaaaatttataaaattatttatcttactttcgaagtttgtcatatcgtatttattatacataaacagcttcctatcctatgctattgtcgacatcttttctattataaataaaagtcacattcttcgattagatttttcgttcacctcaaaatgaataccaaactatttgaatcaagacatgaatatcctatttgtacaaagaaaaaaaatgatcttttctatagaagtgtctcttttttattttgccatacacgttgagaataaatgatcttttatatagaagtcttttgcttttcttctgatccttaaaacaagtttagattttattttctatcaaactgttatgaaatatcactaagctcttttgacaaaaagaaaaaaaaatcagtaattaagcactaaccggaaactcaatttgaacgtaatgttaatcttacttttatttggattctcttaccatccacttgcacattaatcatgttttagcatatgcatcaccgtgtccaacatgaaaaccaaagaaatacaatacaattaattcggttcggtaatgtagaaaaatttggaagcaaataattgggtcaaaatatactttttcacgtgactctcgtaattgtattgtgattttatgaaaagaggtgcgcttgtaaagtaatattcacggcttttgaagattacttggtggaggaaaatgatcaggtggacaaggaatatattaacactaaatgtttagaagtcaaaaagatg

SEQ ID NO: 14276 - DNA, 3000 bp, Unknown
  misc_feature (1)..( 3000): cDNA_ID_3015679_gDNA_ID_2684097_Annot_ID_190165 3000 nt of promoter + ATG
attgaaatagtttagatattcaaaaagaaaaaaagatactcagctacaccaattaggacgaaacatatggtcacaaatgcaaagtttagaaatgtacaacgaactaaatgtattgcatgcccacatatactaaatatatgatgacatgtggtcaacatcacaaacatttttccgatatactaatcgtcaaaatccagtgttgaccataattgaccggcattgacaaacaaaaatattttgtatttttttaaaaattattttattgaattgtttatagtgttgtataatttaaaagaaaacatattatatatttcccataaatatattttgtatatctattgaatacattgattattataattagatagtcttttcaatttcaaaagtaaattaaaagtgaaataaaaaatattaagcgaatttattgtttttacattgtcaataaaaaattagcgtcttattgtacaaatgtttttactaaattcgttatcgttaattttctatatattaaaaataaaactttgcgacctttttttatttagactaaagaatatgtaaatttttctctatttttttaactatgtattatgattttaattttggcaaaaaactttttttttaccatgtaaaatttagacgaaagaatcttctacttaatttattcctaatgaaattaataaaatttattttcatttcccttttaatttagcttgtaaaaaaataaaataataataagaatcatacaaaatatattttagttaaatatagaatgtgtttatctattatacaataccataaactattcaatagaatgttttaagtaatattaaaaataataaaaattcatatatttgaatatttttgttggtctatgccggtcaacgacggttaacatcggaatttgacaattcgtataccgaaaaaagatgtttgtggtgttgaccacatgtcgtcatatagttggtatatgtgggcatgcaatacatctaatttatgtagttggttgtacatttctaaacttggcatgtatggccatgtatttcattatacttggtatagctgaatatctttttccattcaaaaataccaaaaatattaaaataaacttggaaaaatatcaaaaatattaaaatatccgaaatgcccatatatatccaatatacatgaaaatatccgaacagatccataaatttaagaaccaaacaggattcgaaccggaaattttgtggttcctatatagatcctacactctaaaacagaaaaagtcggaaccaaaccgaatacataatagatgtatacctaaaatcgtataaaatactatcctcatacttcatgagacaacatgtatggctgcaagtccaaaatggacgggacactgatgggctacacagtttttctgtaatcgataggagttaattaaaatcattttatttgctgtcacaaaaaactagcaacattttattgttgatactaattttgtatattttatttaattgatgttttaatgtaaataacaaattagtatattatttattgatgtaaatatatagatttgtatcaaaaacattttataaaaacattagttattataattgatgctaatcagctatatttgtcatatttatacataagtgatttaatatagtatcacttagttttgtagtacaatttaagtgatttaattcaacttttttgtagtacaattgtagttgcaccaacgaagttggaaaaaagattagagcacatcttattaaatcaaatttaaaccacactcaaaaccaaagatgtatatagttcaaatttacttcttatcgtactgataaatctacgtttatttcttacatctatatacaccaaatctttttaaaaaccccacacattttaaaccttttaatgtgatgtgaagctatgactccatgtgactggagttaggtctaggaaacaaaagtaaataaaatggcataattcaacgttttctgcccaaaaatatcactttttcaaaaaaaaatctaaactgaagtatttattctaatagatgtgtgattacatagttgagagattgcctaaaataccaaaaaaaaaagatatttgatttcgtattccaataggttccggtcaaatgaaaattttcttaaacgtccaaaagaatttttcggaggctcccagtaaattaaatagagactggaccacgaaaatttgcttcaaaaattaatgttctaatgttttggctgagatgatgcactagttataccacaattttcggtatctccatatatgtatatgtacactctatgagtctgttcgctcaaccttctgaaaatctcaacaatattttctgacaacgcacggttccagatgatgaaaaaatattatattttatctacaataataatttaaaaagttacaaataataataatttaaaagatttttttttattctatcttatcaaataatatcataacaaattttttaaatattttattattatatatatatatatatattaatgaactaaaatatgagaataactataaaatatttttgtatataaaaatatatcaaaattaacctcttaaaataaatattaaatagaattaattttattctataatcatgatgagagagaggcgatttttcttgcgatcgtatctcttcatcttcgcctcttctttgtatcgtttcttgacaagcggttgtcgccggttatcggcggttccttcagagttgatcaacggtattacagttatcaatcgcataactgacgctacccaatacctatttaaactatgtgaatgtctctggagccaatgggttgatcagagtgaaataagccaatttcctttgttcatattaatcatggcagactgcaagaaattgcactaggaattgaagatgaagcgatcaatctcccttttgatttgtgtgaagaggcgattagctaaacccgctatagtctaattgtgaaaccggtgaatccaaggaagcagaacttacgagca

SEQ ID NO: 14277 - DNA, 3000 bp, Unknown
  misc_feature (1)..( 3000): cDNA_ID_2181175_gDNA_ID_2684097_Annot_ID_190176 3000 nt of promoter + ATG
aaaaacccgtggaggagaagaggagcaaacacgaggacataaatgtatttggttcaaatattaaatataaaataaacttttatatgtataaatctatgaataagtatatgtaatttcgggtaagcggatactctttcgggtatcgggttcagatcgtgttttaccctatacccacgggtacgacaatctaagacccaatagggtaaatagctaatacccatacccacctcgaactgttttttttcgggtcgatttcggttcgggttttcgggtatgggttttttgcccaggcctacccgtgatgagccgcggtatacacgttccgtattccctttatgaggcttgcatttctatcgttcatgaagaccaattcagaagtatcgggtacaaccgtttttagcttctccaaaaaccaatcccaactagcatcattttcacctttgagtacgccaaacgctatgatgtaatggtaatggttagggtcttgagccgaggcaaatactagcacaccaccattcaaatgtgttgcatccacaattataactttcctcatcactttaaagccttcaatgctagctcccaaagctatgactaggtactaaaatttatcattctcatccaatttcaaatatgttattgtaccatcatttaccttcttcaacatgtacaaataactattgatatctttttagctttcttccgggctaccttttaaatcacaaaccgcattatatttcccccgtcgaatatgatactttcacacctaatttcgtcttaaccagcttcatgataacccttgaaacctgagtttccaattgtcccgaaaaatgatcatgaagaagagttgcgactaattgttgattgcctttccttttcctgatcctactactatctttacttagccgagtgcaaatttgcatcttattgtaccttctaatcgagaagaatatctgtattacagatatttgacgctcgtaaactctagacaattgttcgggcaattgctccggcgatttaaagatctcctccacaacaaaaacagttcttgcgtttttttttgcggatgttacataagtaaggacatcctcatcatcataaatgttcatctctttccctactccgaacaacggtgggttgtacctcatatgcaatttaaccttatttccatataatccaagcttcgtcaatatcctatcttctaatatggagatagttatcttctcccctaatgtcttcatcatcaaactatacatgcgaccttaaaatagatgatcaagttctctctcattgtatcctgccaaaacaatacacatactcagtcaatattactaatattaccggctctactacattttcattaatactagtcctaattatgaaatactacatgtgtcagtaatactaatacataaatgaaatactatatgtataagtaatactaattctattaaaacatactatctatatataaaaaccaattgtttaggtacaactatgcctagttagaccagtattattttcgcggcaagaacaaagattggattcaagttcaattcagtacgaatcagcatgtgaaatcaaattcttatccatttgcagaccaaatcgaccctaaaactatacttaaacttctaatgtaggtactaaaacacaataacccaaatctaattggattgaatctcaaaatcctcaaatcctaagtgaaagctctttgtagttctagaaacatacatgaactccgtatctcgatgcagcttgcaggaagagaataaacgacaacaatgcagcagcgagagagaggtgtcggagctcgaagtcgttggagaagaaggagctttaaacatatcgaataatttcttgattcttttttttttttactctttttttcctttttaattttaattcaatttcaattattcataagggtaaaatagtattctcactaatcattaaaagagaaagggatatgtagagtagaaagagatttaagaagttttgttgtgtttaaagggaacatgagagctattcaaaaacgaaacaaatttttttcaatggtttcctttattttctacttcaaaaataatattttaagtatattctatctctattttataattaattatgaataataccctttactttctaaacatatgaattttgacctatttatttgatttcatttagaatacattattataaaaaaatcacattccataacatttatttaaagtacgttgtttttccatttaatataaattattttttgtattttagtttgattggattaaataaaaataaatagtttgtttaataaaaaaatatactttgttataattttaaggaccattttgtaaataaaaaagttcattcaaaatatgaagatgtgaatagtataccttcaaatatgaagatacactattgaattcttcattttgaagataaaaatgaagcaccattggagaagatttctctatcttttacttcaaaatgaagaaaaatgtgaaatttaaagcaccattggagatggtctaaaaaagaaatttctttatgatttttttatcggtaaaagaagtaaatgactcaaaaagctttaaacatatcgaataattatgacccaaccaacctaaacggatcgcaaaattacacaagcccattttattcgggtcatatctaataaaacctaaataaaacactttctcactttttctctatggtaaaacagatcgacgacttttttttttccctttcttccttcttcttttagagaaaacctaggtaaaacatatcgtcaatcttcgtcaatgccatttgacaaaaacagatctatattcatttctcttatatttcttcaaagtcgatcttggtaatatttgtcgaaaactaagatattgggtaagttaaaattcgagttatttcattttgggttttgtgattgaaattaattaaagtagagtaactcgaagtgctaatccaaatgattttgtttgtaggtctggagta

SEQ ID NO: 14278 - DNA, 3000 bp, Unknown
  misc_feature (1)..( 3000): cDNA_ID_2729762_gDNA_ID_2684098_Annot_ID_137068 3000 nt of promoter + ATG
ccctgaaactataaggaaatgaattgcattgatctagtgtccactttgttttgcgggatacattgattttatttcataaagtggatgtaatttttcttttacttaatgagtcatgagtaaataaataaaaacgctacaaaaagtgatgcaaatgttttgaaccttgttaatgatgtttaatgctgtatatttggctaaggtcatataacataacatttggtgatttataatgatttatattttggtaactaatttctcatgcatatatcacatatagaaagatatgtctatatatatagaaagatatatatatatatatatatatatatatatatatatttgtactccatttgagggtattttctgataaaatatttcatagtcattcacctaactaagttccagaatttggttatctacctaattgaatcttgaattaagattgattatttatatataaacgaaaaagagtacgtatcctatggatatttctataattccaaaagataatttaggtggccttaataattactcttgcttcttcttcttctttaatattttgtatatatttttctgtcattaatattttgaaattatgtaatgtaccatataaacttttgacattatgttttcagatatattcttctgtggttacactaatattgatttgttttccgaaaggcattcaaaaaaaacaaacgaaaatagagagaaagtcgccctcgaaatatacgttgcttttcttttcttatgtgaagaatagcttcttcttctttgtgtctactataaacactaataatctttttttaatatgattatttttatttatttttgggcaaaatgtttttttaatatgatagtattactatatatttaggttgatcggaagttatatcctctctcattggcctatttttgactgttattttctctatccaaatatatctatcaacattgaatcctgccttattttatcgattcccaaaacacagcttaaccaatttggttttatttcagttaagttttcggttcacaaccaatatgttggagtgttactaatcagatagacgggtaaaataaattgtttgcacaacctattcatatagttaaaataagcgaatagagagataattgaaactacagtgaaaattaacaacaaatggaacatacgtccaagtagttgagacttgaggagtagaaagacaacgtaaggagttgacaaacatgtgagccatttgagactaattcacagacaactaaaatccaagagttatactagtaaatgctttggttattttaatatattttcaagtcgtctgcccgttgaaaactggagaaaatgtatatagagtactattcagctcgaagacaaaaatgtagtgactaaaattaaaatgcttaattggtcggataaacaatccaaaataaatgggaaatgagttttgagttgcgatcgtatcttgcattacaagaagcaaattttagggttaaagtttctgtcacataactccgttacacaattcgcttaattttggatatttgacagaaactaattaatatgtaaactttaatatatatattggattttaggcaatttaacaactaattagtggcggacaaatactgattattttccctttatatatatatatatatataattgaatgcttctatatttgttattttgttgtcacaatgtttttttttttaaaaaattaaatttgatatccttcagtccatcactagttaacaacattgccaaaatatactatcttttcgtcgaaaaaaaaactcaccatacaaactaagtgatttttcagtagtttgtgatcaatgcaaaaatgataaaattaatttaatgtttacaaagctgatgttgggtcgaaagacttggacgtcaaggataacatttggttctaaaatatatggacgtgaaagatagcataccatctttgggactgttcggataagaatgtgtgtgcattagttttggaaagtgtttggccactcggatctttttgtgataatctccagactatgaatattgcggaaatataatccatgatcagagaatatttggcgatgcttgatccatgaccgtaattggagccggatatgttatgatttgatctacaactattattacgctagataagccaattaattatggtaggtgatcgtgaatataacttcactgtccgaaaaagaatagtgtatatgttgccctgaaccatctatctcattaggtgctatgaactagtgagttttaagtatagagggtgcatataagtcgtttttccatcttaaatcaaagacatttcttagtatcttctagatatttcattcttttagtaccatataaattagggatttggacaattcacaattatttattttaaaccaaacaaaataattgttctccgataatcagatgtgacttatgtgatatagtacatataaatatacacactgtttaaatttgtctacccaatcggaatcatagaaactttattgtttacccaaacaaaacggtactgaatatcggaactttttttattaaaaaaaaactgtgagagagaaattgaatcaacgtccaagtcacttgatgcaagaaaaaagcgaaaccaattaaattcccgtaaaaacagaacacaaaagaacaggagagttaatgttctaactgacacgtgtccctaccttgccatacactcacacaattaaaatttctaactctgtctcttatccgaaaaataatcatctccaagtgtaataagaaaatcaaaataaaactctcatttcttcttcttcctcgcctataaatacaactccattctctcatctcctacatcacaaaacaaaaacctcacttaaaaaaaaaaaacagaagacagaaaaaaacaaaaaaaaaaagaaaaagaaaaataaacaaattttcttttcttttttttcctctaaagtttctattttgtctattcgtgtttttttttttacttcctgata

SEQ ID NO: 14279 - DNA, 3000 bp, Unknown
  misc_feature (1)..( 3000): cDNA_ID_2729758_gDNA_ID_2684098_Annot_ID_137069 3000 nt of promoter + ATG
gccgaggatcaccggaaaaccgccggtgatttagccggaccgagcgctagtgttaaagctggagctttaagtctctttgctgttcttggtatcccattagctgtaagtacacttttgtgttgtcttgttaaaaaactttttgctttgcttaaactaacattaatcgattcgttttttattatttacagattactttcagtactccttttgctctagcatccatattctcaagctgctccggtgcaggccaaggtaaatatatacatctttaatattaaagttactaaagttacaaatatgtgggaccgtaactattatattttggtttcatccaccttatgcaattataacataggtatttaaattgtttttgtgatgttttgatttacaggactttcattaggagttttaaatttggcgattgtgataccacaaatgatagtctcactaggaggtggacctttcgacgccttgttcggcggtggaaacttaccggcgtttatcgttgcagcaattgcagcggcgattagtggagtattagcgttaaccgttttaccttcaccaccaccggacgcacccaaggcaacgaccatgggaggattccactagtttactattttttttttttaatgaaactcatcaaatacagtattactgtgcgaaactgcaaaaacccaaataaaagaaaagaatggataaaatgataaaatctaataaaccttgggtcgtctgtatttcacccttttttagttttttttcttctttttttataacttttgtcacttattttaatttgaaatagaatgttttttttttttgcccttaaataagatttgtgtgttgagtacaattgtttactgtttgcttcggtagaacaaatatccaactagaaagtaattccctctaccctcagaaaagaaaattttgataataatgtatggcaattcttttatatatagggaacaagttgaacaatttatgtagtttagaacggtttaggcgataaataaccattaataataccagttaaattaattaatatgattaataattttaaaaatacttattaataaatattaaaacaattctcatgtaagtacataaaatataaacctagaagatattaaaatattaaatattaaataagaaaccttaaatattcttgcaaacaactagtccaatcaatatgacatttttgtattctataaacacactgtattataatataaactatacagtatgtttcttagcacagtatgacacttaacaacttgatgatttatactaggcaacaaccaatgtttttgaagatcatacaatatcatttataagtatatcattttttatattacaaaatgaaagattgttttggtcaacaatatgcgggcttgaaccctcagtggcgatacaacattttacatatctatatataagttttttccaccaatttttagaatatttgcctaaaatataagaatgtttatactgcttaattagtgagtaagaacaggtagtccatatccattttatacaattcggactcagttgtcacgacttcgttaattggcaactttggcaagtatgttgatttcagaacacatcgaatcaacaaaggacagtctattgtgttaagttgcaaacgatcaaaacaaggctggcgtaacataaatgaaggcctttgggctaaataaatataatagatacatcaaaatacaactttcaatttggacagacttgaagccttctataatttggcctggatcaatactccttttaagactaaggtgtatcagcccagtcttttgatttttgattattttttttgtaaaccgaggcaagatttttgataggcaataatcctactttataatacattcggagtgtgtattcaattaaacattttaaatgatttgtgttaaaataacaaattcagcctcacaatttaatgttaaggatacaatcatatcatcctttcattacctcttatgcaatttaccacaaatgattgaaacctcttattcaactagaggttttgaaatattgatatatatatttggattttgtaaataattaaggtttttaaattatgtcatttaattatttgaaaaatgagggtaaataagattttgtacatgactttttttaaggagttttaagtttggcaattgtgatactacaaatgatagtagtgtgacagtgtcaccttggattccattaattttctatgttcccttttcatgaaattcatcaaatagacaaatacagtattattgtgcaaaacccaaataaatgaaaaggtaaaatctaataaaccttggaccgtctatttcacccttcttttagtcttcttactgactttaatttgaaatagaattggtttttgtttttggccttcagtaaacattgtgtgtaactaaagtcttcttttgttaacaagaaagacccagaagatcacactagagaaaataagtcctttttatggcacttctttttgaattagatgggggaaaagttgaattactttactttatttttatttaggtaaataaattacttaatatgacttcaaaaaatagacattaaataaaatttgttaaacttaattaatttgatatttgattaattcaaattacttagaaacattttaattctcatgtaaagatactgaccaaaaaatattaaaaagtatatactactaaaataaggacgtccgttaaattataaaccttaaatattcttgtaaacaactaagtttagtcaactaaaaaaaacaaaacaaagaggagttaatgacctactgccacgtgtcctcacattgtcatgcactcacacaaatgagatttctaactgcgtctcttatctggaaaataatctcattccttcttcttcctcgcctataaatacaactccaatgtctcatctcctacatcacaaaactaaatccccactttcacaacaaaaaaactcttttctttttgtctgctcgtttttcttttcata

SEQ ID NO: 14280 - DNA, 3000 bp, Unknown
  misc_feature (1)..( 3000): cDNA_ID_2729754_gDNA_ID_2684098_Annot_ID_137070 3000 nt of promoter + ATG
gttaccacagtgaccgatgcgagtccagattcggtcgccgtcgtcctttcattgccgccggagtcgcactcgtagccgtctcggttttccttatcggattcgcggcggatatgggacatagttttggagataaactcgagaacaaggtaaggactcgagccattataatcttcctaaccgggttttggttcctcgacgtggctaacaacaccttacaaggaccatgccgtgctttcttagccgatttagccgccggagacgctaaaaaaacgcgagtcgcaaacgcgtgtttctccttctttatggcggttggaaacgttttgggttacgctgctggatcttacactaaccttcacaaaatgtttcctttcacaatgacaaaagcttgcgacatctattgtgcgaatctcaagacttgtttcttcttatccatcactctcctccttatcgtcacattctcgtctctatggtacgttaaagacaaacaatggtctccacctcaaggagacaaggaggagaaaacatcaagtctttttttctttggagaaatctttggagctgttagacacatgaaacgtcccatggtgatgcttctaattgtcacggtcattaattggatcgcttggtttccatttattttgtatgataccgattggatgggtcgtgaagtgtacggtggaaactcagatggagatgaacgatcgaagaaactttacgaccaaggagttcaggctggtgcattgggattgatgtttaattctatacttcttggtttcgtgtcacttggtgttgaatcgattggtcggaaaatgggaggagctaaacgactttggggatgtgtgaatttcatactcgccataggtttggccatgacggttcttgttactaaatcggctgagcatcaccgggaaatcgccggtcctttagccggaccgagcagtggtattaaagccggagtatttagtctctttaccgttcttggtatcccattggccgtaagtacacttttgttttgtccttttgttttcttcacaattttaggtttgtaaccgattcttttttcttgtgtaattattatgacagattacttacagtattccatttgcactagcgtccattttctcaaccaattccggtgccggccaaggtaattttcatttatttaaaatgttaagttacaaatctaatggtcagattctgataatgtaggacatattagcatttattgagttcaaacgtttgatttgaataattaattgaaaagattatgtttccaattttgtgtattattgtatctatctattcaaaagtaattctttcctttattgcataggagaaaaaagggagtaaatatttcctttgtaacttttttcaaagtcttttcttgttaatgtggattatctaccaagtttatctatagcatttaatagggtgagatttattaacttaattatattaattaagatttctatgtaatctgctcttatattttcattatccataggtttcatcattcatgcacctaatgtttgaaacgtagacagtttcttttgcaacataagtaaatatttaaatttaacgaaaacgtgtttctttttacaggactttcattaggcgttttaaatatagcgatttgtataccacaaatgatagtatcattctcaagtggaccattggacgctcaattcggcggtggaaacctaccttcatttgtggtcggagcaattgccgcggcggttagtggagtcttagcgttaaccgttttaccttcaccgcctccggacgcaccagccatgtcaggggctatgggattccattagttaactagtttttacatatatatgaatttccatctaatacagtattgttgtgcaaaagtgaaacccccaaaaaatggataaagtgagaaaaataaaccttggtcgtctgtcttttactgttctttagttttttttttttttttacttttgttattgatgttagtcaatttgttttcgttttgtttggacgttaataaattctgtgtttgactacaatttttttactgttttttttgcttcggtgaaagaaagatccaactagagaaaataatcccaaaacaaaaaatcaacattcaaaatctgagctcttttctaaaattaaattcaaaacatgaacttattctatgtaattttttttttttgttttaaagacatggccaatgggcctttcactcttgtcaaacccatttgagtcgggctttagtcataactcattttaaagattaaggaatatgaggccagttcttttgtcacaatcctagtttaagcttgtctcacttaccaattacgtctctcaaaagacaaattttaaaaaatctataatctctactctctaacatgtatatatatatgataaactcgttggctattacaacttttaaatcacaaatggcctgattggaaaaaaatgtatacataaatgataagtttgtcactgattaatgcgagaaaattctaattatttgcattaataaaattagcgtagttaggttttaaaaaggtttatacaatacattatacatatttataaatttaaatgtttttaaatttatattaaatttattttattatttagataaatcttaaataaaaagaaaccaaatattatttgttattttttcgtgaaatttatctttttaatatattttttattttagtaaaaagaaggaatggtggcgccggaaactgaccgtagggtcagtctaattactctctcagcgtttctctttttggtcctcaaatcttcaccttcaagatcttcttcgtccctcgatctccgatttcaaatctcgtttctccgttcaagcaacctctctgaattcctagtctcacagcaggaattagtactcggcgaagcgatttctgcttcgatctctacatctgaagttccgatctgacgaaatttagggttcgtctgggtcgaagttaaataggaaaaagatttcgaattggcttgaga

SEQ ID NO: 14281 - DNA, 3000 bp, Unknown
  misc_feature (1)..( 3000): cDNA_ID_2729746_gDNA_ID_2684098_Annot_ID_137072 3000 nt of promoter + ATG
caaatggttcaagaagatcgaagaaggaaagaggagcagcgaggatgagatcatcttctccaatatcggtaaatatgctgtgagttcaagcacacgccattagcacacacccacgcctaaacccttggtgtgacagttaaaattttataaacaagagatgggttttgcctaaattggtcttacaagcatctataactaaaggtttcaattcaagatttgcattattttttattgaatcttctatttttcttccttagttggtttgaagctttaaaccctttgaaaaacaagaaatggagactttgaaagttgacgaaacacacatgttttattattagtcaatagtaatttgatgaggtggagttataacattgatgataatagatagtgacaacgttctatgttcatcttttcctcaatcaatcactccaccggtagatgagatgtcaaattgaaactgcgttatgtcactctcattactctttttgtatacgtttctcatcttatagctaatccgaaaccaatttatttaaaactttataatagcataaaacctcttaacttcaaacaagtttcaactttcacatatcttatagggatcatggtaaaaatggttaaaagttaaacctgatttgcattacaaacagaggattacgtgtataagggctataaactatatattacctaaaaaagaaaactagagttgacttattgagtaataaaatcgcctataaatatcgtaacgaaagaaaaaagatcccaaaagagacaaaatattaatttgttaccatagttacagatttctttcgaataatcaatcaataaacaaaactctttctctacaagtcctaaaatccttagagaaagaaagaaataaaatagaataagagaacttgttgtagcagttgaagcagaaaataaacagagtaacgaatccaacatcacaaaacaaaacacaaactgtgtgttgtctctcttctttggtcttctcttcttcttcttcttctttttctttttaagtatttttattttttggtttcttgatctcagaaaaaatggctctgaatagtgtctcctctgaagaatttaccttcccatcgctagcttctcatgattcttctcaccattccggtcttgattcacctcctttgtggaaacactcaccggttacttcctttcgccggaaagattacgactttggtttggcaagattagtcattggaaaagacggtgatcatgatcagaggaagagcttctcgtacgtggagatgagaagtcgttggatcgacgacaaagaagaggagaaaatggatatgttatgggaagatctcaacgaagaattgcctccaagaagtcagagtttgagaattgtacatggcggcgacggtggagagaagaaaacggctttgtttcccgatgagagctctgccgtggccgtggggtgtgggatgaagttatcgaagaagacaaagaagaagacgaatctgaacgttttggtgttgatgagggttttgaagaagcttattgtgttgcgaagttcgtctcagaggtcgccggtgaaaactcatccacggtgattgatctccaccgtgataattgtgaattggggggttattttgtggaattcagaacttacggggcttttgtggagaaaattggaattgtctgaaaatgatttatttgtagtttagtttgggtggttcacaaaaattaattttagggtcctaaatttttaataacacatctgaagtcttttttggttcttcgtcttgattcatttgcctgttccgtggggtttggtttgaatatgtatgaatttataagatgaaaaatgaaagaggtcagaatattagggtgcaataataaaggaaggtaaaaaagatttgtatttgaaacattccacttgtatatgatatcactttttaaatgtgtgataaaaaagatttgtaacatctaaaacttttgggggtctttattttaaaatgagtctttatgaaatacaactttagtctgaatcaaaaaggttttctaaaaatgtcaaaatgtttgtagtcttgtacacttactcactagtcacttggttcatgccacgaaccgacctccctaaaatatttctccaatttgttttctctttaagttcacaatagtagagttttgttttctccctaaaagttatttcgaagaaaacatgttttttctttttcctttttaataaatcgaagattctaaactttagtctataatccctcgaaccgaaaattagaatgaattttaatcctcatgggaaaaaaaattgtacagtagtttgttcttctctttatactaacgtgaccaactacttcttggtttaaaacaaacatgtttaaattatcaatttactaaaactatgattctatagtaacatgtgaaatgagaaacatttcaatgtcaaaagtctggtccaattatcgaactacataaaaacattgtaataccttttatatatatgaagaccaccattaatgtcgacagaaaagatagccatgaatcatattcaagcatcaaaactgatttaggtatctccggaatcattgggagaaaaattaggtgaccttcatatgaaaaagatagagtagacttttttatttaacactacttggaagactttcttacctactctcactatagacccgattcgtcagaaccgggttttggattcaatttcggataacccctaaattggtacgccaattctcagtcactcggaaaaaaaaaaaacctcacctttgtccacgaatcgcaagtgggtcatagaaaaatcgaagcttttgactgatctcagtcactttagtctctctgcccacgacccttctcgtctactaagggttatctccatttgcccctcttcctgacaactttcaggtattacttgtcaataagatgtgaaattgagtatgtgcatcagatgtttcctctagattgaactgattccacctttgatatgcgcagacacgaaaactg

SEQ ID NO: 14282 - DNA, 3000 bp, Unknown
  misc_feature (1)..( 3000): cDNA_ID_2729742_gDNA_ID_2684098_Annot_ID_137073 3000 nt of promoter + ATG
tatgattagagaaaggaaaattagggatcgagggacatttatataacgaaaaaagtgaatggtgtgaaagggttaatggatagatggtcttgggatttgaacaaaaggctctctctccctcgcgcagtagacaaataggcatgcatgtgaatctgactccaaatcaagtgctacctcttttgccttttctatttttggtacccaatatttgttataattttcattttttctgttttatatatccattctcctcgaattctgtgtctaccttgtcatatgttaagtattttggatttttctttggactagggtcaaagagttactgagatgacgtcaccttaagccgaaaggtgatgaggtaaaagaaacgacagccaacggctttgggtggacccgtgcaagcggataaatcagatgaggaacaaatgattagttatgtgatagaaacaggtctgaatcttacgtgtcttacattcgtaatgacacgtgttaaggacggcgccaccaaaccagacaatgggagctggattgctggagaaagacttaagaacatatgaaacatattcctgtgttttactcttctccttattttttctttcataatataatgttcatatatacacgattcctgatgttttaatggccaatgttcgttcctttaggtttactataaatctgagtttagtttaatcatttaagaaaaagttgagattgtggtttcgagtggatctagctagactcacattataaaattagctgcggtggtatattgagtgagatttacgtagtaatccataaatgtacatgcgtgtaaatcctttcgacgttgagatgtttatatacttaataagttaatagtaatatctctttgacaaaaaagttaatagtaatatctcaacaactttgaggtattacgtgtcttatctatgggttaataagacatactaaaactaagacacatttcatcagtacctgatccagcaaacatataggaatatatttctgtagttcttcttcgggtttacaaatccagtcctttttaatccttgaattgtgaatttccaacaagccactcacaatttataactaggttttattactgaaaatatcttacatggtataagaatttatggtgtgtagctgaacatagtgttttaagaaaatagattaattatattcaaaacgtaatttttttgtcatctgattttattgataatacatggaatcgtgttatgaaatattatccaatcaaactgaagtttttggatatattcggaacatccatttgacctaattacgccacataaaaaccgttaatctaaaggatttgtcttgtgtgatgtaataataactaatgagcaatagacaaataaaaaaaaggtttggcttgtgcagtaactgccggtaaagtggagaagattggaaaaactttaaacaaaaaattgcggtaagagagagagagagacgccgaccaaaaacaaaccgtagatgtctatcccacgcgcaatcaaacctttccttcatctccttcttcttcttcttctccttcttcttatatcatcattttgcacccacatgtcacacacttaccatatacatataattaagcatactcgcataaacctatatatacactctaagatttctagctggtccatatgcatgtgatctaatcaaaagccaaactctccttgtctttgctatattaacaatcatttgatccacaccaccagagatttcaatcttcctctccttcttccttttgctactctcttttagatcgttcttgtgaaaatcgcttgcaaataacaagcccttcgtccaatctttattagctcgtaagtttcaccccattgctccttttagggtttttttgttttgttgctgtactcacttcatgcacgaaccagatgatgatacatcggcgtttgtgttttacgtttttattattcaaaaatacatacatattacatatagtatcgttttgtatcgtttcatatcttgaatagtatacatgtgtgtggtcctgttgagattgacccacaaatattagagtaaactggggaattgaaatcaatcatggtggggatttcggaatctatgtgtgtttctaagatattattgtttcttggaaattaattgttgttgcaccataatataatttatattatatagatagtctaggaaaataactcaagacaaagagtgtgtaacacactccaacctcagtgacttccacccgtcaagcttttcggctacatagcctttatatacgattattttacatatagttacagatatatacagtactgcttgtatatttttggtcttataatactaccttatgtcattatatatagtacatattatacaaagtttcaatcttttcatttataagcatcgttcggtatgtagaaggcgaaacaaacccttaaacctaatatttttttctggtccaaaaactttctctatcaagcttttgcattttttcttttaaaatagtaacagctcctccattgttgggtggtcccataaaaatacatcataaccatcatcagcaacatataatagcgatagccttaagcttaaagatccaagcttttggatataatatctagttacatgtatatatatatatatgtgtttgtatatttataggtatatagtatattatcgtgtgcgtccgtgtgtaacatcactatcattacccaacatacagcttttggaatttcattggacccaagagccattcgatccctttcttataattaaatataacgaagcttgtaataggctttggttttggtcccaaatacaaaactttaaggttgtgccttgtttgtctaaggttttcgcaatagcttccaaaaagacacgcttatgtttatatacatttcattttccttcatatcattctcttctctgccacttctccatcttgtttcttactcatttctctaacaattttccaaattaaatacgtttataggatcatcgtgg

SEQ ID NO: 14283 - DNA, 3000 bp, Unknown
  misc_feature (1)..( 3000): cDNA_ID_3447302_gDNA_ID_2684098_Annot_ID_190206 3000 nt of promoter + ATG
cgatttccagcagctcaatgacatttaccgttacaagacggaggagtactctcacaccgcggtaaacaagttcaacgtaatccctgactccatccctgattggatctttgacttcatgcctctccgaggtggctacttcgttggaaatgtcagtcccgcccgcatggacttcaggtggtttgcgttaggaaattgtatcgcaattctttcctcattggccacaccagagcagtccatggcgatcatggacctgattgaggcccggtgggaagaacttgtgggagagatgccgttgaagatatgttatccggcgatggagagtcacgagtgggggattgtcactggctgtgaccctaagaacacaaggtggagctaccacaacggaggctcttggccaggtgagttaccttcttttacaagtcattgatagatagttaatgggatctaatgggcattaagttgtcaaaattaccgaaaacattatataaatataatttaaggtcataaaaaacatgagaaaataaacgaatgcaaataaatatgatatagatgctaaacatgagcgattgaagagtaatagtatagtagactaagatatactatatgattagggaatccgatgccgaaaccgacattaattcttggatttgtttgccgtctatgatggccaaagaatattcaactcttaaatctgtttgaatttttggtttgtccaaaaaataagcagagtttgtttttataatatctttattgtaatggtagaaccaaaacaagatccacgtaaatactttcattcaaccctattttctatttctaacgccacatttgattaattttgttttttgtttggaaatataatcattcaatcaatattgttgactcatgtggctgatgcaaaatgtagtgcttctatggttactaacggcggcaagcataaagactggacggccacaaatagcacgacgggctatagagttggcggaggcacgactgttgaaggatggatggccggagtactacgacggaaagtctggaagattcatcggaaaacaggctaggaaatctcagacatggtcaatcgctggctatttggtcgccaagatgatgatggatgatccaacgcatgtgggaatgatctcaatggaagaagagaaacatatgaaacctcctcttagaagatcttcttcttggacttaaattatataatttcgttttgtgtttttttttcttcattgtagggccttttataattaccattaacagaaacaaaaatattcatagctcccaaattaactttaatatgtggaataatcaagaatggttgtcttgtgatcactatggtaccatggtctactacggaccaccaggtaataaggcatgggtttagaaggagtcattgactattgacgaatcaaaagtcttacaagacacaatccgacagaaacaaattagaaaaagaagaaaaagacaacagagtacgaccgttcgattaatatcatgcatgtacttatacaaccctacacttccagtaatttttggtaactttaccaagtcaaacgcagtataatctcttatgtaactactttgtgatacttgaggttatggatattttcgaatatgtctatttgagttaaaataaagctacggcctacgtcacatgtcatttaaaaagaaactaggttgaaattctgtgctatactaaactaaaagatgatacaagaatcaattacttttataagcaaattgaaaatctcaaaatacaagatttcatataccattttaagtgcatataggtagactaatagaaaagcaggtgaaactctatgagcctataatatataaactttgtgattctttatccacaaaatattaattccataggccatagacactttagatagtgtgatacaaaatgagcaaaccctaaatcctattgatttaaggtttctgatcgtacaacttcggtcaagttcatagaaaaactagggaaaagattcgtaaacaataatatttttctctgaaaatcatgatcaaattctaaaaaagagagagtattggatcgcactttgtatactttaggcttgacagggtcaacgagttgcttttatgtccttgttttattccagattttcggccatttacttttttttcttttctttaaattcttttggtgggaaaaacttttttcttttactggtaaagtaagaactgttttatctatatacattatcatggacttaaaacttgaaagctgaaatctaaaaattagtgataaagtttggacgaaaaattagcagttaactaaaatgatttgttttgagaccaaaactaataataataatcaagatctagctttttttcatgtgggaataagaataataaaaaggaggcaaaacgggttgttgaggagagtgattaacatgaatcaccgctcaccagtaacgtctttatcgacaaaaaaacaatttaaaaatggtgagtggattagtattagcaaccaccaaatagatttaactataataagataactaaactaattagctgtatataatttcttttaactatacattaattaatccctctcgtaaaataagtagatatgattgtagtcttttcaagtatgaacaaccaacaaatctcacactaaatatctccttcgcgttaacttaaacagtacacatcacgtagtctttatcaaaacactcttaaggttaaagaaataatacacctaaattaaagagttaattaggtgatgatcacggttaaagaaacttagatgggaaaatcaaggttaaaaaaattcacctaattttatttttattttataaaggttcttaattacatcactgatctataggattagatactctaagaatgttcatgttccattctaattaattatatatttaaaaaacaaatccgaaaattagcttgcataattatccaaaagtaacaatgatgatttttttttttttaactgtgtcaattttaattttaacc

SEQ ID NO: 14284 - DNA, 3000 bp, Unknown
  misc_feature (1)..( 3000): cDNA_ID_3015739_gDNA_ID_2684098_Annot_ID_190205 3000 nt of promoter + ATG
aactcggttcctttgtacaaagaaatatgagcttatgtatatacacgtctctttccttgttattactatctgatcactcttatctctatccgtttgcattgatacgatcctatctagtaaataggcccagtaggcctaattaaggtccagtaacataaactgatttgggctaaagtgaatgaagaaaactccatcccaccgttggccggtctattctcctccggcgtcgttgaggatctccggtggtttaaggaatcaatcacaccatgccaatgagatacctcaacgcaatggccgctctactaatgatgttctttactctcttgatcctctctttcacaggcattttagaattcccatctgcttcaacttcgatggagcattcaatagacccggaaccgaaattgtctgattcaacatcggatccattcagtgatgttcttgtagcttataaaaaatgggactttgaagtgggttgtgctcggtttagggagaatcataaagatgcgattttgggtaatgttagttcgggttctttacaagaatttggttgtggtaagcttaagatgaagcatgttaaggtattggttaaagggtggacttggattccggataatttggaaaatttgtattcttgtcgttgtgggatgacttgtttgtggactaaatcatcggttttggctgattcacctgatgctttgttgttcgagacaacaactcctccactacaggtaataaaattgcttgttgctaatcttgtcaaagtttgcgttttggaaagtagttatagatttggatgattgggacagattagatcacactgtctgttttttcttaccccaaattggatgtgatcttgtgatgtattcttcactctagcagatcttttagttctatgactcactaaaagatactttttcattgttgtctatatggttcaagaattttggtttgtaaagtggaaaatttcagagtttaattgtctacgtgagcttattgtaaaccagaagaatctttgtgtactgctattcttgttcttagtcaattcatttttgaaagttggacatagatatggataataaaggcaaactaaaatctcctatgttcttattttcccttcagtgcctgcttcactatagttttctttcaataattggatcccattgatgctgagtttcttggtttgtttccttagagacgtgttggagatccgctccgtgtgtacatggagctagaggccggaagaaaacgctcaggccgtgaagatatattcatcagctaccatgcgaaagacgatgtccaaacaacttacgccggttcgctctttcataataacagaaactatcacatctctccacataaaaacaatgtaagtaacgttttatacacccattccatactgttcttctttcatttcatcgttttttaattcgattgttaaacattgcacaggatgttctggtgtattggtcttcctcaagatgcctccctcacagagatcgtctagcaaagagcctactcgatttgattccccaccactcctttggtaagtgtcttaacaatgttggtggcttggactcagctctctctatgtatccagaatgtgtcgctgagcacaacgctgaagcaaaatggtacgatcacctccactgcgctatgtcacactacaaattcgtccttgcaatcgaaaacacagctgttgagtcatacgtgaccgagaagcttttctatgcgctcgactctggttctgttccaatctattttggggcctctaacgtgcaagactttgtccctccgcattccgtgatcgatggtagcaaattcggctcgatgcaggagttggctgcgtacgtgaagcggctcggtgatgatcctgtggcttactcagagtaccatgcgtggaggcggtgtggactaatggggaactacgggaaaacccgtgcggtgagtctcgatacattgccatgtcggttgtgcgaagagattagcagaagaggtgggaagaacgccggagtttgatgagccacatgtggtttcatttagtgtgggtttatgtaaatgtgatcctatgatctgtttctgttacatatgataacttttttgtcctatatagtctcagatcatcaagtaaatgctatcaaatcatgtgttcaagggacaaaaacagaattattcacttatgttagagttaaatgggatctcttggtgtagcttttccttaatcaaaaattcaaaatagattatgattgtgattgtgtagactaagttaaaaaggacaaaaatcaagtcataaccactttcctatatttacctacaataatcagaatcatttaaaacttatcaaaactaaaaccattcaaaatattgggtgaattaaagtttcgattgtttcaaaacgtctgtataagtatgacaaagagacatcaaaattcagattattgtcacatttttatcaccgtaaaatcttagaagaaagaaagataattttttttttttttttttaatgataatcaaagatattatgttagtagtaaaatagagaatggaaaaaataaattaattacatagacaaacgtgtaggtcataaaatcatttggtacatcaaattcatacatgggtcttctggtattatctattaacagctttaggaaagaaatatgagatcagatttttaggctaatcaaacaaaattttctataaaaccatcatatacataacaaatatgcacaagaagtgcataagaagaaagaaatcaaacagaaatgcaaacaaactagatatgatgattggtgatatatatatcttgaaattgtttctatccgcaaaaaagcaaacgctccaatcaacatgttttgccagcttgctaggtctctctataaatattggttccttctcttaacatcattttttcttctctcgagtgttgttaaagtttttgtatagtttgctatttttcgtgaatcaataaaaagagctttgttgaacaaattagctatctcc

SEQ ID NO: 14285 - DNA, 3000 bp, Unknown
  misc_feature (1)..( 3000): cDNA_ID_4254777_gDNA_ID_2684098_Annot_ID_190203 3000 nt of promoter + ATG
atatattgtttcggtttaagataaatgtatcacgcaattcaaacatatgtcaaaaaatcaggctgggaacttattcccagaggtttgtacctgttgctgtcttggtttacttaagacttgtgatatcagtttgcaatgtattggaaaataatatagtatttgccacaagattgttccatttcatcttctttttgtattttaatccgtatttgtatcaatcatattgctctctattgcaaggttcgtagtcaactcgcaaacacccccaccttacaattgccagttatcgattatttttacgctaataaatctaaaattccattttgtttcgttttttttttgcaatggaaacatttaaataaatacaaaagaaatacctacgataatggggtatttatacaaaaaaatgaatttgaaacaaaaaaatataatgaaaaaaagagagagttaaatttgctaagaatttattcttcaggtttctgttttcgttggaactaagtttggagttggagcaggagcaggagcaccgagaggaatttagtggggagcgaaaagaacctaaagaaacgtggaatattaatgatgaccaattctctaataacattgttagacataatttaatatgaacattactttcatcattgtcatttgtctgctaatgtattcgcgtgtttgcttttacattattgacttatgtctgaatattataacgccatatagttaaaacaatagacccctaaatgtatcatgagcacatttggtatccataaaaactgatggaaaatcatcacaaaagtgatagctatctcggtttatttagtatattatatcagattttgaagtgacttcaactcagtagtgactatttttacgtactaacttatatatgtaaatattcagcattcgcattcgcatgtgtatgggcatatatattatacataataaatgaaaattggatgagacaagatggaccgctctaagtgtgattgagatgtagcttgagaccaaagagaccgttatcatcatcaaccatcatgtcctctctttagcacatggaaagcaatatactatagaaattgtactatatatatggatcaagcatacgaatcagagtccattttgatgtgaaggcatcaaatctgcaaaattaaatcaagtttcttgagcgacaaagctgatgatatcattcttgcacttggagtattttctacaacataacctaagccggtggttatttaataatgtttagtaatcttgaattccatacatttacgagggagtgtctgcatagttgatagtaatcatgaagaagctaggtcggttcatttcatcaaattatatgttttacaaaaattgtatcaacatgacttgaatccattatcacagtaataaaagtttgaaacggaatgaatacaatattgagatgctgcaagataaatggatataattaatgctttgtcttttctttcttcttttaagccttaagtgtcacaaacgtaaacatcaagattcaataccataatgatataaaagatcgtgcgtgaaccatgtgaatgtgatcaaacccaaagtgaagctaacaagtaataacacatgtcaaagatatacaaacatttgtatttagagtgtataactataaccccatcccaagagtgtcgaaccaaaaaccataatctaagagatttataccgatcagatcacggaagaagttatagaaaaccgcatctcgttgattctgattttcgacaaataagatacaagccagcccaccgtctgcacggatactcaacttccctgttggtaatcgagttaatttcgaattacatgggtcaaattagaaaaactgttcttgttttatttgtttttaaatgggccatggggttttaatgtcttagtatttaatgggcttatttaaggccgactctaataatagacgaaattaaaaataggcccatttatccgttaattttgccatggtttttttttccatgaatattgcaagttttttttttggtgtaaatcttacaaggtttaagaaagaaaaagtgaattaatactactatcaaaaccgggagtaacagctaattatgtgtgtattattatggttttggatagcaatattatttaagcagataattattattttttgatataacggaagggaccatcatgttccgttgtctccaagagtttacgaacagatacaagttatctagaagattagttccaaatcataatatatatatttttttaatacaagtatacaagtttccacatcttttgttgactgtttattcgagaagaaacaaagataacaccttttgtccgtgtaatcatatatcaactcgtgggtcatgactcatgtatgatcaaacctaaacatcttcaaaaccggtaaaaaaatcagtaagtaaaacaaatattgagctgtaaaaaaaattcttagaattgttttaggcagatttatctttagaatttagagataaaacaaaaattgttaaaccaacaaatggatccacaaaacaaaaccatgagctctgaagtcaatctcaccagtcaccatgactcacttactacgtgtatctgtcttttttacatatattttgaaagtttcatcctttatcccgatggatgcgaataatacaaataacctaacaaaactcgaatcagagaattccagatattacttacataagacaattttagcaattagctttcaaatctcatctctttattctctctctctatctcttctcctcaagaaccctaaaaatctccagaaaaaagatcccaaatttcgtatttcaacgatctgaatctctctctctttcgggtttattttgtttcccgatatggtttagaatttgtgatttaaatggaagctgacgtgtcaatttcctgaaaaaacccttatcgcgaaattttccagattaccaaaaaaaaaaagattgaaacttttttcgatttgtttgaagaagaagcacggtaggaacgacgacg

SEQ ID NO: 14286 - DNA, 3000 bp, Unknown
  misc_feature (1)..( 3000): cDNA_ID_3015748_gDNA_ID_2684098_Annot_ID_190199 3000 nt of promoter + ATG
gaaaatgattagttgtagtagctaagaaaaaatgtgtaggagtacagaccgtagacgaatacttaaattcagtgaatagagagtcctaaatttaggaaaaggactaaaacagactaacaaagaaaccgtattgaaagggaaaaaaaaggaattgaaaactaatttatattgccgtgacgtaattgtcatactcatataataaagtgtactcaaaagaaaatggaagaagggaatgcttgcttacttcgttcgtcatggccataagtagatcatgtggtccaaattctctgtacacttctatctcaccttgtttcctaataacacagcgcttcacacccacgcgccgtcgtcgaaggtggcatttgaagtaaacccttgttcgaagaaaggaaaatctaagcagcacagtcacacacacaagttatgaatcatgaatgacataaaattggatctgagttttagaaaagaaaagacagtgttgagtggatcatcacgtgcgtgtgacacgcgtcgccgtcatcagttttggagtgggacactatcgttgaaactaaactgatctacgccattcattgtttgtgtctctctgacgaaaggactgaaatcccgagaaatcagtttttgtttcttcatataacacactttgacttttcgagagcgtttgagttatgattatttgtacaattacagtcacgtcatggtcaacgcttcgacttaaatcggggatatttccataccacagaagatgagaacggtctttaaacaatgtcgtgacggctctaaaacgcaccaccgtaacatccatgtaaaagcacgtcttcttgatcgctagatacaatatttacacaatatacattttgtcacgtgaatcggtgaatgtgatttttttttgtaatcgattagtatgaccatgcacaagattaacaaaaaaaaggaggctgggaggctggttataaaatattcgtaagatagctactatacatgttttgtcatattgagccacgcataagatgaatacagctacatttatttttgtgtatccatatttttatcctgatcgtgttttatcttcgtacgtttaccttttttgaattgatcaaccggtctaaggaacattcggctctaagctatcgacaagtttctttcattcatccgagacacgtatgacttggaaatgttgagttaagtctgacgtgtaaatttgtggttgtcatattcgaaaatttagtttcaccgcaacacgttttataaagtttatctttttccattttagatttaatcaactgtgtttataaaataaaatcataaagttacattttagtaaatcaatgcggcaacattctgatttcaagacatactaaaagtctttacgtaaatttgaattttctattcattataatttaaccaaagaaaagaagcttatgcagctttggacggtttcgaatgatttacagaaatacatggtatcatatagcccaataaatacaaacagacatcgctggtgccagaaaaagtggaatagtcgatttgaaacttctaatagaaagaaagacattatgtatgaaaaattgcctcagaaaaaaacccagcacaatgtactgtatatgttttatatatgtatctatagaaggaaaagataaagttgaaaaatatttcctccaaaacatttgcagtgaaaatatatagatttgccatctaaagtcttttaatatctcttattaaaaaaaaataagttaatgtatattacatcaaaatttatctagtatacaatttcctctaaaataaccaataacatgaaataaaaatgttaattaaattaaaatcaaataattaatttcataatatttattcaaatttaaattaaacagctagtaagaccaattaatttaagcaataaactaaaataaatgtaatttcaaaacctatctgacaaaagaaatcattaattttgattatttaaatttaaatatattttaacaactttaaggccaaaaaatttataattagttgtaacacatacatagtcaataattataaaccaaatcataaaatatatgaggcacatacttttttatttttaattgagattttatatactagattatataatttttaagtggaaattgtttttaaagagagatatttgttgggttacacaaataattattggttttaagtgttttgcattttgcaattactagaaaacaatatattttagagtatctaaagttatattttgcacataattaaattttatataattgggattttatatactaaagagtgtcagagtttttaagtgaaaacatattttagacagggacatattttgaattacactaataataaatgcttttgatactttttcattttataattattagaaatcaaatatatagatactttttaattataccatgatttcaaaattaattatgtggtaattactaattacattgttaactaaaaaaaggaaaaggacataaacacatacaaacacaaaataaagtttttgcacatttttcatgatgattaatagtcagtcttacaaatatatctttcctcttttcaaaataaaataaaaatcaggtggattctcaatttgacaattagagtggaaaacactaattgaaatttctgtaaagagaaagaaagtatattcgaaaaaaaaaaaaaatcagaagaagaagaaaaaaaaggctggcaaaaaaagaagaattttaaagtggctaagcagaaaaaagaaacaaaactaaaacactttttatttattcctttcagcagtcgccagctggcattatacgttttgccacgtgttattttctcaatgaccagtaatctaatgacgtggcacccacttgcttcacgttccacttcttctccataaatacagctctcacaatctcttcttcagctttctccattttcacctctctctctctgtgttttttttaactccgtttaaattttccgtctgaattttacaaaggaacactaatg

SEQ ID NO: 14287 - DNA, 3000 bp, Unknown
  misc_feature (1)..( 3000): cDNA_ID_3015752_gDNA_ID_2684098_Annot_ID_190198 3000 nt of promoter + ATG
acggtggttacgtcgattcatcagccgtcgagtcgtgtgtttcagatgtttgatacggtgcttcttttgagtgaaggaaagtgtttgttcgtcggaaaaggaagagacgccatggcttactttgaatccgtcggattttcgccggcttttcctatgaatccggctgattttcttcttgatcttgctaacggtacgttctcttttaaaatacagcttttaaactttcatttacgtagtgtatgtactaacacgataattaacttaaatcattatatgattgaattaaccgaatacttttactatatgacttatgattcccgttttatatttaatttgcgtgaaagtattcttacacgaattgactgatgataggatgatttttttttaaaaagaaatcatatttatacgtgtatatctatacgtataatatggatctttggtattgaaaccatgcataatacgatcatgtggggaggccgtgagggtagatatttgtgtagaaaactactatgaaaataacagctcgaccccaaaaaaagagagtaataaatgcttatttatgaacgttatcgccgacgtacgatgagagctatgcaagtccaagttttgatgtgtccctcgttgacgatggtcgtcgcgctggctacaaatttaattacttgatttattgctttgtctttggagttaaactagccctaatctatagctattacattagtacggttctagcattagattaatattgatatagcatcctttttctcaccgttttttttccaataattgtttattctaaagttaataattatgggcaattggggatacgtgttaagtctttctttctctttttttcgagtatgatttgtatgatttttggggtctaaaattttggcatattatatatcatctgaataaatgttattccctgcttttatatgaaaatcttttatcgcattacccattacactattaaaccatgctttttatttatttttgagggataataaaaagagaggaaaatgatattaattttggttgtttttaaaaaacgggtgtataggaaaacaccatgtgtctaactggttacaagatgacgtatggttttagcgatgggcattgtgttttctgtttcctctttatccaactttttcaaaaattagttcgtcttttttttgcactatctaaacttttccattttatctcttatctttttctgttttcccaataattcttattctctttttcttcagccaactttaaaaattaacatccttttggcttttacattcttttgatcaaagtagtcttctcacactctttctctctgcttttgttttatttattttgtgtgtggcgtttaagctacacgagtcgacggaggcgtgtggttttgattgtatgctcttacgtattgtccataaatccttgattcgggaaaactttactttaggagataaccgcctaagggaacccaatcacactctcgcatttagcgcgtgctgttaactctctttcaatcctcatcgaagcaataaaacatagagcttcgggaattggaatagtcagaagtcagggtactcttaactcagtttcaatgttttttgagtctcattgtgatttgtgaagaaaacctgcataggtatttgcattcttcatagtcaactctttttttgaatataaataatatttccacttaggaaatagaaaaggacttctaggaaatttacgatcttaaaatctaaagagacggatccttgaggtcacgttaatttattccaattcgtccttgctaatcctaaacaagctagtaagtaccaaataatggtacgagtgttttgacgttttaggcatatacatgattaaaaagtgtggaccaaacttatgttcgtttggtcattcagtgtactgatgataaatattcattctttcatggtccttatatacatatatatatatatatatatatatatatatatatactagggacatgcatcacatacatgatttaatgtgtttttttggggattgttataagagttaaatgactaatttatgtgaaccgaagacaaaacaaatctcatgtcttcgttgacttttcatttttggtaggagtctattaataagggaattgcttcacaaaatgtatgtatgtatatatttatatatgcacatggtatgtatattttggtgacgccataggtagagtaagaaggcattaataagatgggggaataaaattggcacatagaaatagtttgttgcgcacgatggcatatatacagtagtattagatttcaatttaataatttggtgggtattaagttctttgtctccacgaaccatatgcttcacattcaatctttctttgtattattatctctgaaaaaagctcatttcattgaaccaaccattcacatgaccattcgatctatttcatgagtatataactatataatattataaatgtgcatgtatgcgatgttccatggggggaaagttaataatcgcatgcatgatcttactaagcaagaatcttctttgactaattatttcgttattagaaagatcaaatatgtttgctattttttcacgaggagctgttaggatattgctttcaacgtcaaattacaacagtaaactccacttgctttaacttattattgatcaatttgaaagaaaagaacaacataattaaattttctattccaaaattattgcttttccaaaagctggcttatgacatttcatgattacacttgtcgagtattgactatgcatttgttcatttatttattgactttctcaaacttttgttccactcaaattcagttttaatcttcttgataatcctcgtaagaaaaaagcataccacgtgtttaggatagactaattattcaccttacttagcataagcttatctaaggaaaagttaacttcaaatagattatttgatgatgctcaaacattttccatttattaaattttggaatcgatatcatg

SEQ ID NO: 14288 - DNA, 3000 bp, Unknown; identical to SEQ ID NO: 14282
  misc_feature (1)..( 3000): cDNA_ID_2729742_gDNA_ID_2684098_Annot_ID_190195 3000 nt of promoter + ATG

SEQ ID NO: 14289 - DNA, 3000 bp, Unknown; identical to SEQ ID NO: 14278
  misc_feature (1)..( 3000): cDNA_ID_2729762_gDNA_ID_2684098_Annot_ID_190189 3000 nt of promoter + ATG

SEQ ID NO: 14290 - DNA, 3000 bp, Unknown
  misc_feature (1)..( 3000): cDNA_ID_4254777_gDNA_ID_2684098_Annot_ID_137078 3000 nt of promoter + ATG
attcccagaggtttgtacctgttgctgtcttggtttacttaagacttgtgatatcagtttgcaatgtattggaaaataatatagtatttgccacaagattgttccatttcatcttctttttgtattttaatccgtatttgtatcaatcatattgctctctattgcaaggttcgtagtcaactcgcaaacacccccaccttacaattgccagttatcgattatttttacgctaataaatctaaaattccattttgtttcgttttttttttgcaatggaaacatttaaataaatacaaaagaaatacctacgataatggggtatttatacaaaaaaatgaatttgaaacaaaaaaatataatgaaaaaaagagagagttaaatttgctaagaatttattcttcaggtttctgttttcgttggaactaagtttggagttggagcaggagcaggagcaccgagaggaatttagtggggagcgaaaagaacctaaagaaacgtggaatattaatgatgaccaattctctaataacattgttagacataatttaatatgaacattactttcatcattgtcatttgtctgctaatgtattcgcgtgtttgcttttacattattgacttatgtctgaatattataacgccatatagttaaaacaatagacccctaaatgtatcatgagcacatttggtatccataaaaactgatggaaaatcatcacaaaagtgatagctatctcggtttatttagtatattatatcagattttgaagtgacttcaactcagtagtgactatttttacgtactaacttatatatgtaaatattcagcattcgcattcgcatgtgtatgggcatatatattatacataataaatgaaaattggatgagacaagatggaccgctctaagtgtgattgagatgtagcttgagaccaaagagaccgttatcatcatcaaccatcatgtcctctctttagcacatggaaagcaatatactatagaaattgtactatatatatggatcaagcatacgaatcagagtccattttgatgtgaaggcatcaaatctgcaaaattaaatcaagtttcttgagcgacaaagctgatgatatcattcttgcacttggagtattttctacaacataacctaagccggtggttatttaataatgtttagtaatcttgaattccatacatttacgagggagtgtctgcatagttgatagtaatcatgaagaagctaggtcggttcatttcatcaaattatatgttttacaaaaattgtatcaacatgacttgaatccattatcacagtaataaaagtttgaaacggaatgaatacaatattgagatgctgcaagataaatggatataattaatgctttgtcttttctttcttcttttaagccttaagtgtcacaaacgtaaacatcaagattcaataccataatgatataaaagatcgtgcgtgaaccatgtgaatgtgatcaaacccaaagtgaagctaacaagtaataacacatgtcaaagatatacaaacatttgtatttagagtgtataactataaccccatcccaagagtgtcgaaccaaaaaccataatctaagagatttataccgatcagatcacggaagaagttatagaaaaccgcatctcgttgattctgattttcgacaaataagatacaagccagcccaccgtctgcacggatactcaacttccctgttggtaatcgagttaatttcgaattacatgggtcaaattagaaaaactgttcttgttttatttgtttttaaatgggccatggggttttaatgtcttagtatttaatgggcttatttaaggccgactctaataatagacgaaattaaaaataggcccatttatccgttaattttgccatggtttttttttccatgaatattgcaagttttttttttggtgtaaatcttacaaggtttaagaaagaaaaagtgaattaatactactatcaaaaccgggagtaacagctaattatgtgtgtattattatggttttggatagcaatattatttaagcagataattattattttttgatataacggaagggaccatcatgttccgttgtctccaagagtttacgaacagatacaagttatctagaagattagttccaaatcataatatatatatttttttaatacaagtatacaagtttccacatcttttgttgactgtttattcgagaagaaacaaagataacaccttttgtccgtgtaatcatatatcaactcgtgggtcatgactcatgtatgatcaaacctaaacatcttcaaaaccggtaaaaaaatcagtaagtaaaacaaatattgagctgtaaaaaaaattcttagaattgttttaggcagatttatctttagaatttagagataaaacaaaaattgttaaaccaacaaatggatccacaaaacaaaaccatgagctctgaagtcaatctcaccagtcaccatgactcacttactacgtgtatctgtcttttttacatatattttgaaagtttcatcctttatcccgatggatgcgaataatacaaataacctaacaaaactcgaatcagagaattccagatattacttacataagacaattttagcaattagctttcaaatctcatctctttattctctctctctatctcttctcctcaagaaccctaaaaatctccagaaaaaagatcccaaatttcgtatttcaacgatctgaatctctctctctttcgggtttattttgtttcccgatatggtttagaatttgtgatttaaatggaagctgacgtgtcaatttcctgaaaaaacccttatcgcgaaattttccagattaccaaaaaaaaaaagattgaaacttttttcgatttgtttgaagaagaagcacggtaggaacgacgacgatgaatcgtgctttggtcctacttttatatgtttgtactgtttcttgtttagcttcaagcaaagttattttg

SEQ ID NO: 14291 - DNA, 3000 bp, Unknown
  misc_feature (1)..( 3000): cDNA_ID_3015739_gDNA_ID_2684098_Annot_ID_137080 3000 nt of promoter + ATG
ccgttggccggtctattctcctccggcgtcgttgaggatctccggtggtttaaggaatcaatcacaccatgccaatgagatacctcaacgcaatggccgctctactaatgatgttctttactctcttgatcctctctttcacaggcattttagaattcccatctgcttcaacttcgatggagcattcaatagacccggaaccgaaattgtctgattcaacatcggatccattcagtgatgttcttgtagcttataaaaaatgggactttgaagtgggttgtgctcggtttagggagaatcataaagatgcgattttgggtaatgttagttcgggttctttacaagaatttggttgtggtaagcttaagatgaagcatgttaaggtattggttaaagggtggacttggattccggataatttggaaaatttgtattcttgtcgttgtgggatgacttgtttgtggactaaatcatcggttttggctgattcacctgatgctttgttgttcgagacaacaactcctccactacaggtaataaaattgcttgttgctaatcttgtcaaagtttgcgttttggaaagtagttatagatttggatgattgggacagattagatcacactgtctgttttttcttaccccaaattggatgtgatcttgtgatgtattcttcactctagcagatcttttagttctatgactcactaaaagatactttttcattgttgtctatatggttcaagaattttggtttgtaaagtggaaaatttcagagtttaattgtctacgtgagcttattgtaaaccagaagaatctttgtgtactgctattcttgttcttagtcaattcatttttgaaagttggacatagatatggataataaaggcaaactaaaatctcctatgttcttattttcccttcagtgcctgcttcactatagttttctttcaataattggatcccattgatgctgagtttcttggtttgtttccttagagacgtgttggagatccgctccgtgtgtacatggagctagaggccggaagaaaacgctcaggccgtgaagatatattcatcagctaccatgcgaaagacgatgtccaaacaacttacgccggttcgctctttcataataacagaaactatcacatctctccacataaaaacaatgtaagtaacgttttatacacccattccatactgttcttctttcatttcatcgttttttaattcgattgttaaacattgcacaggatgttctggtgtattggtcttcctcaagatgcctccctcacagagatcgtctagcaaagagcctactcgatttgattccccaccactcctttggtaagtgtcttaacaatgttggtggcttggactcagctctctctatgtatccagaatgtgtcgctgagcacaacgctgaagcaaaatggtacgatcacctccactgcgctatgtcacactacaaattcgtccttgcaatcgaaaacacagctgttgagtcatacgtgaccgagaagcttttctatgcgctcgactctggttctgttccaatctattttggggcctctaacgtgcaagactttgtccctccgcattccgtgatcgatggtagcaaattcggctcgatgcaggagttggctgcgtacgtgaagcggctcggtgatgatcctgtggcttactcagagtaccatgcgtggaggcggtgtggactaatggggaactacgggaaaacccgtgcggtgagtctcgatacattgccatgtcggttgtgcgaagagattagcagaagaggtgggaagaacgccggagtttgatgagccacatgtggtttcatttagtgtgggtttatgtaaatgtgatcctatgatctgtttctgttacatatgataacttttttgtcctatatagtctcagatcatcaagtaaatgctatcaaatcatgtgttcaagggacaaaaacagaattattcacttatgttagagttaaatgggatctcttggtgtagcttttccttaatcaaaaattcaaaatagattatgattgtgattgtgtagactaagttaaaaaggacaaaaatcaagtcataaccactttcctatatttacctacaataatcagaatcatttaaaacttatcaaaactaaaaccattcaaaatattgggtgaattaaagtttcgattgtttcaaaacgtctgtataagtatgacaaagagacatcaaaattcagattattgtcacatttttatcaccgtaaaatcttagaagaaagaaagataattttttttttttttttttaatgataatcaaagatattatgttagtagtaaaatagagaatggaaaaaataaattaattacatagacaaacgtgtaggtcataaaatcatttggtacatcaaattcatacatgggtcttctggtattatctattaacagctttaggaaagaaatatgagatcagatttttaggctaatcaaacaaaattttctataaaaccatcatatacataacaaatatgcacaagaagtgcataagaagaaagaaatcaaacagaaatgcaaacaaactagatatgatgattggtgatatatatatcttgaaattgtttctatccgcaaaaaagcaaacgctccaatcaacatgttttgccagcttgctaggtctctctataaatattggttccttctcttaacatcattttttcttctctcgagtgttgttaaagtttttgtatagtttgctatttttcgtgaatcaataaaaagagctttgttgaacaaattagctatctccatggaccgaccaaagaaacgggacgtactacgagcggtgaattcgatgagctctctatgcgagaatggcaaaaaaaaggaaggaattcgagcagtaaactcgatgtgctcgatatccgaactgacggatgaagacctactgtctcggctgcttgaccgtccaagactcaaacttgaacggaaaatatcatacgaggaa

SEQ ID NO: 14292 - DNA, 3000 bp, Unknown
  misc_feature (1)..( 3000): cDNA_ID_2729868_gDNA_ID_2684103_Annot_ID_137082 3000 nt of promoter + ATG
atatgtctgagtctggttgcggtcttgcagaaatttaaaccatgtgttttagatcaaatatgattcattccaactaaatgtattcagatttagatggtgctctcgagaaattgttcgatcattagaagaaactaaatcatttagatgcgaggatactcactaacttgagacttgagtaaaagtgttctaaattttccttttgaaaagtaccagaagattgtatattataatcttttttgtcaaaatcgcaaattctaaagcaaacctttaaagttgttgatttcgtaatgcaaaactcaaacgcaattgcaagcactttaattgatcaaatcaaagctgaacaacgagatccgtttgctacgttgtcactacttttaaagttcaagcaagtcaatacaagaagaaaaaagttaacagaaatttttgattaagcaaagtatttacgatgctctctgcatatattatataaagcacattaaaatcgaatatatatttgagcttgaccattacgcaatatattctcactagctttctttcttcgtttgtcatgagattcattgtccccaagaaaaaatgacatgtgatgtgttacaaaaccttaagacaagtggcatggacggctcccgagtctaatttcgagcttcttcaatttaatcatgtgttttcgtaaaaatcattagaagattctttctcatctgaagaatcaatcatttatgaattatgcataaactatataggttcagccagggtgttttcgaaaagctatactcgaataaggtgtggaactgtggactaaaaaaacacacgatacggtagtccgatccaaataattgcaattcgttgagttatagcctattctaatacattttgcagctagtaataatataatataataaaactttttcataagttagtgacaccaaaaagccaaacgtgacgaagctgataaggataagtagatgataactgataaagataggagttgtatagaggaaaaaatatttgatgcttaacgccattgattattacatttttggcatgctagtggtccctacaccttttagttttctcatataagatcatttttcttaataaaaaaactttttataaaatatatacattgagcctaacaaaataatatcagcaagttaaattcttcttccgaaataacaaattctagttgaaattcgatttattctttgttacaatttgtttctcagacgtcgggctttattgtccgtaacttgcatgtgggactggccaagtgatcagtgcctaaaatactcaatttcgagttaagcctaaaatacccaatttcgagtaagcctgctcaaacctatcaaccttaattcatttgataatagtgttattttccaactacctctatttgcaacattaatacaccttgtaaatgttagaggtcaaagacgacgaatctctttccatatcaacgtttaaaaaaaaaaaacactgttcgcaaaaatcatgggaccgttggttgtcatttgtcaaacgtcaaagcctgggaccattacatttgtcattaaactttggaatatacgagcttattagtgatataacatgataataaccccattttcttaacttatatgccttaatcaaatgcttaaatgactcaactaataatttttgtagtgtttcatcctgattacaaagtttataaaagactacaatttcatccaaaaaatctctagcatttactaattaatatgtaccaaatcccataacaaatacagctttttgttttcccattttttgtctaacatttatcaggtgccaatttatctacttacacaactgtactactcatctttatcaccaatatattcttccataatagaacaatctctctgtaaagcaaggaatcaagagtttacttcataaaatttgagtcccaaaaaaggattaaatgcaaattacatttacgtaattacgtattgttttcaggtagacgaattaaaaaccccactaataaaagggcacacggctggtggccccaccattatcaccactcataacattttgtcccacgcgccttcgcactattttaacttacacgcttgccctccccactcgctacgacatgaatgatctcacccgccaagcaggcgcgtgtaaacaattattcatacaacgttgtaaaattactagcaaaccaattatattaagtagttttgttacaaaagaaacaaattaaaaaaattatgtgtgtaagaattctgacctgttgttattagtaattgactaattgtagattggaagaatatttgttcaggaaagttatttaaactgtggttaatttcttactgtttctggatactattatcctttgacttcttaattagttatgaaccttcactttcaaggttctacaaaatctaaagttactacaaaagcacagatttatctcaattattagaaaaaattaatcagggtaaattgaagagtaagtttttttcgattcttctagggtaaacaaaaaacaaataaagaggaattaattggacccataattcaaaaaccccacgattctcaaccaatagccactcctgcatctatctctctccttgtgaatgtgaacacaaaaggacaagaagagaaagttgagagttttcttttgattttcgcttgtctggattcgaaccgaatcgccattgttgttgttaccaatattcttctctcttcgtcttcttttgtctgaaaaaaatccaaacattatttcagtttctccattggaaaagcgcaacaaaacatccatccacgagtgtttcctcgtttccttgacacatgtttttcgcatcattcattcattcttcatcattttaaactaaaagaaacgaaactgacctaccaagcaaagttcctctacttgcttcatcttcattcgtcatgatttccctctttttttactttaccaatttcttgaattcttaaacccaaagacaaagcctttcgatttcctatagatactttcagatg

SEQ ID NO: 14293 - DNA, 3000 bp, Unknown
  misc_feature (1)..( 3000): cDNA_ID_2729850_gDNA_ID_2684103_Annot_ID_137087 3000 nt of promoter + ATG
aatatcagctgagacgataatctctccaaattcaatctcagagcaatcatcagttcataagcaagtcacacaagcggttctcgagaaagataatgatggatctttcaaagtgaaagttgtgaagcagattctttggattgaaggagttcgatatgaactccgtgagttgtatggctcgaccactcaaggtgcagcctcgggcttagatgagagtggttcgggtacagaatgtgttatctgcatgactgaggctaaggacacggccgtgctgccttgcagacatttggtaacactttctcaatcttttgcttgtggtttcacaattatcatttcattttccaaaccttatcgagatctctgcctgatagctgataataccaacatgaactgtcatataaacttccaaagttatgcattttctttgatagacagttgttgttttcgatcagatccaaccatcaaggtctatagatcactttagaattagtttcaagaaaagaactttgtagttgctttattcaaacgtcttataataatgctgtatgtccttctttgcagtgcatgtgtagcgactgtgctaaagaattgaggcttcagtccaacaaatgtccgatttgtcgacaacccatcgaagagctcttagagatcaaaatgaacagtagtgatgaacaacactagtacaaaaaaggttctttctttacataaaacaccattcttgattctttcttcatttttctctgaaaccctccatatctgaatctgtatttccgctatcattgttgtgcaacttccttcattccgcatatagatttgtttgatctaatgctttgtatttgcaagatataagcatcatcagtacatgtatagataacttcctaacactctcaccaaactacttaatgtttgtaattgaatgcttttgttggtttgcttaagcacaaggatcctatgttgtggtccaagtctctcatagtatccaaacaatttattcacaagatctagatattaacatttgcagagttgctacggccatattatttaccatttatctctcaccagaaagttagaaattattagagaacttgaagaatttggtatttgcagagatataagtaaaagaaaagagagaaaaagaggagaagttgaagaagaagaagaatcatttttctgcctttttgcctattaggctatataagtttaaaacatcaattgaagaaaaagctgcccgaggaaaaagaatgtttcccactgaggtttagcttaaaagaaaccacaaaaggtccttttaaaattaaaaattcgattttttttcttttgacagaatggtcaaacttttgagttaagaaaagtcttaatatgatctgttattatgaaaaacagttttcatggtggatttttttttttttttttcctggttgattgcttgaggacaaaattatgtctatttagcttagttttatagctgaaaattcaatttagttaaagatcatttaattgactaaaagtgaaatgatatcaacggtgacgtcgaagagaataattaccttttaaaggccaaaacgtacaataatgcactttccgaaaatatgaagatgaaaacgaatccaaagggaaaagatggtaacacgacaaaaagcttgaggaattaatgtcattttgtgaagaagaagaagaagaagaagaagaagaagaagaagaagaagaagaagaagaagaagaagaagaagaagaagaagaagaagaagaagaagaagaagaagaaggagagccatgtcatatgcagagacactcatgtgaccaacagctatcgaattaggcaaaacctcaacgacaaaaatgaattattcatctcaccatgccacatttttttaacctatcaattgctttttttaaaaacaattatacagatctttttgttcggaactttcccaaatgtgtagattatgcttcttaatattcattttctctatcaataattggacaaccgtcatatcaaatctgtgttagaagtcataattttcaatttctattatttgcttagatcatctagttaagaatgtgattaattataaaattagccatgcttcatttaaataaacaataaattgtccttcaccaagagaaccctttttccatgttgtcaaaaacgcttcaccaagaaaaccattacattattttttcccaaagaaaaccgttatcatatttaaaatataattaacttgattatatctcacttttaagaatttcggtttcatgcttgattaggctttatcaacaacaagcgatgatagtaaatgcctcgatgaacaatgaaatcgtgaaaaaattgtattaattaaatgcaattggaaaacaaatagtattattattaaaacaggggaaacttaagagagatctggccgaaaacgtgattatgttcactatataaattatgaaatactatacgagaggccttcatcattaaaaagattcataaaaacgagccccacaccactcttttttttcttgttcttctaatgctaatctttttgttgaatttattacaaaaaatattgtctaaagtctaggcaaggaaataagatactattgctcactcctttctggctaataaattgaagcagcgactttacttctctctctctctctttctctctgactctgaaaaagatgaagtggagaagttaatgttcaccaacttaatactgcaaagtcgaaatctttctttcttcttctttgccttctttcaagtgctttccctctctcattctccttcttcctcctctgtttctttgttgttctaaacttaaaaaaaggtatcttcctcagttacagcatatatgtctatgtaatggtgtgttctcttctttgcgtctttgaatgtgataaacataacaatttgtgggttattatgttgtccagattgaagttgcaagtaacagaggagctgtctcagatctggttctaaagcgagagaaagagattttgagttgaggaaaaatg

SEQ ID NO: 14294 - DNA, 3000 bp, Unknown
  misc_feature (1)..( 3000): cDNA_ID_2729846_gDNA_ID_2684103_Annot_ID_137088 3000 nt of promoter + ATG
ttgttcgattcaaagcttcgttcagccatggagattcaatgcttactctgttcgaatcagtccttctccgtcgccgtttatgtcaacgaaacccaatctagtatcagagaaacctcaccgccaaaatctcaccttgatgatggctccacgaaatctggttccgaagaagacgaatctcacttcaaactcgacccgggtccagttcgagtggataaccgctggatctcagaagaatttcacggcgaatttgatgagaggttggttggctccgggaggagcgccgtgtagagaagcgaagaccgtcgagatttcagttcccggtgtcgacgggattgattctgtggagttaaccgccggagagattcatgaattcaaatttcaagccatagacgaatctggaaaaaacgtttgcattggtggggactatttcgagactgatatatccggcgagaactggaaatcgagaccaccggtgaaagatttcggcaacggaacttactctttctctttacaggttcatcctgagttcgccggagatttcaatctcaccgtcattttactcttccgtcattaccaaggtcttaagtttagtacctcacgtttaggctttgaccgaaagcttcgcaatgttagattacgctttgttaagacgcctgacgttactctgccggagctccggtcatgtaaaaaatctgattttaacagagatgcttggtctggacgatggactaggcttgggaagaatgatgagtgtcagattagcaatgacgggcgttaccgctgcctcgctgcggatttcccttgccggaaaccgtggtgcgacggtgcggttggagctatagagagtaatggttgggtttactctagccattgctctttcaagctcttctctgcggaaaaggcttgggattgcttgaaaggcaaatggattttcttctggggagattcgaatcatgttgattcgatcagaaacttgctgaatttcgtcttgggtcatcctgaaatccccgctgtcccgaggaggttcgatatgaagttttcgaatccgaagaacccttcggagactgttaggatcacgagtatctttaacggtcattggaacgagaccaagaactatcagggccttgattcgcttaaagacagggactttagagaattgctcaagaagtacttcaacgaagaaacaaaccgtgttcccgacgtgatgatcgtgaactcgggtctacacgacgggattcactggactagtcttagagcctttgcgaaaggtgctgaaaccgcagctgcgttttggagagaagtttttgacggggtcaaaagcagaggattgcaaccgccagaagtgattttcaggaacacaatcgcgacaggcgggtacgcgagaatgctagcgtttaacccgagcaaaatggaggcgtttaacggagtgtttctcgagaaaatgagggatgcgggattggtcacgagcgtagttgataacttcgatatgacgtatccgtggcactacgataaccgttgcaacgatggagttcattacggaagagctccagcgaaaatgcggtggagggacggtgagattggacatcagtactttgtggacttgatgctcgttcacgtattgctgaatgcattgtgtgtaagatagatgtggtaaagtttggtaattaggaagagtcacggattctttgtttatgtgtagacttaatttttttgaagtatagattattattatttgggaaaactcaactcaagcttgagttatattgtataatagcaagagattggagcaacaatagtgtactatatgtatctggttgacatttttctgataatgataattttgaattcttggatgataaataagtacaagtttaaaattttggctcaactcagcttctctctgtttcattcctctgttctaatttcttaatcctctacatacggtaatttggctgattgagaatttgggtttcatataatcatctccatggattctgaaagcaatattctataggagaaagggtaaaagaatagaccaaatatttaaggcagtgtcttaaggaacataatgccacaattgggtcagatgaataatctttatcattgtaaagcctaatattaagaagaaaaaggagataattggaaaccaaaagggagattaaagtttacatacttcataatggtgaaagttcaagcaaagtgtgtgtagattatgactatattattgttttgttttaacaaaaaaaatgatatattcttgatatcttttggaagtagcaagcgaggtatatgatcaacttgataaatagaaataacgaagtatttgtcggcgtcacacataccaaattttccttcaccacatgaatataattatctcttagatttgctggtttattatgtgaagcatgttttttgaataaacagatcatattatcaattgagacttgaaaatatttaaaatgcatagctccatttggtttttgtttttatcgtaaattaaatttatgagtcgaaaactagactagttttttgagacgcacgctattgataattcaatttggtctctttttttttcatcaattcataattcaatttggtcttgactcttgatcaacatgatgaatcactaaaacaaggacgacattccactatccggtttaatctggttaagatatttttgactcctttctatatggtgtaaataatctacaaacaaatttatttccaaatctttgtggatcttcaacatagtttttttttgtaccaagcaatttataacaattgtggtttaagaacattggttgaggtttggtttggtgtacaatcatcactggtaaaccgaaattgacttcttctttttccatttttcttttagaaaattcatagtattaaagtacaatattcctcttgcatttactatttggcacacatatatacaaaatccagtatcccactcttgtgagccagccatcaaaagaagaaagagagagagaaaaaatg

SEQ ID NO: 14295 - DNA, 3000 bp, Unknown
  misc_feature (1)..( 3000): cDNA_ID_3610931_gDNA_ID_2684103_Annot_ID_137091 3000 nt of promoter + ATG
ttcagtgaggagaaaaacgctttctcaattatgaactctgcatctttgtcactgattcttctcacctgatctgttgcagatatttggtcaaagagtttattaaaagataacataatataaagtgaaaaagcaatgctgctttctctcattggttgtgcatagagcaaggacagagaaaaacaggttcgtacgtaagaaacacacattaactgtgttctgcttcctttgtattctctcacttttctcttttttcagaattcaatctctggaaattttcttcctaaagattaaagagaaccgtttggaccagatcagcttgcctcttggtaatggtctctcttctctttgttcccaatttctgtagctttcttctttctccctaactcgtctgctctctttgtctcttcctctcacagttcatacgtcttccatggcttccggtgatgttcttcctagattcttcactgtcttcctctcccattgcagctccgaatccatggtgagatttttctctggaatatttcatggaaaaagctgcttgggttgatatgtttcttggatacagtaacgatgtgaatgagatctgcaacattatcttaattcttaactctatatgtttaaatctcttgacactgacaaaagttttaactttcttcactaatgagctcaggattatctctgtttgtgttacttatgtttgaatatgatagagtatgtcaaactaaacactgaatttcctcaaagagttttctcctttgttgaaaaaattgaacaagaggtcttggtcttgttgtttgtctgtttacctccgcttgcagacagagtctttagcttatattttgctcacttttaacagtttagtttatgctacatctttgtgttgagcaggtgataccaaggtcttactacaatcttttaccacgtccgttgcccaagactgcgattctcatcggaactggtggaagattttggaaagtagcaatgacgagcaagcaagagcaagtgtattttgaacaaggctggggaaatttcgttgctgataaccagttaaaagagggagaattcttaacttttgtgtttgatgggcacaaaagttatgaagtaagtatctatggtcgtggagattgcaaagagactcgagcagtcattcaagttgaagagatctctgatgatacagaagatgacaacgtttctcttcatagccctagcaatgtttcacttgatagccttagcaacgattctcatcatagcactagcaacgtttctcttcgaagccttagcaacgattctcttcatggtgatgctgagatagagagcgacagtgagtattctcccgagaacctaccctcagcctctatatctgttgaatccgttgaggtggtgaatccaacaacaagcaggcagagaagttgtaagtaaacattgttcttttaactgatgcttataaccgaagctgtttagaatttgatctcaaatgggaattttgcagacaagaggaagaccattgagaatccacatctgtatttggatgatccaaacaatgtctgttttgagacgtgtcttaagcttagaaagtttgagctggtaagacttcattagatattattatctcgtctcattaaaaatcctttcacgagttgatgattatttttctaactaaagctctatatacattatgcacagttagttcatgcacagttggtgaaagactacggcttgatattcagcgacaatgttgactatattgacggatatggaaaactaaccgcgaaaacgaccaagtgggcagatcaacgggtttgcataaacaaatggcagaaaatatgcgagagaaaccagttcacagagaatgactccatcctatgtgaaattctccgcaacgaggacaaagtggtttatgcaatcaagattcacatcttccgcgatgcagcagcaagcacttgattctctgatgcagttctgcaattgtgtttcttctctttcgagtctagtcttttgtagtaaactattagaatgtctaatttcaaaacatgtttaagacttttgagttctcttgtagactttgaagtaaacacaatgaggagcaggcttaagcttacccgttaatcactctgtttctcttacaagttacaatcatgtaaaatgggttagaatgatcgttttaatatgttaggtacagatttcgtaatttctcgaaaatgtgatatctcttcttcacaacagaagaacagattattgtgaaagtcaaaacaaaaaaaaatctctgaaacaatggcgtgttgcttagcttcgtgctgtgcgtcggcgacttgtggattatgctcgtcggtagcatcggggatatcgaggaaatcagcgaggatcgcttattgtggtctcttcggtgcctctcttgtcgtctcctggattcttcgtgagactggtgctccgctcctcgagaaactcccttgtacgattctctcatccttttctgaactgggtttgtgaaaaaggaggttccttttagccgagattgatgattggaattgaaagagaccatcaaatttcgaaattgggttttctttgatcttgtcaattggaattgaatccggtggttaacgatagatttgggtgatgtcttgtgcttgaatcttactaagcgtttaagtatgaatcttaatttgtattggttcagtggaaatttggttgctttgtagctgcaacagattgataattgtgtactagaactttagaaatctcaatctgtgttgatttggatgtttttcaactttcaattgcgtttgtttatgctttgtgttaacctgcttgatctaagagagaattttgagtgttgcaaaaggaaacttcatcgcctattgatacaaatctccggttttggatgttgtttgacaaacagggatcaatacttctgattcatataccaaagaatggtatcagcaacaagctgttcttcgtgtgagctttgggaatttcctcttctttgcaatatatgctttgatc

SEQ ID NO: 14296 - DNA, 3000 bp, Unknown
  misc_feature (1)..( 3000): cDNA_ID_2729831_gDNA_ID_2684103_Annot_ID_137093 3000 nt of promoter + ATG
tcaaactcattataataagcggatattgaagtcagcattttcttgttcacataggtcatggaattactggaaattaagagttgacgtaatgcactagaataatgtatgaactaatcgtaaattaaaatatttcttgagaggaacttgattatggtttatggtgatgacttgcttccggcataactctttctgtgtcaagctctaaggcagtaaggcttatatttgggtcaacatcattatcaccatatcaatttacttactggttttagaaattggatacaataaacatgttccgagattgttggaactcagccgccatcttgaaaagttagatgatacttaaattattatgaacaatgctccataaacatttataaagtaacaaaattcaaaatgcgagtatgaatcacatactgtatgatgataacataatccatgtagctatgtataaagatacgatgcttaatcaaaagggttctctgtagtcaggggccaggattcatctaaatctttggttggaatgggttgccgcacataccgataataaaattgtctcggtcttcgatggatccgtgtctggagacagcaagccaatatgttgttacagacaatggcatctgcaagaaaccatcatgaaaacgttaacaattacagaaaaatgtgcattccgtatacccgcaattcccaaaacatagttcccaaacttacagactatacaatacaagcctatgaacttttgcaagaaactccctcagcaaagcagctacctttcttccttatacttggaagtgttttcaaggattcaagacatattgaaacatgcctaatcaactaatttagccaggtggttatctagattctctaacaaatgatgtcattgcgacagcatatcattatgaaaacccataaaaacttagtactagtgcatcgaactttccaaagcttattgctcaattgaatctaagcaagtcaaggtttttctatcaatcagacactggaaagtggagtgctttaaagcaagcaagcaagtagagtacctctgcacatcaaatcctgacaatcctttgatgaactttagatttctcagcatcgataatcgattccacgcggttaaccgcatcatcaagcctccctttggcattcaccacaacgtaatcaaagttctttagatgcctaacctcttctctcgccgtagcaactctaacaagcaactcctcttgactctccgtcttccgatcaatcaacctctccaccatagcaagctcactctccgccacaaggaatataaacacagcagagttaccaagtatcctccttaacgtctgagctccttgaatatcaactctaagaacaatgtcttcccctttggccataaattcctgaatctgcttctttggaatccctttgtattctccataaacaagtgcgtattcaagaagctcttcgttctccaccattgacaagaactgatctctcgagacaaagaaatagtctttaccatcaacttcaccaggtcgcatcggacgactagtggcggtaacaacaaaatgaagaccttcacgaacctcacgaagcttgttgatcactgcgtctttaccaactccgcttggaccgctaataacgatgacgatctgattcggcggcgggatgattggatcggcggtgaaagaagaacccaattgaaattcgagggaacgaagcgactcgggtttggtgggagattggataggggacgaattagggtttcctgggatatgggtatcggtcattttcaaggaggagtacgagagagcagaagagtgacggagtggttgaggaaaagagcgggggatgaagatgggtttgttggggaagatgatggagcgagagaatgaagaacagagcttgcgaatcatttgaggagtaaagtagcaacctttgggattcccaaagaagtttggtggagtggattgggtcactcgagccaccgatgctttgccgcgattttgacctgtatcttcgcttaagagcttagcacgatatcaactagggtttacttgttcaaaattccttttggtagatattagcctaatatatacacaaaatattcgatttatgatgaaatttgcacagaataatctatatttagcagcataatatttttcgattagccatctatttattaaatactcgattagcctaatgattttttttgacataagttaaaattgactcatgttttaaaaataaaacacatgtaattttgtattggtaaatacaattcgacttgagattcgattacaaaactgttaaaaagataaataaaaaaagaatgaaaaaacttaaaaaggtaaaaaaaattgtatctctttatttgatgtattgttctattttactggttggtcataataaaatcgaataacacttgaacttattttatgcgctaatttatgtattattattattttgtaggtaaacacaaatcttaattgtgagaaatttcagattatgatttgcaaagagagtaaagaaaatattatcagtttaatctccttcctaaaaataaacaaacaaatatttgctgctaaacacaattagaaaggagatgtaataattttagtatttcttaagttgcgacgttatatattcgcaacctaccaaactgttgtgtttaaaacttaaaccgatctatcaagcaagtggttcctctctctctctacctctcgtttttggccaacgtcgtcgtcttcacgatccacgacgattcagttcttgagttccggcgattatcggtctctcacttctggttccgttgaacccctcatttctcttctcgcccgtgctctcaaattccgatatttgcccctgtgattcgaaaccctaatttcgcctatcaatctggaaaatctctcaattcgaagactttagcagcgcaaagatactctatccgggtaataagatcgaagaaaccatcaatttcttaccaaagtcgtgattcttggatctcgtctttgtttgatg

SEQ ID NO: 14297 - DNA, 3000 bp, Unknown
  misc_feature (1)..( 3000): cDNA_ID_2729823_gDNA_ID_2684103_Annot_ID_137095 3000 nt of promoter + ATG
aatttctcacaattaagatttgtgtttacctacaaaataataataatacataaattagcgcataaaataagttcaagtgttattcgattttattatgaccaaccagtaaaatagaacaatacatcaaataaagagatacaattttttttacctttttaagttttttcattctttttttatttatctttttaacagttttgtaatcgaatctcaagtcgaattgtatttaccaatacaaaattacatgtgttttatttttaaaacatgagtcaattttaacttatgtcaaaaaaaatcattaggctaatcgagtatttaataaatagatggctaatcgaaaaatattatgctgctaaatatagattattctgtgcaaatttcatcataaatcgaatattttgtgtatatattaggctaatatctaccaaaaggaattttgaacaagtaaaccctagttgatatcgtgctaagctcttaagcgaagatacaggtcaaaatcgcggcaaagcatcggtggctcgagtgacccaatccactccaccaaacttctttgggaatcccaaaggttgctactttactcctcaaatgattcgcaagctctgttcttcattctctcgctccatcatcttccccaacaaacccatcttcatcccccgctcttttcctcaaccactccgtcactcttctgctctctcgtactcctccttgaaaatgaccgatacccatatcccaggaaaccctaattcgtcccctatccaatctcccaccaaacccgagtcgcttcgttccctcgaatttcaattgggttcttctttcaccgccgatccaatcatcccgccgccgaatcagatcgtcatcgttattagcggtccaagcggagttggtaaagacgcagtgatcaacaagcttcgtgaggttcgtgaaggtcttcattttgttgttaccgccactagtcgtccgatgcgacctggtgaagttgatggtaaagactatttctttgtctcgagagatcagttcttgtcaatggtggagaacgaagagcttcttgaatacgcacttgtttatggagaatacaaagggattccaaagaagcagattcaggaatttatggccaaaggggaagacattgttcttagagttgatattcaaggagctcagacgttaaggaggatacttggtaactctgctgtgtttatattccttgtggcggagagtgagcttgctatggtggagaggttgattgatcggaagacggagagtcaagaggagttgcttgttagagttgctacggcgagagaagaggttaggcatctaaagaactttgattacgttgtggtgaatgccaaagggaggcttgatgatgcggttaaccgcgtggaatcgattatcgatgctgagaaatctaaagttcatcaaaggattgtcaggatttgatgtgcagaggtactctacttgcttgcttgctttaaagcactccactttccagtgtctgattgatagaaaaaccttgacttgcttagattcaattgagcaataagctttggaaagttcgatgcactagtactaagtttttatgggttttcataatgatatgctgtcgcaatgacatcatttgttagagaatctagataaccacctggctaaattagttgattaggcatgtttcaatatgtcttgaatccttgaaaacacttccaagtataaggaagaaaggtagctgctttgctgagggagtttcttgcaaaagttcataggcttgtattgtatagtctgtaagtttgggaactatgttttgggaattgcgggtatacggaatgcacatttttctgtaattgttaacgttttcatgatggtttcttgcagatgccattgtctgtaacaacatattggcttgctgtctccagacacggatccatcgaagaccgagacaattttattatcggtatgtgcggcaacccattccaaccaaagatttagatgaatcctggcccctgactacagagaacccttttgattaagcatcgtatctttatacatagctacatggattatgttatcatcatacagtatgtgattcatactcgcattttgaattttgttactttataaatgtttatggagcattgttcataataatttaagtatcatctaacttttcaagatggcggctgagttccaacaatctcggaacatgtttattgtatccaatttctaaaaccagtaagtaaattgatatggtgataatgatgttgacccaaatataagccttactgccttagagcttgacacagaaagagttatgccggaagcaagtcatcaccataaaccataatcaagttcctctcaagaaatattttaatttacgattagttcatacattattctagtgcattacgtcaactcttaatttccagtaattccatgacctatgtgaacaagaaaatgctgacttcaatatccgcttattataatgagtttgacgtatcttatgatgttaatcaataattgctaaccgaattttagattaataattttataaaatagctttttgttttgcttgtttaggacaatcaatttaaggtttggtttgtacgtgacacaaggcaacataaagggtttaggggcggcttttctagaacacaagtcaagcaacaggcctctcataaagtcaatgacagaaaattttcttcttgataattatttacaaggaagatcgtcttcttaatataatgattggatgaagaaaataacaccttttttattattgtttgacagaaaataaaacaggaatttgaagttacactttcttgcactcttccttttcgatttttgcctcattgttgtcttcttctccactctttgcctttcttaagtcttgctgtctcttatacacacaaatagatgcaacatatatatataatcatgatgccttttctcatttgtatccatcatcaacgaaatcctaattaataacgaaaaggagaattctcgtaaggtata

SEQ ID NO: 14298 - DNA, 3000 bp, Unknown
  misc_feature (1)..( 3000): cDNA_ID_3033327_gDNA_ID_2684103_Annot_ID_190324 3000 nt of promoter + ATG
tgctataacggtgacaaaaattgttttttctctagagtagtgaacagaatcatacagattttatttttatttgttaaggtttgctaggcatagaaaaatttggggtgaatgatgtaaatcttttttacctgcagctgtacaattccgcacaaagaagctgcattgcaatgttgtgatgaagttgatccattggcaaaggtctgatttgctaaaaacagcagataattttgttcgcaaccccaatcactatcagatagcataaatagccatcctgcttcaacctgaatgtttacttttaatatcatacagtctataggagctgtgaacactatactaaggagaaaaagtgacggaaagttgttgggttacaacacagattgtattggttccatttctgctattgaggatggcctacgaagtaagtctatgttcacagctttttgctccatttggagaagtttcggttttagtcatggagccttctcctctgtttgttttttcaggttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacggtaaaatacatgtccttaattggaaatttcgctttgtgaacaccttagattattctattaccggtcatgctcgaccttgacaatactcttcttctcctcgtcttttattggttataatgttagatgtagtaactgatgatatgatttgttttgttcctgatgttgtgtttctaaagaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggtaagctctccttgtaacagctcatccttttgttttctataggtaacgaaggaactgttctatcctttttctgttattgaaataccaaaagccagcttatcgcatgcaaactttgttgaaatcttaaatctataagacaaattagtaagctagcttgtctttgtttcccccaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccggtaagtgacactaatactggaacaaaaccatgtgttgtattaaaatttaaacaaaagaagcctacttaatggtggtccctttgttgtgcagctccaaaggaactctactggcaaataatgtcaaagtactgagacatagcttaagtgtgtgtgtgtgtacttccatgaaaagtcgtcgattcaataaagctttagattgccatttgtatgttccgagaatgtccttttttgaggccataagccgaatgactggttctctctttgtatttatatatatgtataaactattaagcctaacattaatcttttttaagtttctttgatttgatgagtctactataaaaaagaagggttaagttgcatactagtcactttttaaaacttaattggaaaagtagtcactttactattcataatttgtaaaatagtcatttttcactgtttgattcgtacacttagtttgtacactatttttagtgtacagatgtatataaaaaatacacagcgtacactttacatttgcacactaaaagtgatgtacaatccaagtgtacgaatcaaaccgtgaaaaatgactactttgcaaattatgaatagtaaagtcactactttcctaattaagtttgaaaaagtgactattttgccaacacacccaaaaaagaactacaccaactatgactcggtgttctaaatactgttcttctgtaatgaaagcttgatttgaaactcaaaattgaaaatttcgtaaatttcgtaatttgatattattagaaaaccgaaagaaaacgcatcggatttcgagatttattaatttcgcacgaacgaattatttgattcccgccaaagcaaatagagcaaatataggaattacagtttaacccgccaaattgaaaatggattataaaatctcacaaaagaactttcggttcagttttctctgtcttattttcgcgggcagctcacatttctctccaccgtctcctcgtcttctctcaccaaagtaagcttttttcttcttttttttctttcagtttcatgtttccattattgattgattcaaaatctcaaccagcaaagaattaaaaaatgattcagaactgattctcaaccatagcgtttattgctctctctctatccacattcacatcacatgggcttcgtttctttgtacttcactttccattttgattttttctttcccaacttgaatttgatttgatgatgattcgtttagaatactctgcgtcatacggaggagtcttaattctaactaaaattgaaggtttgatatgcaattactttaaaatacgtcatcttttctaattaaccccaaagttgattaaatttactaaaatcatcaaaagaagaaattagatggcatttagtttcacattacaggcgtcgtgaactttagtcggattcattcctctccggtgagtttctgtaatttctctcactctccaattgagttacctcctatttcataattattcctctgatcgtataaaggttttaatttggagaatccaccctcctctgttttatccgctccacaattcgccgccggttttgtctctgctgttcgaattctcgattctccgatgagttcttcaactgttttgttttgttgagctccttacttttaggtttctttctcatttgctttaattacttccgaccaaaatg

SEQ ID NO: 14299 - DNA, 3000 bp, Unknown
  misc_feature (1)..( 3000): cDNA_ID_3015858_gDNA_ID_2684103_Annot_ID_190321 3000 nt of promoter + ATG
ttttttttatccacttatatcaataattaaatatacgtatgttgttgtcactctactcttttattactggtctttacttctgtcttcatttattaataagattctttaattttccattatctactaattaacaaaaaaaatcgacaaaggaaaaatacgaatcatattcttgtcgttgattttcgatgatgatttgatgacgatgaaaattcaacgttacgagtttcagaccctcatgttcttgtcgattgccgtcactttccaggaaacatatcattatcccttacttcttacgcatttaaattaactactgttttttctttctaactatattatgtgattttctatgtatagttttaccaacaacaaaaaaagaagaaatttaaaggaagctcacctttccaaaatacttgaaagtgagaaagaaagaaaaagctacttttgaaaaaaaaaactttaaatttaggttgatgaactttataagcggctttatctatctactaaacaaataatcgagtttttaattcatgaccagaatttcttgtataaactaactactcgtcttatctcccacgtaatagaccaccagggtgctatgattataccattccaaagaaacccataatgcactttggtgggttgtgtagatttatatatggtattaagttaatgatatgttttatgaaaaaaaagagagttaatgatatgttaattaagtgggttttgtttatatagttgttgtgtacatttatctcaaatattcaaacatacatatatgatgttttgtacaaaccttttttaaacgcatttatttaaagagcactaaaacatttgttaatacaacatttggcaaaccctgtagaatctcttaaacaaaattacaacttttgcttaatcaaatttgtagttctacacgaaccaattcataggacatgatttataaatcaacatcgcatataacatctatctatgttttcttatatgaaaatttagtagccgtttgtttatgcagcgcgtattctaacagtttgttgttatcgcaatatattttatatttgtatgtacctatatatagtaataaacaagtttgaatgcagtgaaatgcgatgcacatctcccaaaagagcttgtctcgaacactcgacaatcatcgtcatcgtaatagaatccacacggtgctccggagaacttatagctcatgttggattctatgtttcttctgcaacatgtaagctgtaacaagacaagtttgtctccatcgttaaagcaaaagataatggaaatttataactttccatttgtgtttagtcattctacactgaaattaatgtgtttgacaagtaaattagttcaacgattagtatggtcgaacctcgtaggatggagcatcgtgtcccactcctatcactatcaattaccaaacacaatgggaaagtagacactggtcaaagtatcatatgtcaaaaacatcatcatataactaccaacccaagagaagtgtgtgttcattgaatcttcttaaatggaataaaaattcgatttgatatcaaagatttggcttactcatctctactcaaagtcatgctttacataaatatggtgggtcgatctaggctatctaattaaagccaatttttagctttccttgggaagaccaaacaattgagagatggttaagttttgtagaaaaagacaaagatctccaattgttaggcttttgtttggttcttcttttaggcaaaccataagagtggttagctcgtcgggtaagaaacttatagtatctatcgtgctcgctacatatcgcttgctgatcaatctaacttgtgatcagttttcaagtacctagattagatgaacgcatgagtaattcgatttaacactcacagtacattcatttggaaatcaacaagggtgtcgaaattgatcacaatacaatcaatctgcacttaagttttagagaatcctacaaagagtttcgatagaactctaaattgaaacgtttatttgatctatgatagccataacaggcaaaagcaagcttcttttgtcttatcacttcattttctgctctgtaaagaggacatggcgattaactcgaggatcgtacttacggaactcgagcttctcaagaagtcccttggtactcttcctcttgacatagaagaatccagttccagctgctgaaactagacggatgaacatgaacgtcttcttcctcttgtctcccatttctttatcaagaatgacatcacattacattaccattcttttcattacagataactaaaatcctccgaactgatgaaacagaggtcacaaaacgtataaagtttccatttttttatagctataattcgaaaatgcacaaactttagaaatggatttgtttctaaatcatatgggacaatgacttttctttgaaatctatgaacctagagattcgaaaatcaagcggaaaacagatctaaaacctagaatccagcaaagaaatctcagttcgagaacaaactacaacaagacgaacacgatacaagcaaagaaatgaaaaattagcaagaaatgagtcaaaatccaagaagctagaatgattagcgtacctgaaaattcgaattcgacggagtccgaaaattgatttcgccgacgaagatgacgggtgataaaccctacaatgagaaatcgggttttgaatcaaaccaaatgggctattaagttgagcccaatatcagcccagcaaagcgacatcatcaaaacgcagcgtttaattgtcgagagccaatttgcttttgttgttgttcttcatcatcgcttttagttctctcagtggagaagaagactcgagtcatctgcagaaaaggtgagagataatgtttgcaaattttcatttagatttcgaaacttattttctcaaatttctgatggattcaattgatttttcagattcccgatcggattggatcatataagattttagggatttggaaaaaatcttgagctatg

SEQ ID NO: 14300 - DNA, 3000 bp, Unknown
  misc_feature (1)..( 3000): cDNA_ID_3015862_gDNA_ID_2684103_Annot_ID_190319 3000 nt of promoter + ATG
ggtttgttcttgatgaatcaactgattgggattgctcctcgacctcaccggattattctccgcagaagacggagagcgcctacacaaacatgagaaaaggttccaggaaataagtttcaaaagttagtgagaggatagaacaataaattagtataaagatcaaggagcaaagacacaggtatggttcaaatcattatccacaaagagtaaagacaccacaaaatgaaatattttatgacctttttaaaaccaatcaaaaccaacagcgaaaagagaatgagaaacgaaaacattatgacactgacaagaggataaaaagctcacatccaagttcggctagaaagtggctgaaaaccatctaccaagtttccattctcaaaacctgatactggcgattgatttcttcgagaaaaccccatattctggtcaggaagaatatctgaccgactgcaacaaaaattgagaattttatagaccgatattagttacatcaaaaaaaccaggatatcagtaaacaccatggccatgtctatgacatctcattcataccacctaggccacacaacaaactgataaaatctgaaagagtaagatacatgatgcagaacaaggaaggtgtaaactcccacaaggacagatgttaaaaggttaaggataagatagggatacaaaacagacagaatgtttatttcagaaagatcctgctggcataaatgaccttgatctaaaggaaatggcataaacgacctttttctttttgaatcttgtgatcgaccaatctcaacagcatcagttcccattctggaaagaatgtgagatgtagcaggtggagacgtggctcgactatgttcaccatgatctttcaagaaattccttgatccatcgtgcccatattgaggatttaaattaggcctgtgaggaaaaatgaagcaggtaaattcagctaagtcgttaagaaaaatccagcagcttgcttattaaaggctataagccaaatccagcgataatgatctctttagagcttcaaagccgctgccatagtaagcccttatgtattaggcagagaaacttatagcactccgccacactctactttcttcctactgctataatttcaattgcagaaactgaaagcatttgagatgtgtgattaacacagccgcatatgagtaatgacactcttcttagtcaaaatatgtcacgtacacttttacctctgaactccaggaaattggtaaggtctcacagaggggcttgtacgtgaagcttctggaccccatgctattccattgaaaggttctgggatcctgaaaaacatagcatcaaagtgttcttataactttctcggcgtaaaaattagtgcaacatatagaagattcaagcagaagttttacaaaaagaatcaaagccaaagaaaacagaaaatttggtttatcccatcttcactgttttgggttcccgaagatcctttacaggtataaggagtgaaaaaaaaaaaagagagccataatagtaagttatctgacctttgaattccaccaggttggtaaggttgtcctgaggagggtgatggattttgaaaagccgacggagatggtattctattaattggaggaacactgcaagcaaaaaccataataacttaggctagaatctaaagaagaagaaaacccgagagtagactgaaaaattaataattgaataagtaaccaacctaacatcatcattagacacatagaactgaaagagaaaaggaataaaagcaagccatacgattaagaatgtctaacctttgaaccccacctggtcggtaaggtttccctatagagagctgagggttttgagaagccgacagaggtggtgctcgctgaattgaaggaccactacaagccaaagttacgaaagaaaactgagcgaatttacgaaagaaaactacaacaagtagcacaataggctcttcctatggaggctcagaaacaacctaacatactcgcatagaaagaaatcaaagctgtagagctaaggttaatctaaccttcgaattccaccaggtccaaaagattgtcctgcaaaggctgaatggttttgagacgccggtggttgaattgatgaatcactacaagcaaatccaacattcgcagtgtgtaagaataaaaaagaaaggtacaatctaagaacaaaaagcaaagtaaagcaactcgcagcttctcctaaggaagatgaagaagcaaaacccgactgcctaagtgatatagaacacaatatcatagaaaattcaagatacttctctcattctcatgatcctaaacactttaatacaacgatagcatatatgtaaatttgacagttcaaaaaaatctctgagtataatagatccatagcgtgaaatgaatcctaaaaatctcaaaactcgaagaaaagtccgattgaagcatagatacatctatagagaatgaagagcacacctagtggttgaagaagcaccgaacggtgtaaacggcgctggcttagagctcatcggacctaagtccttcccgaaaggcctaaacgccattctctgagaaaattccttgacttgattatcgctgcctctcttctaattctccttcaaccttcgtttaattacgtcgccggctaaagtcgaaaccggagcaaattgaattttctgttctggtgacgcctcttccgtccggcgaggattattttacgtttaaaaccaacgacgtcgtttttatttccgaattttatgttgggccttttaagtaacaataggcttattatgggctttggtcaaggaacaagaataattgttcaaccaagaagaacgtgcgcatgttgtcaccatctcccttgagcctccttgttttaggtagaacatcaacttttcatgaccgttgacattttttttccctctttattttccgagaaaaaataaataaaattatcctctagttttcgatctcgatcatctggatccaagaaattactacgattgctata

SEQ ID NO: 14301 - DNA, 3000 bp, Unknown
  misc_feature (1)..( 3000): cDNA_ID_3015870_gDNA_ID_2684103_Annot_ID_190314 3000 nt of promoter + ATG
tcttactattttacttaacttttggaattacagattttaccagtaccactatatatatgatgagatcgtatgatgttatcagggatttgatcacataaaaatcattattttcttgcatgaaaagcatgcattaatacattttaggggagtttgttacagtattctaattttggtacttccaaaaaggaaaaaaaaaaacccgccgacgcaatcaagtgtaaaaagaaatgacagcaaagcaaattgatcagaccaattttgtcctaaaaataaacaataatttttgtttccaaaaaaaaacataaaccagtttctaagaatctaaagaagaagaaacaaaatctaaaaattcactccgatttcattggacaacagacttgtcttgttcctatttcataggaaatggattttttttggagacaaaattttgtgtgagaaacagtccgaagttcaatctcttccccacatttagactgctaataaaacaagcctctccccaaatcctttattctagcctttccctaacaatggctctattaactaatcaatctttttaatttgtaatgtttaaaccttttttaaaaaaaaattaaaaaaaaaagtgaaaataataataaaagagtttacctgagaattaggttcaggatggcctcaaggagcctctcctatacacaactcctaggcctcctgtcctttatactcctcttggtcacaaccaccactatggcggttcgtgttggagtcattcttcataagccttctgctccaactcttcctgttttcagagaagccccggcttttcgaaacggtgatcaatgcgggactcgtgaggctgatcagattcatatcgccatgactctcgacacaaactacctccgtggcacaatggctgccgttttgtctctccttcaacattccacttgccctgaaaacctctcttttcatttcctgtcccttcctcatttcgaaaacgaccttttcaccagcatcaaatcaacctttccttacctaaacttcaagatttatcagtttgatccaaacctcgtccgcagcaagatatcgaaatccatcaggcaagcccttgatcagcctcttaactacgcaagaatctacctcgcggatatcatccctagcagcgttgacaggatcatctacttagactcagacctcgttgtggtagacgacatagagaagctgtggcatgtggagatggaaggtaaagtggtggctgctcccgagtactgccacgcaaacttcacccattatttcacaagaactttctggtcagacccggtattggtcaaagttcttgaaggaaaacgtccgtgttatttcaacacaggggtgatggttgtggatgtaaacaaatggaggaaaggaatgtatacacagaaggtagaagagtggatgacaattcagaagcagaagaggatataccatttgggatcattacctccgtttctgctgatattcgccggtgatataaaagcggttaatcataggtggaaccagcatggtctaggaggtgataatttcgaaggaagatgtagaacgttgcatccgggaccgataagtcttcttcactggagtggaaaagggaagccatggttaagactagattcaaggaagccttgtatcgttgatcatctatgggcaccgtatgatctgtaccgttcatcaagacattcattagaagagtagagaggcaaaagaaaaaaaccattaaacatggcacatataggagaggagaagatacaaaagaaagcaggggtttttagcgatcaaagagagccaaaaatgtttcattacaaagtgaaaaaaagttgtaatgttaaacacattgttgtgcatttgagctcagagtgtgtttcatcacaagaagagatagatggtattatcatcatcatcattttttttttctcctttcttcggttttgtttccctctctttgattcaaacctttagaatattcctcgtgtaatatacataggtacaaacaaaatggaggattaaattcattctttttataaacagagaatcgaatctaaattgtttacaaatcatcaaaactttatcactaaagaaaaaagatccgacacagaaactagcgacactgtttcgaaattccggttacagacagtggctgtctgaaatcaatctacatcaatccagaacaaaacaggaagacaataagttttaccagaattaaggcgagagacgtcacaaatctgcaggattctccaacaagcaagcataaggaacttttggccggtatagttttgtccgcttcggtctcggtttagtggaattcccgacgacaagcttacaccgccgatcaatttcgtgtctttctttgggttagattccggtgtctggtaatggcgaatcactaactaacggattctctgatttgtaactaacataacgcgggaaaaaaactaaaggacgagcaaaccaacctcagctgattattagagaaaaatattgatatacagaagaaccctagatacctccgatcctcgaaatcgatttgtatcttcaggggaagaataaatgtgtttccttttttcaaatctgtaaaatttataatgataaagatgacttttttattattattattaaatttgagttgagactcgagaccatgtcctttggaaagttaataaaaaacagagtattttttaagtaatgttattacatttggtcaaaaataaaggtggagcttttttgctttgcttcttctcattctctctctctatctctatatgtatctctgtctatcttcttcttcgtttcaagccctaaattgtgtatcttctttgttgcaatcttctctacgaagagaatggtgaagagggtcaagaattgagagactccaaagtgaagtctaatcggcacacaaacttgaagcctttccgagcggtcttgcaatctccgtcgtgttaattaaaggaagggttttgcgttttctttcctgattcggtcgcttctatggacatg

SEQ ID NO: 14302 - DNA, 3000 bp, Unknown; identical to SEQ ID NO: 14297
  misc_feature (1)..( 3000): cDNA_ID_2729823_gDNA_ID_2684103_Annot_ID_190309 3000 nt of promoter + ATG

SEQ ID NO: 14303 - DNA, 3000 bp, Unknown
  misc_feature (1)..( 3000): cDNA_ID_2729831_gDNA_ID_2684103_Annot_ID_190305 3000 nt of promoter + ATG
aacttgattatggtttatggtgatgacttgcttccggcataactctttctgtgtcaagctctaaggcagtaaggcttatatttgggtcaacatcattatcaccatatcaatttacttactggttttagaaattggatacaataaacatgttccgagattgttggaactcagccgccatcttgaaaagttagatgatacttaaattattatgaacaatgctccataaacatttataaagtaacaaaattcaaaatgcgagtatgaatcacatactgtatgatgataacataatccatgtagctatgtataaagatacgatgcttaatcaaaagggttctctgtagtcaggggccaggattcatctaaatctttggttggaatgggttgccgcacataccgataataaaattgtctcggtcttcgatggatccgtgtctggagacagcaagccaatatgttgttacagacaatggcatctgcaagaaaccatcatgaaaacgttaacaattacagaaaaatgtgcattccgtatacccgcaattcccaaaacatagttcccaaacttacagactatacaatacaagcctatgaacttttgcaagaaactccctcagcaaagcagctacctttcttccttatacttggaagtgttttcaaggattcaagacatattgaaacatgcctaatcaactaatttagccaggtggttatctagattctctaacaaatgatgtcattgcgacagcatatcattatgaaaacccataaaaacttagtactagtgcatcgaactttccaaagcttattgctcaattgaatctaagcaagtcaaggtttttctatcaatcagacactggaaagtggagtgctttaaagcaagcaagcaagtagagtacctctgcacatcaaatcctgacaatcctttgatgaactttagatttctcagcatcgataatcgattccacgcggttaaccgcatcatcaagcctccctttggcattcaccacaacgtaatcaaagttctttagatgcctaacctcttctctcgccgtagcaactctaacaagcaactcctcttgactctccgtcttccgatcaatcaacctctccaccatagcaagctcactctccgccacaaggaatataaacacagcagagttaccaagtatcctccttaacgtctgagctccttgaatatcaactctaagaacaatgtcttcccctttggccataaattcctgaatctgcttctttggaatccctttgtattctccataaacaagtgcgtattcaagaagctcttcgttctccaccattgacaagaactgatctctcgagacaaagaaatagtctttaccatcaacttcaccaggtcgcatcggacgactagtggcggtaacaacaaaatgaagaccttcacgaacctcacgaagcttgttgatcactgcgtctttaccaactccgcttggaccgctaataacgatgacgatctgattcggcggcgggatgattggatcggcggtgaaagaagaacccaattgaaattcgagggaacgaagcgactcgggtttggtgggagattggataggggacgaattagggtttcctgggatatgggtatcggtcattttcaaggaggagtacgagagagcagaagagtgacggagtggttgaggaaaagagcgggggatgaagatgggtttgttggggaagatgatggagcgagagaatgaagaacagagcttgcgaatcatttgaggagtaaagtagcaacctttgggattcccaaagaagtttggtggagtggattgggtcactcgagccaccgatgctttgccgcgattttgacctgtatcttcgcttaagagcttagcacgatatcaactagggtttacttgttcaaaattccttttggtagatattagcctaatatatacacaaaatattcgatttatgatgaaatttgcacagaataatctatatttagcagcataatatttttcgattagccatctatttattaaatactcgattagcctaatgattttttttgacataagttaaaattgactcatgttttaaaaataaaacacatgtaattttgtattggtaaatacaattcgacttgagattcgattacaaaactgttaaaaagataaataaaaaaagaatgaaaaaacttaaaaaggtaaaaaaaattgtatctctttatttgatgtattgttctattttactggttggtcataataaaatcgaataacacttgaacttattttatgcgctaatttatgtattattattattttgtaggtaaacacaaatcttaattgtgagaaatttcagattatgatttgcaaagagagtaaagaaaatattatcagtttaatctccttcctaaaaataaacaaacaaatatttgctgctaaacacaattagaaaggagatgtaataattttagtatttcttaagttgcgacgttatatattcgcaacctaccaaactgttgtgtttaaaacttaaaccgatctatcaagcaagtggttcctctctctctctacctctcgtttttggccaacgtcgtcgtcttcacgatccacgacgattcagttcttgagttccggcgattatcggtctctcacttctggttccgttgaacccctcatttctcttctcgcccgtgctctcaaattccgatatttgcccctgtgattcgaaaccctaatttcgcctatcaatctggaaaatctctcaattcgaagactttagcagcgcaaagatactctatccgggtaataagatcgaagaaaccatcaatttcttaccaaagtcgtgattcttggatctcgtctttgtttgatggacacaattagggtttccaaggaggttcctggatcttcgaaatcgaccgcacagtcgctcacggagtcgacctctcgcacggaaaccatcaatggctcccacgaattcaagatcagcggctactctttggtcaaaggcatg

SEQ ID NO: 14304 - DNA, 3000 bp, Unknown
  misc_feature (1)..( 3000): cDNA_ID_3015890_gDNA_ID_2684103_Annot_ID_190303 3000 nt of promoter + ATG
ctcaataaataagacgattgtcactttaaaaagaaaatagtaattatccaaatatcaatttcagagatttttttggctaaaaagataaaagagctagctcagatgttataattatcagtaaatggaaaaccgttggagatttagtacaactaacaatttttgataagacaatataagaattttcttcttcttagattagtagttgtctattttcaataccactttagcttaatcaaagtgtccattcacattattcacaaaaatagttcatctattttattaatcttcttactttgattcaagaattccttttttttttgttgttgctcaagatagaatttagcttatacataaaaatgatactttttcgcagttttaaaattctctaagaaaccaaactgataaaatttaaagcgcaagagaatattaaagtaagaaaaagagtaaattattacagaatctcctcactaaacgagcttatacgttaatggctctaatcttgaatatgttgttgttggccgttgaggctgtgtttaatcatgtgacttttaactccaaagctaccaaaagtcttcggcccaagagaaaagagctacatgagtacattctacattcttcagccaataatgagactccctactatcttaattattgggccgaatatgggcctacattaactatttaatgggcttgatagtattgttagcatctagctttttatgattttgtttcagtgaggagaaaaacgctttctcaattatgaactctgcatctttgtcactgattcttctcacctgatctgttgcagatatttggtcaaagagtttattaaaagataacataatataaagtgaaaaagcaatgctgctttctctcattggttgtgcatagagcaaggacagagaaaaacaggttcgtacgtaagaaacacacattaactgtgttctgcttcctttgtattctctcacttttctcttttttcagaattcaatctctggaaattttcttcctaaagattaaagagaaccgtttggaccagatcagcttgcctcttggtaatggtctctcttctctttgttcccaatttctgtagctttcttctttctccctaactcgtctgctctctttgtctcttcctctcacagttcatacgtcttccatggcttccggtgatgttcttcctagattcttcactgtcttcctctcccattgcagctccgaatccatggtgagatttttctctggaatatttcatggaaaaagctgcttgggttgatatgtttcttggatacagtaacgatgtgaatgagatctgcaacattatcttaattcttaactctatatgtttaaatctcttgacactgacaaaagttttaactttcttcactaatgagctcaggattatctctgtttgtgttacttatgtttgaatatgatagagtatgtcaaactaaacactgaatttcctcaaagagttttctcctttgttgaaaaaattgaacaagaggtcttggtcttgttgtttgtctgtttacctccgcttgcagacagagtctttagcttatattttgctcacttttaacagtttagtttatgctacatctttgtgttgagcaggtgataccaaggtcttactacaatcttttaccacgtccgttgcccaagactgcgattctcatcggaactggtggaagattttggaaagtagcaatgacgagcaagcaagagcaagtgtattttgaacaaggctggggaaatttcgttgctgataaccagttaaaagagggagaattcttaacttttgtgtttgatgggcacaaaagttatgaagtaagtatctatggtcgtggagattgcaaagagactcgagcagtcattcaagttgaagagatctctgatgatacagaagatgacaacgtttctcttcatagccctagcaatgtttcacttgatagccttagcaacgattctcatcatagcactagcaacgtttctcttcgaagccttagcaacgattctcttcatggtgatgctgagatagagagcgacagtgagtattctcccgagaacctaccctcagcctctatatctgttgaatccgttgaggtggtgaatccaacaacaagcaggcagagaagttgtaagtaaacattgttcttttaactgatgcttataaccgaagctgtttagaatttgatctcaaatgggaattttgcagacaagaggaagaccattgagaatccacatctgtatttggatgatccaaacaatgtctgttttgagacgtgtcttaagcttagaaagtttgagctggtaagacttcattagatattattatctcgtctcattaaaaatcctttcacgagttgatgattatttttctaactaaagctctatatacattatgcacagttagttcatgcacagttggtgaaagactacggcttgatattcagcgacaatgttgactatattgacggatatggaaaactaaccgcgaaaacgaccaagtgggcagatcaacgggtttgcataaacaaatggcagaaaatatgcgagagaaaccagttcacagagaatgactccatcctatgtgaaattctccgcaacgaggacaaagtggtttatgcaatcaagattcacatcttccgcgatgcagcagcaagcacttgattctctgatgcagttctgcaattgtgtttcttctctttcgagtctagtcttttgtagtaaactattagaatgtctaatttcaaaacatgtttaagacttttgagttctcttgtagactttgaagtaaacacaatgaggagcaggcttaagcttacccgttaatcactctgtttctcttacaagttacaatcatgtaaaatgggttagaatgatcgttttaatatgttaggtacagatttcgtaatttctcgaaaatgtgatatctcttcttcacaacagaagaacagattattgtgaaagtcaaaacaaaaaaaaatctctgaaaca

SEQ ID NO: 14305 - DNA, 3000 bp, Unknown
  misc_feature (1)..( 3000): cDNA_ID_3015894_gDNA_ID_2684103_Annot_ID_190301 3000 nt of promoter + ATG
tgtgtttacttcaaagtctacaagagaactcaaaagtcttaaacatgttttgaaattagacattctaatagtttactacaaaagactagactcgaaagagaagaaacacaattgcagaactgcatcagagaatcaagtgcttgctgctgcatcgcggaagatgtgaatcttgattgcataaaccactttgtcctcgttgcggagaatttcacataggatggagtcattctctgtgaactggtttctctcgcatattttctgccatttgtttatgcaaacccgttgatctgcccacttggtcgttttcgcggttagttttccatatccgtcaatatagtcaacattgtcgctgaatatcaagccgtagtctttcaccaactgtgcatgaactaactgtgcataatgtatatagagctttagttagaaaaataatcatcaactcgtgaaaggatttttaatgagacgagataataatatctaatgaagtcttaccagctcaaactttctaagcttaagacacgtctcaaaacagacattgtttggatcatccaaatacagatgtggattctcaatggtcttcctcttgtctgcaaaattcccatttgagatcaaattctaaacagcttcggttataagcatcagttaaaagaacaatgtttacttacaacttctctgcctgcttgttgttggattcaccacctcaacggattcaacagatatagaggctgagggtaggttctcgggagaatactcactgtcgctctctatctcagcatcaccatgaagagaatcgttgctaaggcttcgaagagaaacgttgctagtgctatgatgagaatcgttgctaaggctatcaagtgaaacattgctagggctatgaagagaaacgttgtcatcttctgtatcatcagagatctcttcaacttgaatgactgctcgagtctctttgcaatctccacgaccatagatacttacttcataacttttgtgcccatcaaacacaaaagttaagaattctccctcttttaactggttatcagcaacgaaatttccccagccttgttcaaaatacacttgctcttgcttgctcgtcattgctactttccaaaatcttccaccagttccgatgagaatcgcagtcttgggcaacggacgtggtaaaagattgtagtaagaccttggtatcacctgctcaacacaaagatgtagcataaactaaactgttaaaagtgagcaaaatataagctaaagactctgtctgcaagcggaggtaaacagacaaacaacaagaccaagacctcttgttcaattttttcaacaaaggagaaaactctttgaggaaattcagtgtttagtttgacatactctatcatattcaaacataagtaacacaaacagagataatcctgagctcattagtgaagaaagttaaaacttttgtcagtgtcaagagatttaaacatatagagttaagaattaagataatgttgcagatctcattcacatcgttactgtatccaagaaacatatcaacccaagcagctttttccatgaaatattccagagaaaaatctcaccatggattcggagctgcaatgggagaggaagacagtgaagaatctaggaagaacatcaccggaagccatggaagacgtatgaactgtgagaggaagagacaaagagagcagacgagttagggagaaagaagaaagctacagaaattgggaacaaagagaagagagaccattaccaagaggcaagctgatctggtccaaacggttctctttaatctttaggaagaaaatttccagagattgaattctgaaaaaagagaaaagtgagagaatacaaaggaagcagaacacagttaatgtgtgtttcttacgtacgaacctgtttttctctgtccttgctctatgcacaaccaatgagagaaagcagcattgctttttcactttatattatgttatcttttaataaactctttgaccaaatatctgcaacagatcaggtgagaagaatcagtgacaaagatgcagagttcataattgagaaagcgtttttctcctcactgaaacaaaatcataaaaagctagatgctaacaatactatcaagcccattaaatagttaatgtaggcccatattcggcccaataattaagatagtagggagtctcattattggctgaagaatgtagaatgtactcatgtagctcttttctcttgggccgaagacttttggtagctttggagttaaaagtcacatgattaaacacagcctcaacggccaacaacaacatattcaagattagagccattaacgtataagctcgtttagtgaggagattctgtaataatttactctttttcttactttaatattctcttgcgctttaaattttatcagtttggtttcttagagaattttaaaactgcgaaaaagtatcatttttatgtataagctaaattctatcttgagcaacaacaaaaaaaaaaggaattcttgaatcaaagtaagaagattaataaaatagatgaactatttttgtgaataatgtgaatggacactttgattaagctaaagtggtattgaaaatagacaactactaatctaagaagaagaaaattcttatattgtcttatcaaaaattgttagttgtactaaatctccaacggttttccatttactgataattataacatctgagctagctcttttatctttttagccaaaaaaatctctgaaattgatatttggataattactattttctttttaaagtgacaatcgtcttatttattgagccatttttttgacaaaacaattttttttcttttcacttctgcagagaaaataggagcgacggtggagagagagaggacaataacaaaacaaatgcatgtgacgccaatcaacaccatacacgacgtattaattgtttaaagtaaaagacaacagtacccctaccggcacaccgacgcgacttcgttgcccacatg

SEQ ID NO: 14306 - DNA, 3000 bp, Unknown
  misc_feature (1)..( 3000): cDNA_ID_2729846_gDNA_ID_2684103_Annot_ID_190299 3000 nt of promoter + ATG
tgaattcttggatgataaataagtacaagtttaaaattttggctcaactcagcttctctctgtttcattcctctgttctaatttcttaatcctctacatacggtaatttggctgattgagaatttgggtttcatataatcatctccatggattctgaaagcaatattctataggagaaagggtaaaagaatagaccaaatatttaaggcagtgtcttaaggaacataatgccacaattgggtcagatgaataatctttatcattgtaaagcctaatattaagaagaaaaaggagataattggaaaccaaaagggagattaaagtttacatacttcataatggtgaaagttcaagcaaagtgtgtgtagattatgactatattattgttttgttttaacaaaaaaaatgatatattcttgatatcttttggaagtagcaagcgaggtatatgatcaacttgataaatagaaataacgaagtatttgtcggcgtcacacataccaaattttccttcaccacatgaatataattatctcttagatttgctggtttattatgtgaagcatgttttttgaataaacagatcatattatcaattgagacttgaaaatatttaaaatgcatagctccatttggtttttgtttttatcgtaaattaaatttatgagtcgaaaactagactagttttttgagacgcacgctattgataattcaatttggtctctttttttttcatcaattcataattcaatttggtcttgactcttgatcaacatgatgaatcactaaaacaaggacgacattccactatccggtttaatctggttaagatatttttgactcctttctatatggtgtaaataatctacaaacaaatttatttccaaatctttgtggatcttcaacatagtttttttttgtaccaagcaatttataacaattgtggtttaagaacattggttgaggtttggtttggtgtacaatcatcactggtaaaccgaaattgacttcttctttttccatttttcttttagaaaattcatagtattaaagtacaatattcctcttgcatttactatttggcacacatatatacaaaatccagtatcccactcttgtgagccagccatcaaaagaagaaagagagagagaaaaaatgaatatgaaaacatcaaagatgaagttcacaaaagagatgatagagtctatcaaagacaagctcccgaggctcagcttcctccgacaatgctacggtggttgcggcgaccggacgcatttactcccttgctccatcgccaccacttccacccgcttttggaacctctccgaccgtcccgtggagctccagattcgggtcggttcaattctaaaacgggtccacactctcaaacctggccgttccaagaagcttagacacagaagcattcacagagcttacgttgatgaccaggaaggacgtagatggctgtactacgacgacacttgtctaccgtacgtatgggttcacgagactggtacggacttgtcgaagatggtgaagcaacagtacgtgagtctcgaggatctgagggattactcggagattagggtttttaaggatttacagagaggttgtgtcgcagttgagaaaagagacagagcttctgctttgtgttgattctccttttctcatgcttcgaattaatgtcttgattttctcttttgaaacttatcgttattggttagtttatctaaattatttccaagttatattatgtgatacatgatgcatgtataactccgtctgactcttcttgaatttggatttattgggattaaacaacgtgatcacaagttgatctctttccaaaaggggtaactagatctctgaattccaaactaatcacaaaattttatttatcttcgtcggttgatatttgtggtagttgaggattatatgtagtggaaaaagcaaatattatatttactaatttagattcagtcagaagatgacattattaagttaacacaacttggttagtggtgttgttacttatagtataagtgatctttgctatgatgatctgcgaatgatttataacccaaaaattagtggttttctattattgtttcccaaaatggtgatgcaatatttaaataaagtttcttataattaagactatccatcctgaagtaaattttgttctcttatttggtcgagaaacaaatactatttagagagatcttatctttacacatttatcgatgatcaataatgtgtgtatttattttgatttttttcgttggagaaaggcaacaaaatccagtgaggtgccttgatggcaggcaaaataatgacctttcctctgatcctctcccactttgatagtccattaatcaattcattcaattgtgtcatatatccaatatccaatattcaacatttgatgcaaataatatacttactggttcaaactcaactaattagtgcaactttaatggctgacatgatatatagtaatagcattagatacgaagtttttagaaatcgatttcccgcatgagaggtaaggtatattgtagactcatagaaaaacatgtctctaatctctatagtctatagttgtagagttgacttttgagtagcataatttaattattacacacggtaagttgtgattaggtggtaaaaactatacaaagtcaaagttacgaagaaaactgaacaactaaccaattattttatgtaaacattaacatattaattaattttctacaacaaaagtctaaaaccacatattaaaccgaactcaataccgaaaccaaaccggaaaagagaagttttgttactcggtttaaaaagtaaaaaagagaaaagtcaaaaaagcattaacgaatcttgaacaagacatcttctagttcttcttctaccaaatcttgtttttcttcagtctctctgcttctcactgttgtgctttctgtcttgtctctgtctttcccattgtcattctctcaccaatg

SEQ ID NO: 14307 - DNA, 3000 bp, Unknown; identical to SEQ ID NO: 14292
  misc_feature (1)..( 3000): cDNA_ID_2729868_gDNA_ID_2684103_Annot_ID_190292 3000 nt of promoter + ATG

SEQ ID NO: 14308 - DNA, 3000 bp, Unknown
  misc_feature (1)..( 3000): cDNA_ID_2729795_gDNA_ID_2684103_Annot_ID_137103 3000 nt of promoter + ATG
gatctttaacgacatatgtcaagtaactacagttgtcagttttgggtttcaatgtaaagcaactcattttccttctttctttattctactatatcgagaactattagtgtaacacctatgttttcaacgtcaaagtgctccgatataatatattttaggagctgtgtgtaaacaacatttcgacttgttcttctttctcgcaaacatcggaagaatccaccgggaaagtatcatctgccttgcgcttcctcgattcattctcctcagatatctccatcatcgaattatcatcatccgcgtttttcaatttggaatccatgttggagtaaacaaccctagatctacgagaaacgacgacttttgtagttgatctaagtcacgagactcgatcgcaactatttcagggggaaaaataatctattttcaaatttttcatcacaaaaagttgtattatatatttaacgtaagttgttttaatataattcaagttaaccagacgaaaaaaatcattctataaagcgagacgatacatgtaacaacaatcagaaacaagaaaatgaaactcgatcaagaaaaaaaaacttttaatgttacagagaaaaagaggagtttaaagtctttaacaagctttacagctacgtctgcaattcccagggatctctggagttccaaccatatactctggattctttccacattctccaagcactgcccatctctcacagctctcgtttacgtcagtacagttaccatcatgtgtcaatatcttatcgaatgagtccacgtggatccacttagtagccgaccatttctctccttcgatcactggacaacctccgtgaaggctaaaggggtctgggattgcgtcttgttggaggttgaagaacaacagagcattccctttcttcggtttcactaataacattaccaaccaatatcaaacacaaacattcttagagataacatggaaagaacaagtcatgattccttttatatatagctcaccagcgattcctttctttgcacaatcagaaagatcgtctttattctcagaaagcgagcggcgagagaattcctgcgcagaaatattcatcatacagaaaaagagtaaagacctatttgtccacgtatatagagaaccaatacaagattagcaattgtggaaatgtaagcggaaattggtggtattgtctgaaaaacaacaaacctgtgcatcggggaaaacagtttctccaccctttgtgacattggacagatacaagagaaccgttgctatgcggtgtccaccacgggcaatgttgactttgtcgtggaagtagtcaaagtgagcatcatatttctgaccgtgctcatatctcaatacctgaaggtcttccccgttttctgtgaccacaaagtgaagaacttaggaaacaataatatcttctgaaaaaccctttcaagaaactcaacaacagttaaggttccttgtcaattgacattgtgaaacagagagaccactattgaaaaaccattcagattgttaaagttaccttttgggagaaatgtccatgttgagagcttgtcctcgataccggaaacaataggatcctgtcattaaacaaacgaagcttcacattaagattgtaatcacactgagatatctaaatttctcaaatctgttcctaataatcactaagtatcattcatcatccttcatccatacacagaagtaaatttatgtctagctatcaccctaaaacctttttagtagtaaacaacaatcacaaatcaacacaatttggggtcaatttactaagatctcgacttatcaacatcattttatcaaactctgatgaccagttcaatatgtgtgtgaacttttggattgaattattctaaaatttctatttccatcagatcttgaggggtttgacttatcagatccattagtatcagaaatcacatcagagattcagagttcttgaggtcgagtgtcataaattagaatcaagatcaattccaatcaagccattcaatgagatctgatgtgccgaattaaaattgcacctttcctttggagataaaagtgccggagctggtacgaacatcactgacttgactctcgccattatcgttatcagcaaccgcagatctctgcagattctctttcgcctttccccaaaaaaaaaaaaaccaaaattagatactgaaactagcacatttaagccaaaaagtttccaaatttgagctcaaacccaaagagcaaaattcgcactcacaagagagattagatgatcacattccaagtccgtcaaaaaaccttcatacacaaatgccctgaagaaacagtcaatacacacagttggaggttcaaagtttccaaatttgcttcatttctcactaaatagacaagagaaagagtaaaatcaaacctgggcttcgacgaaacctgtttgactttagaaggattgatgatagaacttggagaactaatcagacaagtggaagactgaagcaagacgagcaatatagcgacgaacaacaacaatccgagccgagacatcgacattatagcaatcgtagtaatttcttggatccagatgatcgagatcgaaaactagaggataattttatttattttttctcggaaaataaagagggaaaaaaaatgtcaacggtcatgaaaagttgatgttctacctaaaacaaggaggctcaagggagatggtgacaacatgcgcacgttcttcttggttgaacaattattcttgttccttgaccaaagcccataataagcctattgttacttaaaaggcccaacataaaattcggaaataaaaacgacgtcgttggttttaaacgtaaaataatcctcgccggacggaagaggcgtcaccagaacagaaaattcaatttgctccggtttcgactttagccggcgacgtaattaaacgaaggttgaaggagaattagaagagaggcagcgataatcaagtcaaggaattttctcagagaatg

SEQ ID NO: 14309 - DNA, 3000 bp, Unknown
  misc_feature (1)..( 3000): cDNA_ID_3438233_gDNA_ID_2684104_Annot_ID_137104 3000 nt of promoter + ATG
attacgaaaatatagggtcgcttattgcaacatatgaaacgtataggaactaaattaaaaaatacaaataaaggtcttctccttcccgtctagatgtagaaatccctaaaacttgctactgttttgcatacggggcttgtacaaataaaaaccacccaattcctacgctttcctctacaaattgtccccttttttttttaacttttatactttcaattcatctttggttctgtagaattcccaggaatcagcattccactgtaagctactggtttctctaattaactgtagatcgatcgaacttttatagattcgggattgtttctcccaatatttctgtagaaattactacaaaaaaaattagattttcagctactctgagtctaccttgaatcgtttgaaatcgaaaaccctttcctttaatttcaaagagtcgcttaattagggtttaggatagatggagaagaagaaggtgacgattccacaagtgtgtcatggccattcaagacctgttgttgatttgttctacagtccaattactcctgacggtttcttcctcatcagcgctagcaaaggtgataatacttttggtttcttacaaaagtttggatttttttggtcaatttagttactagaactgtgcaaaaattcatgttgatcgaattgagaacttacaaaagtctttgagttttctctgagtaatacttatttcgtagttcatagagttttgagaatactcatgtcttgatggtttagattcgcatccaatgttgagaaatggggaaactggagactggattggtacatttgaagggcataaaggtgcagtttggagttcttgtctggataacaatgcattacgtgctgcatctgcttctgccgatttttcagcgtatgtgtttaattttttttggttcattaagtcattatttgcgtatgttttatgttcttagatacagcacatttatccaattttttgttatcttgttttgttcagcaaactttgggatgcgttaacaggggatgtgctgcattcttttgagcacaagcatattgtccgagcatgcgccttctcagaggttcgttcaacctatttactctctccatatagattctcgatttggtcaactggggttttgtaagatggtaggctaaaagaattggaattatctactgaaatactttaatcctgttttgtctttataggcataagcttttgtatctctgtgttttggattatcggttgtgggcaggttgttatgtaatagctcttattcaggcaactgcacggaatttaagtaaaaagctttgaggatttgtttaattaggtgatagtgaaattgttcttcagattggactattcttaaacatttgttgtttgtggatggtgtcgatccgcttttatgcatcgtcactaattgaatgacatttttctttcactaggatacaaaatcgttgctcacaggagggtttgagaaaattcttcgtgtttttgacatgaatcggttggatgcacctcctacagaagttgataaatctcctggttctatcagaaccctcacatggcttcacagtgatcaaacaatattaagttcatgtactgatattggcggtgtaaggtatgaactaaacaagacacagactaaatacacattgtcgcacataaaaaggcatagtttgatagacgttttgtttgcttttccgtctcctctactgctatcttatacaggttatgggatgtgaggagtgggaaaattgtgcaaacgttagaaactaagtctcctgtcaccagtgctgaagtgagccaagatggacggtatataacaactgctgatgggtcaactgttaaattctgggacgctaaccagtaagttctcattctaggaagagaatcaaatattttctaattaccttttgtatcttgctcaaaccccatctttgccccttgctttttcttccaagttttggactagtgaagagttacgacatgccctgcaatattgaatctgcatcgttggagccaaagtctggtgaaaaatttgttgctggtggagaggatatgtgggtccgagtgtttgatttctacactggcgaagagattggtaagtgactttcaaaacatctatgctatcatattccaaatcagacactgtcatattacctttttgtcgtccaagttaaattccagatagcttcaagcttaattggagtttctgactctgttataaactccatgagtgaagagcttaatagatctttgaagcatggttctttaagctcctgcgaggttttggttttctgattgtttcatttgtgtctgaaacttaggatgcaacaagggacatcacggtccagtacactgcgttaggtttactcccactggtttatcctatgcctcgggatctgaagacgggacaatcagaatctggcaaacaacaccagcaaatcccgaagagaacgaaactagctcgaggagagtgaagcatagcgtggatgaagtttcaaagaagattgaaggctttcacatcaacaaagaaggaaaaaccgcagagaaaccatctgatacttaagctaaactgagcgtacaaaaagcctctatatgtcttagttcatgatttgctatgttttgtttccagactgaatgattatacagagaaaacaaacaaagatctccctctcttcttttgaatcaaaacatgggtgttaaaatttaatagttttctttcaagtgtctttttcaatattgaactaaatttagggacgaatttgtgatttatgattatttgactttagattgggcttgggcttttttcgcaggttggggtataagggtaaaatcgtcatttgacagaccgacttgtctctctctatctggggaaaacgtctatcgggagactcctcttcgagctcatcttcttctctctctttttatctttggttgtgcgatctcctttctctttcaatctccaaggattttactgtgagatatttggcgggaaa

SEQ ID NO: 14310 - DNA, 3000 bp, Unknown
  misc_feature (1)..( 3000): cDNA_ID_4254789_gDNA_ID_2684104_Annot_ID_137106 3000 nt of promoter + ATG
atttttgtctaaattcaccggcaaaagttaatattttgcagtttgatcgagtgaaagattgacgatgagccttcttgtaaccagaaaaacccgatttacatgagagaacctgcaaaataccatagaaaagagatgagcttcaaccacaaatatctcaagctaataagtgagaacaggagagcagtgtttttacagcttcttggtcaatcttgtggtacattagcttccttcttgctccacagctttttcgataagctaccacgacatgagctagaccgaaaaccgcagaagatagtaacaaaaccggcattccccatgagatcttgaggtgatagaccttagcctcctcaagagtagaattcacagtgaaaacacaagttttaaccaaaagaagaagaatccctccaaaggaagataacattactgtttcaagatacagaccataagctaatcttgtgtcttcacataaccaagagagacctgtttcaatagaagctcaatgaatcagaatgctaacatttgtgttttgagtaagagagaattaatgagtccgtacttacagataatgacgagagatctaatgagcgagacgagtggtacatcaatgagagaggtcttgaaactatactgacgaaaatgttgtgcaggggagtgacacgtgaggcacgtgatgctagagacgataagacaaggaactaccacatcagccaccgtgatcagaaccggtaatgaagaagctaacagagacgccgtcattgctgccacaaagaacatcgtccttaaacatcttcgtgctttctccgccacaatccatgacttccacgccgccatctataaatccggtggtggctaaaacaacttcaccatttttttcgaattcagacaaaacgttatagctttatgtaattaaaactttgtaacggttgatatattatagaaaacaatgcaattttcaaatattattggtacacagaataaagtaatgagttgtataagataaagtaaataaatgagtgggaaatattaaatgattaatggaccaaaagacagcaaagacaaagaaatgataagtgtgtttggaggaagagtggcacatagaagcatgtgaatgttaggttcactcttataatattcttccagccattttcttctgtctttgttcccccaaaagtttagcttacttactatgtatacaccttttgtttttactaaaattcgtttttattaaataatttggtaacaaatcatatcgtaatttatcaaatcacgactgctaattttctttgtttgtttactctataaataacgaatatccatttttgttatgtatgcaaagaaaggaaaaaaggttttaacttttcagaaactagaaaatatggctgtctacagataattgagatgcaataattatgaagcaatgatctggcagaagaaatcaagatgttgtttatgaattatgactagataattatgggatctttaatatcagaaagtaaacaaaaatcttcttataatgcataattgaataacaaatcaatactttaataattatgttcccatgcatgttactgcagaaacattggaataaaaatggtacaccgatttatgtacgttgcatatcaatacaaatatacaatacgaggaaactacttaataatctatttttttcttttctttcaaagaaatacttaataatgtatatactatgatttatcttatatgttcaattgttcataaacattagatgagtcatccttcttattattacacatctttctcgtatcaaattaatttatctatctataaatcattgtgattttgtttattattcatgattgctcggaagcttcttgtttaataaaaatttattgccaaaataatagaaatcgtaatgtatattagacttattactttattagtattacgcatttggtggttcacaattaggaatactgtatacattttgtctagaagagaagtataaatgggccgatagtttaactaccagaaggcccaatgtgttttaaaaaacaatgcccacttaccaattctttcaagttttcaactagattggtggggaaaattgacgattaaaccggacggacggtataatccattggggtaggtagggaaacgagcgaaccgaaccgggggtaggtgaagtcttatccgacatgaaccaaatcgggtcgggtcgaatccttacaccaacttttcgcaccaactctctactgaccctaccaacccccatagtggttggtgaaaggactaatcattttctaattttttcttaatcatatattttttacatttaaatcacatggataagatcgtaaagttgctaaatgacgaaccaaaatgatctgtaataacgacacaaagtcatactataatacataaaaaaaatatgcaactgaaaccagatgataatttatagttttacacttttattgaattattagaatgtgaaaaatgaatctttatttaaatattgtatgcttattataaattttaaatttacataaacgaattactaatatttttatatataaataatttacttattgtaggactataaatatataattaagtaatgtgaataataagatacaaaaaatttaaatatatttatggtatgttttctattttcagtgatatatttttattaaaaagagccgaactttattagacagtatactaattgttgtctaaaccaatcagaaggctaaccaatcttattaataaaatataatttgactaaaaccaaaatgttcacatagttttgatatacattattatggctaatgggttaatctttaggacaaaatggattatttttgcattatacaaaatttaaaataatataaatgacattttctttaattaattgtatttaatgccgtatatattaagtataaactcatttctcttcctcttgaaaaactcactttatcaccaccaaaaaccaaaattcactgccaaaaaaaacacatcaaaacg

SEQ ID NO: 14311 - DNA, 3000 bp, Unknown
  misc_feature (1)..( 3000): cDNA_ID_2701811_gDNA_ID_2684104_Annot_ID_137117 3000 nt of promoter + ATG
aaaagattgattttttaagttttccatgtaatatttattggttagtattggtgaattgtaattttcaagaaaaatagttaattatcattggtttacagttataaaaaactgtaaaacactaaaaataatatatttataatcaacatttaatatgtttttttaatatgtgtgttttttctaaacaatcaaacaaaaaggaacagagggagtaaaaaagagctgtataaaaaaaacttgagagtaacgtttttgataacatttttgataaaagtatttatgattggtaaaataaaagttatacaactttttttttgtttatcaatcaaagctttaaaatattaaggaccaaattaaatatggcttgagctataggtttactagctgtaagaaaagaataatttgattacttcaaattttacattgtacaagacaaaaaattatctaaaatttcttaaaaaattatgtttatgacaaaaacaagagaaaatttgaaatgaaaaacaaaaaaaaaactaatccacaatactttaaaatagtattcttattatttcttaaaatataataacgacaataatttttgttagaatcattataaatcatatttatattttattatcctaaataaaaaggtggaaataattttatttatctatttggggtttgttttcttctacaattaccaacaagataaaaggataacgaggaaaatgggtgacttttctcaaatatatatgctggtgagactcctttttatacacattcttgaatcctaaatccaacatttgggctccacatttcacaataccacatcgttactttattacctatttattaatttcccaaccatctcacatttcgaaagctggcaagctgacggtggacaatatttgctgatcgttctagttttcgatagaaaactcgtatttatcgtttgcataaatatctactttatttgcactaagtcaaagtttagttttttttactttttagtgacgaaaaaaagttcataagatccgttcattgccaccctcaaataatcctttcattatctctttatctatttgtatagaaaattagtttgtgagaaaaacgcatcaggtctgatatatatatataaaccaacgattaaaggtttaagaaataataaaaattagagtgtgaaaataataaaatttcgcattactcaaacagttggtaattcttgcttatattgttatgtaactcataaccaaaaatagatatattaaataatatattgttatatattaattatcaagataattaattaattttttgttaattgatgaatttctttataaaattccaatggtcacaaaatacaaagggaatacaaaagcgtgatatgacatttgaaacgtaaaaaagcttttttgaattttcactttgttgccttgtgtggcacttaagcgggtcccattttacagcttgccacgtgtcgacgtaatgtactcagaataacacggtactattggaagcatgcaccttcagttatttgtccacacatgataatcaaaaaaaaaaagtgatacgtagaagtttttgcattggtaaaaaatattttaatttatattctgttttcattaaattttaaattattctattttaaagtatttgtttaaccgttaaaaggtaaaactatatagtataccacttaagtttagggatgatgaaaaaaactaccacgtaaaacaataataaatcggttggttgaaaccttgcaagttccatgtaaatttattaaagtatatattattttaaaaatattttatagataaaaaaactaaattaatagtgccgtgcacttttcttatatgatttttgttattataattttttttaatttttttattataacttactatagagacaaaaatatatatatgcttattggatgaaaacaatcgctatcgttgttaatggtcgctcgtgtcaagccacactttgagcctatatgaacacagacgataatgcatggttaaagaggttaagaaagtcattatcgactccgaaatcactattttaccctcctttgccttggttagtatcgtaatttaaaaagattcgacatgattagtcagactttgtatatgtgtcgaattgtcgccactctttatctccttttagtacaaaccaaaccacactaaactcggctgaattatgggagattatgtattattattgattgccaacaaattctaatattccgggtctaaaataataaaatattattttttggggtacaattgttaattacaaacactaatctgagattaacagtattttgtaggtcaaacaaactttacaaaaaacaaatggttttatcatcttatgaattgaaatctacagaagatgaaagataaactacgatttaattctagctaagtacatatagatcaaattaattagtgaaaaggatcaacaaagcaaattaaatgtactctctcatgattcacgaagataagatagcatcatctattttaatttgaaatcaatgatagaaatctctttacctacaccttcctacacatatgggtcaaaacgttttttttttggtatgacattttattcctttttcctgttgctaatctacatatataactacatagcgtacagctatacatattaaatatattagatctctacaataggttaaactgtaacacaaactattgatttagatagctacggtaattaatacgttttgatcgtccatattccacaaatataaatagaaataccatttgatgtgtaacaaaaaaatctcatagacatttatggttttaatacaaaaaaaattctcaaaaattgtaaataaatacgagtggatacgatggtctacgtacaaaagattccagaggataaaagccattttgatttgtcgttttaatgccttccatttttaaaaagaaagattactaacgccgactctctaaaactctctcaaaccataaaaaatattctccgatcatcattttaatg

SEQ ID NO: 14312 - DNA, 3000 bp, Unknown
  misc_feature (1)..( 3000): cDNA_ID_2729923_gDNA_ID_2684104_Annot_ID_137118 3000 nt of promoter + ATG
gtgaaaatttaatgtgtctaaagtgggtttgggcttaaaaaaaaacccatcatatttaacattgttcttcaagcagtatggggagtcaaaaaaaccaactcaacacaaatcaaatcgaacagttccaccgaatttgatatttttttaaagttcacattcacacctttaaatagaagctggtgatacatttcctaaggaagtgattaccagaatatcccactcacttttttctttgttttaagttccgagaatagtcttcaactattattatcaagtaatgtttaactttctattatttaaaaataaactaaaattttttagcatctacttactgataaacgtagtcaccagtcatattagttctttgatagaaacgtactttagtgttttgagacgagattttttttcgaaggaccactatattatttgtttcgagtttaaaatattttctaactaatgctagagagtagtcaagccaatccaaagtaagttatctttcaaaactctgcttaatttgtttattaactaaatcagattctgtaaacttttttgtaccatggtggatttaaatttcagctgataattttaaatgttacggaaaaaaattctggatcagttttaaataataaaagaaaaaaaaatacgaatacatttaacaaatatatgtcatcgagtaagataacctaaactttcggatacacacacgtgtaaaaacaaaagtactttgttcaaattccaagaaattattaactggagaaaaacaaaacaaaggatagcgaaaatgttatagataaggcaaattaaaaaccaatctttgactacccattcgttgtcatttgattaaatgataaaatataaatcattgatttaaaatgagagatagaggtaaaacaaaatatagaaaagtagcatcaaatggctgttagcacgaaaactattgagtgaaagaaaccctaaatctttaagttccactatagaattagataacgatcataatatagtgatatatttgatatctcgtctctgtgactccgtctaatcttttgaaatgatgtcctcttcctcacttcacttcatcaaaaaaaaaaatgtcatatatatgtatgcttaaactttcataaaaaatttaatgatttcagtaaaatgttctagggttagattatattataatataaatttcaagaaaaattcattcgtaaatttttttcatttatgaaataccacaactgcatgaaaactaatcaatggataaatacagacaaaaaaaattacatcaatacgtgatcttataaaacaaaatctgaatatatgtatagggtctatagctaatttcaatttcgattatattatatgcaaacttgatgtggattacttatttttcggttaagatgttttatctatggtggatttacataaaactcaacaaataattttgctaagtccttaaattagttagacatattggtgaaaccgacactaaaaatgtagataaaaatattaatttatacattatccaacaaggattttatccaaatcgtggtatctatgtgatctaatggttataagtggaatttaggtgttctaaacatgctcaattagtcaattatatacttcactttccaactcaaaacagcatattccgagcgaacaatatggatttttatactataacacccaatttctaaattaaacaaaaattgcgaccattatatatggttctatcttttaaaaaccatggaactaaatgatgaaactatgaagtttttttttcacaaaaaaaaaaaagaaactatgaagttttttaccctatattttttttaaaaaagatactatgaagctttgaagcagctactacgagttgtgtttgttaatgtttctgaaaacaaaaataaattgaaaaaatctttagtcaacatcaactcgtgttttttctcttctcccatcgttataacgtctttttgacaaatgacaaattgcgcctaacttctacgatagacacgtggacacgtgtcgtcatgatgtagttttgtccgtatggaaaacgctttccatgttgtaacctaagatacattgaacagttcctttgtcctttcaacttcgcttttttcgaagctctttcccttaccctaccacaacattacgcgtgtccttcttattacaacatttggcacatatacatttcagaaaacccgtcaacaaaaaacacgtgaaataaaatatctcttcctttaccagttcacatatttcatggttactgttcaatcatttcgccaaaaaatctttttttttttgggtacaaatttggccaaataattgttcctttattctgaaattcagtcccctacacgaatatatagaccaccaaaaagtacatggacggttcaatgttgattaaatcgaccaagataaagtcaataatgttttgtggtttagatgtcgtctggttactatattgacaataaactttgtaaataaaaaatatccttaaaaaaaaaaaaaaaatcctaaaaggaaaatcgaaaatcatttttttaatttgttttacattacttaaataattaaatagacaatcctaggaaaaaaatctcgattaaattaaatattatatgtgaactccaaatgtctaagcagcaaatttccaaacattcatttgaatcttattttgattggaaaatacttttaaatttagcggaacattattgataaatagatgaataaacaaatgttaataaaaaaaaccatttaaaaaaaatagtacgaggaagagctaaatctactcatgtaggttcaatgaactcaagggattgcataaatcacgacgatctaactgacacacgtgtcagaattcaaaagtgtttatagataaacacaaaaatgggtcccatattcagtacacacgttaatcagcggcggtggattcacctatacactgcgtccatatataagtagcacgagacccaaacattattgtcaaaaataagaaagaaagaaaaaaatatg

SEQ ID NO: 14313 - DNA, 3000 bp, Unknown
  misc_feature (1)..( 3000): cDNA_ID_2729909_gDNA_ID_2684104_Annot_ID_137122 3000 nt of promoter + ATG
tcttgttctcttgaagtcaaattttggtgatgagattgtaatctttatttggaacatatgtaggatatagtgttttgactttcaaatcagttttggtacaaaaatatgtgtcggtgcgatttcttgtagtggactctttctcagatctgattcaagaatcttgtttcttgatcgatatggagcttcacattgtgatttgaagatctttgtagactttaagacctttgtagataagcgtagcttactacattgttagatctcagattagtggttttttgatgcagaagaaaatggctgaagatctatcattttgcttaagtttcttgggctcttttgtttgttgttttgcagggtaaggttgttccggatggtgagaaggaatttgagcattgtgagtatggctcagacatagctacaagttatggagctggtgcatttgtgcttctcttcattagtcaagtcattattatggtggctagtcggtgtttctgctgcggcaaagctcttaaacccggtggttcaagagcttgtggcattatgctcttccttatttgctggtaaaactctatacttaacacaatctctataatttatgactttgacttgacacatcattctacacttggttttgaacagggtgtttttcttgattgctgaggtatgtttgctcgcgggatcaatcagaaacgcgtaccacactacgtacagaaggatgtggaacatcgaaaaccctcctagctgtgaagtgatccgtaaaggagtgtttgctgctggtgcttcctttgctctcttcactgctattgtctctcagttctattacatctcctattctcgtgcccgagacggttaccaaaccccacattactagtgagtagtgagatccagaacaagaaaagctaaaccctgaatgagtttgtccatttatccactcactgatcaataggatattaaaatttgatgatgttagtcattttgcttcttgcttgtatcacaattgtttttttttgttttcttgtgatgtataaaatcttattaatatagacagctattctacatttcagtatctaagcttattgttacagtgtaagttttatacattttagagttcataacctggaaacagagcttgtgttggatcattcatgtcgagtaacatgtaggccattcctccgataccttcaaagagagagaagggtctatctcctccatgcatttgaccttctgagattaacttctctgatttatcgagtaggaaagacgcgaaagctttagcgcggtacaaatactttgggtttcttgttaaccggtatagagaaagaaacacgtatgtgtttccgctgataccgtgacagattcctactcgtttaagcaatccacggctccacacaacttctcctgcctccattgctgcctctacaaattccttagtgttataaacctgacgatatccagaaaatgagttttgcattgtggttttacttactgataagagtacttcaatcaacaaatgattacctgagctgcctttacaagtgtgagagcaacaccaggagcaccgtgacaccagtgaacaaggcgatctgatttgcttccttcactagataggtaattcccgctaggaaaacggttttgtatcatatagcttagtgtacctttgacatctttgatttcatctggttcaagttccgtatgcatcaaaacattcatgatcccagctaaaccgtgtgcagccccccagtacctcttcccgtgccactcatacatcaatggacaagttcctttattcccgagttgtcttcctgccctgaagatttcctcaaccactgatctctgaagatatagagatatcataaaatcttgaactttcttgagtaagtcaattaaccaaagaaattttataactttattataccattcgttcagatgatatactctcctgaccaatatgcttattcaagaacaaacacgcccacaagtatcctgctctaccatatagcaactcatatggcaagtcactaggaagcctaatctgttaaacagatcaaagttgcaacactcaagcaaagtatagaacaagttatctattttcactagagcaaaagaaactgtaattagtaattacccctcggaaacgggctaagtaacgatcatataactggtcatcacctaaacacttcgctgcaacagcaccaagagcacatacaccagcatagccacatataaatgtcactcgcctgatagaaaccacaatcattaccccgaaatgaattcatgaaaattggatcattgaagaaaattcacttactcagaatctcttgaagctacatcacaagcttcaacattctctaagcatagcttaagatcatcttcatttctagtaacctgataagatttgaacaagagataagctgtcccaagaactccagtatacaagttataatctcgaacacgttttccagatcgttcccatgtctcccagactacctaaaacagaatcaccacacaaacaagagaaaacacaacttcactagactaaagaaaagtcataaattcattataactacataacttcattataactcaaaatcatatataatcaaattgaaaagtgagttactttatctttgatgcttagagcatatctgtgaagcttctctgagaatgatttgtacggaagtgatagcagtttcgtcaacgaatctttacattcggtaacagtttcttcttctccggataaatcttccggtacaaactccggcatctcatttcggaaaaaccgttctcccatatctctctttctctcagcggttgctgcagaggaccgcgaagaacagagactaacgacgaagtgacgaagtgacacatcgttaccattattaatgggccttaagttaagcccaataatgaccggcccatgattttttctctctgtttcgtctctgaccttaaaacacttgctaaaaccctagagaaaacgtctctacgcggaaaaacaaaaaa

SEQ ID NO: 14314 - DNA, 3000 bp, Unknown
  misc_feature (1)..( 3000): cDNA_ID_2729897_gDNA_ID_2684104_Annot_ID_137125 3000 nt of promoter + ATG
cagagaaaaacaatattacagaaatgccattactatttaattccagcaaggcaataaaaccatatttatttacgaaaatgccatcgtcgtttttggtaaatttgtggctcttgttgcgacggatttgttatcgatcacagatttgttggtcaaccacagattttttacaacagacttgtcttgtaccacagactttactgtgttatgttacgccagacttttttttttcgcagattttttaaccgtgactgatttgtttcatatagtttccacagattttatttaaatttcaaaagtaagaatgttgaaaccaaatctgtcactgatttgttttccggaccacagatttttctttatggtggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaagaaaattactacacagtcacatagtgataacagatttgtttttagtgatgacagttttgtttttcagtgtcaaagcataacagatttactcatgtcaatgttatggccgatttgtttatgactagaataacctttttagtaataacagactttttttggcagatttatttttaaaatttcgaaattttttgttatatgagatttattagctagccctcaattaaattatttcctggtctaattgtatgttaaatccggtttgactggatttttttttttttttttgaaaacgttacgacagacttttattagctgacagatttttccgaaatattaccatatttgagtcaaggaatattctcgtaacgcctagggttttcttacggcagatttgtttatgttatttccatatttgatgtttaatgcattaaattgacaataaagtgtatatctttctaaaatcaaaatttttggtttttttccttattctacacatatcaactatttcaataagatcttttgattgcgtttccttttatcaatttatatttttaatttatatttttaatataatcttaatttatatttttcaatttatattcttaatttatattttttcatatcaataagatccagtttttttcgggatcttattcatttatatttttaatttatttgattcataattcgttttttttttgctaaaaatatggtattaaggttgattaaggttaattggtctttttacttaaaattggagtcattttagttaatcattgccaagaggagtcattctagttatttttgttaaaattagagtcaatctgagcaaatttcagtaaaaaattaaagaatcattttgagtgatcaaaatgacatatttaaaaacgttttcaaagtagaaaacagaggaaatgctctccatttgcaaaaaaaaaaaaaaaaacacttagaaacatattcacaaacatctggtgaacataaaactgtaagaactcaagaaacagagtaataacttcacagagaaaaatctagaggtgtatgtaataataccaattcgttgcctagatccacaacaacatcttggtaactactcttcttgccttacacatacttctcaaaccagctacaggaaaaagtgcacaattgaacttagatgtactgaaaattcgagatttctgctatgcataagcctatatgaccttaacaagcgaatcgctaatacaagcgaatcgctcgtacggtcaccaaatcacgaccagagagaaagacccagattgagaaatagaagaatttgcccaactgaaattcgggattttgtcaaatcgatttcgcccaacaaaaccaataaaaataaaaacttttgttttccctctttgtcaaaaaggtttttttttgacgcccctcaacttgagtgaggaagagagatagagatcgaattctgatctgaaagaggatgaagaagagagaatctcagccgttagatacaattactttgacttaaagtcaaatccttcttcttttattttgaagacacaagttgtttactttttttcagttgttgcaataaattgaagacaacaaaaaaaacgtatcattgattcatcataacataaagattatacaaaggacaagatttgagaccaacatatgttattgaatcaattgttacaagttatactagattttatggccaaatggaatttctatttttaagaaacatgttatacaaggtataccgtacaagttatacggtgagtgcatatggccaaatcgaatttctatttttttgtgagttgactacaaaaaaatcccttataattcacatgtttaatcacttatcactatttctaatggcagcaatagtgatgtaaatataatactaacctgaacaaaaacttagtatacgtataaaatacaagagtgggacaatgacctatagtgatgtacgtaatagaaatagtgatgtcaatataatactaacctgaacaaaaagttgattaaccaaacttgctcctcatttcttggcttttattcctgaaatattctgaaaataaagacataaatttagttactaactgatatacacaaatattaactaactcaatcaactttccaatattttggagatattgataatctagagatatggattaatcttttgacgccagacgttcggtagtagtatatttacattgagtttaataatgctccaccttcgagacatcaaacactcataaacaaaaaaaattattgtgttcctaaagacagatcttagaaacacaatcaatcctttatgaaaagctgaaatttaacaaggtacacaaactttccaacacattccaaggtactcatatattatatgtatattaacttcaagatgaatcgtgtgatttattgagatgtgtcatatatatttgcaaattgtttactaaaacacctatattcttatatgttcctcagcaaagtcaaattcaa

SEQ ID NO: 14315 - DNA, 3000 bp, Unknown
  misc_feature (1)..( 3000): cDNA_ID_4254781_gDNA_ID_2684104_Annot_ID_190375 3000 nt of promoter + ATG
atagtgaaagcgtgcaatgcttataaaaatggagctcttgttggatcaatggttaaaggcagagactgagtccaagaacgtgaacaaactagccagagcggctccaagaagtttaggaccgatgtagctagctttatgaagacattggttgatgaattcgttaatttagagcgaaaccaaaacgaaaaccaaaaccatctgagagcaatgctaacaaagagacccagagcaataaaacaaaccttaggagaagcagattatcgaggtgagccaaagctgccaaaccagccaaactgtcaaatattatttaaatataaattttgaatatttttttaggatgatctatggatatatgatatcaaatttatggtacaccgcaagacgatattttataactaaatatttaaaattttaagttgtatttgttttgctaatattgtttaaattgtttaatgtttaaaattgtgtaattgtattttaattgttaattttaggatttcacccgtagtataccatcccgtattaatattcactcaaacccgtcaattctaatatttcatctgttgtataaagtttaaatatttataatatttaaacttcttataaaagaatcgagatgcatctgttgtatatgttttgttaatattgtttgcgagatgcatctgttgtataagttttgttaatattgtatgttttgtttagtatttaagattgtataattatatttttgattcttaattttagaattttacccgtaatatattattctgtattattattgatccaaagatcgtcaatatatgattttatcagtagtataaagtttaaatatttataatgtttgaatttcttataaaagaatcgagtgaacttcagatcatataagaggagcttctctcataatattagatgagaggagcttcaaacaacatgtactgaaatttaaatttaatccaaaagtaacctgatatgggttaaaacggaagtcatatgagttgagataagtttgaaatcaaagagtttgaggcatcgtgggagatgatggattcagggaaagtttgtggccgaacgttttcatatgcgaagagacgatttctttctctatgttttaggtgacctggctaggtgtaggtgtggcatcctcttacataattttcattttgcttgagagacctaaaacaactacttttattagtaagagatatagattattcatgttaataaataattaattaattactattcataattttgaatttaatttttgcaattaatatttatattaaaaccaatttaattaattttatagaaaaatcgtgagaaataatttatagggaattggtagaagatagcttttctacaaaacaattgataggaaatcgatcaaaacatttctttctggttccttgcactctttcctacttctgaaattttgtaatgacatctgttttacttaggtttggtttcgaatgaattgctggttttctcgaaaacttttctccaaaccgggttagcggggaaagatatggcaaaaatcatagatttaatgacattactattcctctgcaatttatgagaaaataggacattagtgttctgtttctgacgaaacctcccatatgcaaaccaaattataaggtgaatcaatgataggtttcattggcaaattggtttcaattaaatagatatctcttgaagaagagacaaaatatctatgtacagcttacgcaacaaagctagggacttgtcatgattctggtagatctttacgacaagtaggacatgtgagatgattcttaagccaagcgtcgatacaaagcgcatgatagatatgtctgcaaacaggaaatactctgcattcttcattaacgacataaccactgagacaaatcgcgcattctcttgattctagtgacttttcttcatcctcctcatggttgccttgtccaacaagcaacttcggtagtagggtttcgatcacgctttgtttcagcccgcgcttttttccttctctctcgaaatctggtaaccgtagaccggtcgagatgattgtgtggtaggtaacgattctagcacgttgttggcctctttgtactccgatttcgagatctaggtcgagacatgttcctaagaatggtcgcagaatgcaatcgatgatgacgtagattacaagaatgagagctgaggttgcaatgagaacaacgagcaagatgcagagaccgatgaaaacagcgagaccaagaacgctgatgagactaatcgcatcatcttcttctgagctcatgttgattcttacaagaaacaagttccaagggttttgtccaaaatggtgattttcaggtgacaacctaaagatttaaacagctatatatttttagtcatgatagcttgttgtttaggataaggcagtgaggaaggatttgtgtgtattctaagtttagggtttggtttcaaattcatatctaaagttttctgatttttttctctcaaaattatcctaaatcgttagaaagagttccattccatttgatctgttatttgcacacaaaagtcctacatgttttttaaaaaaatataaattatgttgtggatttggtcaaaatttctttggtgatttgaaaatttttcattttatatttaaaaggtaatattttcttaatggtgatacatatgaccaaaataataaaaggatacatatatgttgttgttttttaacactgatacatatatgttgttattcttttcctttgtgtctgaaaatattttcactttatttttgacaaaatattatttacgcaaaaagtgttattaatccaattagattccataattaagttattcagcaaattgacctttgtaaggaattaaattggtcataaagtctaattaaaccggtccaaaccggttctgttctcgctggctcggccaccgcttttcaacagaacaatctgtctttttctctgtctcactctctcactcactcaccggagcaaagtgatg

SEQ ID NO: 14316 - DNA, 3000 bp, Unknown
  misc_feature (1)..( 3000): cDNA_ID_2729889_gDNA_ID_2684104_Annot_ID_190373 3000 nt of promoter + ATG
gtttacggaaatacttttatggaggagaaagacccaaagttctttcaaggaagagcgattctttgtcctactaatgaggatgtgaattccataaacgagcatatgatgagtatgttagatggtatgttaaactttaaccaaaaactattgtattttcgctgaaattacttaatctcaaatagcgtttaactaaaatttggtattcattatgtttgtaggtgaagaaagaatctacctaagttctgatagtatagaccctgctgacacaagttctgcgaataatgatgcttattcagctgattttttaaacagtgtcagagtttctggattgccgaaccattgcttgcgcttgaaagttggttgtccggtcatgttgttgagaaacatggatcctaataaaggtttatgcaatgggacaagattacaggtcactcaaatggcagatactgtaatacaagctagatttattacaggtaatagagttggtaagattgttctgattcctaggatgttaatcacaccatcagatacaagattacctttcaaaatgaggcgtaggcaatttcctctatctgtagcttttgccatgaccataaataagagtcaagggcagacactagagtctgttggactttatttgcctaggcctgtgttttcacatgggcaactatacgtggcaatctctagagtgacgtcaaaaactggtacgaagtttttttaagccaccattttaattactataatatgtatacgattattaatcttccatttatatcaggtttgaagattcttataacagacaagaaaggaaaaccacagaaaaaaacaatgaatgttgtttttaaagaagtgtttcaaaacctacactaagacagtcatggaaagaaagttatgggattcctattcaaccaggttaataagttaagaaatcaaaaacgtttttcagtttttttatagaattacattcaacgtaatatttggcactaatgaaattatttaacaaattctatctttcagatttagttgcatcaaatcaaggaataaagatgctcaagcactgtcaggacgtgttaaatggaataagagttagtaaaaaaaaattgttggattttcttaactatgttatagttcgaaagaaacttatggttttttaatttctttattactctgattatgtctaatattcgaatatgagattgaatatttctttactatataaatacatgacgcagtcaacatcatccattcaaaataagattttaggaatcaggtgctaacctttatacacatattaggatctgaagttgatgtcgcctgctacttcatgtttagtttgtccttcttatatagatttacactaatccaaaagcttcagctggtgcaaacctgcatttaaatttgtaacagattagagttcttcttaagagaacttacttgataatataacaagttaaaccttaagctgtcttaaacatataagtagctttttcaatctttaaatagagtaattggattctcgaacagcaatatataatatactacttacctttcatgtataatctttaaatagagctattggattttgatggtcgtaagaagccgcagtcataggaagtcatgtaatttccaaacaatttttttttgtcagcattccattcagttttaggtatagttttttatttattaaatttgtaaataattaaattagacataatagaatctagagcctatatatcttcattagaccatattaggcccacgactaaaaccaacacacaatacataaacaaattcaaagttgggccaaaaactatatgttctcaaacaaacaaatcatttttctttccaaataaaatacgtaatatagcttggatacaaaattttcacatttaatataaactaaatattatatatttaatataaatacgatattttaaaacaaagacaatctaatgcaacattaatcattatattcaaatagtaataaaagtaaaacatattatagcatcacttttacacttagataattaaaacaaagtattcaattttattcatgaaaaatattaatgcccgtgctgtatagcacgggttatgatctagtgtatgtataattggataaatataactttttatgatcattaacttaaaaatcaagtttcaaaagcgagaggagcaccaatcttagcagcagtggtctcaacacatttattccacatccgtttgctcctaggaagaatcgcagaagcaacatcttttagctcataagtggcgaacacaaaagtcatcaatccttcgtgacattctcttccaatcttcaaaaagttcacacaacaatcctccgaaacgggcttgtcgtcgatcaatccttccgtcatctcaacattgcatttcgagctcattttatccgaacaatcttggagaaatttgatgcgccgggtcgtcatgtggcttaggagttcgtggtcgtactcgtaagctgcagcgggttcgtatgccaatgattcaggagatattggactgatctcttcttcttgaccaatagtttgataaaccatcgatgtggtggctatgagaaacgttatgagaattgctttctccattttctttttcttgtaatgaagaagaaaagctttaacgaagtagccttttaatggtttattaatttgtaacgagtaacgactagctttttatgtttctggtcattaaaggattgtttgatttttttgacatgtttacatatgttacttacttgattaataattaagtcacatttcagtttatacacattttttcatgttcacgccaaatgcatagacttagaaggggcttttgtgttataatgggcctatgggcctatgggccaaaaccattgaagcccattttaagaggagactcacagcaaaccctagcaaaaacactcgaagccactctgtttcttcttcctcctctgtttctttcttctcttccatcgttcgccgttaaggaaaacaaaaatcagag

SEQ ID NO: 14317 - DNA, 3000 bp, Unknown; identical to SEQ ID NO: 14313
  misc_feature (1)..( 3000): cDNA_ID_2729909_gDNA_ID_2684104_Annot_ID_190366 3000 nt of promoter + ATG

SEQ ID NO: 14318 - DNA, 3000 bp, Unknown; identical to SEQ ID NO: 14312
  misc_feature (1)..( 3000): cDNA_ID_2729923_gDNA_ID_2684104_Annot_ID_190360 3000 nt of promoter + ATG

SEQ ID NO: 14319 - DNA, 3000 bp, Unknown; identical to SEQ ID NO: 14311
  misc_feature (1)..( 3000): cDNA_ID_2701811_gDNA_ID_2684104_Annot_ID_190359 3000 nt of promoter + ATG

SEQ ID NO: 14320 - DNA, 3000 bp, Unknown; identical to SEQ ID NO: 14310
  misc_feature (1)..( 3000): cDNA_ID_4254789_gDNA_ID_2684104_Annot_ID_190345 3000 nt of promoter + ATG

SEQ ID NO: 14321 - DNA, 3000 bp, Unknown; identical to SEQ ID NO: 14309
  misc_feature (1)..( 3000): cDNA_ID_3438233_gDNA_ID_2684104_Annot_ID_190343 3000 nt of promoter + ATG

SEQ ID NO: 14322 - DNA, 3000 bp, Unknown
  misc_feature (1)..( 3000): cDNA_ID_1989254_gDNA_ID_2684104_Annot_ID_190342 3000 nt of promoter + ATG
atgcttagaatacggataaagtttaaacttcacagtgaaattcagttgagataataaagtcaacccgttatatttactcatgttcttcaaatcgactaacctttgtaccaaaaggactttcagggtggtcgatgtcaagcagcctccttccctatacaaggagaacacaaaaaaaaagtcaaaactaagtttctgatctccgaaagcaacatcgaagtacactatactctttgtcaagacgaatcatctacagtagatatcaaacaatatcaatatcaatttctcttctcatctcatactctccgtcgacgatcggcgcattactttatttactctgtttttcttatgtttttacgttgtttagtttaagagataagtcccgagcttatcactcacctttgtgggagaattgttcaatttcgatttgacttggcacgtgtgagacactcgcacatgcgaatctaaggttcagtaactggatgaaatttactgaactctaggaattttttaaaatcataactataggaagaaacaaaaaatgtggtcttaactacaagaattatcacatttttaacgataaattatacaagcaaagaaaaatctatcttgatatttttttagaaataagtatataaagaaccaataaaatccaactgctattttgtttaagtttctaattaatattcacaagctttgttgggcaatattgaagattaaaccaaaaaaataaaacgattttgtccataatcattctcgaccgaccactgtcaccattctaaaatatcattgttttgtatgcaaattgcataaatcaaatggctctttcacgtttaaaataattgtatttcggagaaagtgcatatcaagacattgcaatctgacaaagaaaaaaaagcgtgtagacttatctatctccctaggttaacaatccaatgcatgcgtgtccacctttaaatctccctacacaagcaaaattcagtaaaaagcttgtacgttgattacatatccaacgaaccatatccactttcaatttgttaatcatataaatttgaccctaaaatctatctcattctctcatcaatcttcttcctttaaatccctaaatcttcacgttacttttctatctacattttcactttcaatggctttgattatcacctgctccgctctacccacgatccgagcatcttccggatccggatcccttaacccggatcaaaaccgtaagaaatctgctgcttggtgggctcctctcttcggtttaccctccgatccagattacctcaacatcgaaagctcatgctccaccgtgaatccggataaaaccgatatttccgggtcgggtcaaaagtttcgtcgcggttgttttacggaggagaaagctaagcagttgaggaggaaaaccgcagaagcttccacgttccatgacgtaatgtatcactccgccattgcttctcgacttgcgtctgatatcaccggccgagtcgaggattgaaacggattcgggtcagatctggagacgaatcaattaatgaataattaatcttttttttcttaattcagtgttcttgtaggatgcagaccatcttctatcggtgctcctttttcatttgaaccgttggcttgtgtttggtctttgtgtgttgtaaactctagttccctttctgtttcttctgtaatcaaccgttggatttccacttgttatttttagacatgtgttccctagttagctcttttatcttatctcaaatttaagacattgtgttctctaaatctacatcagaacttgactttggtctgaaaatgtctaaatataacattttctcaacggttatctacttcagaacttgaattcggacagcttttctacttcacaacttgaattcggtcttgttttacaaattccacatagacgaactataatattttgtgacatttctcactgaaaagccaacactaattaaaaccactccagatcttattcttaacgatgatcgtgaatttggttgtgtcgaatcttttaatatagtcgtctcgttgtttcaatgtagtggtgatacatctttcctctctattaagatctttttataatgttcaatgaagaaccacaaaatgtaaagtgtctgtgatctattattcattcttgtaagtttttctctccacaattcacattttctagaatcaaacctcaaattagatgttaaaacattaaacctccaaactggttctctgcctccggtagtcaccagtatcagatgcgctcctccggtgacggcaatgcctttccgattttcctttagtaaaagccctgggccaatttgggatttggccaattattgaatataacattataaactttaaaaaacaaaacattaaaccaccaaacgaaattttaatttatttatttaagaatcatactttgttttactttattttcaaaatcatgctgacaaaaaaaaaacgtacagtaaaatacactactgatttacgatttttttttctaaataaattatttacaaatggtattgtgaattgttttgtcaattacgaaaatatagggtcgcttattgcaacatatgaaacgtataggaactaaattaaaaaatacaaataaaggtcttctccttcccgtctagatgtagaaatccctaaaacttgctactgttttgcatacggggcttgtacaaataaaaaccacccaattcctacgctttcctctacaaattgtccccttttttttttaacttttatactttcaattcatctttggttctgtagaattcccaggaatcagcattccactgtaagctactggtttctctaattaactgtagatcgatcgaacttttatagattcgggattgtttctcccaatatttctgtagaaattactacaaaaaaaattagattttcagctactctgagtctaccttgaatcgtttgaaatcgaaaaccctttcctttaatttcaaagagtcgcttaattagggtttaggatag

SEQ ID NO: 14323 - DNA, 3000 bp, Unknown; identical to SEQ ID NO: 14316
  misc_feature (1)..( 3000): cDNA_ID_2729889_gDNA_ID_2684104_Annot_ID_137127 3000 nt of promoter + ATG

SEQ ID NO: 14324 - DNA, 3000 bp, Unknown; identical to SEQ ID NO: 14315
  misc_feature (1)..( 3000): cDNA_ID_4254781_gDNA_ID_2684104_Annot_ID_137130 3000 nt of promoter + ATG

SEQ ID NO: 14325 - DNA, 354 bp, Unknown
  misc_feature (1)..( 354): cDNA_ID_3016084_gDNA_ID_2684105_Annot_ID_190480 3000 nt of promoter + ATG
gaattccaaatcacaactggcttgaactgtgataagcttccaactgattctgaggtagaagatcaccaagaccctgcctatctatctgtttggaatcgcttatttggggagaagtgtgtagttacagtcatggatgttgttgagatgctgagaggagatgtcaatgctgagcctaggaagtgattctcaacatggaagaagttgagtctcgcattgatagtcctgcttgatggggttgtagtttgcagcaacaggaaacaacatcgggtaagtagttcatatgttgagatgcttcatgatttggaattctttatgagctacccatggggtcgagttgcttttgaatcaacaatg

SEQ ID NO: 14326 - DNA, 3000 bp, Unknown
  misc_feature (1)..( 3000): cDNA_ID_3016070_gDNA_ID_2684105_Annot_ID_190484 3000 nt of promoter + ATG
ttatgtttaattcaaatatttatatttataagtttaggatatcaaatttattcaaatatttagtatatataagaaccaaataaactgattgcccgtggtaaaccgcgagttaaatcctagttagtatgttatgcgagtgaattttttaacacaagttgtttatcaaatacatgttttagtcgcaaagaagtcgcaagtaaagggttttgctactgaatagtgacttcttatgtagtcaccagttatctcattttttgtcctaccaaaaaaataaattagttgtttttttgtagtatacggttgcgaacttgtttgtcaaggagttcgattaattaggtctcgatgtgggcatgtctccatgggaatgagcattccactctctccatatgcagtgaatcgaagcttggaaacgtaccagagcaagaacaattatgctgtttcaaaggtttgtttcaactaatggtgaatcgattcttgagaagatgtttatatatcattttaaatgttccttacttacatgtttaatttgtgagataattatattgatctgctaacaagttgattgaccctcaaaaaatctttgtaaccaatgtttttttttgtttttttggcatggattcaattttaggttaaactctttttgtaaaacctcaaacttttattttatatgccattcacattcctatataaaaaaaaaattcttaaccaataactaaaaatatttaattgttcgtataagttttcaaatattgatcatttggaaatcctcaaaaacaagtaattaactctcttttttgtgtgcaaatgagtaattaatgcttaaccatcaatttttcagaatataaaggaaataaagatagccaaacgaatttaaaaaactgcttatctaggatctccctacaaaaatagttggagacatatacaataataggacgggtatagtaattttaggttattaaaggtattttttgtaaaagtaaaatgttatatttgctttactgatgttaatatgaccgaactataaatctgatctctttaaaaatgttgaaaattagtaattaattattacttgtgtaaatcaaatttggtgaattaatatgtgaacacaatgatgagttttacgatgaaagaatacgaaaagaaaacaaatgattccgttggatatgacacttataaataatgtgcatatatacaaatgaaataatacagaaggaaaatgacggaaaaaaagaatacgtatggaaaacaaacaaacaaattaaatgtgctctctattgccaaaacgtctgaactctttttatccatcagaagattcatgagtgtatatgccggatttttgatgcatcttataatctattccgatagctcattagcattatcataactccacaaggtctttgccagtttgcttctaggttgcgttccttcatctttgtggcataaaaatatttatagaaaatctaaccagaaatgtagaattcccatcaacaaaattatattagagccaatagagacatatatgagaatatattaaacatacatggaaatggatagtgacgtggacttgtacgaagaagctctcattgtgttcttgaattagaaagaaatgctgagaaatgatctcttgatcttgaaccttgatcggatgaattttaaggaatattttcaaggactctctgaacattgcagaactcaaaataaggtagagaaacatacattatgtggaagtagagatatgtgggtcaccttaatgttccgtttctcattctcactgcagttgatctttaattgcttcacctgttacagagactttgagggttagtttatatatatataagagatgtgaatgaaactcacgttgtgcttgagttcgaatatgtagagctggtggtgaaacgtgatcattttggaaacagagacaatgaatctgagacaaagagaagtacgtaaacaggaatatcatggatcatagatatataagaaaaaaatagaaatcggattgtcgaagtgtgagagcgagatatgaatttaactccaacgtgaattggtttttagaggaagatgaagggttttaaattttttttgatctggtaccaaacttccaaagatcgtgcgatcgtggtgtggtatgcgagaaaattaagggaattttattttcaaaaatatttttacgtggtttctatcatttaccaaaactcgtttaatttatagagatatgttgagaaatgatacgttttttgaacataattaaggaactagtacggttcctattcataattagagattgcaccgggcccaccgttctgtgagatacagaagtcttgagatacaaaaaaaatgggccatattagcttttgtggaaattacggtaagggcctttctttgttttgtagaacaaatcaaaccctctagccgagttctggtttttgtctacggaagtcagagtcaaagttgataattcgcagaaaggtatgggctaaatgaaatcgttaatgggccttaagacaaatattcacatttattatcgttgtttgcaatctaaattgacttcttcgtcgtcaaaatcaacgccggagttggagctgagagaaactatggcatttatgagcgtatctaatcaacgaaattagttaacaggttggtgaataaaatcatataatactcagattctctttaggttttctcgagattagctaatttttttggagggaatttttagattttttttccatggttaagtgttttatagcaaacaaataagaggatgattgtcagtttgggtattgtatctttattgctaaggaccttcaactcagataatttactatggaaggtgaaattcagaacaagaaatttttaaatttagttcttactaatgttttaaagttttcttccgtagagactgactataatggaatttcatttgcagtggatgattttgttgttgttcaagccggtcgatggattttgtatagcacaggtgaatgggagttcaagatg

SEQ ID NO: 14327 - DNA, 3000 bp, Unknown
  misc_feature (1)..( 3000): cDNA_ID_3016052_gDNA_ID_2684105_Annot_ID_190489 3000 nt of promoter + ATG
aaagctatgtccttcgaatctcaagctcaaaccggcgtcgacggcgatgctccctagggtttttgtgaaggaggcaagaaggaggaagagggaaaaaaaaaaaaaaaaagttgaggattcgaacccaggtatgttgtggtacaaatatcgacttgttaccagtagactaaagtaataaaagtgtaatatatatttattcaaatacgcaaagataaattaacgccatccaacaattttgtaacgtccgttacggctgttaagttgttgattcgaatctaccaacaatttatagatgatatatttttaaaccaacaatatataagtgaggtattctaatccaaacaaaaaagtcttaggtataaaacttcaaaatcaaaaatagtttgggttttttggtgtttttttccaatttaatgtaagtaaagaatttactaaaatgtaagattcacaaaggtggtgtaattctatttatgattaagtggttttgataggttatacatttttttggcacaaaacaaagaccataacatctatgttatttataatatatgtctttaaagcggagataaataaagcaaataaattatttcattgttgatctttgttttgtgacaatgtctaaagagacaaaaaaaaaaaaaaaacagaaagttacatgaacgacaattccaatcctctaaacaaagatcggatgaaatcatgaatccgataatggctaatcttcttctccttctcatggcaattctctggggaaaaggtaaatcgctgaagaatctaagagattctaaaatctgttcaattttcaattgaagtgtttattttttctctcttcacgggaaatggaagagggaaggtattgaagctcatggactcaaatcgattgatagaatatgataataggtttttagtcaattatgctaaaacaccaatcatttcgttgtagtattttaggttgttaatccatatgggtgtgatgctagcaatcaagatgcaataagagttcaaagagtcaagccaagaaataacaggttttggggtttctaagaccatcattattgattttgaaaattttgttgttaagagtttagttaagagattgaaattttagtaatatgcaatggtgggatcttagcttgaagttcttaagaagaaaaaaatttatttaaaaataaaaacattttaattttaaaaaacttaataattattataacttatatacatacatgacattacaaaacacaaaaattttaatagtttaacatagatgatataacaaattgaaaggcttatcattcataaagactaaccaaaatcttgttttcaatgccttatgggcatataactttttaaaaaagaaatggttgataggttaacatagatgatataaaaaataagaacaaaatggtttagttatttgacatttctaattcatttgatgagattgaaatttgaattgattttttgctcctttaatatttattatttagccaatcaacaatagacagttgtctagctcttaacccttagttttgctcttatataagagctattcttagcaaataaatcaatttaatcattaatttttacatccaattgacctaagaactacactaagaacccaccaataatgatgctctaacactcctaagtgaacatgtaggaaacagaaattcaagaagaaacagtaatacactcgaccaacacagctcgttgcctagcattgggtgtggtcgagtgacaggtcgagtaacagacagaaaatgtaacagggatactgtgagagtcgaaattcacacaatagaaattgtactaagggtttcttcaaagaacggacttttgtgagattctcaaagaacaacagagttgttggttaccgcggacagtgttcttgattatattattgagataatgatgatttgatcgtacaagtgtttagagatatgaaatataagtgttttgccttcaaaatcagagcgtttttgatagcctgaagttgagagcgttttagtgcgtatcctctttttgtttgtccttagaggtgctttatatagggctttggcagatcgcttctcacgatattctcggaagatttctgtttatcttagagtcggcgaaggagattgtctttatcttccgaagattgtgggagcttctatattcgataatatcctcggagattctctaatatctttttcgagcttttcggaaatggtatgtcgatcttgtattgattaagtcctttcttcgggtgaaggttttctgacccgatccgaagtttcttccgagccgggttgagctgaccctcagatcatggttgagcggctcggatcgcaatagccgaatgatgcgttcccgaggtatcttgaaaccccccccgggatgattttccgggttggcatccgaggtatttcgagactgggtcgaggaaaccttctgcggtgatgctccgaggcgttttcaaggtcaccttgggatggttcctcgacgtgatctccgagatgttttgaggccagctcgggatggttcttcgacgtgatctctgaggcattgatcatggtcggctcggttacctgggtgaaatccgaccccaacagatactagactgcacagtctcttaccagacaactgggtggtcgagtatcaggtcgagtaataggcaaaaattgcaaaaactaagcaacaggtaacaagatgcagtaaacaatagcagagtaaataagaaatcaattaaatgagaaattcccgaggatgggataattgagtagtttcgtttccttagtttacaggtgattgacatgctcaataaattatccatagacaacaaggttttcgaagaaaagaaacaaggtttgcttcttctctctgatcttgatatttctattgttctctctttttccggtgagctccgccgtttctttgttatttttgatttttccggtttagaaattccttgttttctggtcgtttctcatctcgtcgagcatctccgagccgagtatg

SEQ ID NO: 14328 - DNA, 3000 bp, Unknown
  misc_feature (1)..( 3000): cDNA_ID_3016045_gDNA_ID_2684105_Annot_ID_190491 3000 nt of promoter + ATG
cagaaaaaatgtgctgactactattttaaatttaaatatcatcaaaaagttatagttaaagttattaagtgtatagcaaaatgaaaattgtaagattaaaattcaatttaaaaaaatttactaaattatatatttaagaaatagagattatcatttactatttagaatttaaatatcattgataaaatttataattgtttttttaaacccgcatatctaggcgggcctaacatagtatatatatataccacaactaaaacatattattaaagtttgttttgtgttgttaaaaaaaagagtattaaactttttctttttcgtaaagagtttaataaaattctttacaaaattgtattgcttgaagaagtagctagtgtttgttatttttataacgaggtagcaaatggacaaagcgtgaaatcgacaaatgacaaggttaggatgaagagagaaaatacgatgaagaagacaaattctgtacaacataaaacagcggaattatttgaggtgaaaagttagttggagggttaaagtatgcatctttactgatggagccgatgaatatttttcttgtttcagacagaaagcaaccaagttataggagatgaattggaaactaagcagaaagagttgaaagaacttaagaagcgttaaagacaatgtaggtaaaataagagaaagaggactatttgagtatggtttagtattattatttctggtattgtaaaccggtacggtataaataattcaagtatgcaatccagattcattaatgagaataacgatcttcgtaacaaacttttcttcttcgttctctccttccatggagattctagttctctaacatggtattagagcgatgaatccttaaaattcatccgattctagacctaaatctctattttatttctctttcgatcaatttctacggttgtttccaccgtaaaattgttgtatcaatcaaaatctttctcagtttctttatcctcaacgtattttcgtttttccgatggtggttactcacagaattaatcgtcgcatgatgataagtgtgtattttacatgttttgagcatccatttgtcatcattttagcatcatatcatcactgttttataccatttctcatcatttgtcatcactttatagatttgcatgcatgttgcatatttgcgttgatttcaggtgatttagagctgttgacgagctatctggaagaagcgggccggatcatgtcaaaccactcgaccccgaggtcgagtagaagcttcaagatctcaacagatcactcgaccccctggtcgaatagaggacatcactacttcaccacatcactcgaccccgaggccgagtgtcttcaccttcattgctagaacactactcgacctcttcactctacctggaagtcgagtatcaccatcaccaccactcgactgcatactcgatgacaaacttcagagccttcttcattccgcactcaaccagacactcgagcacaaggaagaaaagaagactccagctattcactcgaccacccactcgaccacatgggtcgagtacagttcttaatccgtcctaatactgcgtcgttttaagtattagggtttcggaacatttggctataagtatcatgtacttcacattttcgcagacaagtttttatctagttttattccgcagaccttgtgttctagaccttttgtaatctggatttctctttatctattcagtattcagtattcatcttttgttcttgatttcgtttactgttgttcattctgttatcatcctgctgttacactgttgttatcatgttttcaacttgttcaacgtttacgcttactgttatgatgtctgagtagtgaataggtttctgaggatgggttaaagtagtgtagaattctcagtatgctaggtgattgagtattggttgatagatcccttctgaattagttgttcttaatgcctattgctttctgatcaactggaatttgagtgcagacatttccgcgcccaaaaggtgtgcgatgaaatgtctgaaccactaattccagagattcgtgatcctgtaccaaggtattggttgcagggagcgttttggctttaacttgttgattcgtaatgcctgttaggttagctctcgtcaatggtgattgagtctgggactaggttaacttgagagtctcttttgcggtggcacttagatttggttaatgaacttgttgtctagggttaatttattgagcatgtcaatcacctgtaaactgaggaaacgaaactactcaattaccccatccttgggaattctttatctgattgaattctttgtttactctactgttgtttactgcatcctgttatctgtcgcttaatttctgcaattctttctatttactcaacctcgtactcgaccacccagttgtctcgcaacagactgtgcagtcgagtatctgtgttttattttctgtctgttactcgacttgtcactcgacctcacccagtgctctgcaaagagctgtgttggtcgagtgtttcactgtttctgtttgattttctgttttctacatgttcacttaggactgctagaacagaccaaaacctgttattgcttggcttgacttagtgacttctgatcacatcttgattgttagcatcacacccatttggattgacaacctaaaatactacaacgatatgattggtgttttaggataattgactaaaaacctattatcaatttggcgccgttgccaattgggtgtttgtttgttacatttgagattttagacttgcttagatcaagttctttttcaattttcttttcggttactaacagtgtgtttttcttgttgtcttcttgatccaggtacacctctgctgtatgcgaactcgatcaacagacaattagaacctccttttcaacgacaacatcgaccgcatagctcgcgaactcagagaaaggagaaacacagtcaaccctgtacctcaacaaccactcgat

SEQ ID NO: 14329 - DNA, 3000 bp, Unknown
  misc_feature (1)..( 3000): cDNA_ID_3015992_gDNA_ID_2684105_Annot_ID_190506 3000 nt of promoter + ATG
atcatcttcgttgccttcctccacttcatcctcttctgttgtatcgtcttcaacatcggcttgtttctctacatcctcattattttcatcaacatttgtagcactatcaaacacacggtcactttcaaaaacttcaccatgagacctagagacagtattcccgaacgccttcacggtagtattgaaagagacgaacaagttgagagaaagatacccaccacgaaccaaaaaaaacgtatcaagacccatctgactgtcaatgtatacaggagggcgtttagtatctatcagcactgacatttctcccggcatccagtagctaattatgggattgatctcggtggacttcaaactgaaagcgtctcggagtgtacggacaaagtccgtgtacgtcatggtttcctgaacgcgtacacaacgaccaaacatgccttcctcaggttcaaatttccattctccttctttgcatttccactcaccgaccataacccacctgcatcataaattcaggagacacacattaaatgcaactgaaaaatactatacatataaaaaacaaatggaatgtcgatactacacatttataaacctaaataccaattatcatttgactattttaaacaaacaaatatagatttttcaaattttctgataaaaacatggagttcgaacacaatcaagatcctaatatgacataacaaaaaacttcttaaaagaacttcgttacttacacgagcaatgcttgttttggctccaaacttggtacaaaaacaagatcaacacttcttcagcaacaatatacgttctcaataattctttattcctgggttcatcttctttatctcaacaattattatcaataatttttttaatattatttgatgtaatgatgattttgcattaattgtgacaatagtcacatctaaactttttggagcattaaatgttgatgtcacttcggaataatggaaataatctcacttgtaacggaaccgaatcgtgtcaacgtgaaacaaaaaatcttcaactgaaccagaacagtgtacgtaactaaacctgttaaactaaaccgtacatttcaacagttactaagagagaagcgcaagggcagaagcgtcattttgcaggcgaaaagacaaatggtgaaaaccacatttgactttgacaatccatggaaataaaacatggtaaacgggagggaaaggtctttaaacaaaccttacaaggtcttaaatatctctagaaagacacatatctcacctttattcttttatttcttttttattcttatttttattaattttatagttaaataccatttatttttaggaataagttagaaaatagtacgtttcccaaacttaattggaaaactagtacatgtactatttataattagtagaatagtcatagtacgttttgtttttgtttggtgaaagagagaggtataagggagagagatagcgtgtgagagagagtgggtcaagtgtgtcaggattttatgtatagatatatgtatagatattatttgtacagtgttcagtaatataaaaacaaaaaattattaaacaaaataaatatcaaatgatagagaaaaaaacatagatttttatatctaaacattggtcttcttttgtacagtggtctcaatgtaagaaaattttaaaaacgtacttggtttcaaacaaatatccttctttacagatgcatttcatcatttgatagcgcattccagatagcggtgtacagttagcgatgtaaagatagcgttgtgcagattacctaaaattctttcaaagtggcaagtattactgatgaatgcataactctttttatgtattatccaagtattatttgttatgtattttaatttaatttgttttctctctaaaaaaattgtttttctttgagataacgctgtacagatagcactatacagatacaaccgcacagattgcgccgtgctgattgcgctgtacagattatgctatacagattgtatttatatctctagtttcacaattatagtaatttaaaaattattaaacaaaatgcatatcaaatgataaagaaaataacatagatttttatttatataatcaattttagaaaaataaaaatttacaaacgagtattttagttcttaaaattatagggaaaatgaaatgtaataaagaaaaaacaaaaccatgactcactctttctctctctctcacatgttttctctctctcccttaattacacctctctctcacgaaagaaaaacgtattattactatattacatattataaatagtatttgtactactttctaattaagttttgaaaacgtactagtttgcaaagacactcttatttttatgaccaatgggatggtcttagaacaaacaacatatattaccacattaacctccattttgggcaaagcttgagtatgaagtaattttctctaaatccagaagtccaatgtagagtctcatcatcccaaaatgttttatgataatattcatgttagatatgacttgaattggattgggcccttaactttaggcataatcagtttagggttaattagggtttcttttgtataagtactcttcttaacctaaccttcatgtattctgtactctgttttctcaagcaataaaatctgtctctttgcccgtggacgtagccaacaacaagtgttggtgaaccacgttaaatatgtgtcgtgttctttacgtttttgttatcttgctcacatttgttataacaaactggtatcagagcacaaggttctttgttctgtgttcgtcgtgcgaatttcgtgcagtttcagatccgtgcaaaattcgtgtcagagcacaaggtttccttttatgcgtttcgtgcgatttttgggttaaagaaagttcgtgcagatctgtgtagaagaaggtttcgtgcaaaatccgtgcagaaaaagttttgtgtagaatcaggttctaggatttctgcgtttgtaatctggtgagaag

SEQ ID NO: 14330 - DNA, 3000 bp, Unknown
  misc_feature (1)..( 3000): cDNA_ID_3016015_gDNA_ID_2684105_Annot_ID_190500 3000 nt of promoter + ATG
cgttacatatttaaaagaaatcggtttgtggggattcatattcccacaaataaccaagtaaagatattgagtatcatgcattatcaaggaagtgcacacgtgctgaaacagattagccatttcttactggaaatggagtgtcttgaagttgtgaaagttgtcatctccaatggatgacccccaaaaggtgcaactcacaaaggatctattggaacttgccaccgcttcacccaagctcaagatattgaagaatctgttgaagcttgccaccgcttcacccaagctcaagatattgaagaacctgttgaagcttgccaccacctcacccaaggtcaagatattgatacgagatacggtatcacatacacccgtagaggtttccaaaacccgagtccagtcttaaagagtttctagttaggtttttggtgcttttcccttttggattaggttgtttttggttcttcttctttttacattaggatgtgtttgatcgttgagccgaataatttgctttgaatctctgagatcttaggaacagctaatggatcgtagtatgatgatattaagacatctttcttatggttatgaaagaatgcaaaataaatacatgcatctttgtactagtgtatgtatgtaaattacccactaatggtggatgtacgagagaaaaaaatacaagatcaaccattactaggacaattcaagtagccatacatattacttacaacattgtagaaaacctaacaaagttttgtaacagcaaataaataattttcttaactaagacataaaatataactttgaagtttgaacaataatcacaaactatagattcataaaaacactttaaccttcgaaatctgttttaacccactgaacatgtttcacattcatcttctcgtccaactccattttctttaaatccgaactagtcccatcttcagcggtcgagactcttcggttacattttcttctaaaagaatcttcactctcaacatctaacccttcgaactctctaacccaataacaatgtaacaaacaagccagcactagaaccattatctgtaacggaatcatcgccacgaaaacaccacattctactctaaccaaagctttagcctctctagggtctcgagtcgatatcagcaaagaaagactctgtttctctctactaaacaacattaaaactgcaataaactgacccgtcagtgaggaaacatgaagcgttatccgcgcgatgaaacatgatcgagattggtgcgaagaggcactaccgaaagaggagatcagagagacgagtgagactgcgaggaaggctaaaccgagtgaagttggagggtttctaagaagaatgattggtacgaaagaacagagggagaggaggaggagagtgaaattcagacacgatacgagaatgttttggaacaaacataactttctgtgaaaagaagccattgatgttttgtgaaattatgttttttttgtttgtttcaagttttatataggtaaagtaagaaactaagcgcccgttggggagaagatgtaacggctatgatgaggtttaacggttatattgacataatgggcttcacaaaagtattgtaatagatttttgacctttagcctcacgaaaatgacggtcgtatatatttgaattagtaatactattttatcattattgtttacataaatgcctgaaactaaattgcttttttttttcttttcttctcaaagacctaaaactaaattgctactcgaatagaaatttgaaaaggattattatttttgatatatttcatgttgtccataaaatactcttttatgtcaattgtattttttaagcatctaaaatatttaaatttttcttctttctcaattgcaatattttaatattttatttacatatacatagactataccaaaaatcccaaaaaagattataaaaatattgaggtacaatatgagcttataagattactgtttaactgcaaaagaaattgtgtcttgactccatccaaacccacgtgtcaacaactgcgtgcaaaacaacatgtgttcgatgagtaatcgtacgatttccaagatcaaccttggtcgttgggtatatatttcggtaaaaaaatcatcgtcgaaacacaatcgatcattaattcttttatttgtcactgtagttaagccaattgaaactctaataaaaaattaagagcttaaaaacaatagaatatgcatctaaagatttttctttccttcaaaccaagacacaatctttaataatataattaaaacaaaaaaggtaaacataaaacaaagatgtttgaagacaccaaaaataggacggtgaaatttgacacaagtaataaaaaataaggtttgtattaatcaacggaaaaccatagattagaccattagagcattctcattgcataattatttttttagtgtctcaaaaccaatatatttaatattttaatattaaaagcaaactaaccattaaaaaaaaatttacagaagtggacgaaaaaagatttgctctcaccgtttgtcaaagtgagaactggtttttacggtttgtcttttcattcaatttcggaccaaattaccttgggaaaacttaataatggcacaaaccaaaccgtgcagcagttcgtatcggttcagttgatggcataaaccaaaccctacagcagttggtttcggtttagttgatgcggttcagttttgaaaaagacaaaacaaaaaaactgaaacgaagaaaccgaagaaaaagaaaaagagaagagagtaacggagagatttgagagagaattagaaagcgaaacgaaattcagtatccattgtttcaaaattcgacataacttcgaattgttgggtagttgaattgagtcactgaactcccacatccggggaagagaaagttactgtttttcccggcgaagccaagaaaaagttactgtttattccgacgaaatttgaacctccggcgagatagcaactttagct

SEQ ID NO: 14331 - DNA, 3000 bp, Unknown
  misc_feature (1)..( 3000): cDNA_ID_3016183_gDNA_ID_2684106_Annot_ID_190511 3000 nt of promoter + ATG
ctcgtgcggaaatcattccgggggaagagctttagccattaaaataaaacgccaaggatttttctggccgacaatgatcaaagactgcgaaaatttttcaaaacgatgcaaaaaatgtcaaaggcatgcgccaacaatccatcagccggccgagctctagtcatcaatcgcctcgccgtatccattcatgcgatggtcaatggatataattggaccaatgcatccctcgaagcagaaaaactagttctcgtcctgaccaactatttctctaagtggatagaggccgaatcttacgccagcataaaggacgctcaagtcaagaactttgtgtggaaacatatcctatgtcgccacgggataccttatgagatcgttacggataacggctcgcagtttatatcgacccgcttccaaggcttctgtgataaatggggaattcgacttagcaaggcaacaccacgatatccccaaggaaacggccaagccgaggccgccaacaaaacaatcctcgacggattgaaaaaacggctcgatgctaaaaagggctcgtggtccgacgaactcgaaggtgttctatgatcgcaccggacaactcctcgccgagccataggagaaacccctttcgccttagtctacggaacggaatgcgtaattccagccgaaatgatagtactgagcctacggcgaagtctatctcccgagaacgatcctgataatactcagaggctcctcgacgaactcgatctaatcgatgaacgaagagattcagccttggttcgcatacaaaattatcagaatgaaacggctcgtcattataactcaaacgttcgacagcggagattacacgaaggagatcgggttctccgaaaagtttttcggaacaccgccgaaccgaacgctggaaagctcgggacaaattgggaagggccatatctgatctctaaggtcatccgacccggagtatatgagctcgccgacctaaacggcaaagccgttccaagatcctggaacgcaatgcacctaaggaagtactattactaaatccaaggtgacaaaacttgaactacgaggtggcttgatccctgaaaagggtacgtaggcagctcgtctttagacgagttcagctaccccccattaaaaagggggggagtgggtccgtatatccatactcccatttatcatcttgtaagtttttaactttggtgataaataaaaatcaattcacaatttctgaacgtattgaacaatatgatgagcgactgctcggagtatcttttatgcctgctcggcaacagtgcgctatacaaataacgagataaaatctatcagataacctctgatcagaaatttcatcttcagatacccggttatactataaacgccggtattctagctcatttctaaacgctgaaaatgaatcggatcgggtcgcaaccgaaatgtttaattccaaaatccaactgtacttatcagaaaaaggttcggatttaaataaagatcgaaaacttcggaattgattaatggataaagccatccaggcatgaattcataggttctaaacaagggataaagccatccaggcacaaaagtaaaaagaaaatcatcaaagtttattcttgaggctcggaaggaaggacatcagcagccataagctcggacaaaggggaaatcatgcgacctaagctaggatcgtaaagaaatcagctgggccagctcgcccaaagctcaagctaagctggaaggagtgacggttactcaggtcgagttacagtccagctcgggcagctggacgagtgacggttgagctcgaggtagctggacgagtgacggttgagctcgaggtagctggacgagtgacggactagctgggcggttatgggcgaagagatacaactcctcagaaaggtgcaactcttcggaagggcgcaactcttcggaaaggtgcaacttttcggaaaggtgcaaggaacggatgtgttgattcgggaagcatccattcgccccctatataacgaagggcgcccaggaccattccactcaccacaacacaccgaaaacacaagaaactcatcattaaaactctctccctcttgggagaataaatagtcttaggattcggtagccgggctgtggccggcaataaagaaggagggtcggatcgaccaaaggaaggtgagggctcctagactttgagtctaagggttctaggatgtgagttagtagtcggatccttgaaaggattgactagtgggctgggtagtatccgagtcatgtgcatcctacacaagactcggtccgggtagggatcggctgaggcggggacgcgactcggcggaggaccggcgggtcttaactgacctgccgagaatcggccggactgatgcgcgatcttcccctctctgaatcctctccacggatccgagtagtgtatggcatatagagcattgcatggacttgcatatgactaagtaaatgagattacttatggctcaatgactttcaggaacgaatggtgatcgtgggaaggacttggcttaggcgcgagagactcaagaccgggatgatgggtggtgatagttcggatagtttagggatcgattatatgacttgtaatagcttatatgcaaactcataggttgtatcgaatcctttgcttaatcaataaagtatccagttgtttgtttactctattcgtctcatatattgaatcacggaatcatatggaacggattagactaggaaagaacctcataaacggttagggctgagtcacttagtggcttgggtcgagagaactcgtccggacttaggcagtcctgatcggggcctttcaagttggtatcagagcatgcttggttctaggactaggtgttgggttaaggggtatcaccactcgtcggcttgagaatctcgcggtagttgttctttactcttttgcgattttactaggagttatgtggattaactttggaggtttcgcagatgggtaagagcagcaaa

SEQ ID NO: 14332 - DNA, 3000 bp, Unknown
  misc_feature (1)..( 3000): cDNA_ID_3016111_gDNA_ID_2684106_Annot_ID_190532 3000 nt of promoter + ATG
gttacacgagatgggaaattaccggtttcaaaattccgcttgtctcctgaagcaaagaaggcgttgttcgagttggttgttgctgaagtgaagttttcagatggctatgtgtcaaacttttcaagatgcgtagagcaaggaagaaagttttctggtatgaaaagtcatgattgtcatgtattcatgcaacgattactgccatttgtgttattcgagttgctaccggcaaatattcatgaaacaattgcaggtaatatatatatatatatactatatatattcttttactcaattattacttgacgactattaacttacattaaataaatacatgataggcaacagagtatttttcaggaacctatgttcaagaacattgacaacagataccatagaacaattagacaagaatattccagtgttgctctataacttggaaaaaatatttccccctgccttttttgacgtgatggaacatttgccaattcatcttacacatgaagctgctcttggtggaccagtgcaattttgatggatgtatccttttgagcgattcatgaaatctcttaaaggaaaggcaaaaaatcttcctagagttgaggggtcgatagtcgcaggaagtttaaccgaggaaacgtctcacttcacgtcgtattactttagtccaagcgttagaaccaaaaagactcgtccacgacgatatgacgatggaggtttgcacctacatataacgttcctgatgttccagatacctttgcccaaataggtagacttgcagggaagttgaaagaagtttggtgggacgaccatgcgctttctcgagcagctcacaattacatactccgaaatgttgattacattcaaaaatttgaaaggtataaagccatacagttttattcttaatttttttatattttatagtgactgtgatactaattaaggaagctaaagtgatttccgattaatttgtaggttatttgattcacaaatctgtgaagcatgtcctggattagaagaaaaagaatatgaaacttacaaagatcgtgattttgttggatggttaaaacactatacacgtataagaatgtttggaaaattcgtttacttaacaacttataaaaaatgataattaaacttaatattttctttgtatacgttacaaacggatgtggaaacgaaccattaccactttggttgcatgagctcgttcaagaacaaagatctaagatcacaacttctccgatgtacttcactcatggctatactttccatacgtatccatatggaagtcgaagggcaactgcgaattatggaatccatgttgaaggtgaaactgagttttatggaattctacaacaaattctagaagtcgaatattcgggacttttgaatttgaaatgcgtccttttcaagtgtgattggtatgatcctgtgatcggtcgaggggtacgggtaaataacttaggggtggtcgatgtcaatgcaaacaagacttattcaaaatttgaaccatttatcctagcatcacaagcagggcaagtaagctttctatctcacccgcgtgagaggcctaggcgtgaagtgtggttatcggttattaaagttaatcccagagaccgtatagtcggtctagttgatgatgttgtgatgcaacaagaaagtatcagagaagtttccataccaaacataacaacagaagatgttatccacattgacctacaaaacagagaattagaagacatcactcatgacgattccgaagaagaagaacaatcagacgaattcggcgaatctgatgaagacgttgagtctgaaagtgattgtaataattcagaaaatgaatcagaatgaatattattattgtttaattatcaactttttacaaaatataacaaatatacgaaaaaattctgaaaatcttttttatatacttccaattttttaattttaaagtttttataaattcagaacttagtgatttcttatttaaaatttttgaaatttgttggtgttcttattatattttttaaacttaattttaataaatttgcgagggagttgctgggagtgcacgcagattcctcgcaaaattgccgaaaaccctaaacaactttgtgagggatttgcgagtcttcctagcaactccctcgcaaaattagcggcttttgattagttatttggtcggctcctcgcaaaactgtagcaaagtttgcgagggatttgcgggtcgttttaagtttatatatacaacgcgacccagaccaaaaaccctaatttccttcttcttctttcttcgtctccgtctccgtctccaaacaacgcaccggttccattcttgttcgtctccgtctccgtctccgatcttcttctccagttccttctttttccatcttcgtctccatctccatctccgtctccgaccttcttctccgtctccaatcttcttcgccgcctctctagtcccatcgatctcaaaatgcaaggtaaagaatcttctttcgtttagggtttcatgcaagtcgatttccgtagatatgattagggtttttcttgtacttaatcatttttgtctaagtttctaataagggtctcgaatttcatgcaaggtgaagattgaatgttctgaatcgccgcctcattccttcttctccggcaataacccgatctactaagccgtctctccctcttctccggcgataacccgatctactaagctgtctcaccctcttctccggcgataacccaatcttcttcgccgcctcttgagtcccatcgatttgcaaggtaaagaatcatcaaacgtttagactttcatgcaagtcaattttatctgtgtttctaattagggtctcgaattttgagttgggtttcattagatctagttagggtttcgcttgtttctgtacatctaatgactttgatctgttggatttcattagatcatattagggttttatattttgtgttggatttcactaatgttttcttttcatttgcaag

SEQ ID NO: 14333 - DNA, 3000 bp, Unknown
  misc_feature (1)..( 3000): cDNA_ID_3016263_gDNA_ID_2684108_Annot_ID_190542 3000 nt of promoter + ATG
aaaaaaaaaaaatccatgatgagtgtgtattgccacgcggccacataaagcggagcggcaatttacaattgcaaaaaagaaaccaggaaagcttcttaagcactgaaacaaacccaaaaaaaaaaaaaaaactcttcaaagcgaaaccaaatttcacaaaacacgtaagcgtagatcggagcaaaacaactatgaagaaaatcacgattccggtagaatctcttgacgaagaagacgatttcctactacaactcgccgcaattgaagctgaagcagcagcgaaacgccctagggtttcttctataccggaaggaccatacatggcggctctaaaaggaagcaaaagtgatcaatggcagcaaagtccattaaatcccgcctctaaatctcgcagcgtcgctgttaccaccggcggttttcaaagatcagacggaggaggaggcgtcgccggtgaacaagattttccggaaaagagttgtccctgtggagttggtatctgtttgattcttacttcaaatacaccgaagaatccaggtcgcaaattctacaagtgtcccaatagagaggttcttaatatgtttatttttgcattctaagtgttcgataaaatgcctatgagaatataatgattttaagctacgtgttctattaggaaaacggtggttgtggatttttccagtggtgtgatgcggttcagtcttctggaactagtactactactagtaatagctatggaaacggtaatgatactaagttcccggatcatcagtgtccgtgtggtgcgggtttgtgccgtgtgttgactgcgaaaacaggcgaaaacgttggccgtcagttttatcgatgtcctgtttttgaggtgtgtgtatatcaatttgtttatatggttggttgtgttggtatctataatcaacatagcaatggcattgcaatctcttgttcattttgtggtttgtgcttctggattctggtttagtgagccctttggctgtgtttcggatagaactatggttatcgttctatatggttaagtgctgagtcttgtctttcattgtatgctatctctgattgttgtaaccaagtatactcagcttagattaggagatttttcatggtttaaatgacggaaatagagtgataactgtggcatacacagtttgtagactttgtgcatcactggaataagtgaaaaattgaattccgagtcaatattgtgcacgatggttaagtggttaatgtagtattgcttacctttgagtgtatgtgtgataacatggctttttattaatttcagggctcttgtggtttcttcaaatggtgcaatgacaatgtagtcagctctcctacgtcgtatagtgttaccaaaaacagcaactttggtgactcagataccagaggatatcaaaatgcgaaaacgggcacgccctgttataaatgtgggaaagaagggcactgggcaagagattgcactgttcagtctgatacgggaccagtaaagtctacatctgcagctggagattgttttaaatgcggaaagccagggcactggtcgagagattgcactgctcaatctggtaatcccaagtatgaaccagggcaaatgaagtcgtcatcttcaagtggagaatgttacaaatgcgggaagcaaggacattggtcgagagactgcaccggtcaatctagtaatcaacaatttcaatcagggcaagcaaaatccacatcctcaactggagattgctacaaatgcggaaaagcaggacattggtcaagagattgcacttcccctgctcaaactacaaacactccaggcaaaagacagaggcagtactaggtcaggctttctagttttgatctgtcttatacaaaatcttagggtctctcttaatatagttaaccacttcattgccatggccaatgggtgtgcctaacttcgaaacctagctttatcttccatcttatgaatctttcttttgttaccttttttttagaaagcttgtgaatcaaagaagactgatctgtttaaagttactgcatgaaattaccttacatttgatttgttttctgacgttttgatataacatatcataatgggttgttctattattttgttgggttgaaatgtgtccattattccaattgtgacaaacgttttgttaatagattttaccgtgctttgactaagaaaaccctgtcaacattgtatatacatagcaaaacaaatcttaaaaatatcaataaaaataagccttgaaattctctaacatttctctccgataacttctgcaataatatatgaaatttattttcacatttaccctacgccatatttcttttcgatcattcctaaagaattcacaagtttttctttatctttaatttttactagtgcaaatgtcaaagcggatattttggtgcgtaaaattcgtgtccaaccgcatcatatcacttatgtaaaacaacattccttagaaatgactcttttgagctctaatttatttcggatgacaaaaaaaaacacaatattcctcataaatggttcttttgagttccaattaatttcggataaagtaaaataaaataaaaaggaattacatatggtccatatggcgaaaataatatatatcatcacctgaagaaattgcaggtaaaaagttaaagaggcacaaagaaaaaaaatggttagaaacgaatttggaagctagtgcttttttagtttgttgaagaaccaaaaaaaatatgacaactttcctctgcaacaacaacgtaagaaaagggacagagaagatttaagttgttagaaaaaatcggtagactccatatttagcttatgtaacgctttactcatatctatattcgcttttatcttatcatcttctgatttctcccatttatggctaaccaacaaaacaaaacccatttttttttctctttagaatcaaaagtaaagattggttgatttaacattgtgtaatgcccactctgcttcaaacagctccaatg

SEQ ID NO: 14334 - DNA, 3000 bp, Unknown
  misc_feature (1)..( 3000): cDNA_ID_3016248_gDNA_ID_2684108_Annot_ID_190546 3000 nt of promoter + ATG
tcagaatatgagtattacttatcaacaataactcatatattttatttagcctttgaaaaacactcgatttaagttcataatagttcttaaatttctttcaaatattgtgtctacaggacaacgatacttgcgtaaaagtttaatcgtctgttttaccaccttcgcatcagagatattctcttaacaatgtgagttatattcaaaaagagacttcaagtcttgaagttttagtaataactaattataatttattttatctaataacaaattcatataagaattgctttatacaacttttagatctttagtagtcaaagattgaacataatcttctggatatgtcacttattatccattcattacttctccttctcgagatgatgaaacttcaagttcatccatctcgtattgaattccactctagaatcataatgtatttatatctcatcatattaactttgagatttggagaactataccgcatcgatgattttaattttgtattcccatagaaaacaatgtatatgctcttctagagtcttttaataagattttatactacttgatatactagattatttcatcgttagaattttttttttttttttttttttttttttttttttctcaacttctggtgataatttaagttcttaaaaaaaactttgaccatcaaaaatatgatatcttcttaagatacattaaactagtcattcatgaaaatttgtataagtgattatacctttaaattaagttatttatcaatcaatttatttcataaaataatccagtattatatactaatacaattttaatgcaatattgtaaaaccaatcagaataaaactattttgtgcaaaatctggattttacatatatcttgacaaaacttttatttagggtaatatgaattcgtgcaagatttgggaaaaatcatttcgtgcaaaattagggcaaaaccatgaacaactttttttttttctttttttttttattttttttttatttagataccacaaagatttagagaaaaaaatcttataaaaagaaaaattatcttgcaacgtttttagtaaaaataataataacacaatcaaatatatggaaatcttataaaaagatttagataataataacacaaagatttagatatatgaaatcttataaaaagaaaaattatcttgcaacatttttagtaaaaataataataacacaatcaaatatatggaaatcaaatatttaatatggaaaagtcaatatctaaaagtgataagatatgtataacgttttaatcaaaggagttaaataagggatatcatatcaatcataaatggattttagacaatatagtatttataaaatgatattgaatatagatgcaactattcaaaactggaatgctaaaacattaatacatgcttgcatcacccaccaccgggttatgaatagttacaaaattagttatataattataaaattggtaatttatatattcaatattgtaatagtaaatcacaaaaattaacaattaacaagcttgattctcttctttaacgattttctttgtagaatcattgaatcatgcgatagtaattatagaaacaaatgataagcatgattctcttctttattgaatcattgaaaacatgcttttaccgatctatactataatcatcgattggctcatattgttttgtttcaataatagaaaataagtattatgaaccatgagtcgataagtaaacatggttcttaaaaaaaaatgtaagaatctctatatctaccttttagagcgtgctgataacgtgttataaacagagaaagagatagaagaaatgagtgtgttattccattgagataaagggttctttatataggagtacaaggaaagggtaaaaccctagaaacatctagatgatgggcttagatgatgggccttataatgggcatccatctttattcataacactccccctgatgaccattatagtatcataactcgtaaagtatttgaaatgctgcctcattaaaaaccttaccaggaaaacccaatgggaaaaaccatggttaagggaaaaagagtgcaacatacaataaatatccgaaaaatagtgcaagaatagttgaatattcattttgtgttatataagatggatttttacgcaaaagaaccatgaaaactaattgtatgtgtccaacatcggttgctaataagcgactattttgggacaggatattttacgacccttttttagcgatcgttttatatcgtcgttaagtagtagtgacaaccttgtttgcgattattttgggactaatatgagggtcgcaaagggcaggttgtcttatatatgaatcaataatgaaaatacataattgagcttaatagagtttttttttgcacaataactatcaaatgccaaaacactatttaagtattttgagttgattaatgacgtttcactttttaatcatatatttaagtaggtctgttaacgacgggaagttaggacataaatcttatttcccaaatttgttttcatgaatctaacctcaccacaatgtatttgggacgaattctaatgtgattcataacactgcaatcgaagcgaatctctaaactttatctttacgatatatcaacgccattcctgcaggtccggtcatatagttccattgattctatccactttaccgcatgtaatttggatcatttatggaagtaatatacagtttttcttgtatgagtcaataacgaatagttttatttatactaacaggattgacgatacatacatgcagtaccacatttacaattaaaaaaaaaatctttatcatttacgcatatatatgtataaccacggcgaacaacattaaaaatctgtaaatttagttttaagggaaaataattttttttaaaatacttattatttttatcacccacacgaagccaatgaagttttgatttctgttttaggaaaccttcttccaactctacaac

SEQ ID NO: 14335 - DNA, 3000 bp, Unknown
  misc_feature (1)..( 3000): cDNA_ID_3016209_gDNA_ID_2684108_Annot_ID_190558 3000 nt of promoter + ATG
atttaatgtttatctctaaccgccatgcaagcatatacacaggattgagtaaggttagacacaaccatccatctcacgttgcttcatatagtatacatatatcgatttacttaatctgccaataagctggttctattttgattggataatgaatgatttccctaatattgttgcaggtctatacgcaagccaaccttgctgcttgcacggttcacctttggcgcaatatcagacatctatataagccaaaaagcctctgccgcctaatgtctcaagctgcacaagctttccatgtcacggatttcaatcggatattcctgaagatacaaaaattgaaccccggatgtgctgcatatttagttgatttgggtaagtgtttttctcagcttacatatattgttattaacgtggctgagatgaagtttactccataacctctgtactttgtaattcgtatagggttttcagagtggagaagagtgcattccaaaggccggcgtttcaatatcatggatagtaacatatgtgagtcttggaacaacgttatcagagaggcccgcgagtacccgctaaactgcatgctggagtacataagaacgacgttgatggattggtttgcaactagaagggctcaagccgaagactgccctacaacattagcttcgagagtgcaggaaagagttgaggaaaactatcaatcagctatgtcaatgtctgttaagcctatctgcaactttgaattccaagtacaagaacggacaggggaatgttttattgtcaaattggacgagtccacttgttcctgtttggaatttcaggggttagggatcccttgtgctcacgcaatagccgctgctgcaaggtttggcgttccaacagactcgttagcagcaaatggatattttaatgagttagtgaagcttagttatgaggagaaaatctatcctattcactttgttggtggagaggtcgcaccagaaattgctgcaggaactacaggagagctgcaaccaccattggttcgctggccaccagggagacaaaggaagatcagaatcttgtctcgtggtgaattcaaggcaagtacctattagtaaacattacaatgtacttcttatctattaacaagctaatagcctatctacttttaatatgcagcggaacaggacaaggtcccagaggaggtgttcacgttgttgtggtgttggacacaacaaggcctcgtgtcgtaatgctatataagtcgtcaactactgctatggggtgctaataggtgttatgaagaaactttgtggagtgggcttaaataatggttgttcccacatatcttgcggaagcgggtttgtttacttctactaatgcaggattaagtacatttattgaaatagtttggtatacccaactttgatgtataccttattattttgatttttatgtactacctgttcatcgttatatttgtattggtatctctaatcccgatgtaattaagtaatgccctgtaacaccgcttttgaaatgtatatatatgaaaccccgctgtttgtgtaatcacccttctctgcttctttcaagtgcaaaatcatccatatcttacttacatactatacagtataacgaattacgaaaactaaaccttaataatgaagtgggaacccaagcaatgatgcatcagtaattgtatacacagatttttcctgtaacataatcaatggggtaaaccataacaaaccaaaaccatcactctgcctttggagcccaagcaatgagtttgtttacacgtttgatgaaactgttggccgaataacatatgttttacttagtttcattatgctgtatgttggagatgcaatttcagtcaatcgcgagcttctacctgcaagcatcacgtttataaatgttatgattatatagccaaacgggcatcgtggatggcagcttcggcataaatagttttgcatggtatcctattctatttactacttactgtactattccgaaccatatgcaagattcaaataaaaaaagctcgtgtcgatatccaaagtattcaactaaaattgttttcttttgatgtcatgttttcagtatatatgttgatattactcgttaagttataaggatatgcaagaacttgacatttcatttattagttgaatactttggagttataggagtttgtagttgtaggagttcagcatatctgttattgcatcactgtaatataacccaacacactaggctaatagactgaaacatttcacttcaaacataaatattcaaacatcacagttattagttgaatttcaatacaattggtctctgattacaaaagaaactccatgtttgttcaacataaattacacatctacaaatcaaacaccacgttctgttggagacaatgcattgaaagtttcgatagcgtactgtttagctgcatctcgcatcttcccatcatctaatttcccacaatactctagagcgtgtgctcacgcacgggttaagtttgtcaatattacataaagttcaatacatattggttgaagtgttagttttgcaattataattcttttgttggtcatatttgcaaatttcccatatttttagtctaatttcagtttttagtttatttcggttcggtttcatagatttcaaacggtttataaatacatttcggttcgattacagttcaaataattctatttttccggttcaggttattcttttttccggaatgcgaaaaaaagaatatcattgtttgctctctcaatctcaacaacaacacttctctcactcaatcgctttctctttgagacgtttgtttagtttcaacaaacaaatcaaaacacacaaagtttgtgtcttcccttaagattcactcaaatctcgcaacacacacattcaacaaatcctgattcataacatctcaccaaatctctcaaaagatctccaaatctaaaatgttcttcttcttcttcttcatctgaatccaaaacaaca

SEQ ID NO: 14336 - DNA, 3000 bp, Unknown
  misc_feature (1)..( 3000): cDNA_ID_3016205_gDNA_ID_2684108_Annot_ID_190559 3000 nt of promoter + ATG
agattatgacgttaattgttcataatgcaagagaactctcatcagttaaaatttatcacctttttttacgtcttgccgattctcgttcttgattgaaattggtactccaagaagaacaacgtattccacaatttcaacacaagtttccatacattttgtcttgttagatatcatctaactaaagtatattcaacaaaagttttttaaaagaaccatgtaataacttacgtcactaaccatagctgcatccacttacaatttcacgtaaacaattttcactgtattaacctaaacatatttcccaagacaacttccttccatggtcttgcatgtatgttcctcaactcctatcatcacctatacttccttagatttataagccctcgacacttcctcaatataagcatttgatgttgcattcgtcaaaattactgaataaccattcaaaataaattgttttacaataccacacaacttgtcccaaccaacctcttgcaacctataaaaccggaatctttgcctcttttctcgtaatttggaggtttaaagtgttagtaaaattagtttggaggtttatagtactagtaaaaatgtaaatttatgatgtggatgctctgaattagttgtgtaaaatcctataagttagggtttaatagtacataattataattacttagcttccttttttataagtttaaatttaatatttgttatttttctttttaaaaacaaaagaaagtaattactattttcaaaaatgttaatcaactagatttcaacccgcggtacaacgcgggactattttgttcttataagaataaaaatttaatttgtttagtcgattaaaaaaaaaatataatttaattttttatattttctgaatgtacaactcttatatctgtatattatttagtatacaattattatgtttgatttttactgttttaaaatatatgaacaataacgttcattaagttttaaagtatagttcattaagttaaaatctagattataaataaataatttaaatttaacttatatttatttgattaataatatttttttgtttagtatttaagataatataattgtattttgattgttatgtctaggatttcacccgtagtataccgtcttgtatttttatcaacccaaacccgtcataccatctaatctcgttgagtgaaactaaacatatgtaatggatttcacccgtggtataccgtctcgtattactgtcgacccaaacccgtcctaccatctaaccccgttcagtgaaattaaacattttgtttttgtttttttaataatactttaatttaacagatatataattcaattttttttttttcaaatggttatttaattgttataaaatccatacattatactattctaaacttgtccccccatctaatccagttttgtaaaattaaacattattttatgtttttgttctaataatttttttattaaaagattaataattcaaatcaatttaaaagatttcttttgaaatggttatttaattttatagattttatatattatatatattctaaacgttttttcgttaaatattctaaacattttctaaactttaaataactataatatttatttttaataaagtataatattaataaagttttaaaatttctccttttcaaaagtaattagaatggatggagatatattagataaggaaataataataattaggcatattaattaattgataataattaatgtcaatggcattccttgtaaataagttccaacttgaggatttatttgctaaaatgactacaaaaatgtatatgtagattagatgctaaatatgttaattatggatgttgcagctctcgattcgttgttttaaatcccacgtggacgcttttagaaacaaataacttcaacttttatataatatagatttgagtatcagcaatacaaaagaaatatattatattttaactgcttcaccacaccaactaactatggttgtcgttcaacttttgttgtgttttttcgctcgggttattccgcttataccacccaattttcactaattacaattgctgtgcttgatctgccaaatttatttttttacgcatagtctgatctactaccattctatcactattcaaacctagtattaaataaaacaaattttgtaattcttacaatttaaaaattatttacatatatccacggattgatccgaattttaccacctaactaatcttgtaggttattccaattatatcacccaattttactcactacagtttgtgttatcgtcccaccaaattcattttttacgcactgttttgacctactatcattctatcactattcaaacctagtatttgataaaccaaattttgtaatttttacgatggtattgatacgaatttttaccacttaattaacagttccgggtgagtatagccgtcaaatagtctagtcaccaaatttttaatgatctaatgcataatataatttttcttgaaccaaatggaaatggccaaatatatacaatcttaagattttacagataaataaataaaaaataacttcaaataatctatggattatatgtaagaaaaagatacttggtaagaaaaaaattaactattgaaagaatgatatattatagcatggttatatttttgaaagaaatatgaatcgtcacatatattgatcttaagagactaaagaacaaaatcatgttcggtataaatcacacacgtcaacaatattgcagcaataaaaaacaagaaaaatttattctataattaaaattctacttctttctattttcgtaaaaaaaaaactaaccataaaataaacttgtattaacgtgaagatgatgaatgaactaacaagtgaaagaaattaaagtagttgatggaaaggtaaagagcatgtctaacaagaagacacattaaaggttttataacaacaagatcgtcaagagacagtaaacctaaaatg

SEQ ID NO: 14337 - DNA, 3000 bp, Unknown
  misc_feature (1)..( 3000): cDNA_ID_1010431_gDNA_ID_2684110_Annot_ID_137137 3000 nt of promoter + ATG
taatatcattatagaaaagttataaaaagaattccacctcgattctcaattgtcttttttttacaattttaccttatacaatttttctttcttttcgatcacaagtttcacaaaaatcaaaagattataagaatgtttatcaaaaaaaaaaaaaaagtttattagaagcgacggcatagcgtttgactaaagaatttcggagagtttttgggcctatcggcccaattatcccacctgatgggaagcgttgccctcaaagtaattgtttgcaggtaattaattgttcaaacaaagtgacaatttccttccgttgtcatataggaaaaaagttgcatcaaaatgatttattttctggcaaacttgtgtcattgttaatttatatgggatttagaataattaatgacgaatgaaaagagtatatgaaccaagtaacagatcgtgacaaagcgccattatgaagtttctactgattttaagataaaagtctaagatcccaaagttaacaaggatttcaaaacatcaaaaagcatcttctaactcaaaacacaacatagataaatttaccctttcgaaaaactcattcttcgaagcttctgttttctgcattgatcaaggtcttcctcttgggactggagaacgactgttcaatcaaaaacattacataagaacatcaatgggacttgagtgaacagtaagaagccaaagccatttttttttttttttaccttctgtatcggtcataaccagggctcctttgtctaccataatcagaactccttcgtccataatctggactcctccgtctttcataagctgctggacctttgtatctgtcgtattctgggcttcgagcacgaccataatctggacttggacgcctaccctgaccagggcttggacgcctgccataatctggacttggacgcctacgatacacaggactaagagaccttctcgggctacgaccaccatttcgatcatctctttcatcgtcatctttcaacgcatactccacggaaacaaccctatccaatattttgctgaggaaacaaaaaggggatgtttttagagaggcaaatgtactaaaagtttgacggaaaaagtaactagaagaagtgttgttttaccttctttgagtagcttcaagggcttttgtagcatcctcttgtgtttcaaactgaacaaatgagaagttgcgtctgatacgcacgttggtgaccttaccatagggctcaaagtgtttttcaatgtcgtgctcttttgttctaatggggtcaaagttaatgacaaacagtgtctttgtaggcttcagatttgaaggggctttcgcgtcaccacgaggcctgccacgttcaccctgaaaaccgaaagaaactttaaaaggtttcttaaatatgcggcatagtgcaagcttcaataaaaaccagaaaaaaatttatacctttgcccattcaactgataacctgcgtttctcatatccaaaaggaaaattgtcgagtttgcgaatagcgtcttcagcatcacgttcatcctcaaagtacacaaaagcatatcctgcaacaaaagaaagcacaaggattacaaaacgcaacacaaagagtgacaatcctcctgtccattaacctgctgcatatctcgtttaccctagaaaataactaaatagatatacaacaccttcatataagtgaaggctggtgaatatgagagatgtagaggcattccatgatgtagtagaaaaacaagatttgtagcataacacaggaattcaggatttttatttttaaaaacaccaattttatattaaaaaatctgagtgatttgccaggcatgcttaaacattctgagtggaggagttcagatatggaaggcaaggcatggcaatgatggattcaatagacttccatctgaagcatcgatgattggtaatagacagacaaattccaaagtttctctagagtcagtgaagattggtaggcacaagatgataaaggcaggtatgaaaatgtagaaatgattttgcaggaagaagaagaagatggcaaatcttgttcctttgaagaaaagttcctgcgaacaaataaacactcaatacaaccatcctctctactgcataaaccccctaccacacttaacacattcgggaaaaataaaaccaatcttttctatgtaacggtactatatataaaccttcaaatcatgtatgaaactggaactagttctaagtatccagaatcctaggtcaagcagaaactaaacctaagcaaagatgatttatcaaccagaagacgaattcgaattcgagacggacaaacaacaaaatttcaccggcgtataacttagaagacactttaccagatttcatgtccactcggtcgactctcccatacttgtcgaacaaccgttccagatccgactggcgagtttcatactcgaaattgccgacgaacactggcctcatctttatcttaattcgcaattcctaacgatccaataactcgaaattagtaacatgtaagggataaaataaggtatatggacatgagcaagtataattatcggagaaaagttacctctgaacaatcggagaagaaacgaaaaacaaaccctagacgacgacgacgactactacgctcatcgaagaaaagcagagcctggttgacttaaaaaagcccgtcataccatcatgggtacattcggaaattcaaaaatcataatgggccttctttataaataggcccacaataagttagccccataccgaagaactcgttggagtcttttcttatagaattaaatttatacatgtttatatacagacccattttccgtcggtgaagaagaaaagaattaaagtttatgtaagtgtccagttttctgacacgtggagattcaacggagttctcttatctgttttggttcgatcatttttgcggtttaggatgtctctattgtttcttcttcactctttttgccacaatctctgttccaagaatcgcgagt

SEQ ID NO: 14338 - DNA, 3000 bp, Unknown
  misc_feature (1)..( 3000): cDNA_ID_2701843_gDNA_ID_2684110_Annot_ID_137139 3000 nt of promoter + ATG
tcctcattggattggcatcttatcatggaccctacttgtcttgaataagttggatcatattcatttcatcaaaaaaatttcttttcatttcatcgtttttcagatgtatttatttatacatggtatttatggtaagcttaatgatcacttatttattttcacaaaatcgaggttttagtatcattttcgaatgacagtttgtgctattttagccagtagatcatcataattaacagcctaaacattacctgtatgtattttcatatacattaactgaaatttaagctttacgaagaatgtgcatatttataaatctgtgaatatttcaaaagctttacacgcggcaaggccaagaggttggaagaatatgcaaaatacaaacatgaaatgacaaggcgccttaaaaataataattaaacaaatatgactttaaaaggctctatagtcttatgtatatgttctgttaaatttatccaaattaaatgagccaaaactacgtttagtaagtattagaaatcatagccaagatgtaaatctaattaaagaggacgaaatttgatttcttaagttttatttctcaaaaccatattactagtttaatctttatcattaaacagaaccagatttctcttagacaaatgaaagaaaaaatagaagtaaagaatcatcttctcttacgcatcttatcaagaactgctacatttaagctaacctcgacacgtgataacatttgtcggacgcaattttcatacacagccacaaagcaatcaccacgtcatcttctcatcaacttggctttcttaatggtgccaaatggcaatgagtcagtggttgatcttgacaactttgattgctacttgtctgaaatgtctacagatctgattcattacattgtataccaaaactttcgtccatttccttgttgaaataagtcgatgtaagtcattctattcaaatattttttttcatgaagtaattttctggttttaaagcaaagtaatagattatttataatttttttaattttaatggcttaaggctaaagtgacgttggatcgatgaagccgccatagttcacaaatggccgaatttaatttgttgtttgtatttaataagtcaaaagagatttccgagaagcaaggtgaacgtaaccttaaactaatcattagaacattaattatataagttgcgtttatcattaatattgttgcttaaaattacaaactttcaaaatcccatggttaagataattagtgtttcagagcctaagacggaacggaacttgtgtaattttgtaagaataaacatattaacttcgtgtctaaaaaaaaacatactacactgacttcgttttctaataagtaattgttgtagaattttaatttatttctgtttatgtaaactgttattttgtatgtttaatgcatatattttagacaagatacttctatccataatagttagcttattaatagaggtataataatctttttagatttcatattatatttagtactattggttttagaaaaatggaaaaaggtcaaataaataataggaacaccactggtttatatttcttttctggattgtgtatactttttagaagaaaactaaaacggcatgttgaaaaggaaaccaagaggatagtaattaggtcagattacttgtttagttacaagaaagtcaagaaatctcataattgagtttaaaactttaaacatttgcatggaagtcaataaatctataatccttactcgtgatcatcttattgtttccgtgtaacgaaattaaacgcgtaaaacatcgcgtaaactatagtacggtatgtgatatgcaaatatatcttaatttattttttattttttatttttcttgggcaatgaattgaagagttgcaaaattatttgccagcttaccacatgcggccacaattttaaccatgattaatcttcttttggaatttagcgagataaatcaagagtaggtttattttagaacatagtatataatacactaatgaaaagtctcgttaaaacgtgtttcacgtaaccgacctctaaagtatggcgtgcgagtaacgacaaatgaaatctcaaatgaaaatggagattattttaatcttaattataacacactaattaacacccgtcaaacatcctgatatgtgaacgtggaatctcgttacacaatcgaataaaattattgcttaatacgatccgtctttctctctctttcgtaatgattatctatcaatattatcttgactaataaaagtatcgcaaggccttggcagtcacatgttaaatgatgatatacgttgttgcatgttaaaacatagtacaacgatcatctaggctgctgctaaattctattttcaaaaatgccttttatatgcaagaaaagcaaaataatcgagtttttttttttgtttcattataaactgcttcatttttcttaggaacggccaaactgttaaaaagtaaaatatgtatggtgattaattgatgtaaccaaagccagttcgcccgtttgattgtcaacccacgttatcattcacttgatcacttccatgaaacatataaaagctgataatacttatattataaaggaaaaaaagtatgaaaatattatcagtagttagatgattagttcacatctaaatgaaatacgacttaaactgaaagagacatgagccaattcgtgtcgagccacaaattttggacgtatatttttagcccgtggttccacaatatttgcaggtctttttattcaatgagtttattttgtcttggttgaataatgaaatttccaaatataaaaaataatagaaatccgaggccctacacaagcacacatagtaactcccacattatatataagcggccaatatcagcaactcagagattccagaaagaaagaaaaaaaagaaacaaataattccaaaaccttctctcttaatcaaaatcaagaaacttacaagatctggtgaaaaccatg

SEQ ID NO: 14339 - DNA, 3000 bp, Unknown
  misc_feature (1)..( 3000): cDNA_ID_2729996_gDNA_ID_2684110_Annot_ID_137146 3000 nt of promoter + ATG
cattttattcaataataataataatgacaaaattgaaggatggatggtgcgataatggcgacaacattttccaactgtcatttgccccccagggtctaggaccctttctctatccctagccaaccctttcgtctatttattaaattttattagataacttaaagtaattcatttaaaagcaatatgggtcttgaaaagtttcatgtagattataaaatcttacctttggtatctaattccgaattgcttttattctgatagcgaaggctttaatttatacgttttcgagcattgatttttgttgtccacattattctcaggattgctttgtatactggttcttttctcggctttagtttaatttgattattgcatctcagtgatggccatcaagaatattgcgtctctaagaacaaatcgactaatgtgttgtcgtcttgatcttttataacggaatcttatatatatattgaaaagaatctagttagacagactcaaactgatatttagtttttaaaaaacaattctttttaagatgaacaagtgcaactacttggaaatgaaagagccttatcatataacaatttaagacatgtaaattgatagttttagcattgacttgacttcatctcttaaccttaagggttcacacacacacatacaatgatcacatatgcattgatttattttgaaaagtacatttggtggtagggtgttattaattgatcaccttagaataaacataagaaaaaatatatagatgggattagaaaaatatagatgcaaaatgtatgaaggtggggcaagtttcgtatggggagggggatgcagaggaatcattatcaagcccaagttagctgcagaaagggaagattcaattgtatgaaaaattggatatgtcttaactattaaattcaatatcatgttattttcttatgtttatatcaaaaaatattcttcccattataacacgtgtaagaaccttcacattgactgttctatattatcaatatactctgcgaatttggcaatacatatacactccttcattatacgaattatggcctctgcaatagctgcaaaagtcagctgctcatgatcccaacctctagatatataaacacattcattcattgactacacttccactgtatacattatgtataatgtgtatatatgcacatgtgcatataacataaggcatatcaacagttggaattataataaaatgtggatgtctatgtgataagttctaacttctataaaaaaaaaaaaattagtttaagctttctgcgtcaatatgtctttgtatgataaaaaaaaaaaaggagagtttatgataactactcgcttgacatacaattaactactagataatttcaattgatcataatgtgattttttggatataactataagttttgacctgaaattaattaagttacatatgaaagatgtaatgaagaagaaggtgaattaggtggtccaaccaaataaagacgatagataaagatcaaagagtctccattgtccattcacaaatctcatatatctttgttttttaggtttagtcgctttcccttcttccaccaacaacaatgccaagattttgtaaatcttattttatataccctatggcttattcactcacccttattattatttctcttaagcctcattttagatcttacatacggagtttcagtttctcttacattcaacttttcaaaaattgagattgttgggccaaataatgggtcaatataaagcccatctgtggcctgaaagtttttataaattatgggcctttttgactaattcttccttttggtggctctcttcttcggcggggtaatattgttctattcttacagaattgggcctaaacaggctctaatgggctttacttgtagttgagttacgtggcactttcacgtgataatgtttagtttcatgataattagagctggtcccattgacattgatttgtgccaggtcaaaggtgatgtggcattaacaaacgattagtttaattaatcaactttttcagattatcaccgcaccaaaaatcatctagaaatattcagtagcgataactatttcatttaaataattttacagcatatatccttaacattataatatttggatacgtcacccaaaatcatgaataaatcttgttattattagttacatctacgtttttaaattgacattaaagcaacgttatatgtaagaaacaggtcgactatatcaaagcttcaagttcaaacaatcaatggtcatggtaaaacatagatatcgactataaaaattatattctaacgtgtatttttttttatatcttttttaagggtgtgattttctaccttaaaaaaaaaaaaaaatcttaataccgtattattataaagtacataaattcaattgttatttttccaacattattatattaaagacttcattaatgggaaaatgtttatcttcgactttaagagctatagttgaactttaaactaacagttcatagaaataaatgaaaaatagctaatgttttgctaaatttgatgattgtaaaattttgatataacaaaattaattgaagtaggaattttaaaaggtaataaagagagatatttcctgcgtattttccttgtggaaattggattcaaaacgtcaatttcagaaggtttcttctggactactacaagtaagaaactctttgctcataagctataaccaaatctcaatctccacacacaaaaaaacctttattaaaaaaaaaaaaaagtcgatagctttactgtataacatatataaaactcaaatcgtctcctttcgttaacaaaaacagttcgttgttcctttaatccgtaaaaaaaaacaaaaaaagttttgatttttctctgtgagtttgagtagtagtaattaatagaaacaatggaggttgattcaagcaaggatccgaaagtctaacgggtcaaaaccaaaaaattccggatg

SEQ ID NO: 14340 - DNA, 3000 bp, Unknown
  misc_feature (1)..( 3000): cDNA_ID_2729986_gDNA_ID_2684110_Annot_ID_137149 3000 nt of promoter + ATG
caaatttaaaaatttaatacttagaaaatttaatacgtttttagtcctcatgaattatcaatcaatccaatggactgcaaatgatcaactgacttgcgtttcgtctaccattttgcaagcatcatatatgtatgtgcaaagtattaagctgttacgttctaaagttgattaaagttactatgttccaaagccctatgttcattttttttataataataatctatcttgaacttccctattttaaaaatcataaacgtactacagaaattaaaatgttgaaatcatataaaattatcctaaatgtgttatcttacaatatgaatttcttaacaatatgtatcttgactgcatatgttctacaaaccatatgaattttgatatcgtaatctcttgtattaaacataccatttggtcgagatttgtaatctaattgatcaatacttttaatgtctcaaaatcattaattgaaattggataagaaatagaaggtttttttttcccaaaatacaaaggttattttatcaatcaatatagttcacgctctatctgtgagagattttaataccaagaggtttatatgcaatttattctaaactcaataacttagcaaattattttgacccgtttcaacatcaatttgacccgacccggttggttggagcatacgaagatagattttcgagttatcgtctccttttcccggtcagttttagtggggaagcagaagatgtcgaccggtttagctctgaatcgctgttcagtttcggtatgtagaacggccgttactttacttaaccggccaactgtctccgttgccaggagtttgaaattcagtcgccggctaatcggaaactgctcgatagcgccggcggatccttatgttgtggcggacgacgataagtacggtaacaaacaagttatcagtctcactcctcgcctttacgactatgtcctctccaacgtccgcgagcctaaggtgtgtaactcttcctctactttgatttatagagattttacttgtggttcggtgtcttacttgattttgttttagattttgaggcaacttcgggaagagacttccaaaatgcgaggtagccaaatgcaggtaacagtttcactggattcatcttgttgatgagctctgggttatgctaattgtttggaatttgaggtgaaaatgaagaatgcacaatacatttgattttggctgtaggtgtcgcctgatcaagcgcagttgcttgcaatgcttgtacagatgcttgcagcagaaagatgtattgaagttggagtttacacggtgtttaatcttcttcctatgagtttcttgagcattgttatcttagctcaatatcgtcactttcgacaataatgatgagcttgtgtttttgacagggatattcttcattggctgtggcgttagttctaccagaatcagggtgtttagttgcctgtgaaagagattctaactctcttgaagttgctaagaggtactacgagcttgctggagtctctcacaaggtgagaccgaaaaacatcacattcaattgttgcgaaaatcaatgcttttcttaggcacgaaagagttctgttttatactttttcatttgctgtttcgagactgcttgaatcttatttttaaagactgatactatacttgtataatggttcctcaacatatatatggcctcttggaaacccttataacattttgttttgctctcttgtcgattcaattctaagagattcatcatgaacaactgtatgattctttgatttgtttactctagtcaggttaatgtgaaacaaggtcttgcagctgaatcattgaaatccatgattcagaacggtgaaggagccaggtaaatacactacgcttcttttattttagtgttcagagtggctctatttgaaatgattgcctaaaatttcagctttttattacatgcagctatgattttgcatttgtcgatgctgataagaggatgtatcaggactacttcgaattgcttcttcaacttgtaagatgaataatgctagtctctttccatagttggccaagttagctttagcggttatctctgttgacgcaggtcagagttggtggagtcattgtgatggataatgttctttggcatggacgagtttcggatcctatggtatgcaacttacacaaacacagccatgctcttaaagcttctcgaatgagaggaaagaccataatctcatatcgataaattcaacaggtgaatgatgcgaagaccatcagcattaggaatttcaacaaaaagttaatggatgataaacgtgtaagcattagtatggtaagtttattttctcgattctatcactttgttctcctaagtccacaacacaacaagctcttccaaactctcgcttgagtttatcacattttttggcgcgtcaggtaccgatcggcgatggcatgacgatatgccgcaagagatagtcatcaggaaaaaccaattgggtcacagtgaacctgatccaagagagaagtcttttaaacatgaaaggatctccatgaagccaagatatacatgtttcaggatagggaatcatttcttttgttctgaatccattctcacaaacacttcgaagactcatctacttgggatggtaaccactaacgcatgtacttttgtcaaattgtttaactctttctgattagtggaaatagagttttgattaagcttttgtgatcatcttaatttctgaaaagggtcccaaagtcctaacaaagctcacagcttaatttctcattgttgtttctactatagtatttttttaattacttttaagataaaatttgtgtagaataagacgttgcaacttttcaaaagccaccgcctattatttaaatcatattctctgagcatagagccgaagtcctcaccaatcaccactcacatgttatcaataattgcttataagaatttgtattcccactctaatcatcaactctattgattccacgcgatg

SEQ ID NO: 14341 - DNA, 3000 bp, Unknown
  misc_feature (1)..( 3000): cDNA_ID_2729982_gDNA_ID_2684110_Annot_ID_137150 3000 nt of promoter + ATG
taatgtttttgttagtttgatcttcttagattcaatttattcaacacgtttaaaagcttcaatataagccaaccataagagataagaaatttgtttacttgtcttggtaataaagttaacttttacgttgtaactaaaataatataaataaagtaaactttttaaaaaacattaattaataataataaattagcctcctctgaagaaggaataataagagaggaaacaaattttcgattggtcagataaatgagttgtgggtcttgcatcgcacataaacgtgaaaggcatgtctttttcttttgatttttttttttagtagttattaaagattttgtctgctcatttctaatttttcaaagatatttatttttctatacagttcaagtaacaatagtttcaagaaaacacttgatatttttacttttatgatagaaataaaacatcatgtaatttgagaattctgaatccttgttatctctaatcgaactttgaacattttttttatattagtctagtcagctgacgattctgaccatataaaattgagaaagattttgcatttaaatgttttttaaacaccttgaaacgaaataagtatattcgaatacagttttaagtattgtcactcatgatcatattactgttttatttaaccaacgtatgttttctcttgtgcacctcttttatccattgtcgataaattttatgtgattttaaagatcacaaaatagtttatgaaaagaaaaaataagataaatgtaaacgatgggatattctttttggatgcgacaagggcattcatccaccatacatttggtgattttaccatattcacatgcatacaaatgaaacaagtattcgaacgtgacaaaaacatagctatccatgacttgagtttgtggaaacaaaattaccactaacattttataaatcaaatccatatatagtaatttatcattacaaaaaaaaatacatttctttcaatgtctatctaacaacagaaacaaacttcttttttttgtgcaaaacaacagaaacaaacttcaagagttcaagtaatactgattagtgtcccttcgtagatggaagacgactaaccaatacaagaccattgacgtcaaggaaatgctagacaatcgcgtggtccattcaaaacgtattgataatggagtaaatatatatatacagatgtcatgacatgtaagtaatactttatagatttagtgaatgcatataattcgtaattaatatacatgctcaaatatagttgatcacctacgctaaatccattgatattgactatataaagttgcaggtcacatagatgtctaaaaaaatgacaggtcacaaatattctttaatctagtcttaatcttattagtcaccgtatgagaaactaaaaattattggtaaacgagtaaacgactcatttaacgcgtcgtgaattaaacatgctcagattcttcgcttggttcttctatttttttaatatgggttcccactttttatatgacatttttacaatttacaaatactataaacaaagacacacgcattaaacgcggtcgaaggttagaaaatggttttcttattctttggtcatcgtttatcaaaaaaaaagttaacaacaaccatagttgtcaaatgacaacccaagaaaaaaacacaattattattaaaccaatgtgtgtttgtaacttcctttattattattttgcagagtttttctatataaaaaaaaaaacacaattattattattataccaatgtgtgtttgaaagaattataataatgagaatgtaattaaaaattaattactttagattaaaaatagttataaactagatgtaatcgctttctacccaaatgtcgttgaataaacattattattcgtagtcgtatcatttaatcagattaaagggaacatgtcaacaacttaagtgtatgacatataccatgtttaaataattgtaacctgtcaagtcacatcaaactgattgatgtttcattttcaaatgcgattctcgtggacttcaatatgtggttcacaagctttttgtagttgtcttctttttattcttcttttatatgtgtagtcattaacaaatgtttttttaaaaatttagctttaatgtcaatctagtcacgttagatcattaccaaacctgtaatcaaatgagcgatcgagtattcagtttacttaaatctttgtattataaacttgttaaattatagatttatttatattgtatgcaataagtttacaacaaatttaaaaatttaatacttagaaaatttaatacgtttttagtcctcatgaattatcaatcaatccaatggactgcaaatgatcaactgacttgcgtttcgtctaccattttgcaagcatcatatatgtatgtgcaaagtattaagctgttacgttctaaagttgattaaagttactatgttccaaagccctatgttcattttttttataataataatctatcttgaacttccctattttaaaaatcataaacgtactacagaaattaaaatgttgaaatcatataaaattatcctaaatgtgttatcttacaatatgaatttcttaacaatatgtatcttgactgcatatgttctacaaaccatatgaattttgatatcgtaatctcttgtattaaacataccatttggtcgagatttgtaatctaattgatcaatacttttaatgtctcaaaatcattaattgaaattggataagaaatagaaggtttttttttcccaaaatacaaaggttattttatcaatcaatatagttcacgctctatctgtgagagattttaataccaagaggtttatatgcaatttattctaaactcaataacttagcaaattattttgacccgtttcaacatcaatttgacccgacccggttggttggagcatacgaagatagattttcgagttatcgtctccttttcccggtcagttttagtggggaagcagaagatg

SEQ ID NO: 14342 - DNA, 3000 bp, Unknown
  misc_feature (1)..( 3000): cDNA_ID_2729978_gDNA_ID_2684110_Annot_ID_137151 3000 nt of promoter + ATG
atttaacaagtttataatacaaagatttaagtaaactgaatactcgatcgctcatttgattacaggtttggtaatgatctaacgtgactagattgacattaaagctaaatttttaaaaaaacatttgttaatgactacacatataaaagaagaataaaaagaagacaactacaaaaagcttgtgaaccacatattgaagtccacgagaatcgcatttgaaaatgaaacatcaatcagtttgatgtgacttgacaggttacaattatttaaacatggtatatgtcatacacttaagttgttgacatgttccctttaatctgattaaatgatacgactacgaataataatgtttattcaacgacatttgggtagaaagcgattacatctagtttataactatttttaatctaaagtaattaatttttaattacattctcattattataattctttcaaacacacattggtataataataataattgtgtttttttttttatatagaaaaactctgcaaaataataataaaggaagttacaaacacacattggtttaataataattgtgtttttttcttgggttgtcatttgacaactatggttgttgttaactttttttttgataaacgatgaccaaagaataagaaaaccattttctaaccttcgaccgcgtttaatgcgtgtgtctttgtttatagtatttgtaaattgtaaaaatgtcatataaaaagtgggaacccatattaaaaaaatagaagaaccaagcgaagaatctgagcatgtttaattcacgacgcgttaaatgagtcgtttactcgtttaccaataatttttagtttctcatacggtgactaataagattaagactagattaaagaatatttgtgacctgtcatttttttagacatctatgtgacctgcaactttatatagtcaatatcaatggatttagcgtaggtgatcaactatatttgagcatgtatattaattacgaattatatgcattcactaaatctataaagtattacttacatgtcatgacatctgtatatatatatttactccattatcaatacgttttgaatggaccacgcgattgtctagcatttccttgacgtcaatggtcttgtattggttagtcgtcttccatctacgaagggacactaatcagtattacttgaactcttgaagtttgtttctgttgttttgcacaaaaaaaagaagtttgtttctgttgttagatagacattgaaagaaatgtatttttttttgtaatgataaattactatatatggatttgatttataaaatgttagtggtaattttgtttccacaaactcaagtcatggatagctatgtttttgtcacgttcgaatacttgtttcatttgtatgcatgtgaatatggtaaaatcaccaaatgtatggtggatgaatgcccttgtcgcatccaaaaagaatatcccatcgtttacatttatcttattttttcttttcataaactattttgtgatctttaaaatcacataaaatttatcgacaatggataaaagaggtgcacaagagaaaacatacgttggttaaataaaacagtaatatgatcatgagtgacaatacttaaaactgtattcgaatatacttatttcgtttcaaggtgtttaaaaaacatttaaatgcaaaatctttctcaattttatatggtcagaatcgtcagctgactagactaatataaaaaaaatgttcaaagttcgattagagataacaaggattcagaattctcaaattacatgatgttttatttctatcataaaagtaaaaatatcaagtgttttcttgaaactattgttacttgaactgtatagaaaaataaatatctttgaaaaattagaaatgagcagacaaaatctttaataactactaaaaaaaaaaatcaaaagaaaaagacatgcctttcacgtttatgtgcgatgcaagacccacaactcatttatctgaccaatcgaaaatttgtttcctctcttattattccttcttcagaggaggctaatttattattattaattaatgttttttaaaaagtttactttatttatattattttagttacaacgtaaaagttaactttattaccaagacaagtaaacaaatttcttatctcttatggttggcttatattgaagcttttaaacgtgttgaataaattgaatctaagaagatcaaactaacaaaaacattataagttgaaagatgaaatcacaatatagatatataaagtaattatgatcctaaaagatggtaaaagttttttccgacatcttgagattagtaaatattttggttagaatccccaatcacaataaaaaaaaaagtttatattagaacaccaaacaaaattatataaacctcaattttattttgatttctatctccgtaaaccaaaaaagccacacaaacccctctaaccttctagataactttctcgttatgctatttttttaaataacctatccaaaaaattgttgttcgtgtttattttattaattctgttttgtttttcaactatttaatccgatcttatgtgcataaatatccgtcggagttaatttagagttaaagaaatagattagcgtgtgagctcatctctcttaaatctctccgctctaaataagtttgttggaattatcctccgcgtttttgttaaatcgattcgttccgcgaccttatccattttcttcatctctttctctctaacttcgattttcctttttctcgcgcgagaaaatttctggattttgtctgcgaatcacgaatattccagcgtttcttcgtcccgcattggcgtaggatttttgtcgtgtttccgggattcgaagaacagtttaaagagtgaagaagagtcgagaggtgtttcggagtcttggaagaacaagcgagatcgtgttttttttgcatagaatctgcgaggtttcgaagtttctctgtggagtttttgttggatgagag

SEQ ID NO: 14343 - DNA, 3000 bp, Unknown
  misc_feature (1)..( 3000): cDNA_ID_2685955_gDNA_ID_2684110_Annot_ID_190603 3000 nt of promoter + ATG
aaaaaacagaacaaagatggcaaagacaatgcatcggtcaatagtgattatcaagcatctaacgggagctctccgcaggcatagattctacaacctttcttgggaacatcgaaagcgcgagtctcttgagactcaagagtcctaacaagcttcataccttcaattacttgtccaaacacgacatgcttgttatctaaccatgaagtctgcacaaaaaaacaaatttgtgaaataaatattaatcaaaatgggaaggcaaacatatgaaagatcgataactctatagatgatgtgaagaattgagaatctttaccttgacggtacaaatgaaaaactggcttccattagtattaggaccagcgtttgccatgctcaagattccaggtccagtatgcttcactgcaaatgcggaaaacaaaaccattaatacctcaaagaagtaatgccatatttgcagaaaaccagagtttttctttgtttgtgagtacttacgggtgaagttttcatcttcgaacttggcaccgtaaatactaatacctccagtaccctgtgagaccatatcgaaaaagacgatttagaaagaaatatcaaaataacaaacaaacagtctgaaatgtaacttgttggaaagaacttacatttccctcggtgaaatcacctccttggatcatgaaatccttaataatacgatggaaagaggaacccttgtacccgtatttcttctcacctgaagaaatcaatttcctttagacaatggttttgattgtgtctataaagttccaaactttaaacatcattttgataaggagcttaccagtacacaaggcacggaagttttcaacggttttaggcacaacttctccaaagagacccatcacaattctgccagcaacttcacctccaatttccacatcaaagtaaaccttgtttgtcactttagcttgaggttcgattacttcttcttcctcctacaaaccaagttcaaaaatcaacacgaatccataaggcaacagaacatgaatgatttatgaaaaaagtaacttacagcagccatggatttaacacaagcggttctctgatgcttggtggtcgcataaaccccagaaaattgcttaatgggtgatgcatagtgcaatctcgaagataatgcaattccagaggaacgagctccaaagcaaactgattgagttgttcgatttgcagaaactaattgcgacttaacaccgaacccaatctacacagaaaaccaaacaaaagagatttaagaccaaaaaaaacccacaagaacaggaatagtatccgattgaaatttcgttttaactcacagagacacactacttaaagtgaagaagaaaaaaggatagaattcaaagcataaatcttcgacgaaaattgaaaaaaccgcaaatgtaggattaagtttagaacctgggcaatggagcgggaagtgtgaaccatctgcatagaagacgaagaagccattgaatgattaaagatgaagactttttgttggttcgctttagacaacagtctttagttttgcagataagagaaccgcctcgagccttgttttttaagttagcaactctatggattggtggtatccttagcatctcatgctaacttacgcctaatgataatgacagctagaggcctatttttaatttcttttaggcccagcccaagtcatttatccaaatgctttctctcttaagttacaacaaaaaattgggttagggttaaacctgtggttgcggatgactatcaagtacaattgccgtagaaagcctttttttattatttgctgtagaaagcctttttttttctttctaaagcacacaatttttaattttccaaaattttgatatcattctctgaaaatttaactgcttacagattttggcatttaatattcctagaacaaaatcatgtttttatgaacaacatcataagaccagcaagattagttttgtctattatttcacactcaatagatcaaaaccacaaactccaagaaccaacaaaattgttcatgttttcatacacaaagctactacagtctttggacattatttaaacacacataatttgctgtaccatgcatcagcaactttcgtctctcttggagtttgtaacagcttctgttgagcaccgactgcgtaagggagaagaagtaaacggaacatcagctaagagttttcgccaaagccattcaaagcttacataaggaaattgtattgctgatgggggtgggttccttgagtgccaagagtactttgatatttctcatccgctaagagattgtttggtagctgagagggttttagttagatttatctgtggttgtggatgagtgaaatttactggtttgctttcactggttgtcgtgtgctaatttcgactctaccccttgccaaggcacattcacaaccatgtaactgtagggtaattgagtaactttctttgtcaatccaggaaaaacatcacttgggccgcaccatggcccaaacaaggcacggatctgctttaacctaacacctcgatttaatttaccctatcgatgattaccacaagtgggcctatttgtttatctaccaggcccagcccatcatgataagaaaatgcttgtcactcaagtttttaattaactttccaactccttaccaagaatttgaaactgaaactttttattattgatctatagatctctgatctggaatatatttcggttaaaccaagaattctagctaacgaaaaccaaaacttaaaagttagattaaatatgtacatgtgtaagaaaacgacatcacatctttcctccaactcccaagctttgctttgcgtttaagttagttaagctatgcataatttctcctcaaacagattcaaatatttataacgatccaaatcgaaacaaaaacatatcacacagtttcaaattagagcttcaaatctagttacttgttcttctacagtacatcatcaaaagtcaaaaccatg

SEQ ID NO: 14344 - DNA, 3000 bp, Unknown; identical to SEQ ID NO: 14342
  misc_feature (1)..( 3000): cDNA_ID_3016329_gDNA_ID_2684110_Annot_ID_190602 3000 nt of promoter + ATG

SEQ ID NO: 14345 - DNA, 3000 bp, Unknown; identical to SEQ ID NO: 14341
  misc_feature (1)..( 3000): cDNA_ID_2729982_gDNA_ID_2684110_Annot_ID_190601 3000 nt of promoter + ATG

SEQ ID NO: 14346 - DNA, 3000 bp, Unknown; identical to SEQ ID NO: 14340
  misc_feature (1)..( 3000): cDNA_ID_2729986_gDNA_ID_2684110_Annot_ID_190600 3000 nt of promoter + ATG

SEQ ID NO: 14347 - DNA, 3000 bp, Unknown; identical to SEQ ID NO: 14339
  misc_feature (1)..( 3000): cDNA_ID_3016333_gDNA_ID_2684110_Annot_ID_190597 3000 nt of promoter + ATG

SEQ ID NO: 14348 - DNA, 3000 bp, Unknown; identical to SEQ ID NO: 14338
  misc_feature (1)..( 3000): cDNA_ID_2701843_gDNA_ID_2684110_Annot_ID_190588 3000 nt of promoter + ATG

SEQ ID NO: 14349 - DNA, 3000 bp, Unknown; identical to SEQ ID NO: 14337
  misc_feature (1)..( 3000): cDNA_ID_1010431_gDNA_ID_2684110_Annot_ID_190586 3000 nt of promoter + ATG

SEQ ID NO: 14350 - DNA, 3000 bp, Unknown; identical to SEQ ID NO: 9580
  misc_feature (1)..( 3000): cDNA_ID_3016285_gDNA_ID_2684110_Annot_ID_190581 3000 nt of promoter + ATG

SEQ ID NO: 14351 - DNA, 3000 bp, Unknown; identical to SEQ ID NO: 9581
  misc_feature (1)..( 3000): cDNA_ID_2184029_gDNA_ID_2684110_Annot_ID_190576 3000 nt of promoter + ATG

SEQ ID NO: 14352 - DNA, 3000 bp, Unknown; identical to SEQ ID NO: 9582
  misc_feature (1)..( 3000): cDNA_ID_3016291_gDNA_ID_2684110_Annot_ID_190575 3000 nt of promoter + ATG

SEQ ID NO: 14353 - DNA, 3000 bp, Unknown; identical to SEQ ID NO: 9583
  misc_feature (1)..( 3000): cDNA_ID_2183994_gDNA_ID_2684110_Annot_ID_190573 3000 nt of promoter + ATG

SEQ ID NO: 14354 - DNA, 3000 bp, Unknown; identical to SEQ ID NO: 9578
  misc_feature (1)..( 3000): cDNA_ID_2183987_gDNA_ID_2684110_Annot_ID_190572 3000 nt of promoter + ATG

SEQ ID NO: 14355 - DNA, 3000 bp, Unknown; identical to SEQ ID NO: 9579
  misc_feature (1)..( 3000): cDNA_ID_2183981_gDNA_ID_2684110_Annot_ID_190570 3000 nt of promoter + ATG

SEQ ID NO: 14356 - DNA, 3000 bp, Unknown; identical to SEQ ID NO: 9577
  misc_feature (1)..( 3000): cDNA_ID_3016298_gDNA_ID_2684110_Annot_ID_190567 3000 nt of promoter + ATG

SEQ ID NO: 14357 - DNA, 3000 bp, Unknown; identical to SEQ ID NO: 9584
  misc_feature (1)..( 3000): cDNA_ID_2183969_gDNA_ID_2684110_Annot_ID_190566 3000 nt of promoter + ATG

SEQ ID NO: 14358 - DNA, 3000 bp, Unknown; identical to SEQ ID NO: 14343
  misc_feature (1)..( 3000): cDNA_ID_2685955_gDNA_ID_2684110_Annot_ID_137152 3000 nt of promoter + ATG

SEQ ID NO: 14359 - DNA, 3000 bp, Unknown
  misc_feature (1)..( 3000): cDNA_ID_3016399_gDNA_ID_2684111_Annot_ID_190625 3000 nt of
tgtgtttagcttgtttttgtttgttttttcacaaattcgtttttgcgtactaataaatgctataataattggattaattgcaggttacaattactattcaaattgattaaatgacattttctatttgctatgtttattactacaattgcataatgtaaatgctatttcaaaacaattaattgcatagttttgacgctatgttattataaattaatagcactctacaaatgctattatataagtaacaatttcaagaagtaaatgttgttattagataattaatggcaaacaatacacgctataaaaacatataacaattgcatcatattgatcgctatactatatcgacaaacaatagcaccactccaaaccactatcataagccgtcgacctattatcatgggcgcagacataacactttctacttcactattgtctcgttagatagaggattttggacactaagaatactcaattttcctgtagagagaggttgtgttgttctctccacgttgggtgatggtattttagtgagtttggcttggacgctaatctaacatttatctttgcttattttatgttttggaatcaaattcatgttcatcaatctactcatagacttgatattaacacgtcctatgtgttcatgctaagtattgaaagactctgaaacataagcaactggtttatcattcttcttcgaggtggaagcctcggttacaacattgttgcagatcaccgcttcaatagaaattttgaattgaacatcacaaacaaaactatatcccaaaagcaccccatttttggagattacaagcttatctgcatcgatctcgatagcgaagccatgcttgctcaggcgagaacccgagataagaatgttggtaatgtcctgacatcagttgaattttactttagttaaagttgtaatgtcgaggttggacatttgtataatattaggtggttataatgttttgctagagaccgcttataatatatgagtcagaactaattgctaatattatacaaacctacatgatcacacacctaagcaaattggattaatgttggattaataataatataatatataatatatttgtatttgtgcatatataataaaatgtttattatactatatatgttatatatgatacataattagttagggttaaacgtttagctatatatatgatatattagcaacgttagtgagatatacttttgatcacaagaaccctaaaatacaagagacaaaagtttgtctaaagttttgagataagatctcaaaggaattagcattacagatctgattcacattttgtgcgtgtggataccggtaaagacacaacacttggagtgctaaaacaacctcgaattaatatggttcatcttttcgctgcagaatatccaggaatatttaaaccctaagatctagatttaattatttatttacacggtttctggctatagaattcgttattagtttttataaatcgttataaaccggtacaaatttcttcaattgtagcagagcctacttgtttaatactgaatatgaatctaatttaatctatattatgatatagataaataatttttatggtttatcatgttgaaatttgtgaaatttaattcgttaaacatggtaaaataaaattatataattcacttagaggaaattcgtttatgtttattggatatacggtttgttaagggtcatattttgattatggtattgagtaaatttttacaatgacacggcaacatgttttggtatatactaggttattaacctccgctacgcgaaggtttatttttattaattgttttaatatagtttaggatttagataaccattttgattaaacaactgcaaatacctagtttcctcacagctcgctaaaactaaatgttttttttaaagatctagactacaaccattgatatgcttttcttaacattataaaaaaatcattgttgtaggtttcacatgttagttcaagtcaatatatgttatccattctctgagaagaaaaattatctttatctttcgttatgtattattattagaaattttgtcttattgtaggataataagatcaaattaatagtattttaaatcttaatagatctcttatatcccttaaacatcccatacaccgatattattttattatatttcttccatttatttttgtattttcgtttctcaatgtataaattatatacattataaattatatatatatatatttgttgtcacttcttaaaatattataaataataagctaaactctagttagattgttagaacgaatcatttttaacatgaaactaaaatgtgcactcctaatattgtgactaagatgacatattaataaatttattgagacttgatgatattatattcatatattttataagtatgtgtaacgatagactttattttaaaggtgatattaaagtctatgctcggacgatccaaaaattaagaaaccatgcataataaaatcatatttagccctctctcttcggcgcttttatttatcccgttaatacccctacaaaaccgaaaaaacgataacagttagtagtctatctgcctcaccatttaatgctcaagatatcgaggttatattggaagatactatgtgccggcattggaaacatcaaagaaatgggaaattattactgatatttacgggcttgcggaaatatcacttacacatgctatgctatttattagggtgatattttcactctgttagcaaccgaaaaactatcatactaaattctttagcttccgacatcttaaatgcaagaaggagctaaacacagagaattgaaatctgaaaggtaaaagttaaagatctgagtattttgtactttaaagttatcatttggaaagttctttactttagggtttgtcagactattgttataattatgagaacgctaacaaaattgttatttacggaaaacctgcagataacaatg

SEQ ID NO: 14360 - DNA, 3000 bp, Unknown
  misc_feature (1)..( 3000): cDNA_ID_3016395_gDNA_ID_2684111_Annot_ID_190626 3000 nt of promoter + ATG
gatttattttttccctaaccttatagctttttaatctcttaaccactgtcatcacctacaatctccaagattcgatcttcaatctccagagaaaaattcttgaactcatctccagttattgaatctccaatctcccttctaaggttatcaaatctccagtctcccatatccataacaatctttgtctcctctaattcaagccgaggagatcaaaatcctattgtagaggacatcacaatcctcttgtagccgaggacatcataatccactgttctttttggaatagagcttgcattacaaggtttgtcaattcttaacaaaatttgtcgattcgaatatgaacccttagttgccgtttttttgataggaataatgactgaatttgtagtctaaatcagataaactggtattttgatagcatactgattgtgtttgaaaaaattgatagtatacccggctgtgtattgaaattttgtgtttattattcactataaattttgatttattcaatcatggagatggaaaattgtgttcaaatggacaagtcttgggtctggtttccaaggcttagcaatgattatgaggagggtgcaagatattttttaattgaatcagcaaagactttaggaaatccttcggcaatgttttgtccttgcagtgattgtcgcaatttgtgccaccaacaagttgatgtagttttggagcatctagtgattagaggaatggatgaaaagtacaagagaaatagtttttggattaatgatggggataaaaggaatgttaatcgtagtgatgatgatccaacttgtccaggtgaagcttatgagctgctcataactgcattttttgaaagtgaagacgacaaacattattcggacaataatggtgaggcagcttctaatgaagataataaagaagaatctgattttaggaaaaaaaaatatgcaggatgctgaaactcctctatacaatggatgtttgaaatataataaaatctctgcaattatgggactttatcgcatcaaagtgaagagtgggatgttggagaactattttgatcaacttataaagctagttcatgatatgctccctggagataatgttcttccaacattaataagcgaggtaaaaaaattcctgaagatttttggatttggctatgatgtcattcacgcttgcaagaacgactgtatcctttaccagaaagagtatgaggacatggtaagctatccaagatgtaaaacttcaagatgggaaaaggataagtatagtaacgatgttaaacaagggattccagctaaggtacttaggtattttcccataaaggacaaattaaagaggatgtttagatcaaaaaagactgctgagaatttacgttgacacttcagtaatcgtagtgatgatggtacgattcgacatcccgttgacccactcaccttggctcaagtgaatgaaaattggccagaatttgctcttgaaccaagaaaccttaggctaggtctttcaatagatggcatgaacccattctctattcaaaacatcagttacagtatttggcctgttttgctagttaactataacatgtcacctactatgtgtatgaaagagaaaaacatcatgttgtctttattaatcccagggcctactgcaccgagtaataacattgacgtttatttagctccattgatagacgatttaaaggatttgtggagtgacggtattgagatttatgactcatttatgaaggagaatttcacattgcgggcgatgttgttatagactattagtgactatccagccttagggacattggctggatgtaaagttaaaggaaaaaaaacatgtaatgtatgtggaaaagatacaccacataggtggttaaagttcagtcgtaagtatgtgtatttaggtaataggaagcgactcagacttgggcatcctttgaagaaggaactgcaaatagaattcacacaggagaagaaattcttgatagtcttaaggactttaaaaatgatttcaggaaaccactggctaaaaataagaaaagaaatcgaaaagagttgtttgaagatgaggttagtttacatgatgaatatgaggaaggcactgatcaatggagatggaagaagcgttctattttattcgagttagcttattggatggttcgctcttaacataataaatagtctaataaattcgtgcattttttaacaatatttattttctaaatgtatagactatgcatgtccgtcacaatattgatgtaatgcatgttgaaaagaatgcgtctgatgccattttgtccattttgctgcatactgcgaaatcaaaggataggataaaagcacggaaagacttggaagatatggggatccgaaccaaatagcacactcaaaatacgtggtaaaaaaacttatttgcctccagcatcgttttggttgtctaaggaagaaaaaaatatattttgcactagattatctaagtttaatggacctgatgactattgttcgaatataaataactgtgttttggttaactcgactgttattagtggcttaaagtcccatgaccatcacgtgcttcttcagaatctattacctgttgctttaagaggtatgctgcaaaaaggacctacgtttgcaataagtagattatgtagttacttcaaccgattgtgtcagcatgttattgaagctgagaagctgataaccttagagtcttagcttgtggagacattatgtcgattggagaggtactttcctccatcgctttttgacatcatgttctatcttccaatacatctatgtagggaggttcgtttacgtggaccagttcacttgaggtggatgtatccatttaaaggtactatcttaaatttttaataacaaatttttttttatattaaaatatttgataaatgttatattttatttacatataggtacatgaaaacactaaatgcatgtattaaaacaatttgcaagaccagaagcttgcatg

SEQ ID NO: 14361 - DNA, 3000 bp, Unknown
  misc_feature (1)..( 3000): cDNA_ID_3016387_gDNA_ID_2684111_Annot_ID_190628 3000 nt of promoter + ATG
cttcctaatctcaactctcgttgattaaacatagcagatcaaggtttaagaaacaatctaccaaagccaatagccagacaagccaatctctgggtcgagtctacaaatctctaaaatttgtaggttagacatccatttgaacgtcttttggacgctggacgtctataatcgaatctccacattagccaacgaaaaccgcataggggccaagcgaatccagaagggtattaacctaaacactaaccacctaactaacatagagattaccctaatctaatccatcctcaagaaccctaatcactactcaagcaacattctcaagaacacaaaaccagaaattactgaaatcataccaaaatgtagatctaaacaagctaaacaactttacttaaacaatcaaatgcaaaaccgaaatagactaacggtaattaaggttttaagattcataaacaaaaagaaaaactgaaagataaagcatagatcctttggacaaaccccaaagtgatctatttatagtaaaatgttgaaacccaagattcactagaagacaagagacttgaggcggtttgggcgaatactcgatcttggggatcgagtaaagagggtgatgcaaagtttgtgcctttgtgtctatgctccgagtgatcaattggtcgagtagatgcttcttcctcttctatctttatgctcagatgtctggttgagtggggaatgaagaggatccgaagacgctttgatagcccaacaagtcttgtagagttggtcacccttggtcgagtaaatgggtcgagtagaggatcgagtaggaggggcgagtagatcaatcttctgcttcatctgagattgccttgatcgagtaagagggttgagtaaactgcagcctcctctgtagcatcctggatcgagtaaagaggtcgagtgaattgatgcctcttctgtagctgcctggatcgagtgaatggatcgagtagagccctttttagctccttctgcacctgaaaacacaccaaaacatgcaatgcgaatgcaagatgatcctatatgcctaagtatgcaaaataagctaaaatggtgcaaaatgacatgatacaatgagcaaaggcaaagctaaatgatgataaacatatacctaaaatgagtaaaatacagtgttatcatttaacaacttgatctctcgctaagcttttagtgaaaggatccgctaagttatcggctgacttgatgtattctaacaaaattacacttgtcgagatcaatcgtctaatggtcttgtgtcgccttctactatggcgagatttaccattgtttaatttattttgtgccctagctatagccgattgactatcacaatgtatacgcaatgctagcaatggtttttcccacatcgggatatcttccgaaaaattccgaagccattctgcttctttggaggctttatctaaagctatgaactcatggttgatctagcttggatagttttcttggaagatttccaagatactgttgcaccacctaatgtgaagacatatccacaagtcgactttgagttctttgagtcagaaatccaattggcatcactatagccttctaggactgacagttctctattatagtgcaacccataacttttggtacatcgaatataattcaatattcttgttagtgccttccagtgagtatgacctggattacttgtgtagcgacttagtacatttactcagtgcgcaagagcgggtctagtacaatttgttaagtacataagacttccgatcactctttcatattccacttgtgacaccggttcaccttaatttttcgtcaagtgaatatgagagtcagctggagtttttgtagttctgcttgaatagttcttaaaccgatcaagaatcttttatgtgtaatgttcttgtgataagattagaccatcgatgtgcctaataatttttattcctgaaattacgttggctagtctcataaatttcatatcaaacttacggcttagcatattctttgtttgagtgatcacatctttattgctaccaataatgagcatgtcatcaacatataaacatagcaaaatttatctatgaggggtacttttgacatattgcatttatcacattcatttatgatgaagccatttgacatcattacattgtcaaatttttcatgccattatttagaagcttgtttaagtccgtacaatgatttcactacacgacaaaatttttgttcttgtcttggaactataaacccttcaggttgtttcatgaaaatttcttcttctaaatcaccatttagaagaactgtttttacatccatttgatggatctctaaatctcttaatgctgatatattcctactagcactctaattgaagttattctcgtaacaaagaatatgtgtcaaagaaaccagcccttctttctcccggaaaccttgcaccacaagtctagccttgtacttatcgattgacccatcagttttcaacttttgtttgaaaatccatttattcccaagaaccttaaacccttgcggtaggtcgattatctaataagtattattttaaagaattgaatctatctcactattcacggcttccttcaaaaaaggagcgtctggtatagacattgcttccctaaagtttttaggttcattttttgcaagaaaggctactatgaactctgaaccgaaagttttttcttttcgagatgttttaatccgtctaagttcatattcttctttgtcattgatagtcgtgcccaagctacttgcctcatttccggagatgcaagtgttgtctcgttgatcacgagttcgcttattactatttctatttcatctccaaaaacttgtcttctagctgcctcgtttttcgaactgtagtttcctcttcctctctaaactctcaaacctagctagctcaccttctctcgcatctggctcacgactctttccgtcgactctcacgaaaatcagtcgacgtcgccgctctcaatg

SEQ ID NO: 14362 - DNA, 3000 bp, Unknown
  misc_feature (1)..( 3000): cDNA_ID_3016361_gDNA_ID_2684111_Annot_ID_190636 3000 nt of promoter + ATG
agctggcatgggttgttgttaacagatggtgaagcgaggatgccttccacatatctcatcctaatgctcattgattcgaacttgttgttaagttcgacgccttgtcggtcgaatttgttttttacttcagacagcttcttagtgatttccattgctcttgtggcttgtccttgaatgagctgctggagcacagtcattatgtctgaattctgaggcgcaggtgcttgttgttgatgtggtgtgaaaccaggtggtggttgctgttgttgatatcttccttgaaactgctactttggaacgaacccttggctttggttgtaaggaacaaacggtttggtttggttctgttgctgctgctgctgagggtagacttggtcctgagggttggcgacattggtgcttcggtatgacagatttgggttgggtctgtagttattgtaccccttgttgtagccaccttgattatgaacatatctgatttcagcacactgatcggtgtccccctcttgtacttggaatggttcatcttcagagatgaagtgaacatgtttctgtttgcatttggatgattttgtctagtttgtcattgagagctttcatctctctgtggtgcttctcatcagagtcagaactggtgaagatgcttctgtcatagtcttcattgtaattgccatccgattgaccaaagttttcaactagctcccatccttcttcaacatccttcttcagaaaattctcatttgaagcggtgtcaaggagcatacgtatcttaggcaagacgcctctgtaaagtgtgttgagaagagaagcttgggtaaatccgtgatgagggcatttggtttgataacccttaaagcgctctcaagcttcacagaagctttcattttgcttctgagtgaatccggatatctcattccggagtcttgtagtcctggagttagagaagaattttgccaagaaggcctttttgcagtcatcccaggtcgtgattgaattctggagtagcgtcttttcccacagatgggctttatctccaagtgagaatggaaacaagcgaagcttgaaaccatcttcactaactccattgattttagtaaggccacagagcctttcaaactcgtcaagatgatctagcggatcctccattggtaggccatgaaacttgttcctctgaaccatagcaatcagaccgcttttgatctcaaagttgttgttctgtactggaggtggaacaattccatgacgctggttgtggttgtgagggaagtcaccagcaccaatgttggtaggttgctcttgctcatctacaacgtcagccattgtgtcggtttctgtttgttctcttagttggcaagcaatacggtcgatgttatcgttgaataggagattctgatttctttgtgaccgtgtatgcatgcaacagatagcaggcaagctataacagacgaatcagagatgcatctgcaaagcgggttgcaaggtacctgaaacacaaagacagaaaaggcacaatgttagtaactattgtaacaaaaacgaacttggtcttaacgtttctaatgatctcaaatatagcaaacaaccaaattggcaacgacgccaaattgatagtaggattttactcaattaatccctaaaacactatcttgtcgttgtagtattttaggatgttaatccaatccggtgtgatgcaaacatatgagatatgattagaaagctctaagtcaagccaagcagaaagttggttggttctaacagtcctagtatgcaataacagaaatgaaatgaaactaaaagaaggaatggcaatagcaggcaagtgaatgacaaagcagaaatgataacagacaatcaaatggataaacgattcctaaggatggggtaatcgaatagtgtggtctctttaatctattcaggcggttgacaaaacttcacagaagctatccctagacaacaagttcaacaacagattaattcactcccgtgatagaaatcctcaagcaaagctagacactgacctaaatccctttagcgatctctaactaagcaggcattatcgaatcaacatgtgaaagtcaataccctctctacagccaatcccttggggttgagtcagatatctctggaattaataggatccaacgcccattaaacgccttctgagcgttggacgtctggactcatactccacattagccagtgaaacaagcaataagcgcaactaatccagaagggattctagaattctaaactcaaccacctaaaacgaccaagtaaaccacaattattctatcccatcctcagaaatacagttcactactcatgataacaaaaatgatgaaagacttaaacgaaaactgaatatcaaatacttgaaagtgaaaatacaaagtcgcaggagaaacactgtggctatcaaagttgcgaaaatgtaaaagcgagataaataacggatcaccacctcatcgagtggatgtcatgaggtggtgatcgagtggtttcttcggcttctcttctcttctttgttctcagcttgtctggttgagtgcagaatgagcagataggcttcctcgtgatcgagtggttctgatggggtgattcctccggtttcgcgattgagtgaatctgagctgcttgcttctccggggttgcgatagagtgatttgccctggcagggatccgaggctgcgatagagtacttttgctgaaggcgtcattgggcattctgacttcatgttctgttttttctctgtttgaactccaaaagcatccaaagtacctgaaaacaaccaaatatgcaatgcacatgcaatcctaatgcaaaatcgtcctaagtatgtaaaacacactaaaacgactcctaatgagatgaaatgtcgatgaaacaatgataaaatggtgaagaatgaatgcctaaatcatgcaaattatagacatatcaagataaaggccatctgtggcgaaaagcacctcctcaagactttatcacgacttgggatg

SEQ ID NO: 14363 - DNA, 3000 bp, Unknown
  misc_feature (1)..( 3000): cDNA_ID_3016345_gDNA_ID_2684111_Annot_ID_190640 3000 nt of promoter + ATG
ggttgagtggtggaggattattcctgcctccttgccttccaaggcggtgagtaaactgatctggtcgaggcagctgaaggtgtcgatcgacacttagtggtgtgtcgatcaacactcttctcgtcacctgcaagaacaaaaggagaaacaagctttcgaagaactctaggtttgttatcttgtgaagcagacttcaaagaatctaaagaattaatcgaaggtaaattagaagagaacttatcacataggtactcaagtggtgtgggctgaaaagattgtgcagaatcctctgtttgagaatcccgagggtgtcgatcgacaggagtggtggtgtcgatcgacactgttgctctacaactatcattgtgtgctgatgggagcgttgtgtgcggctctattatgggattctgagcaccagctgtagctaggaacgctcttccaaggataagaggatccttgggttccttctcatagtcgaggaccacaaaatcagcaaggataaaagagttaccaaccttaataggaacatcttcaaggattccttcagggattcgatttgaacgatccgcgaagaggagagtgatgcgagtcggcccgtagttagtcatgcctagtctctcagcaacagacttaggcatgaggttgataattgatcccagatcacacaaagagcggcttaacctgcctgtggagatagagcaatcaagaatgaagctacttggatctggaagcttcttagtggtctgagcaggagtgatggtgcagatgtactcagcaatgtccactctctgtgccttctctttcctgaccttaggcagcattattgcacttatgtcccgtatcagcaataaggcttcatctgagctaataccaatgtcaacaagttgcttgacatacttgttgagtggggcagaagatgtctcagatgcatccttaggaagagaatggaggatcttcaccattatggctgtgcacttagcagcatgaatctcctgcttagaacgacgcttcctcggataatggacatgacgagtgtaaatagactcgggctgcatttgggattcgcacctcacaaggtgtagtccggatacagtgtcgatcaacacgagagggatatcgatcgacaccttcgtaaggaattgtcttagagaagagcgttccatagggtgtcgattgacacaagaaggtgtcggtcgaaaccatctctacgactgcgagctccaactcgtcctcagtgtctaattcttcccacacatcatctccttctctgatcaagattgcattacagttcttccttaggttagcatcaggattaccaggaagaaagccctcttgtctcttgatggattgtgcagtttgagctacctgtacattgaccttcttcaagtgagagctcaacttcttcagacttagtctcaggctcaatagtctcatcctcagctgcaaaatggacatgcttcttccttgtaagcaagttatgaaccgaatccaacttagcattcacctctgccatctgattgcctgaaacagctccagcaatctttttcctctcaaaatcagcattcttggtgcctttactacaagcaaggttctctattagagctgtaacatcagctggatatctcgtgttgaaattaccattgctcgctgcatctagatctatctagtatctccaatcgactcctctgaaaaaggtgccaagaatttgtacctcactgaagccatgatacgggcagtcccgttgatattccttgaagcaaacccaattagccttgaaagcttcagctggaccttgggtgaaggtagaaaacttgattctcaactcctcagacttagcatcatcgtagaaactgtttaagaaagctatcttgatgcttctccaattcttgagggaaccggctttaagttgttttagccaagaagcggcttccccaacaagtgaataaggaagagcttgcacaataggtagtcctctgagactccattagcgttgatgctcagaacaaggtcctcaaagcgctcgatatggtcaataagctgctcatgagataagccttggaaaggatgctggccaactaaagcaaagtagccaggatttagctcataatcgttcctcaggaagggtgggggtacgatcgctgatcgattagcatagaataggtcaggtctgttgaaatccccaagggtacgacgtggttccgcagtagagtggtaaacacctctgttgcaggaggaataactgctggaatcttaggttggtgtcgatcgacacctctgttgtgtcgttcgacaccaatcgtgtcttcattctaatcccgaaggtgtcgatctacacctctgatgtgtcggtcgacaccaagcccttctgcgtctctggcagctaattgttcattgaggcgcacctaattctcattggcatccttaggtaggatgagcccatgatcatccaatctctgaccagcttcattgtaggcttgcccatcctcatctctcaaaactccttctgcatcacctctgatgactctgtcacccattgcttatatctgggtttttcggttggtgcgctcaagttttcccaagtccagaacagacaagttgatcagatagaaagcataaacacagcaatagagaaaaaggaaagaaaggatctgttcatcgtattgaaaactgaatgaatatctgaagaacaagggatgaatagcttatgtctctcaaaattaggttttacaaaaagcttgataaaagaaaacttaggtctaaacaatgtataaaaaccctataaaatgttcagagactaataatgcaaatagggaagtcctatgaggcaaatttcctctttagtaaacttgaaagcgtgataacacgatattttactcattctagacatgtattaatcatcatttcgcttagttatcactcattgtttcatatcatttgcatcacatttagcttattttgcacatttaggcatttaagatcatcttgcatacatattgcatg

SEQ ID NO: 14364 - DNA, 3000 bp, Unknown
  misc_feature (1)..( 3000): cDNA_ID_3016541_gDNA_ID_2684112_Annot_ID_190646 3000 nt of promoter + ATG
aaactcctatggtgtacttgaacagtatagcaaaaggttgtgtagcaaatattgctgccaaactcgagatcatggagccatgttgcagtgtcaaggataggtctgtagcttaagtcttttgtggcttgtttgtatgtttttagttgagtcccttcaagtcctaacttttatgtttcacggattcaggattgggtacagtatggttactgatgctgagcaaaaaggatttatatcacctggaaaggtatcgattatagattgatcagtcttttgtaaagtttaatggatgagaccagcttttacacacataaagttgtacaatctatagtctgttatttctggtggttaatcatgtccttactgcattgatctagagtgttcttgtggaacctacaagtggaaacacgggtattggcctagcattcatcgctgcttcaaggggctatagacttatcttgacaatgccagcatccatgagtatggaaagaagggttcttttaaaggcatttggagctgagcttgtattaacagatcctgctaaaggcatgactggagcggttcagaaggctgaagagatcttgaaaaacactcctgatgcatacatgctccaacagtttgacaaccctgcaaatccaaaggtttgtggtttatatttttccttatttgtgtcatgatttggtttttgctctagtcatgtaccataagaagagaaatgaaatgttaagttagagttaaccagaaactcatctgtatttagagaatgcccacaagtgtgtaactgaagtggttttcacttaaactgtacaagcaaattgggaagtggctgatcctttgaaatcggcatgatcttctgtgaggttctcttgtcacgtttgtaaactcaagtttgaatatacgcagattcattacgagactactggtcctgagatctgggatgatacaaagggcaaggtggatatctttgttgcaggaattggaactggtggaactatcactggtgttggtcgatttattaaagagaaaaatcccaaaacgcaggtagatgcaaaagttcaatggtttcattcttagctggagtacattttcaggtgttatttagacagtattgtatgttcattcaagcaatataattcgtagttaactattcgatgtttacatgtaccaggttattggtgtagaacccaccgaaagcgatatactttctggtggcaaaccgggtaaggcttgccaatagatatcaatcagtaattttgtttccatgatttcgaaatatgatcttatattcacgtattttgctttctcttgcatttatacaggacctcacaagattcaaggaattggagctggatttatacctaagaatttggatcagaaaattatggatgaagtcatagcggtatgatttattttgttggattctgtatggttatacaatttatctggtttccacaaaacatccacaattcttgtgtcaatttattgcttaaattttccaattcctgagactcaaacttcatcaattactatcttctttttgcgtttaccagatttcaagtgaggaagctatagaaaccgcaaagcaactagctcttaaggaaggcttgatggttagttctttgcagtatttatgatttctgagtgggaaccacacggatgttgtggtgtcatgttgcatgtgaaaggtggaaattacacaagattcttacgtgaatgtaataatcttgtcaggttggtatatcatctggagctgcagctgctgctgcaatcaaggtggctaagagacctgagaatgctggaaaactcatagctgtaagtcttttcggtttcagttatgtgttatgtcttgaaaacaaaaaggtggtgcaaggggtctttgtgcaacatatagatggattgctttagatttcatcttaagatagatttgaggattattaaagtctcccgagtctgtgatccaatactaaaccaaagaatcaacaatatagtcacttggctagttagattgttaaatcttctaagtaggtaactgttaatgaatctatgaatgcggtttttcaggttgttttcccgagcttcggggagagatatctatcgaccccgctgttccagtctatccgggaagaggtggagaaaatgcagcctgaggtatgaacattagcaacttggtctacttctgcaaagctctttctcccataattacagtctgagtgctaagcaatttatttttatcaataaggcattagtgaatgtggtttgagttctattttggatatccaacactagtctatgttttactcaacattttctgttggaaatcccaatgcttaattatattgaattgaacaagatgattgatcccttgtttgtttttcttgttaacctaaaaaatattaactttcatgagtattttcatatataatgatcaacgatgataggttagtgatataactttactttttcatgtagaccaatagaaaaaaataaaatcagaatctaactctaaaacatgtcaaaaacttatttttaatacaaattttgtggtcaaaactttggatgtgaaacttactttgttcgattattgcttttaaagtactttttgatgttttccagttttcacacagttttaagatcatagaaaaatcccgtctttttgaaattttgatccatatattttctaatgctcagagagtcagcggttaatattaggattaggacacgctctaccaatcccacgataattgctttgaatccaatgaagattggaagattattatcttaattgctttacgacttggtttaggccccatgtgtgtgtaaatacataaatttttaatatgaacaacgcggaaatccatgtgaacgttcgtttccattttgttcgaccctacttttgcagtttggaattcttttatactcttacttaactctcaatgagatgataaaaatatctcatatgatcaatttcttcccataagcaaaaacaaaaaaaatcctaacatg

SEQ ID NO: 14365 - DNA, 3000 bp, Unknown
  misc_feature (1)..( 3000): cDNA_ID_1021998_gDNA_ID_2684112_Annot_ID_190672 3000 nt of promoter + ATG
gaaaatcgatttgaagatggcgagcgaaagtcctgatgttgctgttgtagctccggtggtggagaatggcggcgctgagtcctctaatggtaaagaggaacaattggaatctgagctttcgaagaagcttgagattgcagaagatggtcaagaggagaacgatggagaagaaggaagcaaaggtgaattaattgattagctctttttttggtgttctgattgatcacttggttttgtctttgcgtctttaatttatgtacccattgagaaattatttgatctttttgtgttactgattagtagatgatgaaaaatttggagtttaggaatgttatagtggtgatttcaaagttctcgatttgattctttgttctgagaatggttgattaataaagacatatgtttttgatatatgaagctgagacttcaacgaagaagaagaagaagaaaaataaaagcaagtaagagatgcttttgtttcttttgtttcttctgacttcaaacttttggtgtttgctttagtgattgttttgtgattatgttgtaggaagaagaaggaactccctcaacagactgatccaccttcaattcctgtcgttgagctcttcccatcaggagagtttcctgaaggtgaaatccaagagtataaggatgagtaagtttcatagcattctatttaccattgtggacagcttttagggaaatctttcatatgttgtagttgactttgtggaagagtccataccacttttatcttctcaactcatgaatctattggattctcggtcctttttttttgtgtcaagtctcttcgttgttacctttatcacactttttgtgccgacatgtttagatcttggtgcttgtctgcttgatctctgtttttttagtaatctttggagaacaacatctgaagagaagagagagctggagcgttttgaaaagccaatatataactctgttcgccgagctgcagaagttcatcgccaggtttgcttcttgattagagtttttttatggctcttttctgcagccgcttgaaagaacgttttgcccaatccttttcaggttcgtaaatatgtcagaagcatagtgaagcctggaatgttgatgactgatatatgtgagaccctagagaatactgttcgtaagttgatatcagagaatggtcttcaagctggtattgcattccctacaggatgctctttgaattggttggttatgagatctgcctttaactatttctttcgatcaacaattgtttgttcttcttctttagtcatgtttctctaatgactttttaacattcagggtcgctgctcattggacaccaaactctggagataagactgtacttcagtacgacgatgttatgaaattggactttggaacacatattgatggtatggcagtatctgttttctgtttttgtttttcattgaggcaaattgtcagataaaattaacatgtcttctttttgcagggcatattattgactgtgcatttacagttgccttcaaccctatgttcgatcctctcttagcagcctctcgtgaagctacgtataccggtatcaaggtctggacctatttgctaatatgcagtcctttatgaatgtacaactaccagtagggtggagcaatgttgtagtgttttgttctattcgtctctatggaattttataattccaaactcttcagtgtgaaattgatttcatttaggctttgatttgttaggaactatttggttattacttttgacctccttggtggttttttttggctggttcaggaagctgggatcgatgtccgtctctgtgatatcggtgctgctattcaggaggtcatggagtcttatgaggttgaaatcaacggaaaggtcttccaaggtatccaatgtcacatctagattacggctcttacatcaatgtcacattttgacgttaatataataataaaccttaacatgttatgtccttttggcagttaaaagtatccgaaacttgaatggtcacagcattggaccctatcagatacatgctgggaaatctgttcctatcgtaaaaggaggcgagcagacaaagatggaagagggcgagttttatgccatcgaaacatttggatcaaccggtaaaagaaacttggacatagaactattaaaagaaaaggccgctgcatctttggaattcaccaatgtttgatcctctgtatctgttgtattgcagggaaaggatatgtgagagaagacctagaatgtagccattacatgaagaactttgacgctggccacgtccccttgaggttgcctagagcaaaacaactccttgcaaccattaacaagaatttctcgactctcgccttctgcagacgttatttggaccgcattggtgaaaccaaatacttaatggctctaaagaatctttgtgactctggcattgttcaggtaatttcttgcacaatctagatgatgattcatttatctcggatctatcctgagatctaaatacacttaaatcttgctctctgttttatttcagccgtatcctcctctgtgtgatgtgaaaggaagctatgtatcacagtttgaacacaccattttactgcgacctacttgcaaagaagttctctccaagggagacgactactgattcagatcctctgttttgctctgtttacctttattatctcatactgttgtcgagattgtacacttgcttgtttcttttgtcgtcgttaacacaagctttgaatccttttataaaaagcttcagtgcctctgttaaaaaaaaactatgtatttgccatgaacatgaatttgctcatcaatcttactagaagttgattgataaagctccttgctttggagaattggtaaagctactaatttgacaagatcatataaaaagatatataaatacagatatggtaaagaagagagaacactgggatcacacagagatcttagccaatagacttttgagctactcgaggcatttccatg

SEQ ID NO: 14366 - DNA, 3000 bp, Unknown
  misc_feature (1)..( 3000): cDNA_ID_2990209_gDNA_ID_2684112_Annot_ID_190671 3000 nt of promoter + ATG
agatctttcccaattaatccggtctattgccatgtcttcctcgaagaaggttacgttcgattcacaatcttcatttcttctctttatgaaattatttctcgtatgatcttagtttttctctgatttcagggttccgatcggaatcaaatcaggaagtcgttgaggaagttaaaaaagcagattggggaattggagaaacttgaatctccggatcggttgaataatgtgaagcctatcttcatcaagcgcagtatccttttctgttgtcacaagatgctatttttttttgtcatacaaaactgtggaatattatttgttttcacatgacgagcttggttttaagatatatacttgaagaagaaactcaagaagaaagttaaggatcatggcatattctgttcttgctccttggatcctggttcttcaactctttgtggcagcgattgcaattgtgggtatgttccatatctgatcacaagtacttgtctgactaaatattcgtggcggcattggttctgattgttgatgtattgttggttttttccttgatgtataggattctactctcaagctgttcgtctagttgcaaatgcagtagtgaatgcaccaacaagccgttccaacaacgacatatcaagaagatgaagttagttcaggttggtttattacaatttgttgtcttatataaagaatgcattttcaacgttagttgaataagttgttgcttgcagacagagaaatgtggatatgggattgtagcagatgaagatatcaactcaggagagtttatcattgaatatgtgggagaaggtgatgttattacctttggtttctcatatatagttagagtactgttgtgattactctgcttactcttatcaatcttcttatatccatttcttattgtagttattgacgacaagatttgtgaagaaaggctttggaagctgaatcataaggtcgagacaaatttctatttgtgtcagataaactggaacatggtgattgatgctactcacaagggtaataaatcaagatacatcaatcacagctgcagtcctaacacagagatgcagaaatggttcgtttgtaacttattatccatcttctcacttttcttctgttcaaaacaattgagcaaagttatagatcatgaacctttttgttcccatttaggataattgatggcgagacaagaatcggcatttttgctacccgtttcataaacaaaggcgagcagttgacttacgattaccagtaagaacatttccttgcatcacaacaataaagtatttgaatgtaaatgtttagttgtgtgatactaataaatatagcaggtttgttcagtttggtgcagatcaagattgctactgtggtgcagtgtgttgcagaaaaaagctaggtgcaaaaccttgcaaaactaagaacacaaccttagaagaagctgtgaagccagtggcatgtaaagtgacctggaaaacgcccaaggtaaatttgagctttgccttacttttttttagtcatcctgtgattgctaaacagtaacttgtcctttcaaacatatggttagggaaaaactcgagggagacgcattgctggttagtattaattatttggctcgattatcgacaagcttctcaattcagaggtaagagaaaccaatttggatgcgtcaggacaagcttggaacaatcatagccagaggaaaatatgttgccgggactgcattggtgcggtgatctggttagcacgtcccatgaaccaaaagtataactatctttctttttttctcaaaaaccaatttcttccacaccaaagaacagtattacacggctcagatgaaggttttgactctagtagttgacatttttcaggtgttttggaatcattacacaatatgatgagttttaaataagcacttggtatctattcatttgacttattgccaacactgttgttcacattctatctcagtttacgaaatctaaagaatgaacattgactttgtccaggtcatgtatgaggatggtgttaccgagatcatcgacatgtgcagagaagtttggaaggttgtaactgcttgatattgtgactgttccaagtctgatttcattcccttacataggattacacttgaattgtcaagaaattttgtaaccaaccaaaccgtgtcggttggcaaataggtttagactttgttgttgtatgtatccaacttgaatcagtagttcagtagtacattacactgtatgtggaatctttggaccaaataaagaaaagtgtttttggattttaaaccggggttttggttatttaagagacaaaaaatctcatacccggtttgctctgtctataactcgagtttgttaagcacgtgattctccttggcaatgctgctatatcactagcctactgtccgttgtagcggatgatacccacgcgccggtgaccgacagtggatttgccgttaccggtggtaggtaatgtggggtcgtagctcacctacctaactaaattttctttttcttatgtttagttggaaaataagaaaaatataaaaactagttttttgtaaaggaaaaggataaaattactattatggaaaagataaattccaaaagtgaggaaatatgtatttagcacaataaaaagtgatagcaatgtgagaaaaaaaacgtgataacagaaatgctgtgctaaatttggatttctttgttgaaaatatatttacattgataaatattatgtaattagaaaaaggaaaattcaaaatagatgtgtagaaaaacaacaatgttgataatataattttttatctaaagtttttaccggttaccagttaccaccaaagttgttggatctctatcttcatttttagagattagtataaatgagtgagtaaacaaaccagagagaccaaacttgcctctccaccaccacttcctctacctatctaattccgaatctggatttggatttggatctcatttcgattcaacg

SEQ ID NO: 14367 - DNA, 3000 bp, Unknown
  misc_feature (1)..( 3000): cDNA_ID_3016469_gDNA_ID_2684112_Annot_ID_190669 3000 nt of promoter + ATG
gaaagatagttatacttttggttcatgggacgtgctaaccagatcaccgcaccaatgcagtcccggcaacatattttcctctggctatgattgttccaagcttgtcctgacgcatccaaattggtttctcttacctctgaattgagaagcttgtcgataatcgagccaaataattaatactaaccagcaatgcgtctccctcgagtttttccctaaccatatgtttgaaaggacaagttactgtttagcaatcacaggatgactaaaaaaaagtaaggcaaagctcaaatttaccttgggcgttttccaggtcactttacatgccactggcttcacagcttcttctaaggttgtgttcttagttttgcaaggttttgcacctagcttttttctgcaacacactgcaccacagtagcaatcttgatctgcaccaaactgaacaaacctgctatatttattagtatcacacaactaaacatttacattcaaatactttattgttgtgatgcaaggaaatgttcttactggtaatcgtaagtcaactgctcgcctttgtttatgaaacgggtagcaaaaatgccgattcttgtctcgccatcaattatcctaaatgggaacaaaaaggttcatgatctataactttgctcaattgttttgaacagaagaaaagtgagaagatggataataagttacaaacgaaccatttctgcatctctgtgttaggactgcagctgtgattgatgtatcttgatttattacccttgtgagtagcatcaatcaccatgttccagtttatctgacacaaatagaaatttgtctcgaccttatgattcagcttccaaagcctttcttcacaaatcttgtcgtcaataactacaataagaaatggatataagaagattgataagagtaagcagagtaatcacaacagtactctaactatatatgagaaaccaaaggtaataacatcaccttctcccacatattcaatgataaactctcctgagttgatatcttcatctgctacaatcccatatccacatttctctgtctgcaagcaacaacttattcaactaacgttgaaaatgcattctttatataagacaacaaattgtaataaaccaacctgaactaacttcatcttcttgatatgtcgttgttggaacggcttgttggtgcattcactactgcatttgcaactagacgaacagcttgagagtagaatcctatacatcaaggaaaaaaccaacaatacatcaacaatcagaaccaatgccgccacgaatatttagtcagacaagtacttgtgatcagatatggaacatacccacaattgcaatcgctgccacaaagagttgaagaaccaggatccaaggagcaagaacagaatatgccatgatccttaactttcttcttgagtttcttcttcaagtatatatcttaaaaccaagctcgtcatgtgaaaacaaataatattccacagttttgtatgacaaaaaaaaatagcatcttgtgacaacagaaaaggatactgcgcttgatgaagataggcttcacattattcaaccgatccggagattcaagtttctccaattccccaatctgcttttttaacttcctcaacgacttcctgatttgattccgatcggaaccctgaaatcagagaaaaactaagatcatacgagaaataatttcataaagagaagaaatgaagattgtgaatcgaacgtaaccttcttcgaggaagacatggcaatagaccggattaattgggaaagatctaaatttgatgttgaaacttttcaaagcctaatatttgaagagaagaagaagacgaggatgatgatgaatttgtagtggcggatccgatttgcagagagtgaaaagacgtaacggagaaagagcggcagttgctgtttttccttttgaggattttgaaatccttctgcgcaaaaggcaataaatcggcttaaaagggtaaaagagtaatatcgatttatttccattcatccgtttaaagacataaatgggcttcagatttttggactggcccaatacaatcaaacccattttgtttttggtaacaaaataattaatttattactagtcatttgcatttattccagacagttatatcattcacaattggtaactaaataattactcctttttaccgtaaaattgatattctgtatatcaagatattcaacgcacaaggaatttttttgaacaatatattcgatttgctttacttggtttaagtcgccggtaaaatttatttggtttaagtcgccggtttaatttagtttaacactgatacatttgacaaatacgaactagtgacaaaattatactgccaatggaaaaacatattcgaagctaatataaaatgtaatgatccatattcgaagcttaaaagatataattacgtaaaatagagaagagagagagagagaacacgaaacttttatttcgtaaggttacacgaaatcgatcttccgcaattcaaacttcgtctccgttaattcgcactctcgttctcgtcttcgtcgccggaggtcgtatcaagtcagcctcaacgatccgatttgttttttcaggtgatctatctttatattctgctagaaattccaaaagttgtgaaaatttcgttcctcggatcggattatgaaactctctgcgtttgtttagtgattaatcgagctcttactcttgttccttttgattcttatgctttctggtgtatatatacgagattttagttgccaattttatagttgactgattgatcatttgagattactgtagagatccgccctggagaaattgcgtcggagttcttttacttattgcatgattgtgtctcgaatttctattgctgctgtggatttcttcattttcgagattgtgcatatcggattcgagtacctttatcttactcgttgtgttcattagatcatctttgattcctaaattcgatttttggggcatattgaaatg

SEQ ID NO: 14368 - DNA, 3000 bp, Unknown
  misc_feature (1)..( 3000): cDNA_ID_3016479_gDNA_ID_2684112_Annot_ID_190666 3000 nt of promoter + ATG
cggaattgttttgtctatgacatttagtaacatcagcgcccacaaatactagcagtgtcatttgattatcctgacaaccaattacatacagatataaccaaacactataaccagtaaggaaaaatttgtgcagctacaaatatacctaaggttcccgtgagtgaagcaaaataaaaagaaacagggaaaaatagaaacagccaaccagtctaagcaccccaaatctgctttagaattatacttaaagagaaattaaaagattgcatgattacctttgagccataacagttactgtatcagaaagactcattgtccggctctggcaagcagagacacaagaagcgagaaacgaagtcctaagagtagctctagtaaagtcatgagcaccatgacatatgatcttcttaatcaatccggtgatcccctgaaactcaggctttgtactcaagaaccaaactgaatctagaccaacacacaacaaatcatttaaagtctgaggatcagccaactgaatcaatctctcagcaagttcccaatccagtgaggtaacagcgccttggaagagccgtcccaactcaattctttcttgcctattaagctttttctgctgctcaatattttccttctcaacgagatcatcatcccctttaaaatttagtttcttagcactacaaccacagcattctcccgaattagttccagctgaatcctttcctattaaaggtgcctctctcgaaaaaaccactttactcccctcgcctccttcaaatttctgagatgaagcaatggtttcagttttcatctcggaacagaaaggctcatcagggtacatctgatcacttaaattaatggtatcacacacaccttctttctccatccttgtcaagtctgtgactttccaaatcaaactaaaaaaagaagcacacaaagcttattcatccaaaagctatccgcacaacagaccacacactaaacaaagtatatagcaaatccaatccttgcatcatcgaaatctacaaaaccaaaggccaaaactcaaaacccggaactgatccctatcaaaatccaccaacacagttcattctaatcagcgtaaatcctcgatgccttctcttaaacgcactatctcttgaccatgggcataggaaatcaacaacaaaccctaaaaatgaaacaataaatcatcatcatcagcaaacggaaatctatcaattcgattaacagtgaacacgaaatcggacacccgatcagaaaaaaacgaatcgagcatcagaaaagagcgaagaacaacgaaattagcgttatacaaaagaagcagcacatgaaccatagaagagaaaaagagagagagaaaatggtgaaacctggacaagagttccattgagacagagagagagaaagagaaagagaggctgagaaaaaccctgtgcatcgggttctgtttttttatttttatttgacaaaagtactgctttttaatacaaaaatattctcttgatttattaacatttgtcgaatctttagttgattaaattctaattatagattctctcttctttctgtcgctgttaatctcccattgtaattcagaatctatgggaggggaactcaaactaatgactacaaatcatatggaggagacaaaaagacttggaattatttttaggaatcattcaacttataagtgttctcatttttttgttgtccctttagaaattagattttaaataagttgcgtcaactatacaaaaacatttcttatttttattctatctatattgcatcactaacatttttttcctttctatttctgtagtttaaaagactcgggtctttttacttctttgtttagtggttattattacattaagaaggaaaaagtaaaacaaatcatcatataaataagaggacgataaggatcggtcttcagctataaacaagtaaagaaagttgagattcgaagactctttataagtcattggatttgtagtaaataacaaattaacaacacaacaaattaacaacacatatactacaaattcgagttaaaaaccccaatataatatatgcatcgactactaaacgcgtttcaatgactggtaaacatatgtaactatctctgttacatattgaatgaatgatgatgtaatagtagatgctaacataagctcacaattatttgaataattaaagtcataaataaaaatcatctataatgcgtgtaagcttgcataaaaatacagtatataacttttatttaaaactattaagtatcaacatcaatcggaaaatgatttgcttttgaagttattacaactagtttattaaaaaaattgttatcatcatctcgattttaataatgctatatatacttagtcttttatttattgttattgtaatatgcgaaaatgacttgcaactgagttgcttacgggcaaacctgaccaagatgtgggaagttcgaaactgcaaatatgtataattcttaataaaaaaaaaatatatcctacatttcttcattttttttttaaaatactaatatttgcatactttgttgattgagtttctgaaaaatcataattgagtttttaaattagttggtttgtatgcatttgacaacttccaatttcttttaaatatatcacttttcatatattcttgtagagctataattttacaacaataattgaaatgtcgacccaaaaatatacatttaaaggcatttcgctgataaaaatccagtttagatgtatttgtattataggggaaaacaattatattattggttaatatttattagtcgatattgggtacatatgtatgttcttttacgattatgccatcaaaaaatttattagccattcgagaaacaaggcatctctatttttttgcttcttctaatagacttcttcgtcactgatctcccacgacgatctcccaaactcatttctctacgttcatcgatctctctctttctcgtttgctctacgaaaatcagcc

SEQ ID NO: 14369 - DNA, 3000 bp, Unknown
  misc_feature (1)..( 3000): cDNA_ID_2991077_gDNA_ID_2684112_Annot_ID_190665 3000 nt of promoter + ATG
ggcctccataggagtagctggcaccttttgaacctgcaggaaaattttcatcaacaatttaagagttatcagcaaaatgatattttaaaatgtcagcaacaaatacatcaaatgagaagtttgtacctttcctttgacgaaaacatagcttccatcaacagctttgaaggacaaatactttgtaacatctgtatgaataagggtacgaacaagcttgccatttcccatcataaactggtcaatggcattgagagacaagagttagtaagtgacattgataagattagcataaaaacaaaacaaatggcagctagctataataccttaggcatcatgtcaacattgtaatcccggctagcgcctaaatgctcaggagccttctcttctcccctgaacttcttccaaagctgattgagattaagggaagttgattctccaccatagtagtcattcctgtccatgtgaagcacctactcgtcacatccacaaaaccaataatcagatcgcgggaacactaagaggtcaatgtacatatgtaaaagccccaaaacattttcaatcatctccatgctcaaactagacaatcaaatctcatcatcattatcaagatcgaaaacctgagctcagatcatacaatcggggagatctaatctaatctcaccgagatccgtttttttgaatccggatcaaagcaattatgcgaaattcaatcatgaattcaaaggttcaattgaaaataagagagaagaaaaacgaaaaacgaatcggggaaagagaggaaggagaccttgacaccatcgacggaaaggagaccgctgaggatacactccttgagaccggtgccgagaacaataacctcgtactcttcatccatggctgattttcgtagagcaaacgagaaagagagagatcgatgaacgtagagaaatgagtttgggagatcgtcgtgggagatcagtgacgaagaagtctattagaagaagcaaaaaaatagagatgccttgtttctcgaatggctaataaattttttgatggcataatcgtaaaagaacatacatatgtacccaatatcgactaataaatattaaccaataatataattgttttcccctataatacaaatacatctaaactggatttttatcagcgaaatgcctttaaatgtatatttttgggtcgacatttcaattattgttgtaaaattatagctctacaagaatatatgaaaagtgatatatttaaaagaaattggaagttgtcaaatgcatacaaaccaactaatttaaaaactcaattatgatttttcagaaactcaatcaacaaagtatgcaaatattagtattttaaaaaaaaaatgaagaaatgtaggatatattttttttttattaagaattatacatatttgcagtttcgaacttcccacatcttggtcaggtttgcccgtaagcaactcagttgcaagtcattttcgcatattacaataacaataaataaaagactaagtatatatagcattattaaaatcgagatgatgataacaatttttttaataaactagttgtaataacttcaaaagcaaatcattttccgattgatgttgatacttaatagttttaaataaaagttatatactgtatttttatgcaagcttacacgcattatagatgatttttatttatgactttaattattcaaataattgtgagcttatgttagcatctactattacatcatcattcattcaatatgtaacagagatagttacatatgtttaccagtcattgaaacgcgtttagtagtcgatgcatatattatattggggtttttaactcgaatttgtagtatatgtgttgttaatttgttgtgttgttaatttgttatttactacaaatccaatgacttataaagagtcttcgaatctcaactttctttacttgtttatagctgaagaccgatccttatcgtcctcttatttatatgatgatttgttttactttttccttcttaatgtaataataaccactaaacaaagaagtaaaaagacccgagtcttttaaactacagaaatagaaaggaaaaaaatgttagtgatgcaatatagatagaataaaaataagaaatgtttttgtatagttgacgcaacttatttaaaatctaatttctaaagggacaacaaaaaaatgagaacacttataagttgaatgattcctaaaaataattccaagtctttttgtctcctccatatgatttgtagtcattagtttgagttcccctcccatagattctgaattacaatgggagattaacagcgacagaaagaagagagaatctataattagaatttaatcaactaaagattcgacaaatgttaataaatcaagagaatatttttgtattaaaaagcagtacttttgtcaaataaaaataaaaaaacagaacccgatgcacagggtttttctcagcctctctttctctttctctctctctgtctcaatggaactcttgtccaggtttcaccattttctctctctctttttctcttctatggttcatgtgctgcttcttttgtataacgctaatttcgttgttcttcgctcttttctgatgctcgattcgtttttttctgatcgggtgtccgatttcgtgttcactgttaatcgaattgatagatttccgtttgctgatgatgatgatttattgtttcatttttagggtttgttgttgatttcctatgcccatggtcaagagatagtgcgtttaagagaaggcatcgaggatttacgctgattagaatgaactgtgttggtggattttgatagggatcagttccgggttttgagttttggcctttggttttgtagatttcgatgatgcaaggattggatttgctatatactttgtttagtgtgtggtctgttgtgcggatagcttttggatgaataagctttgtgtgcttctttttttagtttgatttggaaagtcacagacttgacaaggatg

SEQ ID NO: 14370 - DNA, 3000 bp, Unknown
  misc_feature (1)..( 3000): cDNA_ID_3016519_gDNA_ID_2684112_Annot_ID_190653 3000 nt of promoter + ATG
tcgaggcgctaaagctccggtatgatatttaaaataaagatgattggtctctatgttttgcttcatcttcaacatttgtttgtcgttgatttttagaaaactagaaagactccaatgacggtagggaatccaaaagaagttcctgagtatgagcttaatccactcgagctgcaagtccgaaaagttgatggcatttcaaaggtttgttgattttcctaattgacaagagccaggtgagattttttgtccgaagtctctcttattctgatgtgtttgtgtttgcttaatttgcagggaacttatcaagttgctaaatggaatggcacgcgagtctcagtaaaaatattcgataaagatagctattcagatcctgaacgagtgtatgcattattcttgaacttctctgtatgattttgtccgtagcatgaagtaatctaacattgtgtttgtctatttccggttcttttttacgagcagaaatgctttcacaaacgaattgactttgctagcaaaagctcggcatccaaatattgttcaatttgttggagccgtcactcaaaatctaccgatgatgattgtagttgagtgtaatccaaaagtaagtacgcattgtttcatacttcatttcagctcattgaatcacaaatgtggcaagcaatcttgtttcattaatcatctcaatttcagggtgatctaagtgtctatcttcaaaagaaaggtcgtctttctccttcaaaagctctgagatttgctcttgatattgctagaggaatgaactacctccatgaatgtaaaccagatccgatcatccactgcgagttaatgccaaagtaagacaaagccgagaacaaattatttaatggcgaaaaaacagtttggataatattttgaaagttttttgtaaggtgccagaaatattttgctagatagaggagggcaattgaagatctctggttttggtttgataaagttgtcaaagattggagaagacagtgcaaaagtagtgaaccacgaagctcaaatcgataagtcaagtaagaaaaaggctgcattttaagttagaaacagattcatatatatatatacaagttagaagcattgttcttgaaagatcctatgcttaccttttgaactgcagattactatatagcacccgaaatttacaaagatgaagtcttcgataaaagggctgatgtgcattcgtttggtgtcattttgtacgaggtagtaacacaaagctttagccttttctttgtaattaaatgtctcggtttcaaactctgcaatgttgttttttggtttcatatgtgaagttgaccgagggagtatctttattccatcctaaaccacctgaagaggttgcagaatcgatttgtatagaaggtaaaagaccaacaatcagaacaaagtcaaagagttaccctccggaattgaaagagtaagcatttcaagatcatcagctattattacatatatgattgttttacaaacattaacatctcaagaatcatatgactatgtaggttgattgaggaatgctggcatccagaaatcagtgtgaggccaatattctctgagattattattcggctcgacaagatagttacaaactgttccaagcagggttggtggaaagacacatttaagttcccttggtaaaaacaaagtttcatcttctttaatctgaatatcaatcctcagttaagtcaaagatttatgttcatcatgttttgtattttcacaggaaatgaaatggaaatattgaatcaatccaatcaaatcttaaacttaaaccccaaagatgaagaaaaaacaagatgagagtgagattttgcagaagactcaagaagattcacaaactcatttgctttgtagaaacagaagatcacttttttgttttcatgtttgtttgtttaatatcataagtttttgagttatttgtaaagttatattttatgataaacatcacttgttcatactgaaattggaagcacattttaatttctagataagagtcttatcataagaggtgccggagggaatggatacaaaaagaaatagtagttgtcggaagtattatctcaagttgaaggcaattatcaaatccaaactaacacttctaataaaataaagttcattttgattcaattggtaaaaaaataaaactttaagattctgatgtaaatttgtgtgtgaagtgaacaatattatttttgataaatgatctaataaaaatcatactggatataaataatacttggtaaaagacattttttttgtttgatgaagaagtaaaagctttaaaaaaaaaaactaatttaattatgaatacaaccaaaaataattatagaaaaataaaatataaaacgatcctttcgtcttggcccttggggttcaagtataatatctgatcgtggattagcccacgtggttacaatcgaaaagatctgggacctagatctgatccaacggtttagaatcactcactcatacaggtgtgagcaaaacaaatatctttatttattctgtcctaaaaagtgatacaaaaaaataagtaaagaaaaatctaaaaccctttctcacgatttatttgccgcatccctaaaacctctcaaatttctccggcgtgattcactttctccggtaaacagcgttcgtcattttcagattcctccgtctactgtaagttatacttcgttattttcttcaatatcttcttcgaattcctcatatttcttaaaatcaaggctttgcatttcgattgcttgcgtcgcttcatttttcaactctattcgagatttcgagaattgtcgtcatttgagagttttctagggtaaatattgtgatttttctcataccgatttcgatttatcgtctgagttttgtttcggttcgtagattttgatagcgatttttcctctttcaaatctatcaggagtgttctcttctgggagatgttcaggtgattcatctttgcacaacaagggatttgacaaaatg

SEQ ID NO: 14371 - DNA, 3000 bp, Unknown
  misc_feature (1)..( 3000): cDNA_ID_3016523_gDNA_ID_2684112_Annot_ID_190652 3000 nt of promoter + ATG
gatcgttgagtgaatacgctaagcgatacataaggcagcttcctacgcttcctcgccaatctttcactgagaaattcccgaacgtgcctcccttagcaatagacttggtggagaagatgctaacatttgatcctaaacagagaatctcaggtcagtttctgtctccatatagcctcttctgcagttttatttggattcttatcatcagttttgccactttgcagttaaagaagcacttgctcatccataccttagctcgtttcacgacattaccgatgaaccagagtgctcagagcccttcaatttcgatttagatgaacatccattctctgaggagcagtttagagagttaatctactgtgaagccctagctttcaaccctgaaaccagcaatgattgaaaaggaccatatctttgatccttgttctgtttttttcttttccttctctgcttttctttgaataatttcccttttcatttcctttaattttttcatctctcagaaattttgttgtgctaagattttctgctagattcccttttgatgttgtcaaatttcatttttaagcaaataaactgaaaaaccatgattctgtgggcatcattgcgactttcaatccaacaaatattaatacatgagctattgtcaaaaatataacattgcaacaaggaagaaagcaatcatatcctactttgagtattttgattgaagacaatcttactctttgtaatagttcatttgcagttttgcttttgtcaattcttcaaattgccaaagaatctagagagtggtacagggccatcggtttcgtgtttacttttgctagagtgtttgtctctgctggacttgtgcttcttctccttctttgatcttttcgaacttgatcttgatcttctagattcatcttcatcactgctagatgacgactctgaggacgaataatgctgcaaattcataacacaaccgatcatggttcatgttagcataagctagaaaacctcacactatctgatataagctaaacttttagaaggcacctttctctttttgcttttcttcttctttgaatctctgtctttcttatctgcgaggtcattgaaccattggcgaccagttaataacgtcctcagaaagaaggtttagatgtcatgttaagttaagtggattatgtttaccttttcgtgacttatcactagaatagttccttcctttggagagtttcaacgacctttctgcatccagctgagctctatactcacgcatcagtttatcggtatctgcttcaagttctccctttttcaattcttcttcctacacatgttacacgaaagaaagatataatgttaaacatttcctaatgttccatactcacaatacagagagactgctgcaagtagtagtaaaaaactgatattgcagataataaaaatgtttaaaaaatgagcatgactagagttacttgaaaaccgcgagatagggatagatgtaatgtagaaggaagacacactcatttttatataaacacacaaagactgcgtatctgtggctgaagatgataaacagcagaggaaaagaaaatgatatgttggaataaagcttctaaattgacgacaataatagcaatcttatgaacactaaatcatcaatggtcaattgattatcttctatggcattataacaaggaacaccgttccatacaacatacagaagaacttaagtattaaaaaggcaaaaagattaccttttgcttctgcttatactcttcccaggtaatagtatgtgtagtcttgaggctagccaaacgagccgcatgccactctggtgtatgaaatgaaccatccacctgagacaatcctcatcagaaatgttccggtaccaatgcaaaatatcaaagtttgactaatccaaatgcttctttgtgttcacagcttacaacaacaataaaaagactcttgaatcactgtaacacaaactctgatgctacacttttacgaaatcacatttaaacatggacttgatatcgtctacaagacctagcaggtattagatacaagttcttcccccaaaattgggactcataaaggatctcttgtaggcttaattctaaatgcagctcgataacccaacaacacaaaagatcaacaaaaccataagtaaatcaaccaaattggaattttgtttggagaagtaaaaaaaaacagaatcaatttgcaatgaagaagatgagagtatgaaaaggtacaaaccattccgtcttcaacctcatccggctgggcggagctggaaccaaccctagatctctgcatagccttgtaagcttgattcttccccatagctaatagaagatttaccccacaagaaacagtccgcaaattccttgcaggagaaagagaatttagagagattgagaggaattgtttgtaaaatctagggtttgggggattaacggtccaaagggagaggatttagggatctgtagagaaagcaaacgagagagagacgagaacagaagaaactgtgaggtcgaaccgaaacgcactggagatttaatttcaccctccaaagtaaaataataaaatctataaggactaatgttcaattattattagttttaatatgaaaactcgatcgaatcgaaataacaataatcatatagtatatagttttggaaataaataataaaagcccttaggaccgattcgttatttcttcgctctctctttctctctgtgtctcgtactcgagtaggtctcaggtaaggagttcttctttcagttcctttaatccttgttaaagtttcgatttctctttacattttcaatcgaattcgcttctattgggttgaaggtttaggtttttaggtttcggagtctttttgtgattcgagagattgactctgaatggtttttaccttttgagtttttgtagttcgaagagcgaccaaactgatttcagatctcaattgtttctgcagttacgtaaaggatcgagcttaaaag

SEQ ID NO: 14372 - DNA, 3000 bp, Unknown
  misc_feature (1)..( 3000): cDNA_ID_3016525_gDNA_ID_2684112_Annot_ID_190651 3000 nt of promoter + ATG
ggtatgcagagcagtttattggatatttatttgatactctgtttgcttttgatataaacagtcggtgtgtagagagcgcgaagaattcctgagattggtcaagaaagaggtacgctgtccaccaatgcttgatcagcactttgtgtcgtagattgaaagactttgtttttctgtttctccaggtggagttctataacacaatggtcgagagagaagatgtagatggtgaaaaagctgcaatgaaggcatacaaagcagctagagtagatattgaccaagctgatgaagttgctgaagcagacgaggtttcctctgcactaatggagaaggtaagaagattttaaatcggtttttaagactattaaagtcccatgagatttgtttaagaggcttactcttcggtcatactttttaaggttgatggtctgatacaaaacctagagaaggaaattgatgatgtggatatcaaaattggcaaaggctggcagcttcttgacaggtatatagactccatttttctgtttgagtgttctgtttccgagacttagaatctaaagtgatcacatctgaatgaacacagagatcgagatggaaaagtcacacctgatgaagttgcggctgctgcaatgtacctgaaagacacactcgctaacgacggccttcaacaactaatcagtagtctctccaaagataaaggtaaagaacagagcgatcctctccttcttgagctcttatctccctgaagttgatcttttttataaatctgttattcaacagagggaagaattatggtggaagacattgtaaggttggggagattgggaagcaagccagaagaaaatgcaacggaagaagaatcaagctgaaggaaataatactatgattttaagacacacatagactttttaatactagtgaagagagttttattgagagaagctctacttcatgttttgctgcttagacataagcaggctacttacatatacaagcggctaagaatacgagaccttttgctagtaatgtgaaaagaggttgaagattaaaaataacattacgccaagaatgatatcttgagcgttttatttcaatggaaactcctgattcaaatgtgtcgatggctatgaatatgataatctgatgattgactggttatactagtttgacatgtgtgtttccagtgatccctaaatgacataattcgattactaaactttaatgatcttcctcgtttcgatctgttggtcacccaaactcaattttgtttgcttgtatgattgtatcaagccataaattaataatttttcttctttatctggggtcacatggaagagtatcatattactaagaaaaaagtgatgtctgtatcccaaaaatctactgaagaacataggatgacaatcttggtacatgtctactactcttttaatatgaggtagaagaagacaacaaaaatggcagccataacatgaccactgttgttgttgttgatgatcatgatgggcctaggctccgtctgctacagtcatgtttactgtactgatgtaaagaactgcatccaaagaaaccacacttaaaaagaaagatatacaaagaagaagattgagagaaggatgagtgtgagagattttagttaccgttgtttccacggataaaggcgtcaccatatttgttcttgagctgcccgtttacatactcctccgtctgctccattgctatgttcatatatccatcaagacaagtaagagtgcctgtgaaaagagtaataaaaacttgatcaagaactcaacattaagcttgaacagaacatagacaaaactgactcgggcacgaaaggaaagaagtcaacaagaatgatataagtagccttgataatgagagaaactgacttaaatattcaaatatctcagtcaactattgtaaccttattgcaggcagaaaggaacatgttcttaagaaaaccattgaacaatgttcacaaggaaaccttagaaaatgtaagaaaagcttcacatattgactttaaaagaatcatttaaaagctgaagacataacatgataattaagttacttaagtgggcttaatacaagcaactctttaattcccttaacatagacaaaagaactagtcctaagtcaaagcttctaacctaaagtgcagcagagatagagaacttgcaaaacacataagaacatctaacgagagagagaggcacctcgataatcaacaccagaattgagcttgacaacaacgggtctcccacggatggatttgaggaaatctgcaggtgtctttgtcgttccagaaactttctcttcaactccactcatcttttaagctcgatcctttacgtaactgcagaaacaattgagatctgaaatcagtttggtcgctcttcgaactacaaaaactcaaaaggtaaaaaccattcagagtcaatctctcgaatcacaaaaagactccgaaacctaaaaacctaaaccttcaacccaatagaagcgaattcgattgaaaatgtaaagagaaatcgaaactttaacaaggattaaaggaactgaaagaagaactccttacctgagacctactcgagtacgagacacagagagaaagagagagcgaagaaataacgaatcggtcctaagggcttttattatttatttccaaaactatatactatatgattattgttatttcgattcgatcgagttttcatattaaaactaataataattgaacattagtccttatagattttattattttactttggagggtgaaattaaatctccagtgcgtttcggttcgacctcacagtttcttctgttctcgtctctctctcgtttgctttctctacagatccctaaatcctctccctttggaccgttaatcccccaaaccctagattttacaaacaattcctctcaatctctctaaattctctttctcctgcaaggaatttgcggactgtttcttgtggggtaaatcttctattagctatg

SEQ ID NO: 14373 - DNA, 3000 bp, Unknown
  misc_feature (1)..( 3000): cDNA_ID_3016533_gDNA_ID_2684112_Annot_ID_190649 3000 nt of promoter + ATG
cattgctctacaaacacttgaagaccaccaaagaaactagccgcatttgttcgatccaaggaatcagcgcagttaaaacgtatcaccccattttgatgtgatctcaaacagaaggcaccttcaatgtcatcaatacagattacctcacctctgcaatctttcagtctttgacgtgaaggcaaatagtcaccttcagaaattcctattgccatagtgggagattttagatacatccacaatccttcaatagtttgctgttccccttttagtttcacgctggcatgccaatcataatttatcaggtgaacacgagtataaggaagctttccactggatttgataaagttcatcgattcttcaaaatgttgtactaagatacattctgatttcccttctccacttcttagtaaattaacgcacacaataggaacaaaagcctttttcttctggttttctccaacaggtgcatctagattcctagtatcatatcgcttgcttaacctttggtaatactctgtactgcctttataaggatccctatctgccacataaatttctgcttctgccgcagtcatctttaattctgcaccccaccatattggtatggtgccacgtcgccaaatgtacgagttgaaagcaatgctttgaccatttcttttaggtatccatacaagctgctcacactcaacttcgttacctgcactacacatatacttctaaattaggccctagtcaatccagagccacactttttaagagaacaacaaagaaattaagagagaggagcattttaggggggcatgtcacctgtgccagaacatgaattaatgcccctagctaggtaacgagtccctggatgcagtctgctacgacgggccattagagcaacaatcccttctagctggcctgagctcccaaaaggtcgatattctgcaaacccctataattaacatcaaataagaagatgatgtcatatcaatttatatgcttttgaatcttcacacaaaaccgaaatcggataggtagatcaaccttcatcaattcattaatggaggacgaacctgcagaagaatgacacagtgttcaggtagcccaatattcttaaaaggcacggacaaccatctattccaaacaaattcatcatcagggctttgaagtggcatacggcttgggaagggccgagtgatgtctctagtatcacagaaatagtgcttcccgtcgatgtcaagctcagtcaactcctgaatattcttggtttcacctttcccttgaggctgtggattgtagagtggtattttgacccattgactctcagccactgtatatacacatccaccaccaggcaaatctggaatacttggatttagcctggtcgcaactaaaagcatcccaaagctccccaagacagcataaccgagtattgccctggcataaacagagcttctaacacctcctcttgatccattcgtaatataatctaaggcttcacgctctgacttaaaattatcaaggccaggcttcccattgtaccgcaggataccagtcgtaggatcgatatagataacttgagtatcagccttagataacaaacttgcaatgacatagacttcaccagtgtctaaggtgacaacaactacagatgtcttttttgaaccacctacaccaagaagataagaaaattagccaaccaaatgatgaaaacagctagagtgaaaaaaaaaaacacttgaatcttcaaaaagaaactaacctggtggatgcagatccatctgagctcaggaccaagcggaccaggtgccctctttgacagcttcagggaccaagatatcaatgtggaaccaaaaatctagcaaaaagtcaacgaaataaggaacttccatcagagaaataaaaagcaatggaatccaaaaaatgtagcatagttagttctatacttaaaacgattcatcaacgccaattaaaatcaaaacagagagatcatcttcctaacaataatctccgatataactgagacaaaagatcagaattttctcacaaatttcgatagaagtaataaaaaaaacgagtaccagagatctgagactttttccgagaatagcaaaattaaagacgcaaatcgataattcaaattccgagaaagcagaaagataaattcttcagagaacccgaatcgaatcataagtcataagagaaggaactcaccttgaagttgtagagatgatcagatgcaaaatttaccaagtcgttcgtagacgaacaaacgaagaggaagaagagtaaatctgctgttacccaacacacagtacaaaaacaatcatagtacgacacgtgtgaatctgtttaattgatttatgaaaaaagagaagaaattattgataacttgaaaattggtccaattagttttaaaatgtaacgaatagacccaatcaaaagaaaagacaaaataaagtatagagatgatgaattaacggctttggacaagccacacgattcgctttgcttatcttgctccacccaatccaaattgagacacaatctctatcgaatccacgcgcctctatcttttttcaatcgagtcgccattaacatatttcatcaagctcagtccactcttctcatgaaacttcatcatcatcgaccttgaccctgataggttattaaagttactgcatttgatctctctttgaactgcttctgttgttcaaggttccaaacatgctcagactcagtaattgaataatgggtattcttgttgcaggtttcagacgacacccattattgtaaatctgctgctggagtcttttttgtctgaatcttcttcttgttgagacactgtttcttcttggtctgtgatttttgttttgttctcattaggacgttctttattccggttcagatttactggatcgtcattttctctttgaaattgtatttttttgttccttttctggtatgttgtgaaagctatgagattgctgtaagaatccaagactgaccaac

SEQ ID NO: 14374 - DNA, 3000 bp, Unknown
  misc_feature (1)..( 3000): cDNA_ID_2990413_gDNA_ID_2684112_Annot_ID_190647 3000 nt of promoter + ATG
ttctagaaatgtaaaattcctctcctgtcgtcttctacaataaaatccgaagtgtcgttatctacaagaagagtccaaagtgtcttcatccaatcgttggtgagtcgctttaattctttatttgatcttttctgattattttcagtcttttttacacatgtgactgcaaaacggatgccttttttaatttatttcttctttcagctttcctcactgtttgtttgtcctctctctttaattcaaaaataaatcaggcttttaaaatcacgattgtgtccatatctgaacatggcttttttctctgtgttttagctttctagctgcatttttaggttttatttacacggattacttcctcctgttttgggaattttgctatgtttgactttgctatgctctgtttgactttgctatacttgttgactttgattttaatatctctgctacacttgttataaaaaagggactgatgaacatttggatttcgaagttgaattgattattctttgatgatgtaatatttattattaatccaaaaatttagtaataagattcttttgtttttttgtatgggaagatgacttcagaaaaagcttgcttcaagcccaacaactacggtccacggatatgactacttagagcaagttccagcctcacacatgaattgcgatcttctcaaaggttagtttttttcaatgccttctttttttttttttgataatttttttaaagtgtatgatagattgataatgacatttgtttgaatattaaaaaaaaaaaaacttgcttgtaaaaaacacatgtagccaaacgtcactttaaaggtaaaaaataaacactttaatgaaatcccagccgaaacacttagtctaatttagtcgaagcacctagtaagaaaaacgtagcgcattttaagttgaattaaattttagcaactctagtcgttgtattactctaagtattagtcgaaccacgttatttagcaacaacacgtaggaattgttgctttagttaaattacttagtcgaagtagtttatcaaattcagtctaaaaagtacattatagaccaaaaaaaaaaaaaaaaaatagcccacttttagttgaaatcatactaaatagcaacacttttagaagagataaacacattagtcggaacacctgtaacgaacttagttacaaaagactgtgcacactcaaacaagttagcacctagtcgcaacacttagttgagatacgaacctaaatatctctaatcaatcgtttgtaaaccacattttagtttagccaaaaacagtcgaatactcaaacattatatcactttttagtttcgtcaaatcatattgaatagtcgaaaaataaacgaaatgcgttctcgggtaataagtattctagagcaaaaatgtgattaaaaacaatatgagtaaaatgcattcatgaattatgaagttgcaaatttcaaccagctgatgccgacgtgttggatttcaggaagttgttggatatcaaagacccttggagatcttagggtttaggcttctagaggctttaagcattgtacaatttgtaaacttcaaagcattagtcggggttgttcttagtcgagttgaataattaggcttaattattcttaattgttcttagtgttagttctttttgtcttcacgggcggctgataagaaatagaggacaattaggcttaattattcattcaggtagaaaatgtcggggttgttcattcaggggttgttcattaaacttaattctccttagtcggggttgttcattcaggtagaatatgtcaagtaagttccgagataatacttgttaaagagtttattatcaataaaaataaagtttaagcacttgttgtttgcaagtgaattctctgtgttgtttttgtctctataccttttaaattatatttttattgaatatatagagtaaatgtaaaatggtaagacttttggtatatagttttttaagtgaatttgacgcataaatttcatgaaactcttacataatatatatatcaaaattgtataacaaaatttttgtattttacagacattacttaaaattgcataactacaaacgaaaaacaaccaattttctcagacttttacagtttgtacttcgaatggttaagaaatcagattctattgatgtggttactcgttacccaataaaatagtaattgatcataatttaatgttctattgatgtagaagtcttagaagatacttactaatggacgaaaatatcgagaaagaaaaaaaaaaaggtacaacaacggcatatttccgtgagaataatgcgcgtggaacgattaatgtggctattcattgcttaacggcctttttagtgtcggctctaaggcccatttttgtctttgtgcaaatttaacggtgaatgtgtttgttcaggtgttttacattttttttttttgagtgttggaacgcttttgttagagtttatgtagctcggattaagacaaccctaattggctaattgctaccgcctaccattgtttgactcagttatacgggcttaagatgagctgattccttatcgaacaaaccaaaaccaaataatgtcaaatttaagaagaagaatcttttcaagttacattttctcagaagcttttggttcctttgttactgactatttccttgttgaccaaaccaaaaccaaacaatgtcaaattcaagaacaagaatatctaacggcaacggatccaagacgatgaatttgacattaaaaaaaaaaaagttaaccagaaagattcatgcaacacttgagaggtatgaaggtacgaataagaacacattctccacgttcgcttttggtcagtgcacttcacttggttggtgattaaaaaaaaaatgtataaaatataaaaatgaaacttaatataaagttgaaagcttggtctaaaaatggaccgtatctgaaaatccaatcgacgtcgtattccaagaaaatagaaaagtaggatcatg

SEQ ID NO: 14375 - DNA, 3000 bp, Unknown
  misc_feature (1)..( 3000): cDNA_ID_3016537_gDNA_ID_2684112_Annot_ID_190648 3000 nt of promoter + ATG
agtagccaaaatgagcatttttatttcaacccaaactccttgatgaacattatgtgaaagaaataatcaaattgtggtgggttttgaaaagttatatatcatgaaatgggaacttgttagaaacttaagagcgtcttacttcaggcctgacatctatgagcactgacttgtctcttgattttaaaaggtccagagttgacttgggagacaaatctccagcatatccaccatatgtccaaacccgatatagaaccctgcaaatatctggtggaaaatataaattcttctatactacattgtcctctcaagaaaagcaagtttaatatccttctagggtaagaaaagccgtgtaccaaaaggttcctgtggtgcctacgaagagaaaaaggtgaaggattgggtcatctggatccaaaccgatatttctctccaaacctccaatggcaacagatacctgttcatcatgatactgttagcaactgtagtccataaagaattaattttcttctacgaaaatatgaatgaaccttcagtatataagacaaagcacctgctgcaatacagctcccacgggactcaatacttttagagcaacatcttctgacgagttaagggcactctttacatctggaggaagtaattcttttgctgatccataagagtacacaacaaaagaaactccatttgttacagatctctctccaagactaactgattgcctcagcagatcaatggcaataacagctgctctgtttgaagcttccttcaagccagtagaaaaactcgaaaacttgtctccagctacatctcccgtttggtctagcgtagaaaacgctctgttaactgcactatctacaacttcagaagcattctttgtaatggatgtcacagacgaggagaaggactccaaagtgttctttacagcattttctccttggttaagtgaagagctgaaggactccttgaccccagaagaaaagtcatcaacgctagctttcgcatcaggaagtgaagagctgaaggactgcttgagcccagaagaaaagtcatcaaagctagctttcgcatcaggaagtgagactgaactatccggagatattttaacagtcgcattggttcccgattcaacagagtctataaggctactggtcttatcggttaaagtctcagcagaaaggcattcaatgggggaaacatctggtacaacagcttcaacaggagaaacatctgctgcaacagcttcaacagggaacacatcttctccattttctacatatgtcagtccctcatcactcgctacaaaagcttcactcatgttataaaccatgtagtttattctgtccaactcattctggcacaaacttccgaatgttgatactggttgttctgttttttcgatagtaccggtcaagaaactcccagtggcttgaggtacgaaactcttctgcaggcgtgttccattagagataccaaagaaggcattgtcacctgaactgtatctgtgaatcaactctctcctgaaggaagaacagcctcgccaattgccaggaaataaaatctgcagaaacaaacccgttatgaggtacttacttatctatgaaaatgaatccaaaaacccaaagcactaacaaagcgtaacacccatagctcaaattggatgacttcaataaatttgctaccagttagcttatttactttcacttctataaagaaaatctaacctgagaatggtaacggcagcttgtggccgagcacaggggaaacatgttggtcagtcttggattcttacagcaatctcatagctttcacaacataccagaaaaggaacaaaaaaatacaatttcaaagagaaaatgacgatccagtaaatctgaaccggaataaagaacgtcctaatgagaacaaaacaaaaatcacagaccaagaagaaacagtgtctcaacaagaagaagattcagacaaaaaagactccagcagcagatttacaataatgggtgtcgtctgaaacctgcaacaagaatacccattattcaattactgagtctgagcatgtttggaaccttgaacaacagaagcagttcaaagagagatcaaatgcagtaactttaataacctatcagggtcaaggtcgatgatgatgaagtttcatgagaagagtggactgagcttgatgaaatatgttaatggcgactcgattgaaaaaagatagaggcgcgtggattcgatagagattgtgtctcaatttggattgggtggagcaagataagcaaagcgaatcgtgtggcttgtccaaagccgttaattcatcatctctatactttattttgtcttttcttttgattgggtctattcgttacattttaaaactaattggaccaattttcaagttatcaataatttcttctcttttttcataaatcaattaaacagattcacacgtgtcgtactatgattgtttttgtactgtgtgttgggtaacagcagatttactcttcttcctcttcgtttgttcgtctacgaacgacttggtaaattttgcatctgatcatctctacaacttcaaggtgagttccttctcttatgacttatgattcgattcgggttctctgaagaatttatctttctgctttctcggaatttgaattatcgatttgcgtctttaattttgctattctcggaaaaagtctcagatctctggtactcgttttttttattacttctatcgaaatttgtgagaaaattctgatcttttgtctcagttatatcggagattattgttaggaagatgatctctctgttttgattttaattggcgttgatgaatcgttttaagtatagaactaactatgctacattttttggattccattgctttttatttctctgatggaagttccttatttcgttgactttttgctagatttttggttccacattgatatcttggtccctgaagctgtcaaagagggcacctggtccgcttggtcctgagctcagatg

SEQ ID NO: 14376 - DNA, 1817 bp, Unknown
  misc_feature (1)..( 1817): cDNA_ID_3016658_gDNA_ID_2684113_Annot_ID_190693 3000 nt of promoter + ATG
gaattctatgttgttctcgctgatgacttaatattaggtgttcttggtctctactgctttgtttccgtttggtttgttggtggacttactgtcttccacttctaccttatctgcaccaaccaggcaagattctttagcttttaacgtagtttccaagtagcttttactgttggtctgattctcttgttatgttttgcagacgacttgtgagaattttcggtaccattacgacaagaaggaaaacccttaccgaaaggggatcttagagaacttcaaggagctattctttgcaaaaattccaccacctttgatcaatttcagagattggtcgccagaagaagaagacgatgtggaggttggatccatagcctctgagctagtcagagcctttggtccaaaagacacgaaaatgagcagtggaaagtctgattccgaagctagagaacggtaacaacggtggcacggctgtcaagagataagtatggatgaagacgccacaacgactgctttggtctaccaagaaccagcggaaaacaaggagaagctcgagcgtggaagtgagatcaagataggccaaagtaaaggacaaacaggtgtaaaatctacttttgtaattcaaagccatgtagctctctttctctctttactcgtcaagatgagttttaaactttttcccattaagaataggaattaggagaattggtgtacataaataatcgtttcttgcgttacaggtaattcaatttggtgtttattattgtctccatctttctttttagggttcatataatgtatagtgtttcttaggtcttacggtaaggggtttataagaaaagaagaaaaatttgccaatagagaaaacaaagagacagagggatgtgaagagatgatgatgattcgttgatatgtttaatattctatttctatatataaaaaagctcaaaatactttaccaattgagcaaaagctatatacatatataacaataatatctcatcttatttttgtgagatctttaatcaaattgacttcttcttcttctttttttttgctgaaagcattcatagaacaaactaattacaaaaataatcgaagaagtgaagcatttataaaaggaaaagaagaaagaagatgaagaaaaacacaaatgatggaaaaaatctaggtgtgaagcacgtttgattgagagatgatttgacttggcttcaccagctcattgttgcatcattctatttatctaataatatttatagatatagttggccgaccaatgaaataacaatatttttaagtaataaaaatctaagttaaacaagaaattattccttcttagttcgaacagacatcctcctattagcgtaatcacttgtcctaattacatacattgtccccattatctcatttactcctgtctgaatattcggtaatgagattggaataaaaaatatatttattaccaaaagaaaaaggaaagagaaaagagaaaaggggcaaaagagatcgcaattttgcaaaacagcgaaaatagttctttgtgattttcgagtgagagagacgacagcttccattatcccctgtctctctccctctcgaactacaaatcaaattcgagtgttttcatattgttaatctttttcttcaaggaaagaagagattttgttttccgtttctgggggtttttcttgattctgatctctgatctgatctcatcatcattgtccgtggattctccgatgggtttctgattgtgggttctttcaaatttcttcacttttggagcttttcttctctctgtcttttgttttccctcagctatg

SEQ ID NO: 14377 - DNA, 3000 bp, Unknown
  misc_feature (1)..( 3000): cDNA_ID_2990045_gDNA_ID_2684113_Annot_ID_190694 3000 nt of promoter + ATG
aaattcgagtgttttcatattgttaatctttttcttcaaggaaagaagagattttgttttccgtttctgggggtttttcttgattctgatctctgatctgatctcatcatcattgtccgtggattctccgatgggtttctgattgtgggttctttcaaatttcttcacttttggagcttttcttctctctgtcttttgttttccctcagctatggcttggaatgagaccaaactcaagaggctctatcaagtttggagaggaagcaatgtaagtcctgacattttccactttgctttcgtttctttcacattttcataacctggagaagatttatcacataggttttggtcattaatgaaatcgctcttggattcctttgagtccaagtcatagcatttcagactcttgactctttattttggtaatgaaataagaaagaagcaaaccagttttgtatctaattgtcaccttccgttgactcagtttagctcttgtgttttagatcattttagactcttgactcttattcattctcttagtagttgtagttgttactatcttgagtcttgattgttcttatatggaagttttcaggcgatggtcattggaagctatggatttaaaactgactttgattttccatttttctttgaagaaatttctatgtggcgggaggctaatatttggtcctgatgcatcatctctatatctatcaaccatcttgatccttggtcctgctgtaatgttctttgtcaaaatgtacactaaaatggctgatcctcgtaccaagaatccaaatctatgtattccaattctctgtgtgtcttggatactcacaattttggtatgtcttctgctttcgaactttttttaaatgatttttttgtgtgtaaaaagtgaactaaagtttcaatagttttcttcaggatatatttttcctcttaatgacatctagtagagatcccgggattgtgccaagaagttttaggcctccggaaaccgatgatgcaccggattcaactactccatcgatggaatgggttagcggtagaacccctaatataagaataccacgggtcaaagatgtaactgttaatggacataccgtaaaagtgaaattctgtgacacttgtttgctttaccgtccacctagagcttctcattgttccatatgcaacaactgtgtccagagatttgatcatcactgcccttgggttggccagtgcattggagtggtaagtttactccatgactcttgccatatattcccggttctatgttttgaacttgtttggattcttttgcagcgaaattaccggttcttcttcatgttcatatcaacatcaaccactctgtgcatatatgtgtttgccttttcttggttgaacatatttcaaagacatatggatgaaaagattagcatctggaaagctatatccaaagatgttctatcggatattctcatagtttactgcttcattactgtttggtttgttggaggactcacaatatttcattcctatctcatctgtactaaccaggtgattagaaagatatatgctttcgtacatttcaggtctttctttttctgttcgctctgttttgttttaatggtgaaaatctgttttgtgcagacgacttatgagaatttccgataccgttatgataagaaggagaatccatacaacaaaggaattttggggaacatatgggaaatatttctgtctaagattcctccatcaatgaacaagtttagatcatttgtcaaggaagaagattatatgatgatgatggttgaaactcctacttcaaatctaggtgaaagtctagttagctcgaaagagaagattgatatcgaaatgggaggaggaaggattgttgatgagagtggaaagagctactctctacctgagattctccggaatctaaactatgaagatcttgaggatgattgtgaggaagatgacttgaaggctaaggatcatcaccaccaccatcaccatcaacatcaacataatgagggaatcatccctccttttgaccctttttttaccaatgagattggtagtaacaaagatgagagaaatggagaagaatcaggaggatcttcaagtgatggtgaaaatacagggaaacgcgttcgggtctcagatgaagatgaagagaaagttgaagggtatgaacgaaattggagtacagataaaggtatgaatataaacgcaggatctgaagatggagcaagctctcctgtatccacttcaccaatgcttcgtaaatagaggtaatcaagctttacctctgtgtttctctagttgctaaagcaagttgcttgcttttcaagaaaccgttctcagccctaaagctttacctctttgtttttttttacttgctagagaaggaaggacttgaagctggagaaatggagtttgtgctttatcattcttttaattctgtttcatataattgtgggaaaaaaaatccgaaaaataacaatcatcttagaaaattgtgagtttgagcactagatttttttatttttaaaattctcctttttagttgtatttatatataccagaatggtctggatatcaccagcatcacatattttctctcttttttatttttccttttttgttataaaaaaagatttggaccacgaatttgtaacgtatatactgttgtcggaattatttttccttattttattggttgattttcatattttatttgtttctaatgatttatcaatcacatatttttctttcaaaaatgttctgttaaataacgaaatcgcaaaaataaaacagtgatattatcaagaagacaatgcaaatcaagaaaaaccaattaattatcgccacgtgtctggctcccacatcagaattcagattttcacaagatgagatttttcacaaatataaatcaccacacagcctcatcttcttcctctagctgcttttgctctctatctcactctttgcttctgcaactcacagtca

SEQ ID NO: 14378 - DNA, 3000 bp, Unknown
  misc_feature (1)..( 3000): cDNA_ID_1019620_gDNA_ID_2684113_Annot_ID_190695 3000 nt of promoter + ATG
ctttatcatgtaacgatcatcatttgtcaagtagaaaaagcttccactcttaccaggggatgatagctcccgaagggcatcattcccgcagatcgataacatgtaatcagctgggtctaccttgaatagcttcctcaagctcctaaagatagataaaattagcataacagtgtgtgagaatacgtacagatgggaaataagtaaagcctaatgttatttgatctcacctaaaaactaatgggcaatagtctttccatttgaattcactagattgatgaggaggtgtgtatttggttccttctggtggaaatcttgtccataccttctcctttggatcaaaagccgaatgcttaagatcaagagacacaaccggagcttgttttccaacagcatgtctgcgtaagcaaatacatttcacatgagcgcttatacatcaacaaaacttcaaattgtataaatgaggcagcaaactgggatatttacctgattccaagctgtagattaagcataagctcgtaattccggtggcctttagatatcgtctcgccttgcttcctccctgcccttggcaatctcataggtgcagggctcggtctcaggctctgaatgaacccttcagcctctagtctcatcatttcagcatccaagtccctcctcgtggtggaatcaatatcagcagcaccttctccgctttcggttccccacatattcatcttctcaaacgctctatctacacccacacttaccctcccgtcaacagacatcctcctcggtttctcgacacgtttggaagagttccaaacagatagctttttctgtgaaggcaacacaggaactctctctccgctgcagatcttgtactcactcagattagtaaacacgtctttaggatcccattcaggactcccgtcgtctcctgatggataataagtaccgttcatctcttccggatcattagaccaatgaccaacgtagaaactcccatcagcccatttgaaagtaccgtttcctctaggaaaaccgtcatcccaaaatccgtcgtatctattcccatccgtccaaataaaagtacctttgccacagatcgtagcgttcttccattcccccatgtaatagctcccatctctccactgatactttccttgggcttcttgcaaacccctcctccattcaccatcatacacatctccattcgcgaaacgcttgattccatgtccatgtttcaggttcatcacccactgacctttataagtatctccactaggacctgtgtaaaggccaacaccatccatgtatccacttttgaattcgccttcatatgtggcaccagaaggccacccgaacttccctcttcccatagtcttcccgttgtaccagtcaccaatgtacatgcaaccatctgtccaaagatacttcccatgcccgtgaggaaaactatcataccattgccctgtataatagtctccattaggaagtattctctctgcatggtacaattcccctatgctgcttctgttagtgctggtctcatcatcattctcctcagtcgtagtagtagcatcatcatctgtctgtggagctacagataccgtcccaaaaatgctgtttgcacgcttcttcgcttgttgggtctttcttacggtcacctcccaagcctttagaacacagctttgttccttgctcatcttcttaaactaataaaacttttctctaagatacctatatgtatatcctagaacataaactcagaaaacatatttgttcttgtctaaacaacaatcctatcaatgtacacatacacaagagaaaaccatgaactctgtgcaaaagaaaaaacaaagtgtaaacctaaaaccattaaatcaaacgcagcatgaagaaatctgcaatggtctttactctgtgacttcctgtctctatgccattgaatcacaagaaaaaagaatgttttttggtcttttagaatgcaacattttcggagtgaaagctgatatgaacaatcatggaaacctaacaaagaatcagagagagagaaaaaccaatggccaaaagagttaagggatcaaaaaaattctctccgacatttcatcttttcttgtcaattcatcttaactaattatgtcgttcaaagaagaaaccgttcatctcctcaaaccaatgaaagccttcaaatttagagaaacaagcatgacccatttttctctattcttagcatctccgagctttcctctcataaacaaacatattttcttcagaacaaaaaaaatcggaaaaagtaataattaatcaatttagccaagactgataacgtctccaatctgagatcactaagagctataatcaaaaacagaggtaactgaaactctaactcactgaggcattctgtcgaacactttaaacgcattgcttctccactaacaagtcacatttttccgtatattcacaacttattttcaaaaggaaagatccattcccaatgctgaagcttcaaacaccataaacgatagaagagagacaaaagttacaacccaaagccaagcgtgtaaagatcaaaaggtcatatttttcctgaggggaaacttccgtcgcaggttaaaattggagggcttttttgtaaacaattcttaagaaggctaattgtagtaatttatttgtaattattagttaactgtgtaaagtaaatactttatccagtaataacgtatcactttagttgatgtctattggttaatagccgaagctcgttccaaaatcgaagagaatctataatctcatcacgacacaccaaagccaaaacctttattgtcggaagctgactcagactcaaacaatgtctctagcgtcaattatatgctaaattcaccagccgcttagagccaatcatataatctcgattctcttcaacggtcctcaattatcctaaattcagatcataaaaacgctaacttttaatttctttctttctgagaaattggttctcatcgttggaatcgaaaaatg

SEQ ID NO: 14379 - DNA, 3000 bp, Unknown
  misc_feature (1)..( 3000): cDNA_ID_3016654_gDNA_ID_2684113_Annot_ID_190696 3000 nt of promoter + ATG
ttaacctgtgttatgttcctttttctgaaaatgttgagatttgtttcagacaaaccgaaccacggcaagaatattccctgcggtgctggatgttgagaaccctgagttcaagaggaaactggatagaatggttgtgagctatgagaagctgctggctataggagaaacagatgatgcttccttcatcaagaccctcaagaggattcctttggttacttctttagcctctgagatcttggctgcttatctcatgcctcctgttgagtctggctctgttgatttcgccgagtttgagcctaatcttgtctattagtagctgcaatgtcaagtcttgagtttacggctggttcttgatttcttgtaattgaatgatcgaaactgagaaacatcgtctttttttttttgcaataaacttttactgcatatatttgatcatattgcgcattggacttacttaaatttcagattttattgaactggttgatacagttgagtttgcaacataaaaaaaaaacacattacaaaatctacgaaaatatccctggaaacaatcctaccctctgtgtcttgtgtaaaggagatttatccagagaggattaaatatgaaagctgagctcattcctcattcctcactcagatttggccttaggtttctcttgttcttcggtgagaggcttaaacacaactttgaagaaccaaactgcaagcaacgtagccttcacaggtccaagccaatacacaagtaaatgctctttcgttatatgttcaccgcgtgcataagcccatcccataacctgcaaagattcacacaaaagcaaacattcaaaacaaagatcgctatttgctgaaatcacaatcacaagacttttttttggtacatacagctgcagggttcatgcatccaccggtaagatcagagccaagaatatgaagagttaacttagcaagactaccgatccaagtcttcatgaagaaacttcccgggatttttcttgttagtcccattgagagcagtacaatgaagaatgttagtatcccttctgttaaagcaccgtggtgaattgctacatttagtttaggtcctttcccaatctcagggaatacgtgaatgatatgcttaaccgcaagaattgatcctattacctgaaataacacaaaaccagagtttcacaatagtatcatctttgattacacattagagcaaaagatcttcaagatgaagtctttataaaacaatagagcatataaccaaaatgatctggttttcaaagaagaacccatcagctaaattctccttttttttctctaatttgacattttacaacattacacaaaccctgagacctctctctaacgaagagtcaatttcaattaaaccaaaaaaagtcaacgaaacaaacctcgacggggattcgaacgaagacggagaagatgaaactgctgaagccaccggagactccagcagccaaagcggtcaaaggattataaagcccgcctttggtggcttgttgaaggtaggcgaagatgaacatggagatgatagagaagagataacgaacgatctcaccggaaggatcggtccggctaaatccaagaactccatggactaaaatgttgaccagaactcctgcccatatccacatgaacgacaataccagatcagtcactactaaaccgattcgtcccatttttcgattccaacgatgagaaccaatttctcagaaagaaagaaattaaaagttagcgtttttatgatctgaatttaggataattgaggaccgttgaagagaatcgagattatatgattggctctaagcggctggtgaatttagcatataattgacgctagagacattgtttgagtctgagtcagcttccgacaataaaggttttggctttggtgtgtcgtgatgagattatagattctcttcgattttggaacgagcttcggctattaaccaatagacatcaactaaagtgatacgttattactggataaagtatttactttacacagttaactaataattacaaataaattactacaattagccttcttaagaattgtttacaaaaaagccctccaattttaacctgcgacggaagtttcccctcaggaaaaatatgaccttttgatctttacacgcttggctttgggttgtaacttttgtctctcttctatcgtttatggtgtttgaagcttcagcattgggaatggatctttccttttgaaaataagttgtgaatatacggaaaaatgtgacttgttagtggagaagcaatgcgtttaaagtgttcgacagaatgcctcagtgagttagagtttcagttacctctgtttttgattatagctcttagtgatctcagattggagacgttatcagtcttggctaaattgattaattattactttttccgattttttttgttctgaagaaaatatgtttgtttatgagaggaaagctcggagatgctaagaatagagaaaaatgggtcatgcttgtttctctaaatttgaaggctttcattggtttgaggagatgaacggtttcttctttgaacgacataattagttaagatgaattgacaagaaaagatgaaatgtcggagagaatttttttgatcccttaactcttttggccattggtttttctctctctctgattctttgttaggtttccatgattgttcatatcagctttcactccgaaaatgttgcattctaaaagaccaaaaaacattcttttttcttgtgattcaatggcatagagacaggaagtcacagagtaaagaccattgcagatttcttcatgctgcgtttgatttaatggttttaggtttacactttgttttttcttttgcacagagttcatggttttctcttgtgtatgtgtacattgataggattgttgtttagacaagaacaaatatgttttctgagtttatgttctaggatatacatataggtatcttagagaaaagttttattagtttaagaag

SEQ ID NO: 14380 - DNA, 3000 bp, Unknown
  misc_feature (1)..( 3000): cDNA_ID_3016650_gDNA_ID_2684113_Annot_ID_190698 3000 nt of promoter + ATG
gtaggtcaatttgattatatagatatgttgtgttgattgtgctgttcggtatctgcaggtattcatatacgacttgcgtacttcaactcccataagagtgaaggatcacatgtaagtcttactgtgtttgtattaactcaaaattctttgtatatgctatatcgttaggttatttcctcagtgttcattgattttctgcaaaacttgcaggtacgagagcccaattttgaatattaagtggcaacggactcttaatactcaacaacctaagttgattactaccgacaaacacattgttagaatatgggatccaaacacggtaagcatcagataagaacaggtttaacctcataatttttttgaaaaaacaagaaatatgtcgagatttttgattcaccatattctgttttgttattttcaatttgtgtttatcagggagaaggtatgaccagcattgaaccgactcaaggaggaataaacgacatttgtgtgttccgtggaagcggacttatgcttcttgctttagactctagcctaatcccatcttacttcatacctgaactcggtcctgcccccaaatggtgttctcctcttgaaaatctaacggtaaattgaaaattcttcctatccttttacaggtttaccattccagtgatgtcaccattgttacaaacacgtttcttgtgtttaatattgttctcaggaagagttggaggaaagtgcacagacaactatttatgataattacaaatttttggcaatggaagatctggagaagttgcagctaactcatttgattggaacagatcttttgaaagcatctatgcatggatattttattaattaccatttgtacaaaaaggtgagtccttaacattttcataatacttataccatcagaaaagtcttttttttttttcgggtcaaattggaatagtctctataatgtttcttcctttctttttacaggctttagcagtgattgaaccttttgcatttgatgattacttagaacgtaggaagcaagagaagttagaagagcagcgtacgcagagaatcacagttagtatttaaaaccttagcagctatacgttcaccatttgtttgtttaccggctacttacatacacatctgtttctcttgtgcttccttcagaaaaagagacggttgccaaaggttaaccgagaccttgcagcaaggcttcatggggacgaatcagaggaggaaaataaaactgccgaggatggggaggccaccaagaaagtgctgaaaaagaagaaacccatacttactgacgagcatttcgtagatggtcggtttggttcgatgttccaaaatccggtattaacatattcttttcaactttttttgtttgatctttttattgctctatttcacatcgtatcaaacgtattcttgggaatctccttttggttttcaggacttccaaattgataaggactcatatgaatatggtgtcctacaccctgttgcttcttcgaagaagcaaccttctctgttagatgaacactttgaagctgtatcagatgatgacgagaacagtgattctgatgcatcacagccttcagatgacgaggccgacgatggagacgcaactaggccaagcaagaaagcgagaactccgaagttagtgtcttttgactgcattccaggatctacatttgacacattctatcttgattcttttgttttctgatgtggatgatttggtgtcaggttgtatgaagtgaaagatgagcggcatgccgcagcttatcacaaccgcacttcactggctaaagaagatagtcttcctatgggcgagcgtgtcaaggctatagagaaccggcgtggcaactttggaggctcgaaagatatcaaattcggtcctggaggatcacgggagttttctttcaaggcgagagggtcatcaaagtacaaagaagatagagacgatgagtatgaagatgggcaaagaaacaagaggagaggagttcagtctcttggactgaaatcaacaaatattagaggcggtttcagaggtagaggaggtggtggttttagagggagaggaggcggcggttcccggggaaaaggtggccgtggtggtgggcgtggaagaggccggcaatgataaatgtagcttttcaggggctttattagatttgaaaaatgtgtcacctactattgagaatcttgaaacttaattgatcacatatacaattttggaatatttttgacctggtcttcaatcagcacaacagaatttgcttacttgaggctaaaggtaattgattggaaagaggatgacctaaagttgaccctagttcgataatgatttatcaatccgcatgataaatcaccgaccgagggttgttaatagctaaattaacaaagctaacattgatttaataaagtaattaaagaagatgcttctggtttttttttttgggaggtcaacaaataaataaaatgcttatgtatatgcttacaacatgagaattgcttatgtatatgcttacaacatccaagtgtttgggactaggaagacgcctgaatctgatttacacgcgtcttccacaatttcttcaggctgagtcatctttcaatatgtaaactctaatacttaatacatgtaatattcttctttaattttttatatagccagtctacttgtgactagaccttgttcacccgtgggacataggctttggcatgtgtcgacctacgtcctcagatccaaacattcttctttatagtacaagtcgtataacacttataatatagtttgcgaatttttaaagttttggttgtataatagtatagtttgttaatttatacttaaccatagagattgatatattgaattgtatatatccgcattatatatacgttggacaataatattctacctaagttcagaacaatcctaaccaaagcagcttccaagcatctagagaaaacagaatctacaatacttgtccttagtaagcaaaaatg

SEQ ID NO: 14381 - DNA, 3000 bp, Unknown
  misc_feature (1)..( 3000): cDNA_ID_3016635_gDNA_ID_2684113_Annot_ID_190702 3000 nt of promoter + ATG
aatagaaacaccctaaactctcatcgttcttttcaaaaaactatgttggatcagtatccatgttttatgaaactaagaactttcttactttgatgtttgagtcttggctttatcttggtgatgatgatttaactccaaagtgttggcatgtttcaggcaattcttagctgctgttttgaacgtcgataagactggaaggtttatcaagtatgatagatcaagcaagaaagcgacagtcttattacaaggccttgcatttgcaaacggcgttgcactaagcaaagaccggtcttttgtattggtagtcgaaacaactacttgcaagattctaagactttggctctctggtccaaacgcaggaacacaccaagtgtttgctgagcttccgggtttccctgacaacatcagaagaaactcgaatggagaattctgggtcgctttacactcaaagaaaggtcttttcgcgaaactatcacttactcaaacttggttcagggatttggtgcttagacttccgatcagtccccaacgcctgcactcgctgttcactggaggaatacctcatgctacagccataaagctgagtgaatcaggtaaggttttggaggtacttgaggataaggaaggaaagacattgaggtttataagtgaagtggaagagaaagacggcaagctttggattggttctgttctcgtgccttttcttggtgtctatgatttgtagtttcctactttgctcagacttaattgtctttgcatggatatgagtttaaatgtgtattacgttgtcacaactatgtgcacgttaattctatttctgctgtttgtttttgacgtccatgtgtatacttttaagtttaaaaaaggtgtctgtactggtactgtttattacatatatggtaatcatatggtgacattttaaaggtgtcaattgtcaaatcatctaatctaaaatgtcagaaacgtacacgtagtttggtacattgtctttgtttagatcagactctcattcataaaataatccaccttactagcgtatatagcagatatagttaaatctgttttgtatgttgataaactgcttgatataacgaattgttatatggaagattcaaaattgatgatcctatgataaagatcaacatggatacaagacacgttttttcttgcgatagtacttatatctgacgtcagtaatagtcgtggtggctatgtcagaagaggacacatctgtgactcatgttatgtggtcgagaatgaagtctcgtgaaattgtatttacactttgttgtcatgtagggtttgactttacttagtcggcaacgtatatatccgatttattttattttcttcaaactggaagcttttagaccaaaatttaaactaattttctgaaccacagaaatccaatctttttttgtcactgaaagcggttataatcataaatgtccaaaatgtgatttgtttttgaaatagttaaaaggaagtgaatttctaattaaccttaatccacgtaaaaactttatatacctcaaacaaaatcccagcacaacgaggttaaaatcaaatatagccagcttcaattttaatttattctaaaatgtcgaagggtccggaaagcagtcaaattgtcgcacattcatatttacgttaattagagaagtcgcttcttactcacgtttctcgttccaaacacaatcttttcatgtttctcttttaatttgaccgtcattttttatgatgtgaaatattaattgcgcgaatacttcaaacgtacatctgtgatctgtccgtcattttccttcacgttacgataagtttcaatctaaaaactaacatcgtcgccttcgttgaatcaatgcatggattcgtcgcagcatttattctttattagacaactggcccttcaagcgaaatgagggatacgtgtatatatatgcatccacataaacaataagaaaaatataacccttatttttggatgttatataaaattgctttacctatatgtgagctagcaacatttactcatacataccaacagtcaacaatatctcttgttccggcggaaaaatgcccattaatcagaaaattccgacttggtttgccgttccggctgtttttgctgtcttgtccgtaatctcgtatcaaaccttaattgtgccggaaaatttagagggcgccaaaaatgtattgacaatggctaagaccataccaattcctgtcgctggaccggagagcattgagtttgacccaaaaggagaaggtccttatgctgcggtcgtggacggccgtattctcaagtggcgcggcgatgatctcggctgggttgattttgcctacacatctcctcacaggtttttatttaaaatatttacaacgtcttttgtcatcgtacatcgacacataatttatctaaaccaaataccaaataagttgatgaaaagtacccgagagatctgggaactcttgtgttgtgtagtaagaatattaataagttatgagagtaaagaacaaataatatgtttgtttctgttttccaagattttttgcagtgaatcagcctgagttttataatttgattttaaagtttgaatatctaaatattcttgtgcaaacattctgtggatccgtcccaattagttccaacgttttatattttatatctccttttttttttgcatattaacgaaaaagggaaacttaaatttattttgctatacaattcaatgaagaattccacactcataaggagatagatttgtgtcagccaaatccttgtggcttgtcaactggtcacctgatatgtattgtttatgtaggcttttctgaaaaaatcaaataagtaaattaactaatgatactttataaccttgttgtatatgaagagggaactgttcaaaaactgaagtagtgcctacttgtggaaggccattaggacttactttcgagaagaaaacgggagatttgtacatatgtgatggttacttggggctcatg

SEQ ID NO: 14382 - DNA, 3000 bp, Unknown
  misc_feature (1)..( 3000): cDNA_ID_3016646_gDNA_ID_2684113_Annot_ID_190699 3000 nt of promoter + ATG
attggttattgttacaataattacgaagatttaaagtgggacaaaaaaaaagttaaataataaaacgtatataataaaaattcaataataatgaaattaaaagacctaattaactgaaatgaaccaaacaaaactagggtacagttaagaaaaccaaagatttcttaaaaacagaaagagaactaaaaaacgtatcaactgaattgtttttaatttaaagtgtaacagtttaattattttctcgtttaattcaatttggcaattatttggacttcaaatcaaaatcaaaatgattaataattattttacaagaatatctgattgacaagctgttaaagtacaaagtaaataagtgaggacttccaacgaaatcttttcacaaacggcgtcgtttaagccgaaactgtgattacctaccttgtccgtggactggaccaagatccaattcttctggtccaagtacaaataggacggcatggccgtgagattgagcgagggtcaagagctaattttggttgttttcgaggttcaagtggaaatcaaatttttcgtagagagaaataaacgaaaatatacagttttttttggttctgctatagtcatattttacactcaaaatattttttacagataatttaaggtagttcccctactacctaagtatattttttgattcttaatcacaggaacatctctttcttttactttatattacgtttgaataaaatagtggagtcaaaatttcaaacgaaaagttataaactcgatagtagataaacaatgtgtatcacaacaacatagcttaaagtagttcctaccattagagcagtagagaggaaaacaaaggaccttataatcattcttttatataatattccaatttgttgctaatgcctcgcagattcttgagatacagtaggctgcgctcaatggatactctgaaactgcataaatcaagaaacttctttcagattttttgtttccttcatttaaaaactttttttttgttttcccttaacaaaagtatgaatgaaggaagaagatttacccgacacaaattcatcgatatagttgcagtctattttcccgtgtgccattgcgcctacctgaaatggtgagacaaataaggtgtgggtttgcataagaccgatatatggaggttgcaagctaaagcctattactacgtaaattaaatggactttgtgaagaagctagagactagagagaaacatttggagagcactaaccacaaaaactgtgtctctatcatcatcacatacagtagctaggtgtttctgcatattgacgagtttctcagagctatgcgagaagcctgatataagaaagagacaatccctctttttagctcacataatctggataaacaacaaaatgtaggaggaaactaaagttttttttttgtttttacctattctgtgggagttaaccggtagatgatgttcttcgatagggttcttgacacaccgtagaagcttctcacggctgttaactgcagtaatgctcagcttttgtagcagttgcactgcaagaccaacaaataggataagagacagtaaaaactgaggaggttaaagtaacaaaatatcagaaaggatgagaggaaagttggacaactaacacatgattccggcaaatcgtttgaaagttcttggtatacgaacatgtggcttaacttcaaaaaggacacctttttctgttctaacataaacagctttcaacctcccagctttattaaccggactatccaaaatcataagaagcgcctgaagagggagatccactaaagatgagtcacaatttgttataagctacctagatatgacataacagtttttaagaccctgacctgatgagtaatgtctggtcggtaatcagccggatttctgttattctttttcaagaaattagcatgatcatccgagttcagtagctggtaagtctgcacacaatcagtaatcacatatattagtaccataaacaaactccgaggcttactgtaatgcaaacattcctgcagattacctttccaactttggcaacttcaagagaggccttctcaagcacgaatacaatgccagacttttccttgttaggagcattaaggacaataggtatccctcccacaatatcctctgctgctgcagttgcttccacagttacttcctcctcgtcattatcttcctctgctcttgaagtgctttcttttttagctttcttcgaactttctcttgccttttgtttttgctcaaactttggttgctcctctacttcatcttcttccttatcatacctctcttctctctcctttctcttgttcactttaatcccatacggcctcaccatcttccttcaaaaatttctacacacaaatttaagtcaatcacaacaccacagagctaaagaatcagatgctaaagaaatatactacagtgtcgatgaattcatacaaaaactaatcaaatttctttaaggttatcgctactacagagaatcaactcaatcaatcacagttcagtagagcttaaattcgaaattaaatcgaacccttttatgaaagacagctaaaagagaaaataatcgcttaccggaactttttgagcttgcgaagaaattcaagtgagcaggcgactgaatcctgataaaccctaattcgaagttaaaggtaggcgtttttttattttttgttttttgtattgtttcacacagattatataatcgtttaagggcttattgtagtaaaataggcccattaagttttagggtttttaaaaggcccagaaaaagaaaaagagaccaagaaacctagaattgtgaccatcgacgtcgacttttgttctgccggagagcacgaccgccttatgtattacaagtggtgtttcttttcatttttatttttggcttcaatttttgcgttttctctgcaactcgccgtcaagggtagaagaattaggggttcctgttcttaactgcttgaagatg

SEQ ID NO: 14383 - DNA, 3000 bp, Unknown
  misc_feature (1)..( 3000): cDNA_ID_3016578_gDNA_ID_2684113_Annot_ID_190719 3000 nt of promoter + ATG
agaacttttccattagttacttgtaagccctcgtgatatttttttttgccttgttgaattcttttcttctttgttgttagttgttccaactgcttctatcttgcttttcaggatatcttctttaacatggcggttactcgccacaattttaggctctttatcaagtctgtattatagccttgcccaattcttctatttactttcaagttttctgattttttcatgggtgcacatcgcatcgaggagggtactcaagaatacatggatcaacttcaggatacgtagttgtcagatcttatattggccaatcttccttgaagagattgacatgatgtaagttcaaccgtatacccaaattttcttctttagttagatttgtaaactttttctgtttgcccttggctcaaaattgcatcttcatatttttttttctaacaacaactgcttacctactaatcttgggaaataaaaaaagtttaattctagatacctttatgcaatgcatttgtcatttttctgagaagtttcacacgattattaatttatgacaattcttctgggtttctcaaggtccatatcctgtgtgaaacatgcagaggaagctgcactgcaaagacattctacatggtcggccatggctgttgatcttgttttggggaacttgattggtctaggtctactgtttaacaccgaatctgtctgctcatttgtattcgactttgcaaaggagtttacgaatggtattttgcggtctggtagtgtgtggttgatgggagttccagcgggttttaagttaaatacagaattggctggagttttgggcatggtatctcttaatgtaatacagatatggtctactctctgggtcttcatggcttctttcatcttttgtttgataagagtaattgccatccttggaattacttttggtgccacagtatctgccgcatttgtcatagatgtcattacttttgcaacacttcatataatggctcttcactgggcaatcacacttgtgtattctcaccaaatccaagccttagcagctttgtggaggcttttcaggtaaatcttgagtattaaattagatgagttcattcattaagctgataactaacatctggtgaatcggtttcttggttttcttaaatctaaaaggaggagacatgcaatacgttttccgtttcctttttaaacttcttgaattcaatgaaaatactaaagtattgttatatcttcttactggtgaaccatttttgttcacctcagttccttacttaaagtaaccttaccttgaattcttctttgttcttccagagggcgaaaattgaatcctctacgtcaaagaatggacagctatggttacactgtgaagcaacatgtagtgggatctcttctgttcactcctcttctgcttctcttgccaacaacatcagttttctacatctttttcaccattacgagcactacaataaactccatatgtatgttgattgaatttgccatctccgtcatccatgcaacaccatatgcagaggttatgatttggcttgttaggcgtaaaagattcccctgtggtgtttggtttgaaatggaacactgtggagagcatatccttaaatccaatgatgccttcgaagactccaaaagtctactagaagaacacggtactcctgagaagaattctctaatggtttccaatcttcgcagcaattttctaaccttaggtaaacttgtagattgttccaagtctaatgacaagttaatctagatgatctgttatgcttttgtttggtattcaatttttgctgacatttatattgaacaaattgcaggacagattcttttgcctcactataaaacaattttttcaggaatatcagcttcttctctgacaacatcagctcgcggagtcctcagtgggaagaggtgattttatatgatcttgatcacaaaatttaagtcattctctctctctctctctctattcaaaatcatttaccttctctcgtcttttccagaatgccatcaaaactggggcttgatcttcctcctccgaggccatggctccacatgccattgagacagtactggatgctatgccataattccatcagctcatgtggcaaatgatgacttctccagctgatctcttagcgttttaatttaactccacaagacaatgagataactaggggagtaaggggtgagaatcgttaacattggaaaacatggattcctttttcaatatttgtggccctttttacttgatttgttcatcagccttgtctctggtttaactatgtaaaaatcttttgatttgatctatgaaaaacaaattatatgaaattaatgatgattttttctagtgaaattatattgctgatgaaatttggttgcatgtcaaaatgtaaataatttaattaaatattctgttgtttttctgattttcttaaaaagttgaggaatatgaaaagtaaaaaaaaaaaaatgtggtaagattctttttttttcttgaatataattgcttttgtgaatttacggaaaagaaagtttttaaaaattaagttaaatacaagaaaagtgagaaaataaatttaaagtttgaaaaataaataaatgtaattaatatctaaaaattaaaaatccttccaaattaaattaatgtaattaaaatagtcaaagataaatgtaacaatatcttcttatagggcttaccaaaaaaatatcttcttatagggaatagaatctggattcacttcccaaaagcaaaagttaaaaaaaaaaatcaagaaaatatttaggatatacatttaaaacataaaaaaagttgactaagatataatttgataggataaccgttagaaaatacctttaaaaagagtaaacctaattcgcctacaaataaaaatgcgcttttccttttcctctttcttctcactttttttctctgttgcatcatcttccaaactcccgaagaagaagaaaataactacaatg

SEQ ID NO: 14384 - DNA, 3000 bp, Unknown
  misc_feature (1)..( 3000): cDNA_ID_3016588_gDNA_ID_2684113_Annot_ID_190715 3000 nt of promoter + ATG
atatttactttgaagtttgaactatgaaaggtctttaaactggtattcacttcacgaatgataatattcaaacgaattgaacttgtatgaaagtccaattaaaggttttatcgggtatatggacctcgtttatttgggcactaaacgaattgaacttgtataaaagcccaattaaaatcaaagaaacccaactcaagcccaataagggattaccttcaagcttccagtgtcatcactgtcgcctaaaaccctaaaaaaccctagtcctttataaattaccaatcagtcgtctcctctttttccgctacaacttttaacgcctcctcctccatttttcaaaaccctaatccgaccggagccatggcggaggtcgacatctcacactcgaagaagaagaagcaagacaaaacggagaacgatgccgccgacaccggagactacatgatcaagccacagagtttcactccagccatcgacacttctcagtggcccatcctcctcaagaactacgaccgcctcaacgtccgtaccggtcactacactccaatcagcgccggtcactctcctctgaaacgtcctcttcaagagtatatcaggtacggtgtcatcaatctcgataaacccgcgaacccttcttctcacgaggtcgttgcttggattaagcgtatcctccgtgttgagaaaaccggtcacagtggtactcttgacccaaaagtcactggaaacctcattgtctgtattgaccgagccacacggcttgtgaaatcgcagcaaggtgcgggtaaagagtacgtttgtgttgctcggcttcactcagctgtccctgatgttgctaaagtagctagagctcttgaatcgctcactggagctgtgtttcagaggcctcctttgatctctgctgttaaaagacagcttaggattaggacaatctatgaaagcaagctgcttgagtatgatgctgataggcatttggttgttttctgggtttcttgtgaggcgggtacttacattaggactatgtgtgttcacttgggtttacttcttggggttggtgggcatatgcaggagcttaggagggttaggtctgggattttgggtgagaataataacatggttactatgcatgatgtgatggatgcccaatttgtgtatgacaactccagagatgagtcttatcttaggagggtgattatgcctcttgagatgatattgacgagttacaagagacttgttgtcaaggattctgctgtgaatgctatctgttatggtgctaagttgatgattcctgggttgttgagattcgagaatgacattgatgttggtactgaagtcgttcttatgactaccaagggtgaggcgattgccgttgggattgctgagatgacaacatctgtgatggctacttgtgatcatggtgtggtagctaagatcaagcgtgtggtgatggatagagatacctacccgaggaagtggggattgggaccaagggcttctatgaagaagaagcttattgctgatgggaaattggataagcatgggaagcctaatgagaagactccggttgagtggagcaggaatgtggttttgcctaccggtggagatgctataattgctggtgctgctgctgctcctgaggagataaaggctgacgctgagaatggagaagcaggggaagcgcgtaagcgtaagcatgatgatagcagtgatagccctgctcctgtaacaaccaagaaatctaaaaccaaagaagttgaaggagaagaggctgaagagaaggtgaagtcttctaagaagaagaagaagaaggataaggaagaggagaaagaagaggaagccgggtctgagaagaaggaaaagaagaagaagaaagataagaaggaggaggttatagaagaggtagcttcaccaaagtctgagaagaagaagaaaaagaagagcaaagacaccgaagctgctgttgacgcagaagatgaatcagcagcagagaagagtgagaagaaaaagaaaaagaaggataagaagaagaagaacaaagacagtgaggatgatgaggaatgagatgggtttgcgttatggtgctttttaagttttgaactcttttgattttgcggtatctatctactctggaacaaagtgagacaaaaggcattttatgcttgtattctacgtctcgcttacgttaccagattttatgtttttgtaaggttagtttcagttctaagcagattctccctttagttatatgactgtggtctctctctctgtttttggtctttgcccttcttgtctgtctgtttgtctgtttggcaacgaggataataatagacctaaatcagtattaaaagttacgggtttttaactttcaacaaacgggccttagccctgaccaaaaaatgggcctgattacgagaactcagtcctttgttgtctgtcgctgggtctagagatgattatctcggataataccgaacttatttaatacgaaccagagatgtttgaattcaacggttttatattcgtcgagtttcaaaaaacagagactatttgtgcaaaaagacaattttttattcttttgcaatttgtcgtgttcgcgagtttatgttcccaaaattagaaagtccaaagattagcttgggtcttacttagatcgccaattttgtctcatagcaaaaatgaatctcaggtttcatttaaatgaatttcctctgttcttcgctaaaaacgaaatcttgaagtcctctattatacatcggaatcttttctttttctatgttatcttgcagatccctatgcctcccatcacttgctgtctcatctttctcaatttcattcctcggtgggttagcgatatctccttctcttctctaatgggtttgaaaaaatcgattttttgattcatctgattctggtcttacagacaaaattggcatctgggttcgattctttgtgtccgtcgtaaaaaccagtgattaggttctcgtcttcgagtcggagacaatg

SEQ ID NO: 14385 - DNA, 3000 bp, Unknown
  misc_feature (1)..( 3000): cDNA_ID_3016612_gDNA_ID_2684113_Annot_ID_190708 3000 nt of promoter + ATG
atcttcaaggagtttttgccttgtgcaattcaacttcttcccatgttgtttatgtgtagtccaattagtgttatttttaattaagatgtggtccaattagctgttctttttctaaaccgtataacataataatacgtgattcaaatacattaacataatgcaaaaatgtaacagcaaattcattaaaaacaaaaaatgtaacagcaaagcaccatactttctctcgtggggattagaatatacagctttcattacaaagactagtcaactaaatcgtaccagctaactgcaaaacatcatcttaggaaatagaaaaaggtatgtgtagatcaatcaaaatgaataaaatgtttgattatgaataaaaatgaataaggaagagttcaatgagatgatgatattaaattatggtagaagaaaagttaataacaggtcagatatagaaactttccgtaaagtcaaggatttaaattattcacgtgaatactctgtctaggtcctatcttgaaatttatcattcaaacctttaatattatctatatgtttttactttaaaattaaattttaatatatgtagatataaaaattaatatttttaatttatatattcttaatatttatatctagatagagtcatatcaaaacattttgtttgaatgcaaatttcaaaagataaattttggaataaacattttcaaagacgtaaattaaaaaagcaatttagaaataaagcattgcaaaaataaattcaactaaaatttagatgtagatgtatattgtgaacccccaaaattaattataaaatcttttggaactgacatgtcaatatttgtttgattgatcaaccttttttctcctccaatcttcgtttagttctaataaaaatatcataaagaattaaagattgcagttatgaagataatgacatttttctttaatattttatttttcttcattattttaaaaacgtttggctcaatttatagacagtgaaggaaagttcttggaatttggttcttcttctatacataagctttggttacacaatcaaaatcaaatcgagaactgttgttgtgtccgaaaatcaacatcaacatcgtttctttcttctgccattaaatttcaccatcttccaccttcaactgccctagacagctattctccacctttctcttttctctctctgttctctatcattcccagagataaccaaacaatctcagaagaaaccagaaagagcaaagaaactaaaaactattattcattaaagtcagtgtttttaaattcgatttcgtaatgggttcttctgcttcaaagaccgcttcttccgtttcttctgcttcttcctcatctgcgttttctccaccgccgaccaaattcagctccgattcatcttcaccggcggtgcagagagctttttcgtttccgacgccgttggttcaccatcctccggcgagaaaaggcgactctcatcaccttgtttcccttacatctacatcgtacggttctcttctcctccttgatctcgatggatccaaaaactcctcttccgaccaacaaacgctgcctcgtatctcaatctccgggaagaacacaccagatccggtctctcctgattcagtcataaacacttgggagcttatggatggcttggacgatgaattcgaattcgaaattcccaaaccgggtaagcgtctaaattcggatttttgctctaaacccgacccgaatcggaatgtgagtttaaatgggtcttcgttgaaattggatgaatcttacgagattgtgagaatcgaagaagacgatggagattgggttcctttgacttataaacctaagcaacctttgtggaagcatttgtctgaagaatcatttctctctgatttagatcccagcattgtctcatcctacaagaaagctttgtcttctaagctattaagcaatcatagtaatactagaaaccctcatagacccacaaagtctctctcttgtagcccatcatcaaatccatccatcttaataagcgaagaaccaaaatctgtatcctctagtcaattgatttcatcaccagccaaaccgagattaccaggaacagaagacaagattgtactctacttcacaaccctcagaggaattcgaaagacatacgaggattgttgttgcgttagagcgatattgagaggagttcaagtgtccgtagacgaacgtgacatctctatggattccaaatacaggaaagagcttcaaagcgtgcttggcgccgcagagaaaccggtttgtttgcctcaggtgtttatcagaggaactcacattggtggcgtggaggagattatgcagctaaatgatggtggtgaattagcagagatgttgaaagatttccctgcttgtgaacgcttggggacatgccggagctgtggtgatgcaaggtttgtgccttgtactaactgtgatggtagcaccaaagtgtttgaagaacaagatgaacggtttaagcggtgtcctaaatgcaatgagaatggattggtgcgttgtcgtgtgtgttgtctctaagtgatcagtttgatcaaaagatgtgtgtgagaaaggggatatagattgattgactaaacatggtatttggttagtaatgtatattcaaataagtaagttggctcaagccttttattatttactcttatgagttgtgttcttttgttccatttacgctcttgaccttttgaactaaatgattcttactatatgaagtacatcaaatggtagatgatgattgataattcgcataatagccgaatgatttgctttgtttgcaaggtattttttatcaatgaaaaatatgtgcaacattaccacaaatgtagtttgattgattgatgtcacctgctcgctcacctatattagctttcttccttctgttcttaaatcctaaaacgacaacgtttagtctccctttaaatcccatcactggactcgacgacttttgctcagataagggagacaaaa

SEQ ID NO: 14386 - DNA, 3000 bp, Unknown
  misc_feature (1)..( 3000): cDNA_ID_3016619_gDNA_ID_2684113_Annot_ID_190706 3000 nt of promoter + ATG
gaaaggtggagaatagctgtctagggcagttgaaggtggaagatggtgaaatttaatggcagaagaaagaaacgatgttgatgttgattttcggacacaacaacagttctcgatttgattttgattgtgtaaccaaagcttatgtatagaagaagaaccaaattccaagaactttccttcactgtctataaattgagccaaacgtttttaaaataatgaagaaaaataaaatattaaagaaaaatgtcattatcttcataactgcaatctttaattctttatgatatttttattagaactaaacgaagattggaggagaaaaaaggttgatcaatcaaacaaatattgacatgtcagttccaaaagattttataattaattttgggggttcacaatatacatctacatctaaattttagttgaatttatttttgcaatgctttatttctaaattgcttttttaatttacgtctttgaaaatgtttattccaaaatttatcttttgaaatttgcattcaaacaaaatgttttgatatgactctatctagatataaatattaagaatatataaattaaaaatattaatttttatatctacatatattaaaatttaattttaaagtaaaaacatatagataatattaaaggtttgaatgataaatttcaagataggacctagacagagtattcacgtgaataatttaaatccttgactttacggaaagtttctatatctgacctgttattaacttttcttctaccataatttaatatcatcatctcattgaactcttccttattcatttttattcataatcaaacattttattcattttgattgatctacacatacctttttctatttcctaagatgatgttttgcagttagctggtacgatttagttgactagtctttgtaatgaaagctgtatattctaatccccacgagagaaagtatggtgctttgctgttacattttttgtttttaatgaatttgctgttacatttttgcattatgttaatgtatttgaatcacgtattattatgttatacggtttagaaaaagaacagctaattggaccacatcttaattaaaaataacactaattggactacacataaacaacatgggaagaagttgaattgcacaaggcaaaaactccttgaagattctttattatttttggtactttgttctttgtcttttactcttttcaataagggaagaggaaagattcgaaattcagaacctaacactacaaagactaaatatgatataaggaagatatgcataagacaaaaagctaatataagaggaaagctcaatagttttagaggtggatcttgacagataaaaatgtttggttcttcattgaatatttgaatgtaatagatttctttgacgccaatgagctaaatatatacaaagtaaattcaaagggaaaaatcattttctcttgtgtgatcttccaagcagaagaggctaaaaaagatttcttgaaattgatagaaactcaattgtttcagcaacattttttcacaagtatgaggtcacatatgttctggaattctacaaactatatactatacacatatactgctgctctgctctctctctacctctctctgtctgtcaaaatgtttcatagttaagaaccttgccagcgtaccaacagaagatatgatagaaccttacttgtgtactctgcgcatttactgctgtaaaagcccttcctgaattcagaaaggcctgaatgcaaaacaatgactagtaagctaaggagaaaaactaaaacaaaaggtaatcttcaggattataaaacatgcttccaggaatgttttggtactgaagctaagaaggtattatcacctatgaactgttttccagacaatcacttaagcatatggatcatatcatcaatgctgatgtacttatgtagagaggagataaattatctgagcatgtgaatgatcctgaggatacttgtatcgacacaaaaaccagctactatgagagataaactcaagcagctgagcaaaaggaaacgagcattatatgcatcccagagttgctgatcagaacaaatacaaccaaattggagttgagaaatctcgatttttgttcatgggccattaacaagcatcattaacataacaacatccatgcgaatccataagatatgtatagtttcatatacgaagccgaactttagttacacatacacacactgagtgactgagacatatatcaatcacttccaccaaaaattgttcccttttcgaccaaaatgatctatctttatcctctataaactcaaactattatcaatttcagagtttgtagggaaatttgaagcgactctaatctaaaacaacagagcaaaacaaaaaaaaacgtaaaatttggggaagagaagaacatatacgcacagaaggagagctaaggatctcgaattcaatcatccgacgtggaaaggaccaatatctccgtttctcagagaaccagcgatctcatcagcgatagccacgcaagtgaaaacccaaccactcagagaaaaccaaaccattctcatcagatacatcgccatgcccagcggcatcgccatctcaaagcttttctgcttctttctctctctttcgtcagatcaaatgattggccggcgaagccattagagtggccaaaagcttggggaaaaaaaaatcaaagatgattcggtaggttcaaggatcttccaaccatttagattcggccacgtcttcgtcgtatttattcaccagccgacggagactcataattaaattcgagggcccacatgaagataaaataattaggatccgacccggttttgtatccggaacccgacccgataggatgatccatggattcccgctccgttgcctttttcgatttcattttgaaattgaaattccccaaaaggtagattcttctttctctctctctcctctgagcaacgtctctctctctctctagaaaaaatg

SEQ ID NO: 14387 - DNA, 3000 bp, Unknown
  misc_feature (1)..( 3000): cDNA_ID_3016627_gDNA_ID_2684113_Annot_ID_190704 3000 nt of promoter + ATG
tagtcgactcgtcggtgtgtgtatgaaccacacgattacgtagttacgtcaatattactaatttaattagcttaatgagctttatggtcttgatacggtgaaccaaacctcggccataattttaaacgatacagcagcgatataactttcacatgttttgagaattttattaaatgagaccaatcttttattttgtttatataacgttaagtagatcagtttagacaatttaatgttttttataattaatatttccttgttcccgttgacccacattatcatatactatatgatttcatattttaaccatatatagaaagtacgtgtattattacaatttatttaaattggttttatagagtaataatttacaccaaaaaaatgcttcagtctattacatttttttggggctctttatgaactttatgtgactacctgatcatgaatacccaaataaaaatatatagatcaacatttgtcgaagaaaaaaaagagagatcaacatctataaattttactcattcgttttggactcttgaaaaatgacaacaacgcattaacattaaaatttcatgtgtgtaattcgtgttcgaataaaagcaattaaaaatggacgggaaagtgttatcaaatataatattgtatgtttatagcgggaattgaaaaaaagaaaaacctaatcacaaagtgagactttttgtttaattatctaattatacatatatatagagggagagataattcatcttgtctggtctgaagagataatacactttatttaggttagttcacttttttttttttaatgaaatttttagaaaaatatggagatgtacatgcatgtaatgatgtaaatgtaaaaacaacacgtttaaatgaattaactaattacaaagagagacatgatatatccatagattcggattttcttagatccatggaaacatcatgcatggatcacatcacatggacttaatgttatcatgtggtaggtttgcgagactttgttttgcttgatatattcacaacgattggaagatatttgtaacatcagcaaggactcaccaccaaggagcttgagttggattaataaacaacaacaaaaagaacaccagtggtggttacttagagagattgaaacaataatagatccttatctttcactttttaatttccattattggtattaataagaaaaagaataccattattgatgtttgcattctttcatagaaaggctatatatgattataggcttctagctacaaactttcttcctctcataatatcaggtaacaggttccctatctgattagccttcctttcttgtcgtcgatttccattctcctgtgtcataagaaaagatgcagattgatacatatgtcgacaactttataaattttcttaatactataatcgattaatgtaagtgtgtttggtattatgatatactccctctattccaagttatttgatgttttagtgttttttttttgttccaccgagattgatattttgtaaaaatataattattaattttgtttgtagccaatagtgaaaagaaagaaataatagtaatattattaaactaacaaaaaataattaaaaaatagaaaaattattttttcttaatttatgtccaaaacttaaaatatcaaacttcatgaaacagtaggagtataagactattctcattcacatcaatgttaattatttaggttttatcatttgttccattatattattttagagagaaaaaggtagacagaattgggataatatacttaactcgtgtactgaacaaaatagatgagtacatacaaaattgtagttagaagttagaacttcaactaattaataattactaggaaaaatacaagagaagttgcaactcattagttccaaattttatatatattgcatgcctattataatctaattaaatatttagattctaaattttgctagccataacaatacacgtataaactcttcagtccttactgagttttttacccgtttcactaagcaaataacgttcattaaatatacaaatattgtatagttaagtgtacgaaatcgtgaacatgcaatactcatttcccttacttcgttaacttgaaaatgtaacgctattcattcatttctgctttcgagatttgtgccaacaaatttcaagatttaatatcagaataatattgattaaactcaacacttaatacaaatgcccttacagttgctgctaggccatattcaagatacgggaagtgtctctccgatggagtacagagccacattattgacacaccaaatcccttttgcttttcttgtttttcctttgccagcaaatcttttattattttatctatcgcgtgagtttatatttcatgtaacgtatcatttaattcataaaggttgtatgattgtgttcctatataagatcttttaattatcaagctagttaactcattttaaaccattagtgacatttctcttggtttttactataagaaatatcaattatgattttaaaaagggaagtcaatgtatttgtatcatttgttctcccattttttttatttttgaagaatctatctaatttctgaaattttcttatgttcagacaaaattttacataaaataccatttcgtaaagaaatggctcaagattactatgttctaaattgggcataatctcaacagaaactggttgcttaaaacattatatgttctaaattgggccggcaaatgggcttcaataaagtccattaacatgttagtttcgtattcttcatttcaatcttttctggggataattgatctcttaacaactaattaggctaaatctgaattaaacaacaattataaggaagtttctctaatttctctaaccttaagacttttctccaaagaagagagaaacaaaagtaaagaagctctcgtaacagtagaagcagagtgcaaatctcactgactactaccaaggcaccaatcaccatg

SEQ ID NO: 14388 - DNA, 3000 bp, Unknown
  misc_feature (1)..( 3000): cDNA_ID_3016652_gDNA_ID_2684113_Annot_ID_190697 3000 nt of promoter + ATG
acattgatttaataaagtaattaaagaagatgcttctggtttttttttttgggaggtcaacaaataaataaaatgcttatgtatatgcttacaacatgagaattgcttatgtatatgcttacaacatccaagtgtttgggactaggaagacgcctgaatctgatttacacgcgtcttccacaatttcttcaggctgagtcatctttcaatatgtaaactctaatacttaatacatgtaatattcttctttaattttttatatagccagtctacttgtgactagaccttgttcacccgtgggacataggctttggcatgtgtcgacctacgtcctcagatccaaacattcttctttatagtacaagtcgtataacacttataatatagtttgcgaatttttaaagttttggttgtataatagtatagtttgttaatttatacttaaccatagagattgatatattgaattgtatatatccgcattatatatacgttggacaataatattctacctaagttcagaacaatcctaaccaaagcagcttccaagcatctagagaaaacagaatctacaatacttgtccttagtaagcaaaaatgtgtgcattagtacctccattgtttccaaactttgggtggccatcaacgggagagtacgacagctactacctcgccggagatatcctcaacaacggcgggtttcttgattttccggtaccggaggagacttatggagctgttacagcggtgactcaacatcagaatagctttggtgtttctgtttcgtcggagggaaatgaaatagacaacaatccggtggtcgtcaagaagcttaatcacaatgctagtgagcgtgaccgtcgcaggaaaattaactctttgttctcatctctccgttcatgtcttcctgcctctggccaatcggtaagaagctactccgactcattgattagacccgttatagtttatgcatctatacaatttagaagaagaatactgcgttaaaccttttttctttcctttcttgcagaagaagctaagcattcctgcgacggtttctcgaagcttgaagtacataccagagctgcaagagcaagtgaagaagctaataaaaaagaaggaagagctcttggtgcaaatttcaggtcaaagaaacactgaatgttacgttaagcagccaccaaaggccgtcgcgaattatatctcgaccgtttctgcgactaggcttggtgacaacgaagtgatggtccaaatctcatcgtccaagattcataacttttcgatatctaatgttttaagtgggttagaagaagataggtttgttcttgtggacatgtcatcttcaaggtctcaaggagaaaggcttttctacactttgcatttacaagtggagaagattgaaaattacaagctgaattgcgaagagttaagtcagaggatgttgtacttgtatgaggaatgtggaaactcatatatatgagaatttggtcttgtttctttatagttatgttatgtcgtcctttttctcttcgaaatctaacattcttgacaaagcgttgtagtcgagttgtttcgtttttttggtcgaagtcaatgatcgattagttatgctattaagtataaactgattattatgaagttcatgttacagctataaactttaattttcgcctagactttgaatgttactaataaaaaatttgtttatgtatatcttgttatttatatccagttaagactagagttagtgatgttttggtgtatcaatagaatataaaaacgagaaaagacaaaagagggtattttattaacaactactatatatcactacttgtgggcaacattatagtaaagagtctatgggctccaatttagaagataagttatgtaattaagccaagttgcacttatgaattaatagattgtggtgacattaaagagttaattaagatttattaggataaatgataaatgagaagccatgtggttatccattgatcctttttttgtcaaagggttatccattgatcttggagttattatatactagaggcagtttttttaatcagagtggcatcacagaaaaaagtttggagtattggttttgaaagagttaaatctttggatttttagtttatgtttgtttaaaaaaagaagaagaaatgtattggtttacttggcttggttataaaatatatgagatcgaataaggatatgaatttacatgatgataactgtagctttcggagattatcatattagcttagaaaatgtgagtcacgaaacgaatgttggaaacttcattgattcacaatcacatatacaattttggaatatttttgatccattcgtgaaagaataactaaatcagaaaatatattactttagacacaaatgggatcaagttgacattagaatataaaatgaccatcgtcattgtggaattaaaataaccaggttacatttattttagataaagatattaaattttgaaatgcttatgtatatgcttacaacatgaaaatgctagtttatgcttacaacataaaaaatgtatgggacgaggaagtaaagacgcccaaagcatcttccacctgattaccacgagctctcaacattctcactcgcatgagtcatctttcaatgtgtaaacaataatcttactatcgtgtcatatacatgtttgattcttacacaatatgctgagcttgtgactaaacctagttcatgcgtggaacataggcttcgacacgtgccaacctatgccctatagagacctaaatatttctctttatagtatgtaagtcgtataacacaatcatataatctcaacgaataaaaacacttattatatagtttgttgaacaatatttaacaacagagatttgtttctttagtctttcatccgcatatataatcaggagactataatattcctaccaaaacaacttcaagaaaaaaacagaatcaataaccttgtccttgattaagcaaaaaatg

SEQ ID NO: 14389 - DNA, 3000 bp, Unknown
  misc_feature (1)..( 3000): cDNA_ID_3016745_gDNA_ID_2684114_Annot_ID_190739 3000 nt of promoter + ATG
cctatttgttcatagaatctaaaaacaaaaatttgtggattttttaaaacaataaaaattaaaaactaaataaatttccattcacgattttgcaaaaactaaattctacaacaaaaatcaaaaactaaaaacaaaaatccaaaaaccaaaaacgaaaaccaataaaaagtacaaaacattcaggaccttactgtaccatcgtacgttaggaaaaatattagaaaatcaacaaacactaaacaaaccaaaaaccctacgatcatttctttcttctccttcaattttttttcctgagtagatgccacaacaaaacaatagattataaactaaactgagcaaaatcatcaaaacaaaatgcaacaaaaaaaaacatcaactattctctttgaacaaacgtgcaacatatatataatatatataaaatatttcacaaagaatgaaaacataaaatttatagaccaaaaagaaacataaagatatagaacattctcaatattaatttcgatttaacaatcctgatatcttcagctccaatcacctgaatgttgttcacatgtagcccacttaatcatctccaatatcaatattttatatttatagattttccgttgcttccttctacaacttataaacaaaatttaacccactttattataagtgcaaacattaaagaaatatgtgtaccttcgaagacactacaatttgactcatcaaagcttcgttctttatcttatttgccaaattggttcaagaaacagagaagttagtgttgattcgactcgtatgtaccaaacaggacctacttcaatcccaagcctatcgatatggagacaaagaaagaaaagagcaaagaaggtttaatcgctgccaaagagctcaagcgcctccaaaccaacttagtccgacttgatcgattcattgattctcatgtttgtcgtctccttaaattcgatctcctttttgttcttgctgaattttcagagacaaaaccaaattttcctttgtatgacggacataagttagaactataccaacatgaacactatttattatatttataataatgatacaaaaaggtactttaaacagcaaaattatatatacttttttgctcaaactaaaagagaaaactatttaatatatgttattattctttatatagaataacataaaataatatagaaattaatataaaattatagaacggttacaaaaatatctatctatatatcttattttattgatttagaaaaacagataaagattagataataccgaatacttgtaaaaataaagttatattataaattgttactgtgataataagtttttaaattattatatagttaaatttatcattctcagcagccgtcatgtttcaggtatatatcattctgagtaataatatactcaatattaattactttaaaattttcaatcttcaatttagcataataatcaaatataccaatgcagccgatgaagtacattctctgttaaacttacgttagtttctgggtgctcctctacaacatcactctaggcacatgcattaaaatattcactgttttattaaatatatatatatatttatttattttctgacaagataagttacaaatttttgtttccatactctttgaaagagatggagaaaaaatcgaattcaataattgttcttggtatttattccatttcatcatcatcattaattgttggggacatattacatgtaacatggttgtgacgcatcaatcctactcgagccaagtggggaccaacagttcactgagcttgattcagttgagaacttaggaatcaaaaagagggacctgattggctctatcaaaacctcactggagcatgagtgtcccaagcaagtctcatgctctgacgtcatcatcctctccgccagagacaccgtggctctcacgggaggcccactcatttccgtgctattaggacgaaaagactccctctccactccaagcaaacacgtggcagactctgagcctcctccctccactgctgatgttgacaccaccttaagcctattcgctagcaatggcatgaccattgaacagtctgtggccattatgggtatatatttataagaaattttcatcgtagccttctatctcagtttttctttcaggaacttgcaaagtggacagggccaatcaaattttagccatttagacttaagtggacgaatatactctcgaacgagaaatgaaacgaggcggttcagtttcattttctttgttttctggttaccaaaataatatttaaactttaaaattaaatcaaaaacacattaataattttaaactacaaaaaaatcaaaaactgtttcgtcgaagacgcagaacaattccgacgaaacataaactcagatcgaaagtgaaattttgattgaggctctatgcgagttcgagtcgttgcttaagtggaggaaattttgatcgagttcgtgttaaagggtaacaataagaggattttcgggtttctcgagttactgtttctagaaaaactcaaatggcggagatgaagaagagtagtcggcggtgaggagtttcggaagttaatgtatcatcgtcggcgacgacaattatgggtaagggtaagtttggtttaacttcgtttggggaatgagttgatacaaaatctaggtaaattttggagatttcaaatcagaaaatttcaattgacaatgggttttttgtgttttccgccaaaaaacagtagatttgagtataaaatttttggtgtacgtgtatatgaatatcaaggacatgtttagtttgtatttggatatagtgtacgtgttaagaacttcatcgtatttttcaactttcatgaagtacttctaaggatccgattgaattaccatagaggttgtttgcactcgaccactaccctaccaaggcgaagataaatgcgtactccaaagcggagtacattggtcagataacatttgcgcttaagggaacaccagaa

SEQ ID NO: 14390 - DNA, 3000 bp, Unknown
  misc_feature (1)..( 3000): cDNA_ID_3016706_gDNA_ID_2684114_Annot_ID_190751 3000 nt of promoter + ATG
aaaggaccgagattgaaatacaaaaaaaaactataaactatattgctattgctatgcactaaaatcaagctacgatgtttgtgtttgagaggagggatcctatatttataggtattttcagcataaggttttagggttttacatatgacagcgtaaattatacgggcctaatatctttgtttgaaaagcataagcccgttagggttgttaggcgacttatgattgattaggtttgattaggattaataggcgatttaggtttgattaggggcgccagagaataggaaatttagggttgagagtgaattaaaccttttttttttctacacattaaaatataaaaacaaaataataagttatctcattagttagtaaaaatattaatttatccttaaaaaccttaagagagggagggcaaatccatcagttcattttctgagagcgaacatgaaagtttttgacatctgctttaatatataagattctccaccgcttatgtttgggccgctacgaattcaagatgttctgattcgaatgattgagtgattatgaaattttttacaaaaatgatcgataggtattgtgttgttatgggttttaagaaatatttaaatacttttttagagacggtatgcttgaccttttgtaatattatggtcgaattttcaaatctcataactatattctatcattgaaatttaaatttttttttaaatactctagttggtattaaataacattccttagttttgcctcgtttgagctctaattattaatcggatgacaaaaaaaatagttaatattaaatagtgaaatcttttataaaaagaaaagaaaacatttatttactagtggggataatgtttctaaagcccaataaaggcccaaacgttctctgaaataacaccctaattatagcttctgaggcccaaatctctctctctcccctccggaaatctcctcgattcctccgtcaccaccgtaccgtaaccgagactggtcgcaatgttgtcgctcaatctatctttgaaaccccaacatctcaagctcttatcttgttacacggattcgtctgctccttcaatcgcgaaaaaggtacctacacacttgcttctgtttcttagttcacttcatatcttgaattttaggtatctctctactttgtacagttgatcaaggaatcaaagctatctagggacttcagtcaaaagatacaaatcgtagactacgctccattagttcaaactttaagccagagaagattacctgatgtagctcatgagatttttctccaaacgaaatcagttaacttgttaccaaattacagaaccctttgtgctcttatgctttgttttgctgaaaatgggtttgttcttcgagcacgtacgatttgggatgagattataaacagttgttttgtacctgatgtctttgtagtctctaagcttatatctgcttatgagcaatttggttgttttgatgaagttgccaagatcaccaaggatgttgctgcaaggcactcgaagcttcttccggttgtgtcttcacttgctatatcctgttttggtaagaatggacagttggaactgatggagggtgttatagaggaaatggattcaaagggagtgttgttagaggctgagactgctaatgtgattgttagatactatagttttttcggtagtttagataagatggagaaggcttatggccgggttaagaagtttggtattgtgatagaggaagaagagataagagctgtggtgttagcgtacttgaaacaacggaagttttatcggttacgcgagtttttgtcagatgttggtctcggtagaagaaatcttggaaatatgttatggaattctgtattactgtcatatgcagctgattttaagatgaaaagcttgcagagagagtttattggaatgcttgatgcgggtttctctcctgaccttaccacctttaacattcgcgctcttgcgttttctagaatggctctcttctgggatctacatctcactcttgaacatatgagacgtttgaacattgttccggatcttgtgactttcggatgtgttgtcgatgcatatatggataagcgactagcgagaaatttggagtttgtatacaaccgaatgaatctggacgattctcctcttgtcttaactgatccacttgcatttgaagttctggggaaaggggatttccatcttagctcggaagctgttttggagttcagtccacggaaaaactggacgtatagaaagctaattggagtttatctcaagaaaaagttgcggagagaccagattttctggaattactagctacatgccacatctttgctgcaaagaccgtcactctttgctcactatcacaatccccctgataaacttttccgatgcttgaaatgaaacattgaggttagagagtcttcttgctactagatttacatataaatcatacatgcctgtatttacaatgttttattgttaaatagatatgtatattgaattacatacatattattaatgcacatttttatccggagttgtggaccatagaaagacatattgactcctcaaagtaaattctgcatgttacattgaaatcataggctaaatttgagatgcactatttttagaaagtgtagagaaaaggacaggaagaaataagcgaaagctttggtaagccaccaaacctgattactggaagaaaagaaaaaagttccgagaatagagttagatcgctggtgagggttttaaatggaacacaacaatggttgttttagagtgtgttattcttttgtatttataccttctcataggtttcttgtaatacacgcttcttcctctctctccctctctcttatggcctcgtcttgaaagcgtcttgcatgctaagagaaggctttagagcaaggagagaagggagaagttgatttatacgtccatcggatatatcttctttttatatctgtctctcttttaaggaagaaaa

SEQ ID NO: 14391 - DNA, 3000 bp, Unknown
  misc_feature (1)..( 3000): cDNA_ID_3016714_gDNA_ID_2684114_Annot_ID_190749 3000 nt of promoter + ATG
tggtccacaactccggataaaaatgtgcattaataatatgtatgtaattcaatatacatatctatttaacaataaaacattgtaaatacaggcatgtatgatttatatgtaaatctagtagcaagaagactctctaacctcaatgtttcatttcaagcatcggaaaagtttatcagggggattgtgatagtgagcaaagagtgacggtctttgcagcaaagatgtggcatgtagctagtaattccagaaaatctggtctctccgcaactttttcttgagataaactccaattagctttctatacgtccagtttttccgtggactgaactccaaaacagcttccgagctaagatggaaatcccctttccccagaacttcaaatgcaagtggatcagttaagacaagaggagaatcgtccagattcattcggttgtatacaaactccaaatttctcgctagtcgcttatccatatatgcatcgacaacacatccgaaagtcacaagatccggaacaatgttcaaacgtctcatatgttcaagagtgagatgtagatcccagaagagagccattctagaaaacgcaagagcgcgaatgttaaaggtggtaaggtcaggagagaaacccgcatcaagcattccaataaactctctctgcaagcttttcatcttaaaatcagctgcatatgacagtaatacagaattccataacatatttccaagatttcttctaccgagaccaacatctgacaaaaactcgcgtaaccgataaaacttccgttgtttcaagtacgctaacaccacagctcttatctcttcttcctctatcacaataccaaacttcttaacccggccataagccttctccatcttatctaaactaccgaaaaaactatagtatctaacaatcacattagcagtctcagcctctaacaacactccctttgaatccatttcctctataacaccctccatcagttccaactgtccattcttaccaaaacaggatatagcaagtgaagacacaaccggaagaagcttcgagtgccttgcagcaacatccttggtgatcttggcaacttcatcaaaacaaccaaattgctcataagcagatataagcttagagactacaaagacatcaggtacaaaacaactgtttataatctcatcccaaatcgtacgtgctcgaagaacaaacccattttcagcaaaacaaagcataagagcacaaagggttctgtaatttggtaacaagttaactgatttcgtttggagaaaaatctcatgagctacatcaggtaatcttctctggcttaaagtttgaactaatggagcgtagtctacgatttgtatcttttgactgaagtccctagatagctttgattccttgatcaactgtacaaagtagagagatacctaaaattcaagatatgaagtgaactaagaaacagaagcaagtgtgtaggtacctttttcgcgattgaaggagcagacgaatccgtgtaacaagataagagcttgagatgttggggtttcaaagatagattgagcgacaacattgcgaccagtctcggttacggtacggtggtgacggaggaatcgaggagatttccggaggggagagagagagatttgggcctcagaagctataattagggtgttatttcagagaacgtttgggcctttattgggctttagaaacattatccccactagtaaataaatgttttcttttctttttataaaagatttcactatttaatattaactattttttttgtcatccgattaataattagagctcaaacgaggcaaaactaaggaatgttatttaataccaactagagtatttaaaaaaaaatttaaatttcaatgatagaatatagttatgagatttgaaaattcgaccataatattacaaaaggtcaagcataccgtctctaaaaaagtatttaaatatttcttaaaacccataacaacacaatacctatcgatcatttttgtaaaaaatttcataatcactcaatcattcgaatcagaacatcttgaattcgtagcggcccaaacataagcggtggagaatcttatatattaaagcagatgtcaaaaactttcatgttcgctctcagaaaatgaactgatggatttgccctccctctcttaaggtttttaaggataaattaatatttttactaactaatgagataacttattattttgtttttatattttaatgtgtagaaaaaaaaaaggtttaattcactctcaaccctaaatttcctattctctggcgcccctaatcaaacctaaatcgcctattaatcctaatcaaacctaatcaatcataagtcgcctaacaaccctaacgggcttatgcttttcaaacaaagatattaggcccgtataatttacgctgtcatatgtaaaaccctaaaaccttatgctgaaaatacctataaatataggatccctcctctcaaacacaaacatcgtagcttgattttagtgcatagcaatagcaatatagtttatagtttttttttgtatttcaatctcggtcctttttatgatgcatcttcatcgatttttccgactcctttttatgttatggtcacttggaaagtaagatctcatagatctttgccaattggtgatgagttgtttacccaaggtttacagtttgttcggttacatgttttggttttcgtagctatttggtttttatatgtgtgagaattttcttgattttgattagcacctcttttttgtttctgaggtacaatcataaattttggggattgtagaattgcaaacgaacttcgaatcaaaccgaggtatctcactaatctttcttgatttacacatttttttagtttcagctttatcggatatatttccttgattgtctccgattgtatcaatctataaaattattgagaatctctctcacttaaccaaaagagcttttcaccagagagagcaaaaagcatcaaccaaaccatg

SEQ ID NO: 14392 - DNA, 3000 bp, Unknown
  misc_feature (1)..( 3000): cDNA_ID_3016680_gDNA_ID_2684114_Annot_ID_190758 3000 nt of promoter + ATG
cttctttcacaagcctgcaaacacagcttaaggaagctaactgcaaaatgaaggaacaagaaactttacaagcagagcgtgaagaagaggctttgcaaattgcagctgagcacttgatgatcgtgaagtacttgagcgcaaccgacccaaacattctcgccttcctcgagtctcaatctattgatcccgctactgctgatgtccaaacataggtaccttttccatccttctctgaatttgaaaacgtgtgttggtttgaataagaatttttgttttgttttgaacatataggttgtttggttttgaattgaacaagaatgtgtggtttgttggatctgttttaaatacacatttcttatgtgttaacaagtctgttgataataaattagaattataatcaatttatcaagaattaattgaaggctaaatcaagaattaaacctctaatcaatcacaaagtagtagcaattcaatcaccaaaacgttcacaaaacaattgtgatgttgtggcaaagatgtcgcataacagtcgctatacttagcgacgacattgcgactaaatagtgaccacttaaatcggttgcacattagtttgttatgcgagtgattattttaacactcgttgtttaggaaatacgtgttttagtcgcaaataagtcgcaagtaggggttttgcgactgattagtgacttcttatgttgtcgccaattagctgtttttttgtcctaccaacaaaaaaaattagttgttttcttgatctagagacttgatcgtagaattcgatggtagtgaggaatgttggtgagatgagagagagagagagagagagagagagagagagagagagagagagagagagagagagagagagagattgttggatagcatgacaaaatttataaatcaatgataatagcatgttttgtccttgaaatacatgcgtttataaaatcatatataatcttatatgtcacactgacgagtgatggagaaaatccggtgagaggagaaacacaaaatatacgagggataagaaagatagcttctaggaagaaagaaagagagaattgatggaatcacatatccaacgagaggaagataggaaaaaaggaatgtggtggtgatgagattcagtaaaagaaaaagatatctagagagagaatgactataatgttgcagccaaacaagaaaaaaaaagaagaagataataaaaggataagatgaaccaaaaacccttaaaaaaacatatagcaaatagtgtccatttagtcaaaggttatttcgttgattcttttcgagtcttaggttagtttctatatattctctaaattttataattttcttttcgattctagtgagagctgttgctaaagctaaaaagagaaaaagatatttaagtaaagttttctattaaacattatatattttactatccatatcaaatcatggaacattcatagccacccaaaacattttgagtgccaccagcaaaaaaggcctaatcatatcaaaaaaaaaacatttttgtaagtgtaagagttgaacctactacctattgttctatcacccaacgattaaccagtatagttataagagatatttggaaaatagatgacggttaattaataactatatcttataccgtaaacacatgcttccctagcttgtgactaaggcagattctggtaacaactcatattttatgcataagataaagctcacatagaccttgttcaaaagcattacatatccaacgatttacaataactctatcatttacatttccaaatgttatatattttagtgtttgtttgatttaatggaaaaaaaaacagttttgcattaactttgtaagggatacaacaattaaaaaaagagtcagaaataaaatagaaaaataatataaacaaaaatagagaaatctactaaagaaaactagatatttgatcttccaacatattaaacagaaaaataaaaaactaaagagaaaaaaaattagaaatggagtaaagaaaatacagcaattcaccgttacccttaactactttttaaaatattaaatgatattttcttttagaatcttgaaataaaaataaaagtttcttttttgatatcaaaaccatattaaaaactcatcttttactaattttagtataataattaaaaaacaaactaagtaaatgtttttgttttgtgcaaactaaatgttaagttcatgaatttgtgtaagatattttccctataaacctatctcaatgtggacccaataggccaccatgcacacaacttggcttttactctttgtgtcagtaaaatctaaagatagtaaagacagaccaaatcgcagccgtttatttcccatataaagaagtacgtacatggaaatgacaataataccctcactccttaaaccctcctcttctctcactttatttttcagtctctctttatttctctctatcactttttatcgattctgcgcaaattcatgcaaaaagggaaaataaaaagttctacactgtccccaagattctgcgtgagtgtggtattgaattcttcgccgtcccttttctatttatcatattttgttccttctcttattttcctcttagtgtcaatcatggactagaatcaactctctttttccctcaaaggtgatatattgattttgtgttctgatcataaagttgtggttttttcaatctgggttttgtttgttgttgatgacgatcatgtttcgtttttcattttgatacgacactgttactctgttttacacctttttagtacaataatgttgctttcgcacattaaccaatatgatcaagttttaaagttcatatatcatatatgttctgggttgtctctagttgcagataaagtttgaatcttttttttatttgtcaagtggtgaatgaatcctaatgaagctatacatgtattggttacaggagatcatatgtggatccacaagtgatcttgaagggaaagaaaaaaatg

SEQ ID NO: 14393 - DNA, 3000 bp, Unknown
  misc_feature (1)..( 3000): cDNA_ID_3016684_gDNA_ID_2684114_Annot_ID_190757 3000 nt of promoter + ATG
gtctttagaagcagaaattgtgtgtggttgattgacgaagctgtatcttgtttctttgtagttcctcaagtggatattaactaaagagacaaacaaaactatcttgctgggtcgtcgttgtctcttttgttacttgttagaaaagatactgaaaaatagtcatcagattgttgattaactaaatgatctgtcccatttgttttattgaaacaaaaactcaaatagtgaaactgaaatctaaaacataaacacaatctgaactgaaactaaaacataaactcaactgaaactaaaacgtaacacttgaactgaaactaaatcataaactcaactgaaactgaaacgtaatacttgaactgaaacaaaacaagacatttaactttaagtatcaaaccaattttttcaaaagtacttaaactgaaacatccaagtacttaaactaaaagtacttgaactaaacaaagacatttaagctaagtctaaagtacttaaactgaaagtctaaaacattacaaaacagtgataagaaacatatttaccgtagcagcacatatctcagtcttgtttcttgatttcaaaagtgattgcttccaactcacaaacaaaaaaatatatccgtttttctttgccagactgcttggtgactttccctgtgagacaccaacaatataaatatatgatgtcaagactaaatcgatgtgggtaattcattaagaaggaatgaagatatatccttttttatatgaaagccatgacttctacaaactctgcatcaatctgaagcaaaggaccaaaaaaacactgaatttattttacaatgtcaatattttacaatgctgactataacgaaccccaaattctcatctctctgcctattacttctcaatttcacaacctcaacagctggcttaggagtgatcacagattcaatcttagcctttccgatttcgattgaacaaacatgaattcactacaaaaaaatcattgtttatttcagtaaatcaaggaacctccaaagaattgaagcaacacaaaaaaaaattacttatgattcattacaaatttatttcagtaaatcaaagattcaaaaagaactgaagcaggactgaacgaagatttttttttttttttttttttttttaatcatcccaaaatgggctttaggcaaggccttacaacaaccaaacgggtacaaaataagaaggtaacgactgacaaatccggtgacccgagatcggacccggaggttgatcggaaaacaaggaaacacgtccaatagtaccagcgattacaagaagcactgcttcgcggctacgacggcaaggacaaactcaatgacagaagtaatcagttcccaacgccaagtcgatcccgacgacaaacctgaacctacaacacttcttccggtatgaaccgaaacctagaaaatccggaacccaatccctctaatccttaacctagcaaaaagagagaacctaaaaatctaacacccagactccagatctgtcaagcaaacaaaaccttgtacgagcaaagccaacctcaaatccggttagacgaaaactaaaacttggaagctgagaggtttagtggctcaaaccaagcctccacggccaagatccaagattagccgaaacagatctacaagaaaagtcgttaatcgtctcaacaaacagcctaaacccaccaatccgccttcatgacttccgccgcaacccacagcacccaccgcaaacatatgagccgcaagaaaactccaccaccatgcctccgacgtccataaccagaagatttagccggggagatttctcaaaaatgtcgagatagaagccacagatgcatcacgaaccagattaaccatacgcagctgtcggagaagaaagctcgctcacccccactttattgaataaaaaccaaacctgcaatgaagatctaaaacaagaaaagaaaccggaaagtagatctgttttttttttctcttgaggagagagaagagagaacgattggaacgattgtccccttaaatcatcttttcctgctacaatattctattgtatcaacaattacagttttaaatctgctgtgtcacttttctctttgaaaggaatgatcgtcattttcttttgcttaaattatctttaaagtttttttccttccttaacgaagattcttcataaaagatgcaaaggttttttttttctctaacttttttccgggtcgcccgcaaaaccgcggtctttaatgggcatccatgaattaatccgcaatccaaacggaccattcccgcgagacccgctattttttttctccattatataggcgggccaggcctgcggaccagaggcccgattaacatccctaaacataataaatgacatctgaattaaatgtaggtacatattgtgtaggcattgttgcaagtgaaaagaattcagcatacgatttcaaataaagaatgatccaaggtcctcatttccaagttataattaaagctttccgggtcattaagtatattaattctgacccgattagcttttcttaaaatatacttcaaaaatgttaatttagatattggatacccaattagttaatcatgtcggaccgagtcagatcagattttcgaacataaatctttatctctccgaattgaaccaaatattaaaccaaaccaatttgtaaaaagaaaaatcggtttggtttggatcaatagaatcgggtcgcatcaaaactccatgcatgcctagttctgtccatgctggaaagaaaacccacctacactcgaaagttttctttaaagaaaagcgcgagagaagtttaggttttgtaaatttccaacttttaaccacattttttaaagacaaaaaatagtgaaaatggtaaataatatcccgcgtgtcccactctgaaactggcgccaaaatcgaggttaatactaaaaatgcccaaatcaatcagatagaactaaaaccctagaaccacccaaaacaatcaacatctccg

SEQ ID NO: 14394 - DNA, 3000 bp, Unknown
  misc_feature (1)..( 3000): cDNA_ID_3016702_gDNA_ID_2684114_Annot_ID_190752 3000 nt of promoter + ATG
cagtatcgaatggtggtgcttcagtcaaattcgcggattctaaatgtgaaatcgagagggtatagaggagaattgaaattcaaacattgaaccttggaggaggatttgcagacaaaaggagaagaagccatcgtttcttcttcaaggtttgtgtgaagctcatcaactacaagttgaaacccggggtaataggttcagccaaccaagagaataaccactagactagaataatatattcgtatgataaagttaaacaatttaatatataaattcaaatagtagaattcaagtttaactccgtcaaatgattctgttatgtctgttaacggctgttaactcatatgtccgattcaaccaataattaaaagattgtattttatttggcaataatttattaaatgaggtatttttattccaattcaaaaatattgggtattaaacttccaaataaaaattaattttagttttttttggggattttttcccttttgttttatccattttcatttctaatctctttaaatttttaatgaccattttacccctatttgaaaattattttaggttaacaaaatgaaatattaataatttttcgtctaaaatattccaaaataaaattcccgccaaacttttaccgcaaaattttcccgcaaaactttttcgaaaaaaaagtttcccgccaaaatttttttttaaaaaagatttttcccgcaaatttttttttgttggcgggaaatagatttacaagggattttaaaagtgttttaaaagattgacaagggtttaaaagatttacaagggattttaaaagggttttaaaagatttacaagggatttaaaaagggttttaaaagatttacaaaagattttaaaatatttacaagggatcttaaaaggattttaaaagatttgcaagagattttaaaaggtttttaacagatttataagggattttaaaagggttttaaaagatttacaagagattttaaagggtttaaaattgttttaaaaggattttaaaatatttacaagggattttaaaaatgttttaaaagatttacaagagattttaaaagggttttaaaatatttacaagggattttaaagggctttaaaagatttacaaaagttttttaaagggtttaaaagtgttttggaagatttacaagagattttaaaagatttacaagatatttttaaaggctttaaatgtgttttaaaagatgtacaagggtttttaaaagttttttaaagaatttacaagaaaaccctttaaaattcattggaaatcttttaaaacccttttaaaatctcttgtaaattttttaaaacccttttaaaatctcttgtaaatcttttaaaacccttttaaaatcccttgtaaatctatttccagccaaaaaaaatttacaaggatttttaaaagcatttttttggctgagaaaaaatttgttacgaaaaaaaatttgccgggaatttttattttggtgggaaaaaagtttggtggaaatatttttttggcgggaaaaataaattttggcgccaaaaaatcggcgggaaaaataaattttggcgccaaaaaattggcgggaaaattctagtttccaattacatgttcctattagatgagggtaatttggttattttgttaaagggaagaggtattttaaaaaatggacaacataaaagggtattgttacaaaagggtagtaaataaaaggtagttttgcaaatctccctaaatacaatataattatataaattatgaataccaaatatacttgacaaaatacgagaaataaatataagaaagaaaatgcagatagttgactgaatttaagtaattaatttctgtatttttacaaaattatttatccaaaaaaaatagaaaaaaagaaaaggaagaagaagaaaagtaggagatccatcggttttataagtaataggggtgtttttacagtttataatggatctcaattgtcttccttcatttgacccgcatgtgttctactttcttctttttattattttattactataaaatcaagaaacgcttgtgtttgacaaactttcatgaatgaaaataattttgcgttcaaccccgttaagcgtacgaaccatcaattaaaagccatttcattcaaggcctataaatgtgaacatttttcttatgtaaacaatagtttttttcaactgcgttttcaactttctattgtccaaacgagttaaaagctgtgggaataataacaacatggtaaataagacacaatcgaaattttaagcttttacagtactaaaggtgtatggcactgacacatggtagggttacacaatctactcagagacacaattatttaattaaatcactatatcagcctctgaccagtatttgttcaagtcactatatcagcgtatgactatccttttcgatatcttaattttctttattatgcaattttttatatatacatgcaatgaatgtacatatgtgtgacagtgtgagaatgtataaacagaatgtaccagtaaattaaaaatagagctttgaaattaaaaactcatcaacttgttataactctaaatgaacgtacatatgtgttagtagatctcttttactcagtttgagaaaacaactatatgtgtcaatgggtgttaaaaaagttgttgtcaggtaagctgaatagatcgctcctaggtttactaatgtttaatgggcttggttttaggctcattacgtattgggccaaatccaacccccaacaatcaccataggaattaaaaaaaaaaaaaaaactcaatccaattttattgtatcaagttaaataagaatgtagcgctacagtaattaagtagtaaaacattaaactgaaatagttttgtgatttatttttacactactctgttttggatgccgatataaaaactaagtaaaatctattcatatataatcatcactttttaaagaacctccaaagtgacaacaaacattctcgcatcatg

SEQ ID NO: 14395 - DNA, 3000 bp, Unknown
  misc_feature (1)..( 3000): cDNA_ID_3016724_gDNA_ID_2684114_Annot_ID_190745 3000 nt of promoter + ATG
gtcacgcaagttatgctttggtctccaaataatgagagctcgagtaaaggatcgagcatctttttgaattgcgcagctcttgattaaacggtggagagcttcttgttcttgatcactcgatcaaacggacaaaaataaaccttaagaattcactcgatcaaacggtggtgatgcttctctcatttggtcattcaaatcaacggctcaaaacacttctcctcattctactcgatcaacagttgagatctttcttgacttggtttgaatttactcgaccgttgacttcctcagggttaatgaaataaacctgaaacaattaaacgaaaacatcaaaaataactagaaagatagaaagttatatacatggatagacatgggatttcctcccaagtgagcttgttttaagtcattaagcttgactcttacagagcttagtcaaaaaaaaagttaaagagaggaacatagaagtcctcatcttcagtggttgaattttcagtgcctgaatcattctctgcattctctgcatcctctctgcatcctctcttgaatcattcagtgcctgaatcattcaagttaactcacacgatggaagagttaaatagcaccattcttcttctcaaccaggctcctttgacgaatcctcaatttcaaagctggggtagcctttaaccattttcttgaagttccagaatggtgctatttaactcttccatcgtgtgagttaactttccaattgtatcctcatgagctttatatccaatccagagctgtaccacccaaaattaaaagaaaatataagatcagattttgggttaaattgataattttgaaattgtctgatttcaggaagatttctgagatattcgaaagtctaggcaaaatctgtaaatagagaaaaatcagaggactaaagtgaaaaaacgtggaaaaggagagaaattcgagtttatcttttccgaaactgaagggaagttttggcaattcgaatccttgttccttaaccctaatatatcgtatatatatgtgttttatagccccagcaaactagaagccgaaaccataatcaatttgagacttttggtgagtttcttagatcatttttgcctcaatgccaatttgaatatttgttgatattttgtgaccggattttgtggctgtttatgttagttgtgacttcagttgttgactctttagtattgggttgctttcagccttcttcagagttctaggtaagcttcatcttcttcctttttcagtttgcttccttaaaatgagctttaagctctttaatggtgaatctctttgcagaaagaattaggagttgatctatatcttgttagaaaactctcgtttgtaagaatccaacgccactgacatatcatcaatcggaagtcggagttgatcgaaatttgatcggtatatatttgatttttgttgattcatagtcaaatcgggatttatttacgccggttcttaagcttttaaaaccggttctagaatgttctgactatgggcaatactcgtttgaaatctaattttgaattggttgagtctgattttaagcggttagtaatttggtccggttcagcttgttttaaacaggttctgtcatttctgatacttgattaagattgaaattgaaattagcattcagatggtatatagtacttatttttctgatctacggttgaatttaggcaaattaattggtgatttggagcgtgggtagaattgatgtaaacactcgttcggtttttaaagcttttccaggtgagttctaactcccttattagttattatacatttgtataatattttaggagtgtgataaaaagaataaaggaattatttgtatattctcaaaattgatttgtttgctttcataattaatttggttataattataatactaagatacgttattctgttaagatttgatgtatatttgcaaaatatttgggaagaaaatagaaacaaaatttgaattattggaatatgtgaattctaaaatttgattaattatttagggtgataattctgaatatgattctgataatgaaatatgtcattctgttaagaccagtattagcatgcgactctaattttgctagctctattgagcaatctgtggcggccggcatcgccaacagatgtattccgtattatgttagtctgttagtggtattgaggtcggttaataccgtggaccgtacttccttatcaccttgataggggccagcatccctatcgagtatattatgtaaatattttgttagtatacggttttggtcaaccaatgttggggttgtaccattccgacacgtattgctggatatttggtcgttctgttctgatgttaatattttgtgctgttgatattattctgttatgctgatttgataatataattttggtagtataagctctgatgtgtttactttattttaaattaattaaattaaaatttatgtctattagtaccaacacgtgaatattattctgtacgggatcagaccgtgttggtacttgttcgtcgggtttgtagtctcactgggcaatttttcgctcatataagttttgattccgtgcaaaggacattgaggaggtggagcgtgcaactgaggtttaaagtttttagttcaatcgtaaagcgagacttggttgatttttcttgattgaaattattttgttttcgacatttggtgtttttatgaattttcaaacattatacattattgaattttagtatttttattatattatttttagtaatactttcaaaattctaccgaatttggggtgttacagtttggtatcagagccaggttttacgaaaccttgggattttcaaaagccttcgtaggttttgtttttaaaataaaaaatatatatcttactggtctcgcgataggattttgaatgtgaggtttaactgttagcttttgtgaccaaatttgtctaaactaagagtttaacttctcattcaattgcgttcagatg

SEQ ID NO: 14396 - DNA, 3000 bp, Unknown
  misc_feature (1)..( 3000): cDNA_ID_3016816_gDNA_ID_2684115_Annot_ID_190769 3000 nt of promoter + ATG
aatcggaaatcaaaaaacgacgctgaaaagatttttctctctaaaggatgttagagagataagagaggaaaagagaactatggacaagcatttcttctttaacattacatatgtttaatatccctttcttgaattttcttcactactaactttaacttttttgttgtgttttgaaaactattattggcctagtttaacctatttttaaaacgaaaacaaaccaacaaaatttatataaatatttgttaaataaatgaatgatttataatgttgtaagtaattatctaattcacaataaaccacatatatccatcatgaatatatatttttcttacaaaaattatttttaagatcaaacaaaatttgtagagaattcatatattatgtgactttaatcaatctcatttataactttaggcagtattcatatatgtatgaattatgatcatcaacatattaaacacatcaaaaaaaaaaaaaattttaaaaatagttttcaaaaaataacttttttttattagatacgagtacgacatacattcacttgtatcattacaatttcaatcactgcagtggagatcatctaccactaccatctttattttttgaaatataaggatgtttgggaaaacggacatcaactctattcataaatccataatcgcacttatcacggcttttgtcgcaatatgctacatcacataggcagtttcttctgcattcttcatctgtcgaacaagaatcttcatacgcaagagtgtatccttaataaacaaacaaaagtataagaaaattatcttaaatacaagcatattggtaagaaaataattaactagaaaatgatttcgaatataaagtttgtttaaacaaaattcagactcgattcttttataaaatggattttaacaaagattactttcaattatttgtgaagagatatgtaaaattttgttggcttgtttgaaaatgatactgttggtagctagggtatgtatacttacgagaaacgacgacaagaagagaaaccaataacaaaagtttgaatgaaatgcttctcatttttctacttctttctgcttttgatggtgaagttatacatgcgtttcgtctctttttatagtctagtttagatgatggtttgagcaaaaaaacttaaagattttgtttgtatatatatacaagttataattctttcaagatttcacttaccaaaaacggttacaactattaataaatgtatagtgatatttagtcaatactgaaatctgattcacataactatattcctattgaacatttaaagttccggtcatcatttttctttctatagactttttcatgagactatttctcatcatccgaccagtatagagcattcaaatgtgttatgagttatgactatgatataacaatatataatgattagacgattttttctcatgatgttttattttatcctagttttggtagatacttataatgtattttttaaattcaataggaaattaacaagaaaatatattgaccaattatagagggcttaaaacttcgtggatgtaacgtttggaatttttgttgtttaacgatggaacccactttctttgtccctttagagattctttcccgacaaagtacaaatcattcacagaagaaaactttttattaccattgttcccacaccagatttacacttttaccacttgttgattcttgtttatttggggtccacacggtgaatctgaatcatgtgatagtgattaagttttagattttgttttttctctttccatttactaaattaattgtttttgtagtttccactagagctttattttgccatgattttgtatggaatgaaatatactcaaattggtgagaaaataaactagtattacattattgtgaaaaattaaattacaactttttgtttataaataaatttaaaatttataagttataactcattggttgtataactaaatattttatttcaatatatatatatatatataatgaataaataattattttaagttgaaataacctttttaatataattataattattgactattttaaaatttattttatataatgttggtaagaccttcaatactgattaatcaattttatcattatattttgaatttaagcaagtgaaaaaaaaaaacatatgttcaatattggatattgattttgtgtagtttaaaatacaaaatttaatgatgcacgatacacaaatccaaaactaaatatatttcagaatcttaaacgctataaatacggtttacatcatatcacaagaagaaaaccaatcccatctctctgcaaatcgatagaacctgtgcaaacaaaacagttgtgaaggtacatcttcatactcttcttctctcaatcgaagtaaaatcctattcttctattttaaaattcttaccacctcaattagataagcaagtgcatatattatattccatggaaaaaaaagattcactagtaacataaccaaaaccaagttcatagcttttttttctttcgggtttaagatataactttttctaaagttttttaagtttttataaatatatatatatgcacttatgtttatatatatatatatattaaagataattactcttatggttagattcgatttgagattattacacttatggttagatatcgaatctacttttcttgtaacatatagttaaattgctgacaaagacctgatcaaatgagtcggtgaaacttctaataactgaaatcttgacccaaagaaaaccctaccaaaataaccaaaaaaaataaaattattaaaaaccccctctactttattatctcttaaattcacacactttatcttttcaattttagatttcatcctctaattttctaatttactatgttgtattatttattaaaattgatttagatttaatctcttgcttctaaacaagttggcaaccaaaaattagattctaatttcacgaaattaagatg

SEQ ID NO: 14397 - DNA, 3000 bp, Unknown
  misc_feature (1)..( 3000): cDNA_ID_3016808_gDNA_ID_2684115_Annot_ID_190772 3000 nt of promoter + ATG
ttggaggaaactcgcctcaaaaagtaacaccgagcttccgcaacacacaaggataactcattatcatccactgctctcaccgtctctgcaaccccatcaacaacctcgcctatacagccgcataaattcaacaactacagaggaaacaatcatttcagaggaaacaagaacaacaatcagtttcaccccaatcaacaaaattagacttactcaaatttctggcccagaccatttaatctgtggcccaatcaatttgcgaactggggacccaactctcaactaggctcataccgaggcccatatgtctttcctcaaatacaccagtatcctcaacaagcccatctgacggaaattcagtcgacgactgacttcacacaagcttacacgataaagactttggttgatcctaatggtgcaccatgggtcatggattcggctgccactgcacatctctcgggcacagcaggtaatcttcactctaatcttaatcataacatcactcactcggtcatcgttggtaatggttcaaaaatcccttcaatttacggcttatgtcaaaaatcaattcaatacccaaataaaatcctgtcaatgcgacaatggaggaaaatataataaccatgagttcaagaattatttggattcaaatgaaattacagttcgtttttcttgtcctcacacatctcaacaaaatggaaagtctgagcgaatgatacgcaccattaacaatgcgattagagctcttctctttcaagctcaactctcgccaagttattgggtagaagctctccatgtcgatgtccacctattaaacattcttccctcttccgccatccaaaaccaaatcccctacactcgtctttttaataagaaaccaagctatgatcacttgagagtattcgactgcctttgttttccaaacttaaatcattccaatcttcataaactttctccaagatcaagtccatgcttgtttcttggatatccatcacaacatcgtggctacatatgtcttgatctaaaaactaataagatcattatatctcgtcatgtatactttgatgaggatatttttccggcaaccgaaacacatcaaaaagacacaaagtatcaatttctcgatgatgatgttccttcttctcaattgcaacctattcttcaaactccatttcctactcaaaaccaacacctactagtgttcctgctcaaagaacccagccacaaacacaatttatttccattcagccctgtcactcaatgatgacacgtgcaatagctgggattcgaaaaccaaaacaggtcatctcacttctcaccaccacaaaatcgcctctcccaaaaagtcacattcatgctttttctgatccaaattggacaccagcgatgactgatgagatagatgctatgcttaagactaagacttggagtttagtgcttagacctcctaaggtcaatattgtaagatctatgtggctgtttaaacataaatatgatgcagatggcagcataactcgtcacaaagcaagattagttgctaatggaaaatcacaggaagccggtgttgatttcacagagacgttcagtccgatggtcaagccggcgacaatacgaactgttctcaatgttcatgttggtctcgattggccaatacgtcaattagatccatcccatccgacgatcggtctgtccgacccgttccgtcagacgatcggcctgtcccatccgacccgtccgacgatcggtctgtccgatccgtctggccgatccgatccgtctgatgatcggtctggccgatccgatccaacgatcggtctatcggatccgattcgtctctaagacgaacggtctaccctctccatcctctacactccatcgaaccgttggaccgggaggtagcatgcgcatcagttcggtcgagttatactcgccgagccgcaccccctttccgaccaacaactctaggatgtgttgggactcctttaagaatgttttatggtgttttggatgttgtgagatgatgtgagatgccttgggcgtcctcccttatatagggggcgaatggatgcttcccgaagcatcacatccgttccttgcacccctccgaaaggtcacatccgttccttgcatcctttcgaaaggtcacatatgttccttgcatcttttgggcgatgcaaccgttcgttggtacccgctcgaccttacaccttttggccgagacacctcttcacccgtgagctaccacagtccaccagctcgagtgtcagctgaccggaccacccagctgggtcagtacttgatcagctcaccgagctcagttgagctgtcggtcagctcacctagcagagctagctagtcttccagctggtttagctcacatagcttacctagctagttcatacagcttgtccagctcacctagctggtttagcttatactttctcgttcttcctacttagtattttgttccattcctcgaccatgatctagttttctcctaaaacaaacctgcctctttatgaacgcgggatgcggtcgttacaagtctaccccgttacactgaattcgtcctcgaatttggcgggtgagagatcttgtttactccctaacttgggacacgggcgttacaaactctcccaatcatgtgtgtcgattacacaaagcgatctatggtctcaagaaagcaccacgagcttggaactccaggtttgcaaaattcatcacccaccttggctttgttacaagcagggcagatgcatcgctgtttgtttacagaaaaggagttgaccttgcatacattctcctatatgtggacgatatcctcctaactgcttcttcgaccaaacttctggaaacatcattgcttcactgaaagctgaatttccaatgacagacatgggaaagatacaccactttcttggaataaaggcagattacaacgacaaatgattgttcttgagtcagtctttgtatgcaaaggagatactggaacgtgcatgaatg

SEQ ID NO: 14398 - DNA, 3000 bp, Unknown
  misc_feature (1)..( 3000): cDNA_ID_3016796_gDNA_ID_2684115_Annot_ID_190775 3000 nt of promoter + ATG
agaaaggaatatacgcattgaatattttaaattaatatgattcagttgctgaaaaaggaattcaattaatataattaacaaaaattaatataaaccaaaaaagtaattaatcttatttttaaatgtttaaacatattttttctattttaaatatcaaacataaaaaatagtttagtttaaattattttccagttatttaaataaatttagaatatttaacccaatttcgaattcaaacatattaattcgatatttataatgttatatctataaataaagcagatttgattagaaaatatttttaaaaaaataattggattagtaatattttagaatataatattgtaaattcctttgatatatgagtataattagttatccaattttaaacccacgtaattatgaatagtattgaataagggaatataataattgaaaataaataaaaatcctctctccaaaaatcttgttgtaggatttattgaaaaaaattcaatggctacaattaattaaatcgaatggccaagattataacgtatgactcaaaagtttaaatccgggtcaaaaggatctgcgtgttttttaagtgaagacgagagattgaacggacacaaataattcaatcgaatggccaagattataacgtaagttaagtgattctcaattaaaggtaatttttccatgatattaatattttaaacatatgattttaaggtaaaaaatttttttaattgagaatcacttaacgtacgtctcaaataatagtgtagatatgtatatagcaaaattaaaacgttttgcacagaggaaaatgtacgttatctgcctttattaattttaggaaatgatgatccatgtttaattccaagaataaaaagcaaagagttatataaatcatagagtattggtgtgtcgtagaaatgccaattaagtcccagaaagaagtacaagttaggaatatttggtttggtagactaattcttttgagaagaacttataagttcatgaactaatctaaaaagcaaaaaaattatgaactaatctaaaaaagaaaaaaattatgagaattttaattatgtataaatagttaaatacgtaagagatcgtttaattgaaagcaatagtttttattatatttataatcacataacaagttgatgacacataagttgattttttgatagccgaaatatattagctgtcatatattacccggtcgtacccccgattatcccctagtttggtgttatcatctatacttgtaagaaagtccattttgtcatagttttgtaagtaagatagaatataaaataaaaataagataagatttcatgaatatctttggataaaatgtattaaacatattacctagttgtattcttatttttacttactttgaatttattataatatttatggtcagtaagtttaggaaagaaatggagtacttaatatctttggtatgtaaatcttctatatcaataaagtcaaggaaaataatttgtccacatccatttacaaaaacaaaacaatagagagagaataaaatatttgaaaaaataaataattattactagaaaatcagtaacactaaatggtaacaaaatattatacagaaataaacttgatgttatcatctatttttgtaaaaaaaaccaatttttattttattttaagtaagatataacatttaaaaaagaagaagaagataagatgcatgaatactgtatgagctgtttgtataacttcttgttcttactttgaagttattatgatctttttggtcaatgaagtttgtggataagttccacaaacttaccatcagtaagtagagagaaatcgagtagttttttatatgtaaatgttctatgcaaaccaagtaaaagaaaactatgttttcacatccatttacaaaagaaacaatagaccaaaaaaattgattgagaaaaataaaatttacaataatcatagttttgttcatcgaaagacaaattcatccaaagactgttatgagaaatttggattgtcttggtagccgtattcggtttccagttaactgtgctttcaattattttagtcgacaaaaaaaaacttgacttcaaaactaacagtaagaccctcttctaaaatgtcgagaaagctatcattttaatttctatggccaactaggcattgtggaagaggcaaccaacaattttgctgtcaatcttgaaaccgagtttttgtgtcagttgaaatatttgggaagcacaactcaccggaagccggatgagacggtcacgacctccaattttcacatggcggtctttcgatgaagttgcctaattaggactacgcttcttttcttttcatttcatttctcaatgtggctatatatttaaacttcagtttagcctttaatctcgacctactttgaactcccgggtttgcattactcgaaaaccgtcggtgacaaactaatattaatctaacctaattctggaatttatgtgaatagaatactcagctattcagttacgacataaaaaaaaaattgagaatgttatttcatgtgaatacagacagatgcttttatcttccatgtgacagatccctttaaatctaatttgtctttattaggtcaatctcgcacttaacgtcaaaaaataggtgattgatacgtcaacaaaatgatcatattgttattttaatcattgatttgcttatataaaatctggtaatcacaacacatatataaaccaaaaacactttcagtgatttaacaatttcatatatacattataagttacacgtaaaaaattagattaaataataaatccataatttcttgcatgcttcattgctttcaacgtgaacaagatttttcacggcattggtgagtccattacgtctcttgaacacatatagatttgccttcttgagctgtcttttttattttaaacattaatataaagaatctcacattcaagatcgagggagagatagataaagaaagagatg

SEQ ID NO: 14399 - DNA, 3000 bp, Unknown
  misc_feature (1)..( 3000): cDNA_ID_3016775_gDNA_ID_2684115_Annot_ID_190783 3000 nt of promoter + ATG
ttaattagaaattgaatagctcataaaaaagttattgtgcaaaaaatgtaaaagattaaagagatttaccttatcactgaaaacacaaatggattcttagaataatttcatataagatggagaaaatacttctcttcttctcactagacgaatttatatatgaatctatcttcatgaaaactcaccacataggctaatgggctaatattttgtacaatgattggattccacataggctgaagtttggtttgagattctctcagttatccataaaagaaaaaatcacatttcgaaggtttttaccatataatattttcgaatcaatactaacatcgttaacttaagctaatcgacgttacgatcattttactttttcagaaatgtttttgtaagatttttgcaaaagaatatatcactattagtagggaaaatggtcaaaatcaacctagattatttgttggcgattttttcatacctaaactataatattgagtatatatcaacctaaactcattaaaaattcaaattctcaatctacactatatttaaatagccaaagtcaacatatgctgaaacgatgttagttgaccgcttaagacgatgagtcagccaatactgtggcaatgacggggcatcgaagttcagtaaaacaatgtcgtttcgtgagcttagggttctcgaatcgaagattcattggcgattactttatcgattctttgattcaagaaccctaaactcacgaaacaaagtcgtattactcaactacgatgccttgtcattgccacgatgtcggctgattcatcgccgttaagtgattaactaacaccgttttgacatatgttgattttggctattttcatataggttaggttggaaatttaaatttttagtgagtttacattgatattttccgagtatcgtagtttgggtattaaaaaatcaccagaaaatagtccgaattgattttggttattttcccaccattagtacgtctgttcatatagcgtccaagttgttgttaaagaaaccgcaaaatctctaatgtatgtggcctgttggaagatgagtgagcgagctctcacgtctgtaagaaaacctattaggaaaaggtgaaaatgtttacacttataaaagcccaacccaacttacaatatagcccaaatacaaattttagtgaaaattgaaatatatgattgagagatttgagaatttctccggctgtattgatcttttagaccgaaagtccaaattttgaaactttcattgatcaatctaactgtgacatctaaactccaaaaatgaatattacaatgaccaatataaaatttttacacaattacgtacaagtctttgtcgataaagaatgtttccatatttggaaccagtaaaaatgaacgtaacgtaacactaagtatcgttagctcaattagtaaagattctaggcgttcgtctagaggtcgtcggttcgagtgacgcttaggacgaaactaatattacatactgtggtttcgggtttgggggattatgggattcggcccagaaccttctggtattcaaaaaaaataaaaaatgaacgtaactcattatacgacgacctaaaaatatgtaaacacatcgatcttataaaacaaaaaataaccgattaaaaaatacgagtatatcaattcttcaaagactttgatcaccaacattagtagacattttcggtttttctgtttcatcaacattagtttcgtttagtttaactactacatcttcttgatcagcttcatacattctcatataattgtcataatacatatatatccgctattttatttgaaataaacttctatataccacaatactaacaagctatatatttttcatagcttatctttgccttttacattagagcttaacgatgtatatactctaagcatatagagccaacgatgtatcaatgacaagattcaagatagcatgattttcatattttattgcaacttagcgcaccatgaacatcaaactatactaaacggggatagaaaacaaaaattggtaaatattgtatttttgagaaatttaagacaagattttcatcaatttcaagaatacacatagtttgataaaaaaaaaaaaagaataatacacatagtaagaaatataccaaaagggtaatatagaagatataaagaaaatatcttatattaccagattaattacttatctaaatttggttatttcttttttttcaaaattagtcaaatatatatttaccattttcctatttttcataatcaattataaagaaagaaaatggaatgagaaaggacaattttctttagaggcatgacaaaatcttatcattgcatacaatgtatataggcatgacaaaatcttattgaccaccttaattaagaattttttttggtgtatggtatataagattttagtaagaatgatatatatatatatatatattaaattttattttatttatggtttagtccttaaaactcaatgctaataactaaagtagaaaataatattttttgtcctcaaatttgtttagttatgagttgtatatataatagttcacatcacatgaaaagaattttgttttagttctgagttgaatatgtaatagtccacattacatgtaagtgaacaaaactaacttaaaaagatgttcataactaactgttacttataagtaatcataaaatatctagtttgtgcttagataaaaacaatcaaattcttgtatttattaacgaacgagttatattgcgtattacttttaacttaaagggattgacctgcacattttggagataagggttaagatgcgaaaaatgacaagttggagggtctttttttatgttctttttgcaaaaacccctaaaaacacgggcttttaggtgtataaaacgaggcgattagataataaaatgcattccaacaacttctagatttctttcacattcaccaaactttctacagtcaaattcgattatg

SEQ ID NO: 14400 - DNA, 3000 bp, Unknown
  misc_feature (1)..( 3000): cDNA_ID_3016791_gDNA_ID_2684115_Annot_ID_190778 3000 nt of promoter + ATG
tgatttgcctgaatgaaaataatttattatacacagaaatgtatttgatttcaaaattcaatttatgtgacctgaatgacaacaaaattcccgaaaacaaaaccaaaccatgagatgttttaaccgttctaagttttgtaacccagccggagcatgtccaatgctccaccttgttgaaaagatatattaatatcatttttttgggccaccttttttactgcaaattaacaattgtttggctatatactccaaaatatgaaaaacaatagttgttttaactacttacaaatttgaggtaactccatgtattagctattaggaggtcaaattattcaaaattataactcaaattttcacgtttgcaaattaattcctcaagttttcgctaccacgcaacatcatgctaaaaatagtcaacgttaacttctacgttttcttatttggcgttgacttttttcaattgtatagtcaatttaaacttcaaaaatttaatgtgcgcacacacagttgagaaattaataagtcaattgcaaatatttaaggaataatgaataatttccctatctatttggtggtttaatctccaacttatcttttggagaatcttgtttcacagttattaactttcactaaaacaaatgagttctttctaaaataaccttttaagttgtaacctaattatagtcatatacacatacaaaaaatctacaaaattctatattcatatacacgacttttgctttctttcttctctaaaaccatcatctttttgtgtagtgaatttgagtgaaattaactttgatacgtcaaaaataattttatttttattcttgagaatttgctaatcttgccattaaaagtatttttgggatatctaaaaactaaaaaaatgaagaatctaaaataatatttgttctacaatatagagtaatctctttttcataacatcttttacaaagaagttacaagcaaaacttgaaataaatatgtggaacagcgttatcaaaatacatggaatgcttatgatgtttgctacataataatttttgtttgttacacattacttgatgttttcatttttcaatgcaaaattaattattttatttgtttttaatcatttatattctgcgctttgttgtctaaatagtttttaattaaaaaacattatgttttaattttgtttttaaaaaaaaacacaattggtttcttaatctatttaatcatcactaatattgaaacttaagaagtaatgttaaaacaaagtagccctatagggtttttatagaaattaatgtaccgttaagtaatagatttcagacatcattgactatcaaaaactaaattttcggacaaaaagaatttcattactattttaaatttgttgatgttaaagagaatagattggctgaagtgattgatgttaagctgaaaaacaatcacaaccatggaaaagtcacatcagcggcaagactggctagtagttgtgtgaggatgaaaggtaaaaaatggccaacaatggcgaagtggctgtcgaattggagcacattcgctcattagcgtagtcgcgtttttttttgtatttttttttttgaagaaaagtaaacaggacctagtgtgactgtgtgaggtcattgattcatgctgatcttcaagaccgatcgaagtgtagcaaacaatcatcctgcatgcaggcatctggttccttgagcagtctccatagctttgatttgcgtttgctcttgatttcaatctattttcacttattatactttaaaagaccttgaaaactcgaaaccaggaatattgaactgatcagatcctggaccactgcaataactgagttcatgtacgtacaaaactaatatgtcacgactaggaatttagcgtcctcgtgagattgagagagacacgtatggtgtcaattgcccgaaggtacagtattagtttgaattgggcaacaacaacaaaaacgtgcgttctctaatactcacttctctagaaaacaacaaatatgataacgtaacctcctttgcttcttttcttattaattaagaccactcgtaactaataaagatgatagatcttttatataaaaaattgtattcgtcaatgctcttttatgaaaacaatagttcaactacccatacttgcatctattagctatctagtattctcatattattacaaacattatgcagattggagataattaccaacatttctatataaacaatccgaatttggtgattataaatacttaattaccattctggaagtaacaatataacaggtagtatctatgttattttggcatgaaaggaaatgatcttaacttctcaaagtatatttcccacttttctcaagaagatcattaataaactaatacctcttcttggacagacatttttgagttatcttgtttttgtttcggtcactagttaagaaaagagaagaaaactcaacataccattttatcacgttatagccatgttcgaattgaaaactaaccacctaaaactagaggatatgatttcttatctattttttggtttcattttaagcaggaccaaaacctaaatggccggttcctccaaaactagttatattttttttttgtataattgcaaattcataaagatgaaaagagctgcattcttgggtatatacatgttaacatatctttctttagatacagtggtcctcctatgcatcacatgcaatatcgggtaaggtcaaaaagatattgaattgtccacaacacataagaagttaagatgtcactcgtggacattaacgtcgtagagtacccatatattcccatggaaattattggtattcgtaactcttggatatttttaaacgttgttaatactttaataaaatatattatattgtctaccgaatcaaacacagctgtatcaacaaaaataatttgaaacttgtataaatagatgaagtggatatgagaggaatgtaagccttatagaagagaaaaaaaat

SEQ ID NO: 14401 - DNA, 3000 bp, Unknown
  misc_feature (1)..( 3000): cDNA_ID_3016769_gDNA_ID_2684115_Annot_ID_190785 3000 nt of promoter + ATG
ctgtttcaggctctggaggagaagagtattcaattggagattccgctggagaattatgagatccgagtttcgatggtggtgatgcgtggattaaaggcgaatctgctagatccggtgacggagccggtgaggatttagttaaaatctcaccggagacgagtacgagacttagcatcatagcaacaataatgaattcgagcttcattttcaagtttttttctgagatctttctctgagaagttgtgatgatgagtaagtagaagaagagagatctggagaagttggttttaggagtgaaagagaagaagagagaattaatgaatattattacgatcgctagatttgcggctacgaaaagtgtacgactaatgagattgtgacacgtaggaaacgtatggaaatagagaaaggtgcgaaacacttgatcttgccaggttggtttttttaaatttgaaaatatggagaaagaggattttcgcgtagtaaaaaatgtgaaccgtagcgtgaaaccggcacgtgcggttcacgtgaagagctgaccttcacggtatctttattcaccggcactcgcaatggtttgggctaggcctgggaaaaaaaccgctaaccgattaaccgaaccgaaccgaaccgaaaaacatagttcggttcgagtttggatagcttaaaataaaccggctggatattatatgtcttagattccggtttcggtttcggttaggttagtaaccgataaccaaaggataaccaaagcatatatgtatgatagataatatatcacatatattgtatgtattgacacttaactatgttcttctctttattagttttgtgaatcatgtattttaatattatggagagtatggaccatatttgcatctttatgagttgtgaataggttttttttacagacgttctatatcggttattggtcaatttttttggttgtttcggtttttagtcggttattttggttttggtttatttatggttaccaagtttaatattcaaaccgaaccgaaagatatccgaaccgaaccgaaccaaaattcctcaaatatccaaatggttcttatattactataactaaaataaccgaaaccatgcgcaactgaaccgaaaccgaatggttaaccgaatgcccaagcctagtttggacgattaagagaaagtaacaaagaacaatgctatttgcatttctcaaacttttttaacagaaaaaaactttttggttaacaaaattcatttagcagcatataaagtttatatgatcttgcttctcctcaccacgaagttaacttttcgtagcttcgaaacgaaagtaaagatatccttagttttcgaggtaggaaaaatgcataatacagatatagaatccattttgaagcacgaaaatcagggcttgttcaataaattaagagttctggtataattctttaaaatgaatttttgcatactaaaaaaaaaattaaacaatttttcatgctaaaaaaatatttaaaattttaatcattggcttttttttcgtactaaaaaatgttttgaacttttttcatgctaaaaaatctttaaaatgatcatttcttcgtattaaataatacatttggacctttaaatttatccacaaaaatttggacatagaacatttgctcctcttgctctcctcaagagccggccctgacgaaaatatgtcacaaaaattaggaactacgtttctagatgtttcccatttctttttttttaaatcgtttcatcgttttgaatgtttcacttctgcaaatctgtttccgtttacatgcatcttagataaccacatagttctggtattcttaattttaatactgtatttccatctttatgtggttactcttatttttcaataagtgattctggatgcatatttattaactgtgaactgaataatgccggttacaaaaatttgattatctaactaagaacagcagtctatgaaacaccataatctgaagctagcgatgtcaaaatcgtaccttcttatttagttcaattgcaaagatgtttctgttagaattgagtccatgattaaaatatcatatatgctatagtttatatttaaaggcaatggatgttatgtgttacatatcatacactacgaatgggtgtgagtaagagacataacttatcggagaagttaaaactgttaccaacggttatgtagttggttatgtagttagttatgtatacatctatataagtgtgtatgttgtcttatgtaaaaacagtcgagaaaataacaagcttcagttttaataaaagaaagtcttgtttacaagacaaatgtctcttgctctgtttttcttcattctctctcaatattccaacagtgccgtgtgtctatgatctagtttttactattgatctccaaaattccccaacttatgaatgtcaacagataatttgacatgatcatgatgaatcaatttgagatggatatgaattgcttatactaaatgttatgtctgattagtcacacaaaccataagatatgataatactaatgttgttaagtagagaaaagcatacacgatataagatgcactgaaatgcatgaggtaatcaatactcttcctcttcctcttcttcttcctcctcttcttcttcattggtaggagtttggtccaagatctcaaccaaatcaaatcatggggtcaaatcaaagaacataccgcatatattagctactgatttatttttaaatagtttttgtgttttcgatttagtaaaatggcaaatactatgaagaaacatttagaaaaatatttgttttgccatcttattggctttctaaccccacaaatctttgttttcgactttaaataagatttactttgtaatcgtggccaaggtgatgagttcgatgactattcaaatttattttgaaacaagatatatatgatattcatcaccattcgtccccacgtctttctcgtttggaaaagaaaaaagaaagaacaaaccatg

SEQ ID NO: 14402 - DNA, 3000 bp, Unknown
  misc_feature (1)..( 3000): cDNA_ID_3016800_gDNA_ID_2684115_Annot_ID_190774 3000 nt of promoter + ATG
tgcaaggaacggatgtgatgcttcgggaagcatccattcgccccctatataagggaggacgcccaaggcatctcacatcatctcacaacatccaaaacaccataaaacattcttaaaggagtcccaacacatcctagagttgttggtcggaaagggggtgcggctcggcgagtataactcgaccgaactgatgcgcatgctacctcccggtccaacggttcgatggagtgtagaggatggagagggtagaccgttcgtcttagagacgaatcggatccgatagaccgatcgttggatcggatcggccagaccgatcatcagacggatcggatcggccagacggatcggacagaccgatcgtcggacgggtcggatgggacaggccgatcgtctgacggaacgggtcggacagaccgatcgtcggatgggatggatctaattgacgtattggccaatcgagaccaacatgaacattgagaacagttcgtattgtcgccggcttgaccatcggactgaacgtctctgtgaaatcaacaccggcttcctgtgattttccattagcaactaatcttgctttgtgacgagttatgctgccatctgcatcatatttatgtttaaacagccacatagatcttacaatattgaccttaggaggtctaagcactaaactccaagtcttagtcttaagcatagcatctatctcatcagtcatcgctggtgtccaatttggatcagaaaaagcatgaatgtgactttttgggagaggcgattttgtggtggtgagaagtgagatgacctgttttggttttcgaatcccagctattgcacgtgtcatcattgagtgacagggctgaatggaaataaattgtgtttgtggctgggttctttgagcaggaacactagtaggtgttggttttgagtaggaaatggagtttgaagaataggttgcaattgagaagaaggaacatcatcatcgagaaattgatactttgtgtctttttgatgtgtttcggttgccggaaaaatatcctcatcaaagtatacatgacgagatataatgatcttattagtttttagatcaagacatatgtagccacgatgttgtgatggatatccaagaaacaagcatggacttgatcttggagaaagtttatgaagattggaatgatttaagtttggaaaacaaaggcagtcgaatactctcaagtgatcatagcttggtttcttattaaaaagacgagtgtaggggatttggttttggatggcggaagagggaagaatgtttaataggtggacatcgacatggagagcttctacccaataacttggcgagagttgagcttgaaagagaagagctctaatcgcattgttaatggtgcgtatcattcgctcagactttccattttgttgagatgtgtgaggacaagaaaaacgaactgtaatttcatttgaatccaaataattcttgaactcatggttattatattttcctccattgtcgcattgacaggattttatttgggtattgaattgatttttgacataagccgtaaattgaagggatttttgaaccattaccaacgatgaccgagtgagtgatgttatgattaagattagagtgaagattacctgctgtgcccgagagatgtgcagtggcagccgaatccatgacccatggtgcaccattaggatcaaccaaagtctttatcgtgtaagcttgtgtgaagtcagtcgtcgactgaatttccgtcagatgggcttgttgaggatactggtgtatttgaggaaagacatatgggcctcggtatgagcctagttgagagttgggtccccagttcgcaaattgattgggccacagattaaatggtctgggccagaaatttgagtaagtctaattttgttgattggggtgaaactgattgttgttcttgtttcctctgaaatgattgtttcctctgtagttgttgaatttatgcggctgtataggcgaggttgttgatggggttgcagagacggtgagagcagtggatgataatgagttatccttgtgtgttgcggaagctcggtgttactttttgaggcgagtttcctccaattccaacattgacttagccgtctcaaaacttggaaacagctctttgtgtttgattacgttgacgatgtaatcatatttgtcattgagcccgttgaggaggtaagtgaccagatgtatctcgttgaccggtgcatcaacattggcgagcagatcagcaagcgatttgagtttttgacaataagcctgaatcgtttgttctccaatctcttgattacgcaattcattatctagttggatcgctcgagcctctttgttgttgcggaattagttttcgattcggatccaaacgtcacgtgcagtgcctccagtcttgaatgatgagcggaacagatctggagcaagagttccatagatccagagtttaacgagtccgtcgcgtttcagccaagaaccatcgttatctccactgggaaacatagtaccatcaaggtgtcctagaacatcgaacgtcagacagcgtgtctggaaaagctctctccaagcatcataattgtgatcattgagatcgagaattaagagtatgtgggctttgatatttgtaaccccaaacgctcgctctatcgctggaagttgagcagccattggagacttttgaagaagaaaaaagagatgaaagaaggaaagaaggaaaaaaggaaagaagaaagagaaatgagagaaaaggttaaggagcgatggtgctctgataccatgaaagttaatgaattcctcttgagaggatcgttgaattgacaaggctatataaagccaatgttgttacacaaaatcagggattaaaaaatcatatatacagaatatataaaacagattgtaacagaacgtccctatattctatcatggatgtgtactttaattttttttagtagtaaatgaatgaaggtgttaaaaaaaaaacccaactgggc

SEQ ID NO: 14403 - DNA, 3000 bp, Unknown
  misc_feature (1)..( 3000): cDNA_ID_3016908_gDNA_ID_2684116_Annot_ID_190791 3000 nt of promoter + ATG
attaggcaaaatcgattttcccaggtttgatggaagcagaatcaatgaatggctgtttaaggttgaagaattttttggtgttgattttactcctgaggatttgaaggttaaaatggcttccatacacgtttattcagtctggtgtgggtttggatgttatgtttgattggcctgaatatgtgaaattgttgaaagacagatttgatgaagatgatgatgatccaatggcagagctgaaaaaattgcaagagacagatggaattgtggaatgtcatcagaagtttgagaatattaagatgagagtgaatttgtttgaagattatttggtgtgtgtgtatttggcgggtttacgtttggatacacaaatgcatgtgaagatgtttcagccgagaatagtgcgtgattgtttgcgtttgggacgtttgtatgaaaaggctcatcctaagaaaactttttctacaaattggcaatctaaagcaggggttactacgggtgtttctaagacttcgcgtgacgtggatcagaaaggtgagaattatggcaacaaggtgtcttttaaacctcaaaatacaaagaaattaacacagcaagagatgagtgataggcgtgctaaggggctttgttatttttgtgatgagaagtttacaccggaacactatttggttcataagaaaactcagctttttagtatcgatgttgatgatgaatacaaggatgctgaggaagttttgtacaatgaagaggaacctcagatttcagttaatgcagtttcaggagttgctggttatcgaacaatgcgggtcaggggaacatatgggaagaagcctgtgtttattttgattgattcagggtcaactcacaattttattgactctgctgtggctgctaaacttggttgtgcgattgaatatgcaggtttaactagagtttctgttgcagatgggagaaaaattaatgtggatggcaagatttctaagttcacttggaatctgcagactacaacatttcagtctgatattttactaattccactacaaggtattgatatggtgttgggagtacaatggttggaaactttgggccgcatttcatgggagtttaaggagttggaaatgaagtttaagtacaataaccagaaggtgctattacgtggaattcgtgaaggttctgtccgagatgtgaaagcacagaaattaagaaagttggatgatgatcaagttcagattgctttgttgtatgttcgtgaagtgccagcagaagaagagttgttggaacagggattgagttgttctgtgaatgcagtagcaaagacggagggtgatgatacggagatagaggagcttgtcaaagacttccctgatatttttgctgaaccaactgaattgcctccatttcggactcaacatgaccacaaaattgagttgttggagggctctaatcccgttaatcaacgaccctatcggtactctattcaccagaagaatgagattgacaagttggttgaagagatgttacaaagtggtacagttcaagtaagttctagtccttatgcttcaccggtggtgctagtcaaaaagaaggatggatcttggcgtttatgtgttgattatcgggaactcaatggaatgactgtgaaagataggtttccaattcctcttattgaagatctaatggatgaactgggagggtctgttgtcttctctaagattgatttacgtgaaggatatcatcaagtgcgattgaaaaataatagtagaaggcagtgaattgttttacgaatgtgaaagaccaaaattttagacttaagcatacatggcaaaaggagagacttgcagttttgggaaaagtgactgttgatttagtataattagatgaaaagtaaactggtagattaattaaggtaataataaaataacacgagagttgaaccaaaaaacaaattgaaataaagagtaaaacgtgtacttccaaaacggcgtcgctttacgtcgataacgattcctttatgggcattaccatctgatctccgtcgcaagatctgtcggccgagatgatttcgcagttttctttctcagaggcggctcatggcgacactgtgctttctcccatcggcttgatttcattgtgattttctaaattgaggatatgattttctgagccatgggaagggagagaagaaagcttagcttgagcttgaattatgattcatctgagaaatgcaggcaaatgttgatgcacatctcctgttgttcaagtaaactttttctgattcgccactacagtatcttgtccgttcaatttctgtctgattgatggccttttttcgttcaaaatcattgtttggtgttgatgagaacacgggagctgcaaatcataggtatcaaatgccaaagacgagtacttggcgtgaacatggtggacttgactttgtattcagcttggtatgaatatttttacaagtttctgtgtctacctaatttggattatgaattgtttctttgttaggatgtatttgcttaatacctgaagatatattggagttgagaagaaactagtagatatatacttatttaactagagattctgattttagtattgtgggtttgttcttgatgatagtggaaaatattctttgaaccagggaatgttatagaagtctcagtttttttatatctattttagtttagtattttaggagctgttatgtttaaaatatgtgatggcttagtatatgtaaatgttgcatgtcattacatttctcaagtcaactctgaaatgctcaaagataagatgttttcattgctcttagacaaattcaatggatacaagaaaagttaataaattatggtggatttgacattgaaaaaatattggatgttgtattatatagtgaaaaagttttgacctgaccttttttgcagctggagaaaatttcatcgaccattggtgtgaaagacagtttctttcagaataatcagactctctgtttcttcagaaatg

SEQ ID NO: 14404 - DNA, 3000 bp, Unknown
  misc_feature (1)..( 3000): cDNA_ID_3016896_gDNA_ID_2684116_Annot_ID_190794 3000 nt of promoter + ATG
taattatttaactatttcttaggcatattttaaaagtctaaaaaaacaacgaagtcaaaaaccaaaaagggaattttaaaaagggaaattggcaaaactaaccaacaaaaagtttataattaagaaactatcataaaaaaaaaaaaaactgatatcctctatattttgtatattaattccaaattcacctttctatctatttctctcatctctctttctgtgtacctctctcttccgttctctctctcctctctctttctccctctccccctctctctttctctctctttctttttccctccccctctctctttctccccagtaaagtccttacagctacatcgttacttatttttgttttcaaatcagagtctcttaattacttttgggtgagatttgatctgggggtttcgaattacagaggaaggaacacaatttggattcagagagtcgactttcgttattgcgcttggtgtcttggtgatgaaattgagttttgttgttgcaatttgagagatactattctatttgtaaatatactatttccgtataccttgttctatatacgttttaaaatgaattatttcttttaattaaggatgttaagtgatttaattattggtttagatttaaaccattgggttccctatatattatcccttagggtttaatatctttccatcaaaaaatattgtgtatctatataaaaggttatgttattcattgacaacactattcacatctaaattattttgtgtctgccttgaaaatttaagtcatgatatatgtagaaaactatacaactttttaattgatatatcatgaacttgaattattttttttaagattagataatatgaattacaattgggaaggggtaaagaaaaaagaaagagaaaaaggacttctctcctaccacctgattttttttctcacctcaacaccaataataaagtcacgtcagctcacactaaacattctccttcctcgctgacaaacgtaacaccaggccagtgatgtcttttcacaccccttaaaggttatttactacatttataaatttatggtgttagttagttaattatttaatgaaaaagtgatatatctgcaaatcacccttttaaaaataaggatatcaaggaaaaactactactgtatactttaaaaaaaaaaaataataataacattataacgagaaactatcgagaatccgttgggcgtacttaaatgaatcagtttctttaaaacttacaacattttcatacattgaatgaaacataaatatttgtcaagatgaaaagacaaaaatggagaagttaaacgtccttagtgcagtgtgacataatatgcactttaaattattcatgagaccctaaattagttgcagttttttaaatgaaaatagtttcttatacaaaaaaaaaaaagcagagcagttcagttatacgtacttcttaactaaacaaattatattctctcttatgttttgccattaattagattgttgtgaattaattgctggcttgtaattcttgcgagaaataatttatatatctgatttggtttaacaagaatgaatctgatttttcaatgcagataacaaatagtaaatgtaatccaaagcaggaacgagttgtccaacaactattggaacaagtccaacttcttagccaaaaatttgattctagtaaagctattctggtttctcaaaacaatatcaagtttgattttaaacttgcaagagaggcaattgtttctcaaaccagtagggcctcagagatgaagggagaaacttgtgtcatttgtctggaagaaaccaaggccgatcgcatgttcgtaatggataaatgtcttcaccgtcattgctatccttgtgttaatcagttagtagaagtgaaactgcgaaacggaactgtgcctacatgtcttgactatgaatgcaagttaaaactaagtcttgaaaactgtttcaaggttttgaaacctaaggtgattgagctatggaaacacatgatgaaagaagagtccattcctttagcaaagagaatctattgcccatatataaactgttcaacattgatgtccaaaaccgagatttctcggtctaataaatccaatgaccgtgcatgtatcaaatgttctggactcgtttgcattgattgtaaagtaccatggcattctgatttatcgtgtgctgagtacaagaaacttcaccctgaccctgtacttgatgacttgacgctaaagcttctagcaaacgatcaaaaatggcgccaatgtgtcaagtgtcgacacttgattgagcttaaccaagggtgcaaccacatgacttgcaggtacatataatacatatttaactcaattaagacataactagagacaaaacgtttatgttttattgtaatgtcgttgtggcctttgtagatgtgggtatcaattttgctacaaatgtggagttgaatggaagaagggtcaagtgacttgtcctactggttgtccacgtactggccaaggttatttttatgatggtgaatgaagatgattgggatgatttgtatgctcatggtggactggtcgtatatgctgaatatccatagttgttatgaaacactcttttctcaattctttgtatcttatgaggtctagagatcaacaaaaatacttttttttttttttaatagtactacttttccgataacattacttttccctatcgtttttgtttaggttttttaattttaatttacttttttgatatatatgaaaaaatattccttaatttgataaaagtttaattttcttttttttgcatagggctctttcttttttaatttctcttagttcccttttaattataaagttaattagtttaatcacacgaacgagctaggagccgcttctgatatataatctataaaacctagaattgtatgtgtcgagtcattaaaccttaggccccctacgaaaaacaaatcttcaagtatgtgcaacagattcatg

SEQ ID NO: 14405 - DNA, 3000 bp, Unknown
  misc_feature (1)..( 3000): cDNA_ID_3016892_gDNA_ID_2684116_Annot_ID_190795 3000 nt of promoter + ATG
gaatcactcgacttagggatcagaaagatcgtgatctattgtgatgacaatgagctttaccaaaacgtaagtgtttactttactttggtataacttttttcgtgaatattttggcacttttatctatatcatatcttgttttgtgacgacggtttcattgtgatgttttggttaaacaaaactgaatctgatttgcaatgcagataacaagtggtaaatgtaaacctaagcagataaaagttgtcaaacaacttataaaagaagttcaacgccttagggagaaatttgcttctagcgaagcaattctggtagccgaaaacgacattaagtttgcctttgaacttgcaagagaagcaattgtttctcaaacaaccagtgccgatgatgatggacatgatggtgacaataatgacgatgaagatgataatccttgggcttacggttgtggttgtgattggtgtttacctgatcctcccactaagcccaattacgatgccgattacattgaattttatagtctttagtctctgtgtttggattaatacatagatttcaaagttgttttgaattttctttctttggattttctatattgttattcgattaatttaagtttcattttgcacattttacaaaaatgtcaacctttttttttttacttttctcctattccacaacatttaattacaggcaatgtttttaaacccgacccggacgatgaaccggactaccttctgggtcaccgggtcatcaggtcaaccgggttggaccataggttaattagttaaaatttatttaataaatttaatattaatagaaattttagagtattttataaaaaacaaaattagtattataaatataaaacaaaaataatcatatcatatttaatcaaatataaaattatattatgtttaacaaaatataaaatcatttacacccaaatatatatatatatatatatatatatagaaaaaatcaaacaataataataaagtggttaaaaatttgaaatccaactaaatgtctaacaccgtaacaaatatattaggagatcatcaatgacagaaataaattaataaaacatcgtgaattcaaacaactaatctcggttgtctctctcaccattcgattcaattttaaggcggtattttaaagtgttcaacaaaatctaaaacatcaaatgaatttaagaactgaaaaaacttttaaaaataattgaataaagtctaaaatcccatattttattgtaaaatcaagagaactttttaaaacccacacccggccggttcaaccggttcaccgggtcacgggttaattgcgagtttttgtgggttttttcggttttgaacttgttgggttttagcactaaacccaaaccggaaaagtgttcgggtcacgggttaaccggtcggaccggacggttcgggttgggcgtgaaaacactgattacagggctatcttctgtgttactggatcatcgggtcaactaggttgaaccacgggtcaactgattaaaatttatttaataaatttaatattaatagagatgatagagtttttagagttcttattaatttaaaataatcatatcatgtttataaaatataaaatcagattatgtttaataaaatataaaatcatttacaccaaaaaaataaaaatatattttatatatatgtaatcaaacaataaaataaagtgattaaatttttaaaatccaactaaatgtctaataccgtaacaaatatagtaggatatcaccaatgacgaaaataaactaataaaacatggtgaattcacataactaatattgcgtgtctcactcaccattcgattcatttattaaggcggcattgtgaagtcttcatcaaaatctaaaacatcaaatgagtttatgaactgaaaaaatttctaaaaatgattgaataaaatctaaaatcccatattttattccaaaataaagaaaatattttaaaacccacaccgaccgattcaaccggttcaccaggttatgggttaatggtgagtttttgtggatttttttggttttaaatttttcgggttttagaactaaacccaaacaaaaaaagtgtttgggtcatggttcaaccggtcggaccggacagtccgagtcgagcgtgaaaacactaatacaagctcattctttagcctgaaactctagctttatgatttatgacatcagatttgtaaacgttttcacttccggtttacatttctaaacctattaaattaatgaatattgttgacagaataatgttatgttgttaacttacaaaaaaaaaagtaaaacaagattaagaaaatcctataaaaattgcttctctctcgaaaagtctagccgctgatctcttgccttgtttgtgtcccatgatgtttactctcatttgatattctatctctaattatagtctctgattcttttgatttgtggagctttgtatttggaaaaaaatcaagaactcatgtcttattgttaatttatccaaaattttaattaaaaacataagtgagacgagagtcctaatgattggtaaaatacgtattgatttattcaagagaaacaaatagttgccaatccccgaaattacttataataaccccatttcacatttggttaggcttaataaaaggtccgtaataatcttattaagaaccccatttcacatttttcatttatatcttatataggatattatgggttttttcacatttatcttagtaattagttttttttccctcactaatttaaatttaattaaataattaaaattcttaaaatattatgttttgttgagatattcgtgagagtatctaaacaagtagatatgctttaagtttccatttctctctcgtttcttgtttcaatagttatccttaacttatcatataagatttgtttaagagagttctacgagtcataaaacctaccttaacactaaataatcttagagtttgcacaaaaagtacgagaagatg

SEQ ID NO: 14406 - DNA, 3000 bp, Unknown
  misc_feature (1)..( 3000): cDNA_ID_3016880_gDNA_ID_2684116_Annot_ID_190798 3000 nt of promoter + ATG
ttaattaatcgtaaacattaaattttcgtaacttacataatttataatgggttttttcttctgaatctttttgcataaattagaacgcaaaataataatttatcgtgttaacattagatttttgacatcaaatatttaatagatttctgtttcatatatattttactttttatcaatgttatatagatattatcaaatttaaatagttttctttgttatttgaaagtttcctatgttaaaagttacttttaaaaatatttgaaaaacaaaaagaggaatgacgatatctcatgtttatgattgtaagtatattatatactagaaaaagtctcacgcgatacgtaagtgaaatgaatatagtgaaatatacgactttcacgtctaaatccgacattgttttgctcgtcaattcatattcgttgggtttaagattcaccgaattgatcgaagaagagaacgactctttctaaaaactcatctatgttcataaaattcaaatcaaatagattaggtttggcgatttaatctgaccaattttatgaggtaaaaaatcaagaaagaagacaatatcatcggagccaatttgagggaagaagagccatcgagctagtaactacaacgacttgtcgtttcagattttatagagattgtgaagtttaacgatgatgttataactggagaaagaaaagaagaagaagaagaaaaaccacgaagcttacaaatatatttatttgtaaaactacaatgtgaattatgttagcatgttggtgaagttgtgtctctagacaatagaggtcatgggtttgagactaaatctctaagtttttaaaattttgatttttcgtaaaatgaagtcgttttgtgttggcgatatacacgtgtcattcatgtcaccacgatttcacagtggattaacggtgtgaaatttttacacgtttctgtaagatttagcacaaaaaaattaactttgggtttgaaattcaaaattttttaaaagtgcatgtatgatttaacacacatataagttaaatctgtgaattcaacatagttcatttgtgcaggtatgaaaaagccgatttttggtaaattaagttataaattactgtttagtacataagcgtttatctagatttgcaaagatcaaaaattttaaaacttgacccaaaataaaccaaatatgaacaaatggagcaatgtttgtatattgaaattctaaactaaatgaaggagacggaaaaagtaatcacacataaaaataaaaggtgaatatattaagaaacaccaacctgaaaagattttatgtatcaaatgaacaatcgcctatatatgtgtcatttggttaagtactcatttttggtgttttgactagaaactaaatactttccaaaattaatatgaattttagcaacttgacaaaataggcatttcgaaaacaatatttgttaacttcaaaacatgatgaagaagtagaggaccattaataattccactctcattattttctcttcttttccaaataatcaacatttccacttaacttctgcttgcttgcttaaattctgatcagcacagctattctctctttcaaacatgccacggtttctgataacgattgcactatgtgctccatctatgcatcaaaggcttggggaatattaaccatgaatctagcccaaccttgaaaatatataactgcttagatatacagcttacaaaaaagagaaagaaaggcaatgagagtccgaggaaaacattaccgggtgttgagcaagaaactggttttctggaacaagggctgactcgtcaaacttttatctctctggatccatcgtaaccttccacgctcttgtcgcttgcttatgccatttaagtccgacccaatgcttttattataattataagatacgtcgttgtttatttgtatttttatttacaaatctgaaaaccaaaaaccaattttctcgttgtgtataccactgctctttatggatttgaccccgaatatattactacacacttcaccgtgccctattgggtaattactcggacaattataacactaactaaataaaacgaaaaattatcatatgtgatctatctcatagaataaaagataaatcgtctttgttcaggtaacttttcattcggtcaatctattgcatatggcataagaaaaatgactgcatctacctcaagggccaccttctgatcgtgtcgcactcgcctcatcgacaagagcatcaagaattggatgacttcactttggtatgagacgttggtttgcaaacaaaaacctctaagttcaataatacttgtttttttattgtttaattagctttaactttctatcatttttaaaatgcaaatttcttttactctctctgttaaaatagatatctaaatgaataatttttacaaaactatatataaaaaaattagtctaaaacaaaaatatcattgacgtcacttcaatatttttttggtcatatcacgtacgtgtattatactcatttcaatgcctaacctcgaaagtaccatatagtcggctcaaggttagctgtcatgactttgatttcttccttcgatgatctggattgatacaataaaataaaatctttctttatctatagggtaatgatttgctattatttgacttataaacaataaagacgactagttgagagttagaagagataagataaatgaaaataaagaagtcgaagtaaaaaaatgtaacatggcagacacaacccgaacagaaccattgacattagcgtttaaattaaacaaagaccaacgacgtgcccactagttgtattagttaagatttgtcaacgttaatattagtttatatatcataatataacaagtggcattgatataagtagagtatatagaggaacaacttcattgatccactattattacacgaaccaaagtgctattacccccaaacattaatttccattctctccacctctgctacctgcatccgtcatg

SEQ ID NO: 14407 - DNA, 3000 bp, Unknown
  misc_feature (1)..( 3000): cDNA_ID_3013477_gDNA_ID_2684116_Annot_ID_190808 3000 nt of promoter + ATG
ccgccaaactcttttattacaatatgacttgttttgaatccccaaaaaacggtttgatttgatatgtttaggatttcgttgctatattggcgatggcttttcaagaataataatattttgaatgattagtggtgttaaaagtcaggaaaaactatttggaaagtgaacgaattttttgttcaaattatctctatgtgtatagtttatgacgatcacaaaacaaaaaaaaaatgaaatcgttactcaaaataaaaatgagtaataatatcatcaatttattttcacatgataaaactaaaattcaattaatatttatgaaacaaaactatcatatgtatatgattatgaatccaagttaatttgtgagctacaatgtttggatagtttgcaaaaaccttaaaattcaagatacgcctctaagctagccaataataggtttaacatcaaattctctaacttcagtgatcaatttttctgtggcccaatgggccttagcccaagaaaactcaaaatgttcaaactggtttctatacagaacagattacgagcttttaaagaagtttccaaatcaacatcaccgcttaagcggaatctgaagtggacaaatgacaaaatatttccttacaaaattttgagggatcattgattaacagatcgtaaattttgatgatattaactcaagaagcgcaagatgcataagaagagaactgagaaatttcactctgttcatatattatgattggaagaaaaatgaatattttgttttaaaaaaagacataactttaaatttataaaaaaaatataaatgattgttaaaaggaaaatgtatatgtttgtatattatcaaaattttataacaaaatgtagctcaaaatataatttggggtatattttgtcatattaagttttgctaaaattaattataatttaatatttttaattgtttatcacaaataaataaaaatacttttactttttagaagacaattcatttacattttcttgggtcaaaattgggttaaaatagagtcaaaatcggattaatttggttaaattttagataagtcaaaccggatgtataattatcggttaattggtcggttcaattggaggcatagttttaagaacaaatccgaaagtatatgtagttttatcgagattaaaattttttatggtgattttttaagtgactaaaaatttatggtgaaaagttgagattccaactattatagggctgaaaattcagacaacccttctatttttgaagaataacaatttttgtttggtcctatctaaatgaaaactcctaattagctaatgctatctcattaattatctatctaacaaaagctattttgagcttaaacccttcttgttttggattctccaacaaacataacctacaaataatacagatatatgcgggactagaatccaaatgataacaaatgacgaaactagtgtaaattattaaaatacaaaatttctatcgtattatatagaaatgtgtgtattcagtaaggtcggtgtagggatttattcaattgacttctttaagagatatggacgttatgacaaccggcttttgtatgtgttccatgcaaattgatttgaaattgacgaataatttacaaagactatgaaaaaggaatcgattcctttgtattgtcgcattatttccctacacgtaacattatagttgtattgtaatttcttttctttgaataagcacctctcatttgtattaatactttaattagacgagatatacaatttcgtagcatttcgttcaagactgagattggctataagtaatttaatccgttggagtattttgaataattaatagtccacttgaagtatcttgcaaaattatgacttttaataacaaaattggttaagcgttacaatgaagtgatgtcatggtcaaaagacatcagcgcaatatcaaaacacaatgccagttgaaactataaatttcgaaaatttaggcataaactgagattgaactacttatgtcaagatcaagatcaaatgaatagtctacacattatatacaatctagtaactccaataatatcttctgaggtaaagcaaaattccataccaaatctcttgtttatatactttagtaaacacatacatatgttttctactttgatcctctcatgtttcttctcttcctgttcatatactgctttgagtttgaaatgtgctccaatggagtgtatatagccttaaacatcttccattaaaaagcatatcaacatcttgaaatattcttccttaagtccatcatttcaaattttgaacttcaccacttacttatttttcttagaaaaaatcaatctatatagtttattcttctagaataccatttaagagagttgtcttgatatttaactcttctagctcaagatatgtagaaaaaatgagcataccaacccaagtgatgaattatatgatttcatcaccataagaaaaaatgttcaaaaacatgaatatgtggattaattcagtaattatacaaatataaaatcttcaaaaatatcactgagctaccgacatggtcactaacatatgtggatctcaaacgttcaaaacctaatcctatcttacgtaactttcaaaacctaattattacgtaaaaacttatcactttaactttatatatatgcagcttagatatcaatatcatgaagatcttttattttagtcaaaacagccttaaaaataataaaatcaaatatttgcgtcacgacaaaaaaataaacaaaattttcttgtttttcttggtaaacatcaataaactaatcaaatgacaataacacactacccaatagcaaaatcagactgtactgacacgtgtcaaagcatgtgcagagatatgtaaacccattatgtcttcatcacctcttctttaacgcctctggctctgcatttctcagtctttttgcacaagaaacaaagctcaggaaaacctcaaaaccctaagctatg

SEQ ID NO: 14408 - DNA, 3000 bp, Unknown
  misc_feature (1)..( 3000): cDNA_ID_3016837_gDNA_ID_2684116_Annot_ID_190812 3000 nt of promoter + ATG
ttgtgttcggacatggtccaactttttgtttcaataccgtacggtgagttctagttatagttaccggtaaatccggttttatcgtcgccgttctttggtattttgcctttatttgtctttatttctaataaacttattaagtttcttcattacgaagaaaaagtggaagtttaagagtttcggcttcataagccttgtcgttcaaattttgtagtagtttcacttgatgggcatggcgacgttaagtctcaccggaaaatctttttggttgcttacgtcattgtgatgcttcatgctactttggaatggtggacgctttccttcatatgaaagaaagtttcgttcgtttgttaaatctgagtttaatttcgtttggaagaggaagactagatgtgcaatttctttagagggtcttcagtgctctacttgaagcttctggttttgcggagtgaacgaactttcggtgggtaggcgttcttcgatctcagaaaacatgccggcagtggttggcattctcgacaaacacgttcttctcgtcacgtgtctgtgatttcctcatgaggcgacacatgtctctgtgttgtatggctttcttatcccttcctcgatgggttactatattgggctcggtttgacttttgttgttggacttttgttttaagaaggctttgttttaagaagaaagagatagcaaaataggcaaaatctctatttgcgcaaattggttttggagttgagaagcggatctttgtggttacttttcgttaggatatctgtgtaagagggccttgcagaagttttggattgattggattgcactcatggctccatcagatcgcgtgttaagtgtaaaggttccccgaatggggattaagtgagagattcagtttctccctttttagtatcttattttcttttgagatttctgtaagatttactctttcaatagttcattgttagtttacaaatttgattcgtcttttaccgaccaacatataccatttcatttccaatgaaagcagacaagataaagcagaacttgcagattatgaaaatgttcaattctgagtagatgaaaattaaaggagattatctatatgtgtttgataatttaatatcgtaatgctcattagcctatcgaattctgtaagtggagttttccactattgtaacactttgttgttatatatcaaagccaacacttatgaagaaaaaaaagtaagctattttcgagttcgaacaagatattaatatttagtttacaaattcctctaaataatcgtatgcgctatataatttatgttccaacattatcgttaaaaatattgattttgttatgaaatttatttaagttagagttctatttatgttaaggaataacgatgcatcgttaaacttcactggattataaccttctaaaactattccaaagtcatctaaaagtgatttcaaatacttaaccttatcaaaacaatgattgtttaaattagttctaaactttaaatcgagtacttcctagatggacaaacgaaaatcattaggtacgggcaaaatcgaaagcttataaagagcttccaaatgcatgtggatgatatttcccttatgaacactcttttgaaaagaatggcctagtcgtttattccattgttcatctgtagaacgtttaaaagcttgaaacttgtggactgttcaaaggttttgaagcaagtctccattgcaacaacttaaaatgagttcttctttgttacataaactaatgatgcatgagtgtgttctatcactttgttactttttcagcttaaaatagtttatcccatattcttttgcttattactttttttagctgtattttattttgaacattgagttactcttagatacaaagatatatatgaaggatagtattcgtgtatgtttatgttttaatttacgagtaaaatattttctgaagtcacatgtttgagttttgttgtgtacagtattcttatttgtaatttgttcttaatccggtacttagatcatcataatttatagaaaaataattattttgatgaaatttcattgtattagacgattagttttataaaacttgtaactaaatttctaaatttttagatttatttccacatgatttctgaaaatatcggatatgtagaagaacaaaaattaaaatataatcattgggttgaaataaaaccaccaccaaattaaatcagtctttaaccgacgccaaccaaaaataatcgaaccggagatagtggcagatccgtaataaactaataatctaagggcatagttaattcttcttattaggcaatcgtggatctagaagcggccaaaatctcagccatccaatctctctcacttgttgtctcttgcaatctcccacttctctcaatcttcttcatcttccacaatctccgatcgaatctctctactcagccgtatgttttcacttctctcgtaattgactctttcatgttgggatttgaatcgccgaatctcaaaaccctaattctggtgtttcgattttagttccggagtagttattgagatcaacgtgtttactgattccgattgtatgtagaaatctcatggagattttggattgtcgtcgatatgtttttttttcgattgtactgtttcgttgacgcgtctcttattgaaccgtcgcgtcccatgcacggattcattatggactttggcttgttagattctcgatttcgatctgaaagtttgatactttggattagtttaagatttgctaactcaattttattggattagtgtataatattagtttctttgatcgggaagatgttcaatttgaactgttattagtaaaactgtcgatctttttattctgtgccactatacacgaatgttgctgaattactaaagtttaggtagttttgtcagtatggtttgcttttgcttgtatgtcttatgatgagacatgattccagtctttttatctctgtcttgttcaggaaaaaaatg

SEQ ID NO: 14409 - DNA, 3000 bp, Unknown
  misc_feature (1)..( 3000): cDNA_ID_3016841_gDNA_ID_2684116_Annot_ID_190811 3000 nt of promoter + ATG
attaaatttggtacatgacaatgggagagattgagagtaattaaatgattaaaatttgatttattcctattaaatagtgtaatttgttttgattatttctgattttatctccggctcttttttgtgttgaatgtatctttaagaatatttgtttttgtgaccgaaaatatcatatatgtaacgaataattcgcaacaattaagtggcaaaattaaaccattttttaattgattagttagatatcccaataactaaactgataaagtaacaatttaggaaaatgattacctcttttgataagagataaatgagaggtaaaaatcattcaaaggcgttactgttgtcactcattgttaatgcttagtttgtctccaaatttgctggcgactaactattctcgtttagacaactcgagaacatagagatgaaaacgtgagtatatacaacagaactcaaacaaaatattactattatatagataccaactaatcttgagtttatattttacagacactttggaaattaaggtgaataaacgttttgcaaggctgtcacattctacgactaaaattagtgattcataagaaatgattggtatccaagtaaggaatattgatcattacattgcaattggaccctcctcgtggatcaagtttaaaccaactaacgatgaccatttcatatctcttttgagttattgtaatataatatatttatttatttcattacaacaatcaatttttattaacaaattatagtttcgaattttagatcagataaaagaaacaaagtgattgaggatccgcatgataaggattaaaaaatgcgacacgtgacgaaaaaagaaaaaatctttgaagaaatcgagaagagagacaaagaaacaaaagtggggatcccagaaggctctgatagatatgagcatgtggtctcagtcaaggccaagactcaaagctgagaccaacccacttctattatagatacatacaatatttgttttatatcttgtcatgtattgatgtatatctaagtagatttatcataattatcgtaccatgctaagtgctaacgaataacgatcgttcatgaatccaaataaaatcacgtcaggtgctgcgacatggcttcttcattcggtttgttactgtttttttttcctctctttttctttctatgatcatcataaatgttgtaaaactatgttaaaaaatcgattcatgtctttttgtgtatgatgaggaagttttaacatttctttaggtatcatatatagtttatctttttgcatactataatatagttaactattttgtgcaaattttataaatcataattttttaaagtttagaatctatattggtattttcgtcctatacgaaaacaagtacaaagaattaattatacactacaaaaaaacgacattaattaattcatatagttgtacaactaatactataatccatcggttcttttttgtttgattttaggaaaaaaacgatattaagaaaacatattaaatgtattattctttgtgatttacaattttcaataattctaaacgaatgatattcaataatttttattaatatttacaatttatcaattataattaacaagtattgcattaataacttaaaaaatcaattttttataaaaacaattattctagaaaatccaaaaaaaaaacatatggagtatatattagaaaaaaatcccatggctgataaataaataattgtatatatatatatatatatctcacgcatacatatataagatatgatatcattactctataagatataaataattttattctatattttgaatagtccattttcatatgcaatttgaaaatttataacattataaaaaagggtaataaaacaagtagtggatcggaccagagattttgaggcgcaatttccaaagcgatctgcatctattcttacctccatcttcaagcaaagcatcaacgcctatagattcccatgcaacgctattttctttataacatataataaaaatatttctgttgctttttattcgtttcactttcctgacattgtttttgtttattcttactttctattcatagaattaatgaatccttatcatatgatccgttataagtctctgctttcgaacttaggaaaattaaattcgcattttttttatcaatgacaataatcataatcactagctaggttaggtataacttataaggtctcgcacttccttgattttaaaataactttgtctttaccaaacaaaaataactgaaccgtaaataccaaaatattttggataacaaaaaatattttttaaaaatatatatttcaaaatattagttatttctaactaaaaatagttgaaaatatatataaacagtaaaaatatttaaaaataacaaaaaatattgaaaaaatgacaaaaatatccaaacataactgaaatatccgaaaatattcaaagcaaataaccgaatgaatactaaattttaaaaccaaaagaaccggagccgaaccaaaatcgaaccaaactttcaaaataatcgaataaatattaaactttagaaccgaaaaaatcgattaccgaatagatacaacctaaactgaatggataacagaacgtcgagaattatttttaatggtcaaatcagttgccaacaattttgaggcattaatactctcaattttgccaaaacaattttgatctatgaatctggaccgactctactctccaacccaattggtattttccatctacttaaaatatgggcttgtacggcccaaattattattttactcatatcgttttaacgtcattaatgattttctgaagaaacgtaaacatttgcactgtatgacgttttagagtgacaaaaacaacagatcaacaaatttcgattaccgtagacgacacgatgtttcacacccgactacgaatcacgacgacttatacaaaacagcaaaagcgtaaagacttgaacttaaaacc

SEQ ID NO: 14410 - DNA, 3000 bp, Unknown
  misc_feature (1)..( 3000): cDNA_ID_3086066_gDNA_ID_2684116_Annot_ID_190815 3000 nt of promoter + ATG
aagaagagaataaaaaaattctgatcgaaaatagcttacttaaaaatcataattgaatagtatcttttgtttttaaactaatttagtctatataataataatattattaaccatcgtaaaccacacatgatattcaatacttataataaattaatcgcataaaatacaatacttaaaacgagtgttatataattttacgtaacgtaaaacaatacaaaattttaattcctgaacgaataaaacgagtatattaattaatttattgatcgtattaaaacgaatatgatccaattaagattacaattactaaaatccccacactattattgtcattatttaactatggcagatagatagatacagaaccgtaaaggacgttaggaagaggaagaacgttgacgaagtcaacaacgaacagaaaccgtcgatttgaggcggctctaatctcaaccacacgatcttctctgcctttccctcttctctcttcttcttcttcttcatcttcttcctcgcaattaccgcgaaaactcatctctgctcaatcctcaatctcagtctctctgttgactccgactgttatataaaaccatacaaataccttcagattcactacttcaaacctcaaagcaaccactgaatctcgactttgatcaattgagagagaaatgaacaccggcggtggccaatacacggattttccggcggtggaaactcacggaggacagttcataagttacgatatcttcggtagtttattcgagatcacatctaagtatcgtcctccgattataccaattggtcgtggagcttatggaatcgtttggtatgtttccttctctgagctttttcttaagttttattctttgagatcggagtttttaatttctggattttgattttgtgaagctctgtgttggatacggagacgaacgagctagtagcgatgaagaagatagctaatgcttttgataatcatatggatgctaagcgtacgcttcgtgagatcaagcttcttcgtcatcttgatcatgaaaacgttagtgtttttgttcgattttgtgaaatatctgtagaaattagtaaataaatcatgattagggttttttgatttggtattgcaacagattatagctataagagatgttgttccaccaccactaagaagacagttcagtgatgtttatatctctactgaattaatggatactgatcttcatcaaatcatcagatctaaccagagtttatcagaagaacactgtcaggtaaactaaaaactgttcttggcttttttctgggatttatatttgatagaagagacatgaaactgatacttgatttggtgtttttgttgtcatggaaacagtacttcttgtaccagctacttcgaggactgaagtatatccactcagctaacattattcatagggatttaaagccgagcaatcttctgttgaacgcgaattgcgatttaaagatttgtgatttcggtcttgctagacctacttcagagaatgattttatgactgagtatgttgttacgagatggtatagagcacctgagcttctgttgaactcttcagattacacagctgctattgatgtttggtctgttggttgtatctttatggagcttatgaatagaaagcctttgttccctggtaaagaccatgttcatcaaatgcgcttattgacagaggtaaaatattttagagagttatgtaattttagcatggtttaaagattctgccttttcacggaatatgtgatgaatttgtttgaatcttgcagttgcttggcacaccgacagaatctgatctcggttttactcacaatgaggatgcgaaaagatacatccggcaacttcccaacttcccacgtcagcccttagctaaacttttctctcatgttaacccaatggccattgatcttgttgacagaatgttgacgtttgaccccaacagaagaatcactggtaagtttcatacatgttctctgttggtttttcttaccatcactatgttttgattaaaaactgaaaataccatcttgtgcagttgaacaagctctgaatcaccagtaccttgctaaattgcacgacccgaatgatgagccaatctgtcaaaagccattctcttttgagttcgaacaacagcctctggatgaggaacagataaaagagatgatctaccaagaagccatagcactcaatccaacatacggttagaagtgcagcagccccgtgaatgcctggtattacccaataaccatccgaatggctacttagtatctttgcctgttcttttattcatgtacttcttccacatatgtaatcttgtaacttttatttgtttgttcatgttatttactgctagtgattaagtgtagctccaatgtaaagtactccagttattaaagaatatctatagacttttttacttcacatactcttgagtcttccctagtaaacaaagagaagagagaatataattttgtaatgtacagagcctcaatatttgtgggagacattatagagctagagccagagtcaatgctgtcgccgtgagttgtctattctcattcaatgactttcaatagattttagtgggattggctttaggtagcttgcattattgaagtagaaatggtcaattccttagcaataattaggcacaaatgtgtctttctttagtaatattgtaatatcctttgtctgacaatttagagttgacttctaaaacgttgggttggaaataatgttgtcttcacacaggctgttacgaagcagacagtgatggctcaacttgcatcaacggaaacctttgagtttttgttttactttcttaatgtttctttatttgaagctgctgcgcatggagaataaaatatcgtggacccgagaaagtcatcattgctgtattattacttatactgtatatatgtttcagaatttcaggccattgttgacaaaaatagtgaaagatttctgcttgattttgagac

SEQ ID NO: 14411 - DNA, 3000 bp, Unknown
  misc_feature (1)..( 3000): cDNA_ID_2990381_gDNA_ID_2684116_Annot_ID_190814 3000 nt of promoter + ATG
acggatctgccactatctccggttcgattatttttggttggcgtcggttaaagactgatttaatttggtggtggttttatttcaacccaatgattatattttaatttttgttcttctacatatccgatattttcagaaatcatgtggaaataaatctaaaaatttagaaatttagttacaagttttataaaactaatcgtctaatacaatgaaatttcatcaaaataattatttttctataaattatgatgatctaagtaccggattaagaacaaattacaaataagaatactgtacacaacaaaactcaaacatgtgacttcagaaaatattttactcgtaaattaaaacataaacatacacgaatactatccttcatatatatctttgtatctaagagtaactcaatgttcaaaataaaatacagctaaaaaaagtaataagcaaaagaatatgggataaactattttaagctgaaaaagtaacaaagtgatagaacacactcatgcatcattagtttatgtaacaaagaagaactcattttaagttgttgcaatggagacttgcttcaaaacctttgaacagtccacaagtttcaagcttttaaacgttctacagatgaacaatggaataaacgactaggccattcttttcaaaagagtgttcataagggaaatatcatccacatgcatttggaagctctttataagctttcgattttgcccgtacctaatgattttcgtttgtccatctaggaagtactcgatttaaagtttagaactaatttaaacaatcattgttttgataaggttaagtatttgaaatcacttttagatgactttggaatagttttagaaggttataatccagtgaagtttaacgatgcatcgttattccttaacataaatagaactctaacttaaataaatttcataacaaaatcaatatttttaacgataatgttggaacataaattatatagcgcatacgattatttagaggaatttgtaaactaaatattaatatcttgttcgaactcgaaaatagcttacttttttttcttcataagtgttggctttgatatataacaacaaagtgttacaatagtggaaaactccacttacagaattcgataggctaatgagcattacgatattaaattatcaaacacatatagataatctcctttaattttcatctactcagaattgaacattttcataatctgcaagttctgctttatcttgtctgctttcattggaaatgaaatggtatatgttggtcggtaaaagacgaatcaaatttgtaaactaacaatgaactattgaaagagtaaatcttacagaaatctcaaaagaaaataagatactaaaaagggagaaactgaatctctcacttaatccccattcggggaacctttacacttaacacgcgatctgatggagccatgagtgcaatccaatcaatccaaaacttctgcaaggccctcttacacagatatcctaacgaaaagtaaccacaaagatccgcttctcaactccaaaaccaatttgcgcaaatagagattttgcctattttgctatctctttcttcttaaaacaaagccttcttaaaacaaaagtccaacaacaaaagtcaaaccgagcccaatatagtaacccatcgaggaagggataagaaagccatacaacacagagacatgtgtcgcctcatgaggaaatcacagacacgtgacgagaagaacgtgtttgtcgagaatgccaaccactgccggcatgttttctgagatcgaagaacgcctacccaccgaaagttcgttcactccgcaaaaccagaagcttcaagtagagcactgaagaccctctaaagaaattgcacatctagtcttcctcttccaaacgaaattaaactcagatttaacaaacgaacgaaactttctttcatatgaaggaaagcgtccaccattccaaagtagcatgaagcatcacaatgacgtaagcaaccaaaaagattttccggtgagacttaacgtcgccatgcccatcaagtgaaactactacaaaatttgaacgacaaggcttatgaagccgaaactcttaaacttccactttttcttcgtaatgaagaaacttaataagtttattagaaataaagacaaataaaggcaaaataccaaagaacggcgacgataaaaccggatttaccggtaactataactagaactcaccgtacggtattgaaacaaaaagttggaccatgtccgaacacaacctcacaaacatacgggaaggcatacgaaacaaagaattttttctttttctcaaaattttagagaaagaagagaataaaaaaattctgatcgaaaatagcttacttaaaaatcataattgaatagtatcttttgtttttaaactaatttagtctatataataataatattattaaccatcgtaaaccacacatgatattcaatacttataataaattaatcgcataaaatacaatacttaaaacgagtgttatataattttacgtaacgtaaaacaatacaaaattttaattcctgaacgaataaaacgagtatattaattaatttattgatcgtattaaaacgaatatgatccaattaagattacaattactaaaatccccacactattattgtcattatttaactatggcagatagatagatacagaaccgtaaaggacgttaggaagaggaagaacgttgacgaagtcaacaacgaacagaaaccgtcgatttgaggcggctctaatctcaaccacacgatcttctctgcctttccctcttctctcttcttcttcttcttcatcttcttcctcgcaattaccgcgaaaactcatctctgctcaatcctcaatctcagtctctctgttgactccgactgttatataaaaccatacaaataccttcagattcactacttcaaacctcaaagcaaccactgaatctcgactttgatcaattgagagagaa

SEQ ID NO: 14412 - DNA, 3000 bp, Unknown
  misc_feature (1)..( 3000): cDNA_ID_2991095_gDNA_ID_2684116_Annot_ID_190813 3000 nt of promoter + ATG
tctgctgatatcgctgtttctgcatcgccagtaactgaactagccatgtctcaaaatcaagcagaaatctttcactatttttgtcaacaatggcctgaaattctgaaacatatatacagtataagtaataatacagcaatgatgactttctcgggtccacgatattttattctccatgcgcagcagcttcaaataaagaaacattaagaaagtaaaacaaaaactcaaaggtttccgttgatgcaagttgagccatcactgtctgcttcgtaacagcctgtgtgaagacaacattatttccaacccaacgttttagaagtcaactctaaattgtcagacaaaggatattacaatattactaaagaaagacacatttgtgcctaattattgctaaggaattgaccatttctacttcaataatgcaagctacctaaagccaatcccactaaaatctattgaaagtcattgaatgagaatagacaactcacggcgacagcattgactctggctctagctctataatgtctcccacaaatattgaggctctgtacattacaaaattatattctctcttctctttgtttactagggaagactcaagagtatgtgaagtaaaaaagtctatagatattctttaataactggagtactttacattggagctacacttaatcactagcagtaaataacatgaacaaacaaataaaagttacaagattacatatgtggaagaagtacatgaataaaagaacaggcaaagatactaagtagccattcggatggttattgggtaataccaggcattcacggggctgctgcacttctaaccgtatgttggattgagtgctatggcttcttggtagatcatctcttttatctgttcctcatccagaggctgttgttcgaactcaaaagagaatggcttttgacagattggctcatcattcgggtcgtgcaatttagcaaggtactggtgattcagagcttgttcaactgcacaagatggtattttcagtttttaatcaaaacatagtgatggtaagaaaaaccaacagagaacatgtatgaaacttaccagtgattcttctgttggggtcaaacgtcaacattctgtcaacaagatcaatggccattgggttaacatgagagaaaagtttagctaagggctgacgtgggaagttgggaagttgccggatgtatcttttcgcatcctcattgtgagtaaaaccgagatcagattctgtcggtgtgccaagcaactgcaagattcaaacaaattcatcacatattccgtgaaaaggcagaatctttaaaccatgctaaaattacataactctctaaaatattttacctctgtcaataagcgcatttgatgaacatggtctttaccagggaacaaaggctttctattcataagctccataaagatacaaccaacagaccaaacatcaatagcagctgtgtaatctgaagagttcaacagaagctcaggtgctctataccatctcgtaacaacatactcagtcataaaatcattctctgaagtaggtctagcaagaccgaaatcacaaatctttaaatcgcaattcgcgttcaacagaagattgctcggctttaaatccctatgaataatgttagctgagtggatatacttcagtcctcgaagtagctggtacaagaagtactgtttccatgacaacaaaaacaccaaatcaagtatcagtttcatgtctcttctatcaaatataaatcccagaaaaaagccaagaacagtttttagtttacctgacagtgttcttctgataaactctggttagatctgatgatttgatgaagatcagtatccattaattcagtagagatataaacatcactgaactgtcttcttagtggtggtggaacaacatctcttatagctataatctgttgcaataccaaatcaaaaaaccctaatcatgatttatttactaatttctacagatatttcacaaaatcgaacaaaaacactaacgttttcatgatcaagatgacgaagaagcttgatctcacgaagcgtacgcttagcatccatatgattatcaaaagcattagctatcttcttcatcgctactagctcgttcgtctccgtatccaacacagagcttcacaaaatcaaaatccagaaattaaaaactccgatctcaaagaataaaacttaagaaaaagctcagagaaggaaacataccaaacgattccataagctccacgaccaattggtataatcggaggacgatacttagatgtgatctcgaataaactaccgaagatatcgtaacttatgaactgtcctccgtgagtttccaccgccggaaaatccgtgtattggccaccgccggtgttcatttctctctcaattgatcaaagtcgagattcagtggttgctttgaggtttgaagtagtgaatctgaaggtatttgtatggttttatataacagtcggagtcaacagagagactgagattgaggattgagcagagatgagttttcgcggtaattgcgaggaagaagatgaagaagaagaagaagagagaagagggaaaggcagagaagatcgtgtggttgagattagagccgcctcaaatcgacggtttctgttcgttgttgacttcgtcaacgttcttcctcttcctaacgtcctttacggttctgtatctatctatctgccatagttaaataatgacaataatagtgtggggattttagtaattgtaatcttaattggatcatattcgttttaatacgatcaataaattaattaatatactcgttttattcgttcaggaattaaaattttgtattgttttacgttacgtaaaattatataacactcgttttaagtattgtattttatgcgattaatttattataagtattgaatatcatgtgtggtttacgatggttaataatattattattatatagactaaattagtttaaaaacaaaagatactattcaattatg

SEQ ID NO: 14413 - DNA, 3000 bp, Unknown
  misc_feature (1)..( 3000): cDNA_ID_3016872_gDNA_ID_2684116_Annot_ID_190800 3000 nt of promoter + ATG
agagaaattactagatttgttttccctctctaaacaaatctattgtgtgaatccttggttcaacactgagcagatgttaactgttgatttttgccgtcatcaatcctgtgtggagtgcgtgaaacgatatatagaagtaaagctagttgagggaggtgtactaagttgtcctcattatcaattctttctttggtgtagaaatggaggtttttttttttggtgcattttcaaaaatgcatttttcaagaataactccttatgttgtctattttttaaaatacctcttttatgtgctaaacgtcgaaactacttttcttttgttgaatgaatataatgagaaaatcaaatattcttgccaaagtaatttttggtgcaaaaaaaaggtttctcgctaaaaataatttggtactcatattttcctttttaattttttttcatgccaaaaaattaagaaacccttataatctttttaaattcttataaattcttttaaaacttttgtaaatctttttaaaacacttataaaatccctataaatgttttaaaaaccctgtaaaagcttttaaaatctttttaaaacccttatcaatatttttaaacttttgcaaatcgtttaaaacattcataaatcttttaaaaccgttttaagacaaacatttcgcaatgacaaaattaatttacaaagattccagcaattccttaaactctttttaaaaaaccttttaaaaaattctagtaaactctttaaaaccccttataaacccttctaaatctttttaaaacacttttgtaattcatttaataatatttgtaaatccttttaaaacacttctaaatcctttaaaaccattttaaaactgttgtaaatcttttaacactcttataaaccatttaaaaacactttaaatcctttaaaaaatcattgaaaacccttgtaaatctttttaaaacgattttataatcattataaatcctttaaaacccctgtaaatcctttaaaaacactcttaaatccttttaaaaaccttgtaaactctaaaagtttctaagataaagtttcccaccaaaaattatgggatcaattatttttgttgggaaaatgtttcagatattttgctgggaaaattcaaatgtttatttgtttacttaattatttattaaataggggtaaaatgcccattaaaaattaaaggaggaaaatgaaaatgatatcgaagtgaggggttattttttaaaaaagaaggtatcaatgaaaggacatttctaacaatttctcttttttttcctctctatatattttttctttctttttaatttaatcatttttatctttccacttttttggtatgattcatattgatttattctaggaatctctttttctttatatagttttgaactaattcattttgcaatctcttttagtttaaaatctgttttctttatccacatatttgttttttttttgtcaaccacacattaattaaaaaataactccatgattagttgcccaattaggaggagaagtgtttacaaaagatccacatattatttaaataatgaaattttgctattttatttagagaatctagaataaatttttaaagttaatacttgaaatgattaattatttatataaagaagaatatatctttactatactattaacactctacaaggaatactttttatgataatttaatttagagatttatacatttatttaaatacattaagaattaactaaaactaggaatatataaaatgagatctgtaatacatcatttcaaaaggtgatttatctagttaaagtcttaactcttaacttctctataggatgtaggatgtatttattactttcatactaactacactcacgcacaaccgaattttatatgtttatatatcagtttttcgacctaattaataatctaaacatgtgtttggctcggatcatcatctaaactcaaaattaagttaaatttgcaatggaaacaatagattgtgaaatcagcttacttgtggatcctgagacttgcagtatatgtttcaatgatgatttcaaatctgagcaaatgtattatgttgctttatgcaatcataaattctgtttggaatgcatgaaacgatatatagaagtgaggcttctagagggaactgtactgatatgtccttattatcaatgtgagtctaagctgactcttaaaagttgttttcatattttgacatctaaactaaaagcgatgtgggaacaaaagattgaagaggaatccattccagtaacggagagattttattgcccgaacccgaggtgctcggctttaatgtcgaaaatcgagctctctaaatctaccttagaagatggatttgtgagatgcttccaatgcggggagcgcttttgcattaactgcaaagtttcatggcaaagtaacttgtcatgtgacaattgcaagaaattgggtaataatcctacatcagatgataagatgctaaaagttcttgcaaatgagaaaaagtggcgccaatgtgaaaagtgccaacatatgatcaaactttcggaaggatgcatccatgtaacttgcatgtatctctcaaatcattttcttaattataatccattcaaattttgatgattaaagtttgtttgcctaattaacattatattcatgttttgatggatagatgtggctatttgttttgctacacatgtggagccgaatggaagcaaggaggttgcccacatcgacaaaggatgcttgaggagtgttgtattggtactcttatcttggttcttcttgtctctttaatagttctttatttttattaatttctaaaaaataataaattaatcggatttctagattattcatgacgataatgaaaactaaacaatataattataagaacaaaaaacataagaggtttcatgcttgcgtaaaaaccagaatttcccaaaacagaataaattcaatcgcagatgatcaaggacatatgtacatg

SEQ ID NO: 14414 - DNA, 3000 bp, Unknown
  misc_feature (1)..( 3000): cDNA_ID_2991762_gDNA_ID_2684117_Annot_ID_190824 3000 nt of promoter + ATG
gtaatcccatcatttcgacgatcaaaaacgccctgccatattggattgatatcattgattgtgaagtggatgatgtctatctttggaagctcgagcatcatccacccacaccattgttctcctctactctaacttggctcgctttgcacccatctacctgtccggttctgtggcataaatctatatggtttaaggactatattccaaatcatgcgttcatcaattgggttgtggcttggaacagggcttcacactagggaccgaatgcggagttggggaatttctattcccacggattgtgtcctttgctctggaagttcggagtctagagatcacctcttctttgagtgtgactttagtctggcggtctggagtcacttcaggaatagaacaagattatctcctccggtccccttcatggcctgcctcttatggattaattcggcttcgtgtgatgcttatctctgtctcatcatcaagctagtgttccaagcctctatttatctcttatggaaagaacgcaatcgtcagatccattctcatgctccccgtacctctgctttgatcatcgaggaacttaaggttattctatggtcaaagcttgatcccatttctcggcgtagtgaatttgattctccaggatcctctctgctctctacttggtttcgtttcttcagctaagggcagttccttcgttctctgttcttctttttgggctgtttgggtcttgttgggccattcaagtttagtttcgggcctgcgtgacttggatttgggcttcttgccgtgtatatttttcgggcttgcgtgcctttttttggactctttgttttgtaacttgcttttatctttaatggaaatttaaacctaaaaaaaaagaaaagattgggtgggcaaatgcatgttacctactgatgttaccgagtatctcaagtactaacaacagctctatgtttctcaaaaggaaagtctcaaagcgacgacgtattattttcacgcacgttttaaattcttgatgcctttttttgttttattcttttttcttaagttacacatttaaacaaacaaaaaagaacaaaatgagaaagaaatagattgttttcgagctttctctctcttctctctctaaaaaatcttagagaaaagggaaagttttctcttttgtttcgctggcctgatggcattccgacgtttatgtgttttaatatagttgggttttatatctaacatctctgtcgtttttagcagtgatggctggctcttgcctgacagcgttcgaattccatgaccatcgttggccggatctacttttcttatcagtgtatctgatgtttttttttttttttttctttcaataatctcatagatcctctattggaaatttaggtgtttttttgcttaaaggtgtttattatccaatttgatcttttgagtttgcgatttgcaggaatcaatccaaagagttacatcttaagttgcagaaaagaaaacaatttcattgcacactaatattgcttttagctgtaaatctctattttgatgttcgattggtttatgaacaatgaaacctagaagaatcaagcttgcttttataatcaatgatgatttttctcactggaatcgatctcagatggcgaatgatctacaattgaggctatttgtctaattgatctatggacacgagtgttttcctttttgtttttaggtgttgctgaaaagctccatcggcttaatatctacgttgatgttctttggagttcgggagtcattgcccttgtgaagatcttttctttacagatttgatgatgtagttggtaggattctctagttaaaaacctgtggacttatttcttgaagctctgacggttttcggtagttttggagttcccttacgcttcgtaccatatcggctatgagcggcgaacggcgacaacatctacttcaactttacttcataggctcacacatggttttgtgttggatttgttatatttcttagttccttaaaggggtatctttatggattggactttttaagttgggtctccgcttataagctgaattgttggtgaagtggaagcttccactgttgtaccttttacgacatagagttttaaatagaagagaaaattcccaaaaaaaacttcaactattaaaatttgccaaaaaaacctcaactttttcggttgtcaaaaaactcaaactaatttattagtgacaaataaaacccaaactagaaatattggcagattatacatacgctctaaaaacaaattatagttttatccttaaaaaattaattcttttttttttgaaacgaaaagaaatttcttatttactttgtatttttttagtttatacgtttttgcctttttggaaattatcatagaaaaatgatatgagtgtctcatttttaattctcttttcatatatttttactttttagattttcaaactttaaaaaccaaatcgtttctctatttcttttttttttgcttatttctttctaatttttggttcctcaatatcaaaatgattcaatgttcttcgactaatttacatattttgattttttcatcataattatatagttagctttgtgttaatatatcttatttaatttattttagcaatacgataacggcggtatgcatgtactaaaaaggatgcgtaaagagtattaagtttttcacatcgaacaaaattgtccactattttatttttttaaatagttgtctatattacaagaacaaatgaaaataaataggtattattagataagtagtttttttttttggtaaggcattattacttattagataagtagttagatatataaaataatcaaatagttgaggtttttttggaatatttctgagaaaaacaaaaagaaaacaaaattgattgaataatgaatacaccgaataacgaacgttgcgtagagaagagaaccaattcccaatcaaacggagaagacagatattattcacagagaggctc

SEQ ID NO: 14415 - DNA, 3000 bp, Unknown
  misc_feature (1)..( 3000): cDNA_ID_3016996_gDNA_ID_2684117_Annot_ID_190826 3000 nt of promoter + ATG
cacaagagtactcaaaaatgaccatgaaagacttagtgtccttataagcaaatcacgaccaagaaacatacagagaaatcatcaaatactaaccggagagattagtagggacctcagatcaaaattttcaggtctggttaggcatgtgattattaccagaaccaaaattttcaaaccaagccaatccagtttttggtcatttcaatttagggtcggtcactaaaagtgaacaggtcggcataattttttagtacatatatttaacatgtgcccaagttatgacaaacgatgaaacataacatatttattataaatgatttatacatcataactcataaaaacatcaaaattatgaaatattttggtagcgctaccataaccactcaatcatccgactgaaatcatcaaaataaaaaaatattttctaactttttttatatttacataaatatatctacaaaatgatcccgtataaacttgtaataaattatatatgtgcatttttcaagaccaaatctctaagatcaaagactaatgctaccacatcattcaacgaaacaatgcaaataaattttgggataactttaactttgatcatcttttaaagtatttaaggattttacatacaaatttgtaatttaaagggttcacaaacggcaacaaaaaacaaaaaaaggtttactaacgaatttgtaattttaagaagatcaaaatataagaaatataaataatatcataaattttaaagggttataatgcaaatgttgaactttaggaaaccagctgacctcctttaatcgtctttggatgtctatgcggcggacccataaatactttttatgggtccatcaaatataatttaaaaataataagtaattaaaaacaaccaaaaactaaaaaaaaaaaaactcatctctttaagtttacatatgaatttgtaattttaaaaaggaaaaaacaaaataattttaaaggtctacaatacaaatatagaattttagaggggtcgtctgaccccttttaatctttttgggtctgtcgcgtgggcagacccataaatactttatatcagatcaaaatataacttaaaataattagtaatttaaaaaaaaaaactaacaagttttaaaaaatattattagtttaaaatataccgcaaattaggttcaatatttatgggtgaatcacattaaaaggctaaaagtatcaaaacacaaagtagaagaaaatatataataaaacttaaaaggtttacatcaaatttgtaattttaaaagggtcaaaacatatgaaatataaataatatcataaattttaaagggctataacacaaatgtagatttttagttgggtcagctggccttctttaatctttgctctttggatctgcctatgcggcggacccataaatactttttactaggtcaaaatataatttaaataattaatagtttaaaaagattaaaaaactaaaaaaaatattcatttgcttattatataccatagagaatgattcccaattttttttttgtcggcaatgattcccaattttaaatacagagaatgatataatcataatttatttatttaaatattcatacattgacaataactgagtacatccatgattctttatttttgaatcataatgtcctttcttcgattattattcgcttacaaacaacactcttataaaatattttcatagaggaattaagcacgatcattgctcggaaagttttgtatactagtttcatcactaccgatatatagataattcaagataaataacattcatatttaggggtgtcaaagtgggtcaagatttatggatcaactcaactcaacgcaacttttgaaccctaatgagttgaaatttttgactcaaatgagttgatgggtcaaatgagttattgggtcaattggtttgatgaataaaatgagttgggttgtaatgattaatggtttcaatggtttacccaattaacccattaacccataactcatttaaccctaaactcatttgattatgagttgagttgagttgggtaacccattttgacaccccatataaccaaaagaataaaaaaaaaagataagttggagagtagacagtttttgctaaaataatttgaaaagtagacatttttttttagagataggaggcatatgtagttttatctctcctctctaatagaactccctctcaaatacaacttttagtaaagtactattttacccttctgttgttttgatgaaataaaatggacctcattaaaagcagcccaatatcatcttcaatttcgaattgttcatgggcttgacatcaactaaaccccatattttcttaagtcattagaaccaaacacactcataaaccctcgtcgtcgacatcttcatctgtacggtaaagacctcgtcgttgtcaaaaaaggataaaccctcgtcgttgccaaaatcatagagacattgtcaatttcataccagatggaaggtatgtttatcataaaacgctttaaagtttttgaatttttgctgtcagccaactaataactttgactctgttttcgttttttttcaggggacgaatcatgcgtctccatggtcggccgctggatttgctactcgaatggttggtgggacttcaaaattgataaaactaggccaggaaaggggaaaatgcttaattatttcctaaaatatccaaaatgcgcagattaattccccaattacctcagacgcataataaactcccaattatactttgacgtagcaaagttagacttcattattgtcaacgttaaatattaaacatgtcgttaaatatgtcgattctcatcttcttcttctccaaatcaaaaaccctaaattcctaaagctttatctttaaactcgaaacaatcaactgtaaatctactttccaaacttatcttccctaaatcaaacatcaaaacctaatccgattggcaaaacgaaagttttaattttgcaaactgaacc

SEQ ID NO: 14416 - DNA, 3000 bp, Unknown
  misc_feature (1)..( 3000): cDNA_ID_3016984_gDNA_ID_2684117_Annot_ID_190829 3000 nt of promoter + ATG
tctaatgcctcggaaacttttaatccttccgggattttcgtatatatatcattatcaagagatccatataaataagtcgtcactacattcataaggtacatatctaaaatattagaagccgaaaggctcattaagtatctgaatataattgcatccatgaccggagaaaatgtttcttcataatcaactcctggtctttgagagaaaccttttgcaacaagtcgggctttatatcgtgtgatctcatctttctcatttcatttcttcacgaatacccacttgtgcccaacaagttttatattctcagatgcagtaacaataggtccaaagacatttcttttatttaaggagtgtaactcaacttgcatggcatttttccatttctcccaatccagcatttttctggcactcggataatgtctttggatccggatcatcattctcatgatcgatctgtttagagaaagaaaaggagaatattccattttcatcatcaatatcatctctatcccatatgataccatcatgggtatagttaatggaaatctcataattttctctatcgtcccgagaaaatggttcttgttgaagaaccttttcatttttttctctcattttctttttctttcggggatttttatcttttgagccaataggcctcccacgctttaattgaaccttagattcattaattttgctccaatctaattccagcttactaggaattttaactcttgatatgacatttgcagcggggatatatgactttgtcacctttcttgtataggtgaacgaatctggtaattgatttgttattttttgtaaatgtactttcagctcacgttgcttcgtggggagggggggctaaagctgggaattcatcttcattaaaatggcaatcggcaaaacgtgccgtaaacaactcaccagtttgtggttcaagataccttattatacccagtgatacataaccgacatatactctcaatctcttttggggccccatttttgttctttgtggcggtgctataggcatatataccgcacatcaaaaactacggagatgggataaatttggtacttgacaataagtcatttgtaaaggagaatattcattatctgcgcttggtataatctgaaccaaatctgcaacagacaatatagcatgaccccatataaaaattggaagttttgttctcaatattaacagtcttgcaatgagttgcaaccgtttaattaatgattcggccatgccatttgtgtatgaatatgagggagcgaatgctttacatcgattctcaacgatacacaataatcattaaagacttgcaaagtaaattccccagcattatcaagtctgactttatttatgccataatcaggaaattgtgtctttaacctgattattagggcaatgaatcttgcgaaagccgtgtttcgtgtagtcaaaagacatacatgtgaccatctattagatgcgtcaattaataccataaaatgtcgaaacggcccgcatggtgggtagattggtccacatatatcaccatgaattctcaacaagaattcaggtctttttttcccaattttagttggcgatggccttattatgagttttcattgagaacatgctttacatgaaactcaccagatttaaatattttatggtttttcaatgaatggccattaaaattttgcacaatttttcgcatcatgacttaaatgtactagtaaactcactcgagggattatcactcgagtttactgtaacattcgatgcgattatatttatttttgtgcaatataattgatgtaagaatgggagctgacgtaccggctgatgcacttgttgacagattgcttgttagacttcttgatggactttctgacggactacctgaagtacttcttgtatcaaaccagcttgtgcgaactaaggaaagctatcctttccttcccttttgtgcgtcccagagccacatatggaagcctggagatcctctacgccaccaagaaccattcacacttaatccttggtgcatctttccttatgtgaacccgctgagccaagactttccttttttggagctaaatgagatcaaatcacaacgactctattttgatcatcttttgggaattaagaagcctcctacaatgactctagacgtcccaaaatcacatcacttccagcccaagttgtcaagactcaagacacatcacaactttccttatttggccgatttcatcattaaagttccaacggccatattttcatttattgttgcgatttctttacttttttagagcatatgaatgttgtataagcctctatacaagctcaccttagttttcatttgtattcaagccttttacgaaataaacaagtatttttttcaaagtgtgtctttgagttttatgcattagaagttagtgtggattcactaaagtcttgtgtgtttgcggatcaattatcttgtggcttcaagttaatttgttcgtggtttgattgtggattcaatcaagcacgttgagtgtggattcattcaataaaacctccatctttcatctctaccatcattcatcgaatcattcaagctttaggtcgagaaatagagaagcgtaaaccctatgtagattccgaggtttgcatcattggtatcagagctaaaagctcctatcccacaaggtgaactcgttcccttttatccctttcaatttctgtttttgttattttcaaatttaaatcgaaaaaccaaaataaaacttgtttcttgcaatttgttttgttttgattccgcaaccttaatagaaaaacaaaataaaatttttccttgtttagtttgttatttgtttcatttttgctattttcgttaaaataaataaatcaaatgttgttatttttgacttatttgttgacttacttcctgagttaagttatgattcattgtcttctttgttttactctcttttacgaggtaccacaaataaaatttgagaacgatg

SEQ ID NO: 14417 - DNA, 3000 bp, Unknown
  misc_feature (1)..( 3000): cDNA_ID_3016953_gDNA_ID_2684117_Annot_ID_190839 3000 nt of promoter + ATG
gtgggttttcaatcattggctcgtagcgtttcaacgttgtaaggagaattgttgagtccttgggtcaagtgattgaaatagatttctaggatacaatcactaatcatattaggttcatcagagttcgagttaagtttggcatcactaatagtcttaggttcttcagaagactcaggtttcaatatggtgaaagagcaatggtgagttttcaatatgagcggttgagaagaatttgtagccactacctcagattcactcatcatagtagttattgtccttactttcatactccacgaaactgtcttgaagctcctgatatgtctgtcaatggtagaaatgaagatgtggatcagatgaatagaggcagatctgaagtttttacagtcactggtctttgatcgttttcaagaagaagacatctcggatcctttagtgggttttactaactttgagaatggtgaatcctccaaagggaagagttcaagttcctcatactgacaacttcccccaacgaaaagataaatctctttagtagagatgatgatttcactcaacaaaatttttgtcacactttttggtccctacaatctacattgcagtaggaagtttcagtttactagctctttaactttgaaaacagtttgatgggtgatgtgtataacataattggtgatgggaaaacagtttgctgactggtattttggacgaagaccatacgcaagtgcttaagtgtgatttttttgtattactaaggtttaatctccttgtaaaattgatgtaagtattttgataagcttgtggtttctgcaactattgtaacatgaagttaaatgtaattttttttacaacaaaacttatatagaagcccaaatactataccaaagaagaaggtaaacttcaaggacgtgtcttacgataaagatgagtcaatggacatgtgttgttccaacaaccttcgccgcataagagctcaattcaggtgaattgatagtcgacgggataccaatcctaacaacaaagtttgtttgctcaccggtgatgactaaaacgggtgaaaaggacattcaattgaattgaagtgtccatgaccgtttacctagcatattgaagctctcaatacaaaggaatagcaacaaaaagagattaagatcaacataggaaaagaagctataatcattactcaaaggtataatcacaaccatgaaccgtttgagtgacatagccgcagattcaacagatcaaggcatagaaaaaagtgcagcagaagcataaatattaaaaagacaaaaagaaacggcaaaagagccgataacaaacaattgaagagagctgataacgaagccgacaatcgctgttgtgtaaaaagaacgatgccggatgagagctaacgaagcacaactttgggtggatattagatagtagccggatttgacataacccggacgacaaagttgaaatacatcgacgagatcttaacagaaagaaaagagtttctctttctaaaaaatttgagagagataagagagagactctcactttcctataagttgaatgtaataaaatgggaaattagcaaaactaacaaaaaaaaactatatatttaagaaactatatttaagaaagtaacaaaaaaaaaagatgatatcctatatattttgtgaattaatcctaattttgccttgtgtgatttacactctctttctccctctccctctgtctctctctccctccctttgtctctctctccctctctctttccctctctttttcgtgcgtcactgtaactcgagtcttttatctttttcctaccaacttatattactcactagtagttgggtacccatttatttgtgtgaaatcccatttaataaatggatttagttgggctaacctatttaacctcatttaacttttttaaaaaaattagtttaaatggatcaatttctcttagacatactcgttaattaaacatactcattaattatatgaagtttgcatacccatattaacattattactcactacattggacaatgatctcaaaagctctctactctccaaaaatgagtctaaatactctcatataatctgacatactcttatactcttaatgaattttaaaaatccttgtctacccttacccaacgaaccggaaccggacgaaccaaaccaaccaattacggtttagtctccaaaccaataccatttaattcataaaataaaattaacctatcagaaattcccaaatcttcttttcctccctcacaaaatcaaaattgacgactgcagccatcatcgaatcctccgacgtggaatccaatcgaccaagctcgccgtcgttttgcttctgttattcaaagtgacctttaccattttttcttatactttggacatcttaattcatcaagtcttgtgttgttgtgtttgtactttgtagatttcaattagatttgatagatttgaaattggtgttggaaattaatggacattatgttggtaactatatattttgggtctattaagacattttaatgtactgtaatggttgattcgtagttaatcttaggcagattaatgtttttggtccgaaaatctttgctagaacagaataatctaggtataactaagaaacgtggtatagctgtttgaagtactatttatagtataactggtatttctgaaaatgagcgtggtatagctgtttgaattactatttatggtataactggtatttctgaaaatgagtgtggtatacctgtttgaagtactatttatggtataactggtatttctgaaaatgagcgtggtatagctgttcgaagtacaatttgctagaacaggaaaatctaggtatagctaacgtttttttttgttttttccaggagaatgggcataatcatatattttgattatgatggatattattcaaaaaccggagaagcatatcaatggaatccaaaagtagttggtttgtatggtatgttgtttaggacatcatca

SEQ ID NO: 14418 - DNA, 3000 bp, Unknown
  misc_feature (1)..( 3000): cDNA_ID_3016968_gDNA_ID_2684117_Annot_ID_190834 3000 nt of promoter + ATG
gttcttaattgactaaacccaataagcttgaagaacgaaataaaccctttaagaaaaggaggagcaaagaactacccacccagatctaaggatctaatcaaagcaatcaagcacaagaaaactgaaactaaatagaaacaaaggaacgaaaaatgaaaaaacaaatccagataaaagccgatacctaagccatccgaatcgagagcgaattgatggaaatagagctatttgacattgctaagagagtcaacgacactagacgaaagccgaccaacaccactaaaaaactgatcgttgccgaaaccaaatcggaacatcggacaagactttctctctctcaaagattaagagagaaaagagagagaaagtcttttcaatcttttctatatttttacgtgaatcaaaaaattaaatatattttttttgtctcactctttaaatttggtactttggttccacgagtttgaagattttcgggaataatttgagtttttagattctgaccacagagctaaatccataaagtcctttagaacgttttggtgctagttttcttatggttcagacaaaacaaagtagcaaagctgctttatacaccgtgaaacacacacataaagaaagaaaaaggtcagagacaagacacttttgtaacagactcgagagtgtttgctactgcttagtggaggctgcgcatgataccgtgtatgtatcctccggtcataatgaaagacatgatcgacacaactccagcaggaaatatcttcttcgaacgcatgtatcgggttcccattacgtacattaacgcacccgccatcacttttttaacaacacaaaacaatgcagatgtttagacgccacatcatcagacttacaaaaataaaagctagtatcaccgccgttcaggaatccagcttttgaaactagtaaattggacacaactactctgttattaacaattgtttttccttacctacaccaacggttgatgcaagaacaggttttgttgggagctgactgaagacatacagcagaacagcagctgacagtccacctgcaagcaacgatttctggctaccgctcttcagataacccatcagcccaccaactacatcaaaaccatctaacagttcatgagcatttgagtatcgctttataggcaagcataacatcactgttcttcgatacgtttcaatatatctgtgagtccattaataaaatgagaactcaacttcacctaataagcatacacatatacagactgaactaacctggactctccgatctcaatcacattagtaacatcaactcataaaaagaatcttaaaggcatcaacaagaacaaggaacctccatgtttaacctaaagctatgacagtcagatccagaaaccaagttttgcagaattcaagtaacatctccatctctaggaaatatgcaaataggaattaaccctctatgaacctttttcttctcacaaatactaatgagtgtgcttctaatccctaatccaattcttaaaaccccccaagataaaatcatccaaaatatagattccccaagaacattagagttcaagaacactgatcaaattctcatccacgataaagaactgtgatgattttgctatccctaacacatcacgttagatcttcaaattcaaaatttcaaagtataaatgaagaagcaggtaaaccctaaaccctagaagttcatcacattcacaaaattgaatctcacctactacacaagaaactggataatcttagctttataccgaagttctaaatcaatttcacaatgaagaatcaagtataaaccctagagttacaatgaatctcacctccgacgagaaaagcgtaaccaagagtcaacttctgcgacatagacagaggcgtgctcttcttcccgtcactctcctccttatcgtcttcccctccgtcgtcatttccatcgccgcctccaccaccgccgccaaatttatcacctccaattccaccaccacctccgtaatcgatcgtaggctcgacttcaacagctttgactcccgaatcaacgcagttagcagtaatcgtactggtgatcgtcttagtggagtcagagggaactactgcaccgagaggaagtcgtcggtgaccagatgcgaacgccagaggatgaaaaccgttggaattttggaatctgacacttcggatcggtgaagcagtggaggtattgagtagatagtgattaggtctgacgtgaaggagagaggattgtgcagaggaggaactcaaaatcaaatccgccattttcttcgtcttcttcttcgcaagctttttgtttaacgactaattttagtgattgattgattttggagaaaatcaacaacaaaaaacgttaatcaaataatgaaccttaaccggctaaattggtcttatctgcaaaccggttttcattagatcttactttattaggcattgcaatcggtacttcggtccgggtcagttcggaatttcggtttgtttgattaataaaaaatctaaccaaattaaccgaatttgaactacggttttcctcagttctgaagtgatatatttcggttctgaagtgttctgaattgaaacaacaataattaatacggtttgctcagtttaaattccgattggtccaataatttcggcatatttttcaatatttcggaacatttcaaacaattttgccatcgatttatagcaaaaattggacaatttaaagaatattttggtaaccgattggtgcacctcctcatatcaccgaaccggtcactgatttcaaaaacaagtttctgaacggttttaagaatacccaaattaccaaaattttcggatgggtccggtacatctgcccaggtcttcgcattagtaaacgacgtcgtttttggtctttcatcccaatatgtatgtgtagtctcccaataaatcaacgcagaaaaccaaaaccctcctcaccggagatccaccgtctaaatcgtctctaaaaatg

SEQ ID NO: 14419 - DNA, 37 bp, Unknown
  misc_feature (1)..( 37): cDNA_ID_3016924_gDNA_ID_2684117_Annot_ID_190847 3000 nt of promoter + ATG
ctttagttttgatttatgaaagtttagcttcaccatg

SEQ ID NO: 14420 - DNA, 3000 bp, Unknown
  misc_feature (1)..( 3000): cDNA_ID_3016939_gDNA_ID_2684117_Annot_ID_190843 3000 nt of promoter + ATG
gaaaaattaaacaagtaggggaagaaggtttgtccttgaaaaggaaagaagttgaggaaggagtatcatcaccaaagattgctaagcggtctgaattagaggtggttccgcgtgaggaaccgcccaattagttatgagtataatgagctagaattgtcagggattgaggagcttactggcaattccaattctataggaaatgaggcgtgatcatttcccggatattatgttcctcctggagaccaagaactccagtaatcgagttttggaagttaagaagtggatgggttatgataatgcccacctcgttgatcctgaaggtttgagtggtggactagctttattttggaaatcgtcatacgacatagaagtgttacactcagataagagaatcatcgacacgaagatcaagttttggtccttggaatttatgcgtcatttgtctatggagatggtgcttggaacttaagacaagaagtctgggataacttaaccaacataggacttacaagaaatgaaccttggtttgttatgggggatctgaacgagatatgggagaactccgagaaacttggaggtccagcgcaagaagaatcatctttcttgccttttcgtaccatggtacatgattgtaggctgcaggaaattccattttctgggaataaattctcatgggcgggtaaacgcaatggtatgtggattcagattcggcttgatagagctcttggtaatgctgattggttccgtttattcccacgagtgagttctgaatatttggagcgagtaggatctgatcatcgtccagtgttaactcggtttgttaatgaaaaacaataatttagagggcggttcatgtttgatcgaagatgggtatccaaattagaaatcaaagagattgtaaaacaaggttggacttgtaatactttaaatggtcctacaagtctttttgatatacttgcatcatgtcgtcgatccttgtctcgctggaaacgttcttcttctcaattgaatgctaaaaccaagattaagaagttacgtgaacagctagtggaggaagggagtaaacaatttcccagatttttccttctaattaagtggaaaagagaattagctgatgcatatcgcgaagaggaagtatattggaaacaaaagagctcggagaaatggcttgatgatggtgaacgaaatactaaatattttcatggctgtgttaaaggcagacgggctcagaataaagtcttctccttgtttgatgagaatgacgtcgaacaatttgatgatgggtccaaaggtaatatagcagtggtttattttcagaagctttttacttcttcccagcctaatgatgctgcagaccttctagctgggatgaactacacggttattgctgagatgaatgcaactttaacaaaacgggtcacgaatgaagaaataagacaagccgccttcagtataaagagtagcagtgcaccaggcgctgatggcatgacgggcttattttttcagtcgtattggtcagttgtgggtcagcaagttcgtgaagaggtgaaggaggatcaaaaggaggaagttcatcatcaacattcacattttccatattagatggatttgacatgttctcatgagactcattcacattattatctaaattttcatttgaatgatcatgaggatttaaactaggtgctacactaggaccagcctcactagaattcacactagctgcagatctttttttaacaaacttttccatagatcctccttgagattctataaattgtttttcagtttttttctctttttttttgtcattcccacacaacaccatgattaaatataaaaaagaacaatatcacctgtgaattgagaaatgcacgttttaaaaaaatcgactgtgtgacgttctgcgtccaagatccaaccactataaaaatccaaaaatgaaaaataatattagatatggctatgagaattttttccattgtgttcagtagattggtaagtaaaagaagattactagaatcaagaaaagtttacctaaaatataaaatcaaaactgcagtttgcttgaaatagataaattgatgaataagaaaagatgattagttgttttgtgaatcgtgaggtgagacttgagagggtttcagattttgatcataatctgagagtgagtcacaaaaaccaacgacgttttgatttcctctcttactaattaagtaggttaactttttttgggccttttgttcttaaacgtttttttataatgagcctatttgttctaatttttttttcccaaatcttacaacaaaaaaaaaaatttggaccttttttattttggaccttaggcatttgaccatgctgccctgggtcagagacgggcatgctgctgagctgaatgcaacctcaacaaaacgggtcacgaatgaagaaacagtacatcaggcgctgatggcatgacggacctatttttttagtcgtattggtcagttgtggggcagcaagtttgtgaagagatgaaggatttttttgagtctggttctttcccttcgaccaagaagcttatgttccgtatcttataagataatttcaaagattctgtgtttcaggctaaaggctatacttccggagattgtgtgagatacgcaaggtgcctttgtggcgggaagattaatatcagataatatgcttttggcacatgaaatgatacatgcgttaaatactaatcctgcgtgtaatgaagattttatggcgatcaaaactgatatatccaaagcatatgaccgtgtggagtggaattttttggaagtgatgttcacacgtcttggatttcataggaaatgggttgcttggataattatatgtgtgacattggttacatactcggtgctgctgaatgggaattcttatggttttattaaaccagaacggggtctacgctaaggtgaccccctttcgccattcctttttctcctatttgcggaggctcttgttcacatcatg

SEQ ID NO: 14421 - DNA, 3000 bp, Unknown
  misc_feature (1)..( 3000): cDNA_ID_3016949_gDNA_ID_2684117_Annot_ID_190840 3000 nt of promoter + ATG
taaatcttaacattgatttcaacattacatgagacagctcaattctcaaaccgtctaaaccagtcaacgatcgtcctggaaagaactcgagtttcgctaagaggaatggtctttagcgcctgagccacagcgtctgctggcgtgtacacagtcccaatttgccactttggatcctttaagatacataatcaagttcaattaacaggatgtagaaatgatagagcaaagttgttaactgcagaactactagagtctctagtgttgcttggttattacctgtatgcaaggtgtaagatggtttccgttcagccgaaccttttcaagtgtaccaccaatagattctatccgaggcctaagagtttcttcgagcaaatcagtctcgtcgattgcatcggagttgaattgtacctgagacaaatgttgcagcagacaaagatcaaatatttgtattatttgctggttctaatcagacagatactgttcacttctatgcttcttagatcaaccaatatggattagtaatgagtacacaaacagtctctatgtccaagaaatcatctcagacatgtataacagtttgcttagcagttgttcactctttgaaccgtcaagttcatataactataaatgaacttgtaatgtgtgcattaccagtagagtgtgtggaacgctgtaggagcacttgaagcaattgcgattctcaagtggtgacggtctgaattctgacactccttgtcctacctgcatagaacaacgaaacaaagaacgaaaagttcaattgtttttaaggctaggccaattacaagggacttacataaaaaaagctcaatcttcgatacgaagtcaagaagtcccttactgaagaaatacctcaccaaatactgatggcaattgatccaccaatttagtaaatgacttaagagcttcttgatcgttgtttagaatcgttgtcccagctgtgtcaagtaagagtttcaaaacatcacctgtaagtgagcacaattgcaaagataattagctacttttgattctcaagaattataaaagtctcaactaataatctacattgtttgacagactatttgaataagactttgtagcgtaagtagtatcacctgaagcatttcgagccatttcatatactggagaagcttccaccattggcagcatctgctggatgagaggaccaagctgcagagaaacataggcaatctaagatacaagcgatcataatctcatcaatcaatcttgtgaagataatagtaccagccctaagatcgcaagtaagaacgttgagctacttttttgtagcctagactctgataatataagctacaggttgctaacatcaagtacataccctgtgatctctattggagtcatatagtgaaggttttaaataggacaatataagagaacaatgacaagaacttatcactaatacactctaaaccaagcaaagcttaagagactaatgataatatttacctgctcaaaatatggaaccgcctctgtcgctgatttgttattgaatgaaataatggcattaacctttcacaagagagagattacatttttgtcacacttgcttagaattaagacaaagagaagattagaatcaacctaacctttggtatcttctcagcaaaataacttccggtcaaaacttggagcagtgcaccattactgtatagaaagttgaaaacttgacactagtcagaattcaggacacagagaattcataaggtttaaggaaggagagaaaagttgaacacctgtgaccaactgagaaaagaggaaggtcagctaaatctccaggcttcaagtttgaatttggaattccagatgagacaatcgtgtccaagcatgaattaaacctctcataaacttgcttagcagcttgttcatgatcaaatgtaacattgtacggcacagatactatcaaatacccttcctttgccagtagctccttaaggtaactacaaatcacacagagacaaaggaacaacatcttttaggttatgtgaaatttgatgaactcggagaatcaaagtacctgtaagtgagttcaggaacagctccgacgaaggcacctcccaagaatttaacaatagcacgcggtttcttgaatttaggaggaggaggaatcactagacaagaatcaagcctcgtgtaaaccttattgtttctgctgccaccggtcgctgtgacggtgagagacaaagctcgagctcgtttgctaaacagagtggccgggattagttgagtacccagaaaactcgaagtggctaatccaaactccattattccttttcttccctacagttttgtgtgaagaagaagaagcaaacgtttagtcagacttttttttttttaacaagttttttttttttttcacagaaagttatttttattagggtgaattgcaaaaataacagttttcaaaaaattattaaatatgtggttttataatgtggataatgtagtggaaagaaattttcagggctcctttttagtggagagtaatcttatatacttatattataaaaaaagaaaaaaaaatgattttcttttatccgtaaaagaagtaaatgacatagaaaaccttaaaaatattgattatttacgacccaaccaatataaatggattccaaaattatccaagctcattgtatttgggtcatatccaataaaaccctagtaaaacactaggttttccaaattctctgcggtaaaatcgattcacgatctctttcttctctttcttttctgtttttttttcttatttcttcactgtaaatctaaatccagtaaaacaattctcaattctcgtcaacgacaacgacagatctgttcgtcgatcttggtatatctgtagaaaactaagaaattgggtaagttaaaatcggatccgagttatttcagattgggttttgtgatcgaaattgattgaagagtagtactaatccaaatgattttgtttgtaggtttggagaaatg

SEQ ID NO: 14422 - DNA, 3000 bp, Unknown
  misc_feature (1)..( 3000): cDNA_ID_3016988_gDNA_ID_2684117_Annot_ID_190828 3000 nt of promoter + ATG
ttgttttgattccgcaaccttaatagaaaaacaaaataaaatttttccttgtttagtttgttatttgtttcatttttgctattttcgttaaaataaataaatcaaatgttgttatttttgacttatttgttgacttacttcctgagttaagttatgattcattgtcttctttgttttactctcttttacgaggtaccacaaataaaatttgagaacgatggagacaatagagtactccagctctgatgaagaggactcatatggatatagtcaagactcgtactacaatgagactagatttgttgagtcatggcatgatgatggctactcatcaggctcggattttgaggaagaaccatatggtggagcacctgaaccagagccaccagatcgttatagtagcagctacaccacaccgagttatccgaagtcatggatctcatggaaccccataccaaacaccaattcctatcccactttctaccccactcgcaaagttatatacaaattatttgtgcataatggtagtaaaacttatggacccgaattctttttgttttcaggattgggctatctacagtgggaaagtaatataaattactatttcgagtaccattccacaccacaagaagataagctttcgattgccctagggcaactcaagagtagtgttttgaggtggtcggatcaagatgagtacaaccgttgaggtgatgggagaccaaagatcagaatgtgggagaacctaaagtggattatgtacgaaaagtattgcccacaatgtctgaatcaagggaggaaaacaactttccctccaaagcaagccatccaaggagacaagatgcctaaaacaaccttaaatctgactgaaaaatcatggtaagttttctgaacttgaatgttctatggaactaacttgctacaggtgcaaaggacaaggacacatagcaaaggattgtcccaccaaaaaaagttcaccaagacaagaaccaactctttgtcttcatccacaagtactccaaaaacaagtggacgtttccactcttcaacatgatcaggttcaaactgaagcttgtcaaattgattataatgttcctatgactcttttaatgcacttgtctagtgccaaaagcattgagaaagtttcaggtacaaaagagatcattaaggatcaaggaaaagtttcaacaatggagaaagtgttcacgaaagaaactcaaaaccaaggagaactgacattgaaaaaagttgttgtcaacaaagatgagagtgtcaaagacattataccgatcaaagaagaaccaccgaatgctcaacaatttctccaaactcaatgtaagcttctaaacccttatacacttcaatggagtaacttgacttatctatgtgtaggtaaacaagttttgaggacaaaacctcttgaagaaggaggggataatgtaagaatgggagctgacgtaccggctgatgcacttgttgacagattgcttgttagacttcttgatggactttctgacggactacctgaagtacttcatgtatcaaatcagcttgtgcgaactaaggaaagctatcctttccttcccttttgtgcgtcccagagccacatatggaagcctggagatcctctacgccacccagaaccattcacacttaatccttggtgcatctttccttatgtgaacccgctgagcgaagactttccttttccggatctaaatgagatcaaatcacaacgactctattttgatcatcttttgggaattaagaagcctcctacaatgactctagatgtcccaaaatcacatcacttccagcccaagttgtcaagactcaagacacatcacaagtttccttatttggccgatttcgtcactaaagttccaacggccatattttcatttattgttgcgatttctttacttctttagagcacatgaacgttgtatgagcctctatataagctcaccttagttttcatttgtattcaagtcttttacgaaataaacaagtattttctttaaagagtgtctttgagttttatgcattagaagttagtgtggattcactaaagtcttgtgtgtttgcagatcaattatcttgtggattcaagttaatttgttcgtggtttgattgtggattcaatcaagcacgttgagagtggattcattcaataaaacctccatctttcatctctaccatcattcatcgaatcattcaagctttaggtcgagaaaccaagaagcgtaaaccctaggtggatttcgaggtttgcatcaataatccagatgatagcattggcaattcttctaatatatattgcctctcgaattttatgcaaagatattcaatgtcatctctatatgatatccattacttcagatatctttaaaacttatcaattttctatgagacttgggggaatataatgcatcatttactttaaaatgagtttcccttgggattgtaaaattggtttcgctaaagcctaatattatctttgcatggtcatatatagtactcacgtttctagcgaagtcttttataatcgagagaggagaagtatttttatctttaaagattgtgtgcatagaaccctgtcagctgatatatatgttcatcctcaatctcatattttgacatttttctataataaaatatttattcattaaaacatcgacataaactattcatatgtcataatatattacaataaaaacattatcccataaaaacaaaagcatcaataatgcttgtcatacataacatgattatacatatagctataatatattacattaattttctcgttgtcatgatcaatcgagagaatctgtcatatcaagatgagtatcatcatgttggcctttaaaggaaggtcccggctcatcacagaagagattagtttcaacatccctttctttcgccttttacgaagattggtacatatcggctaaattgtttggtatacgacacgtctagtactagtgtcctttcatg

SEQ ID NO: 14423 - DNA, 3000 bp, Unknown
  misc_feature (1)..( 3000): cDNA_ID_2730102_gDNA_ID_2684118_Annot_ID_137155 3000 nt of promoter + ATG
acttctttgaggtattaatggttttgttttccgcatttgcagtgaagcatactggacctggaatcttgagcatggcaaacgctggtcctaatactaatggaagccagtttttcatttgtaccgtcaaggtaaagattctcaattcttcacatcatctatagagttatcgatctttcatatgtttgccttcccattttgattaatatttatttcacaaatttgtttttttgtgcagacttcatggttagataacaagcatgtcgtgtttggacaagtaattgaaggtatgaagcttgttaggactcttgagtctcaagagactcgcgctttcgatgttcccaagaaaggttgtagaatctatgcctgcggagagctcccgttagatgcttgataatcactattgaccgatgcattgtctttgccatctttgttctgttttttgctattatgactattgaggaatccaaaccatcaaaaagccaaagattttcaaattctggtcttttatttattatatatttcggatacatgagttataagttcttttaatcgatgtgggattcttattagaatgtctctctaagcattgaccatggttgcaaccgcggcttgctgaacaattggctcgagcttctcatctttgttgtcttcccataaatcaggtattgcttcctttatgttatgaatgctgcttagtgcatagtcagcacctggaactagcactgattcccccacaaacacggtttttagccctgttgctttagcactagcgatgttacgaatactgtcatcgaagaatatctgaaaagaaaaagatatagacttttaagtttggtatctgaaactgtgaaagatcatagtgacttttctattaccgttttgcgtggatcaacaatgtctgcaatgcgaattgcagcttcaaatgcttcaacagagggtttacagaggatttgagtgtttgaatcagaagaagggtttagtgtttcgaagcaaatgattccttcaaagcagtcctcaagacccaatctgttgagagctcgtgttgcgtgagctttgtctgcgttagtaaagatctgttcgaagggaaaatgaaaaaacagaggatgagaaaaaaagattcagtggagaattcgagtacaaagcttgaagaaggaagaaacttacgattttacggtgaggcatagagaggagaaggttacggaggagtggatcaggttttagtttctcgtagggaagtcttccatggacatattcatggaattcatcgttgtcgaattcgtaacccataacctataagtacgcctctgttttggttatttcagtttcctcagtgaatgtttaagatcaagaattttgaaataagttaccttgagaccagccatggtggttccatattctttgtaaagatccaaacacaactttggaacttcactctcttcgattccgagttggttaagcatgaactctgcaaataacgaaaacaaagggatacaaaattcagttatatggccgttaatgattaagtaaagacaagcatcttgaaatgttaagtctcttttccttggatgttgtttcgacaagctaagttgattccgatgctcaaagggtataaagtatcgtccatatctgcaacaacagataagagttttaattcctttacaaaaaaaaaattgcacaagggaaataagattgaagatgattggtttatagtttatatgtgtattatttaccaaagaacaaacactcgtagttagctccaaatccatccattttacgaatccaacgaagaagaagctgctaacgagaattaatgaattatagacgggaagattaataatgaaaagagagagagagcttatgaacaatgtgaaggagttggttgtatttatatacacaattcaaaaaaggtagtggattttgttaggacacatagaatatttggttactagtctttatctaatatcgttttgaaacatatgatatcattctagttttttttttgcatgcattagggtttgtatcataaataccctttaacttccggtttttggatccataattttctattgcggctagaactagctaataataatatcacgtttaatgcataaatcatttgtcccaagaaatgaaactagttaggttggtgtgttgctctaaaattcacaaaaagcaccatgcatccacttgattgtacaaaataaattcagaaagcatgattgttgaaggtgacttgacgatcatgataattatccaccatgttgcatctatgctgatgcgggcaataagatgaggtgtttagcatctactatcatttatttttatcattcttttaatttctttgtcatttcccacactttccgtcgtgacctgccattttcattttctataaataatgctaaaacaaagggtgaaaataaaggtgaactctcaaatattctgaaatgtcaaaagtgtagacagaacgaaaaaaatttgtcaaggatcaaaagcagcagaataaagtttaatcgtgaagaacatattattttttattttttttgaaaatctgtctaaaactattttgattataaatcacaaacaagttgcatgtttaccaaataattaatataaattatgatttttgtccaccatcaagacacagatgaaactgaatcaaatctgcatataatatataaacggattcgaatgaatggttagctgatgcatagagcactctctttattataatagcaaaaaggtgtaaagcctaaacctaaaagttaggttaatgacatagattatgtgttcattttctggttccgtaaaaaagaattcatcatttacaaagtttaataatttgtataggcatgtttgatttggaatttttgttgttttctgagtggatttaaaattacaatgaaacaggcctgttaagtgttaactccacctaaaatggcccaaagtatatctcccattttagataaccggccaatttctctgtgttacagagtgacgaca

SEQ ID NO: 14424 - DNA, 3000 bp, Unknown
  misc_feature (1)..( 3000): cDNA_ID_2730095_gDNA_ID_2684118_Annot_ID_137157 3000 nt of promoter + ATG
gacactatgcataggtcatggcctgaactgagtctaactttctaaatttgtcaaattggcctctttctttttatttttcactggaattttgagtgcttatcaaaattcaagcaagatatttttacatgcatttattgaccagatatactaacagactaacaaatctctccatcagagagctgagacaagaccaaaaaaagatggataaataaccaaacctcaatcagttctccccgattgatagagattttatgcgcttttccacaccctgacaagtgactcaaaacagctgaagcctcattcgaaccgttgcacaaattccgaaacttcttcagcgtgacaacacaagtagaagtccagtgtccctcagataatatcttcaccacgtcagccgccttctcctagacatcacatagacttatttcaatcagccacatacttatataataaactgagaattcttctcctagatatagatggttaaaagtgagaacaaacagaagcaccttcaagagtggaacaagaacaagtgtattttccagaatctcttcctgcttcactggctgttgaaccattaagttcttcactgtcctcaataaacgagcaatacgaccactaccgggatcatcgagatcactaatccgcacaacatcaccttcactatgcatcaataactggaaacacgagccacttatataatcgatcttaaagaagataaatcctctttggccactaaatgcagcagaaactcaccacaacatcatcaatgcataaaggcgtcattcctcctcgatcaaaccacgccttcttcaccttttagaaacaagtgaacaaatcaacgttacataatcagttcttcctactagttactaatttcatctagaaccaaaagcaattgaccagacctggacaggatcaatgatgaacaacccaaactgacgcgaaaccttgatgatcaaatcacgccaaaactgaaatttaagttcccaatcggacctctgaccactaaacgccttgaatctagccatcgccaccacctcatcgtcccaatctggaacttcccttcgtataaactccttcacagcttcaggatccatttccttcactcagatgaaagaattagggaaaaattaacagagatggtgaagaagaatcttgtagactcgcaactatacaagaatatcgacagaatcctgcgaatttgaaagtcgatttcccgccggactaagttttatacgaagatcgtcggagagataagccaagtctcggagatgttctcgattcgacatgctctgccgtttgtcctatgaaatttagcactgtatgacgtttttaagaattcggccaggcccattaactagagagtactaggctttgactttcaaaattaggcccggcccattaattagagtgtactaggctttgactctcaaaacgagactggtcaaaactcaaaagatcccagggtcaacgtcgctccggtggttttaacaacaaatccaccatcaaataatgtacctaaacaacctcttataataatgttttattttacaaaatcagtgtacttactattcaattaaactagaaagcgaccaaatttatttttaaaaacttagttcttaaggataagtaaaacgtcccacgggaccggccataagatgacccaatgcaagttacacgttgatagttttttcatgaattagaaagaaaaaaacaattgaaaatgggaaagtcaagtagtaaaatagtaattgttttttgtttgttgggtgatgaaaagctaaaattaatttttaaaaagtgagaaactagataagaaaagtgtaaaagacacaaaggagacaagaaggaccgtccatgattatagtaaatgcgtaatattaattacgataatgatatgttttatatataaacaccacacaatacacctgaggcaagccaattccatacacatatagatgtttatctacacaaaatagagacgttataacggctttaactcatcctggtctgggatatttatagcatatcacgtgattttgcatattagatgttgatatccatatctgtttcagtccagctttatggtctatctatactataagttatagaatgcgtttagcattgtatatccagaatcaatgccaaacttacatagttacattttcaaaggataaactgattatttatagcaaaccagctccatttttggtcgttgaagcaagattataggtggcatttattaagtgggctaatacttttaagttcctgaattggtttatcagtctcaactcttagccgattccgcgttaatggataaaatatggtttaatatgttagcgattagtgatgtaataaacggtcgattagttaaagcttcccatattggattatgggctatggcgtttataaacaagttataagggtgaacatgtgtcactttttaatgcttgagagcgacaacaaatttggaaattgtaggaataatcaatctcgtattaagacaatggcgaaaaaaaggtcactaactacgtgaataccttgttttaacattgaatttaatgagaattaaatctactttccggtggattttttttgtaataaaaaaaaccagagtcgttctatctccgcgttaaagtaggacccaggggaaaaaagtaacgtttctattgaaaatagtaaaaaaatcgaccaaggtttttcaaataaatgcagtgattagtagtaatccgaagctattttagtaatgatagaatcaaacaaagtgagttagatatttacccccaaaaaaggattaaagtagaaataaaaattgctgttttcaaacaaaaagagggctaaaaacgtaaatagcacaaaacccgagactcgggtataaatgaaagtgatcaaagggagttaaagcacgagttgactcagttaagtttcaccattataacgatatagtggagactccaaacgtcagtctcttcactttcctacttcttcttctctttcatg

SEQ ID NO: 14425 - DNA, 3000 bp, Unknown
  misc_feature (1)..( 3000): cDNA_ID_2995974_gDNA_ID_2684118_Annot_ID_137158 3000 nt of promoter + ATG
acgcgtggtaacatagtgtaggttcgatttagtgcataaagtgttagctataaggaaaaaaattatacttcgattaacaagttcgatagaatttcgcaaaaaaattaatccctctaagaacggctctcactactgactgaaacaatctcatcatccatgaaaacaactactgtttatcgtatttacaaacgcaagaaaaggaactaaatccaactctaaaaactcgtccccataaagcataacttaaaaaaaacatcaaaaacgctaagtctataacttcaacaaaaagaagaaggaaaaaactaaaacagagaagtagatatatgactaagaagcttgacgtgtcgcagaagctaaagctaccgcttgtgcccacactttcaacctcgccttgacctcctttggatcatcacctaatttaataacataaatttattcagagacaaattcaaacataaataaaacataagtaaacatatttgactattactttacttaccaggactggagatacgccaggtggcgatgggtgagtcgccgccgctactagtctgagtatcgaaattcgacccggttgttgacacagatatccgacccggaaccggaacctctaattcgaacccgagatctctacaagctttcacttcttgtaaccccatcctcaacgacctatctccacctcttgctctcgtcaacaccgttaagccttctcttccaccgacgtcacactctccgttaactccctttttcttcttttccctcctttgcctccgtaaactacacttactgccatttttgttactctcattcgcatctaactcgccggaaactgtaagttttcttctccggcgagatggagtcaccggaagagagtaaaacccacgtgtctctttgtcggaatctgactctcgaacgttctcttttccttctccatcatcggaaacttccccatccgcctctgctccgtcgaaattctccagagatgtggaaacacacgaatctggttgattcttcgtggctgcttcgtcgtaagcagagctcgtacatatagacaatctcgacaaagaagaaaccattactaagctctcttcgaacgccatgaaagagaagaagaagtaggaaagtgaagagactgacgtttggagtctccactatatcgttataatggtgaaacttaactgagtcaactcgtgctttaactccctttgatcactttcatttatacccgagtctcgggttttgtgctatttacgtttttagccctctttttgtttgaaaacagcaatttttatttctactttaatccttttttgggggtaaatatctaactcactttgtttgattctatcattactaaaatagcttcggattactactaatcactgcatttatttgaaaaaccttggtcgatttttttactattttcaatagaaacgttacttttttcccctgggtcctactttaacgcggagatagaacgactctggttttttttattacaaaaaaaatccaccggaaagtagatttaattctcattaaattcaatgttaaaacaaggtattcacgtagttagtgacctttttttcgccattgtcttaatacgagattgattattcctacaatttccaaatttgttgtcgctctcaagcattaaaaagtgacacatgttcacccttataacttgtttataaacgccatagcccataatccaatatgggaagctttaactaatcgaccgtttattacatcactaatcgctaacatattaaaccatattttatccattaacgcggaatcggctaagagttgagactgataaaccaattcaggaacttaaaagtattagcccacttaataaatgccacctataatcttgcttcaacgaccaaaaatggagctggtttgctataaataatcagtttatcctttgaaaatgtaactatgtaagtttggcattgattctggatatacaatgctaaacgcattctataacttatagtatagatagaccataaagctggactgaaacagatatggatatcaacatctaatatgcaaaatcacgtgatatgctataaatatcccagaccaggatgagttaaagccgttataacgtctctattttgtgtagataaacatctatatgtgtatggaattggcttgcctcaggtgtattgtgtggtgtttatatataaaacatatcattatcgtaattaatattacgcatttactataatcatggacggtccttcttgtctcctttgtgtcttttacacttttcttatctagtttctcactttttaaaaattaattttagcttttcatcacccaacaaacaaaaaacaattactattttactacttgactttcccattttcaattgtttttttctttctaattcatgaaaaaactatcaacgtgtaacttgcattgggtcatcttatggccggtcccgtgggacgttttacttatccttaagaactaagtttttaaaaataaatttggtcgctttctagtttaattgaatagtaagtacactgattttgtaaaataaaacattattataagaggttgtttaggtacattatttgatggtggatttgttgttaaaaccaccggagcgacgttgaccctgggatcttttgagttttgaccagtctcgttttgagagtcaaagcctagtacactctaattaatgggccgggcctaattttgaaagtcaaagcctagtactctctagttaatgggcctggccgaattcttaaaaacgtcatacagtgctaaatttcataggacaaacggcagagcatgtcgaatcgagaacatctccgagacttggcttatctctccgacgatcttcgtataaaacttagtccggcgggaaatcgactttcaaattcgcaggattctgtcgatattcttgtatagttgcgagtctacaagattcttcttcaccatctctgttaatttttccctaattctttcatctgagtgaaggaa

SEQ ID NO: 14426 - DNA, 3000 bp, Unknown
  misc_feature (1)..( 3000): cDNA_ID_2730091_gDNA_ID_2684118_Annot_ID_137159 3000 nt of promoter + ATG
attctttgtcccctttgttttttttttttgtatcttgtactcgtcttttgtttctagataaccaatatgttattacatgtatttggtcaagtattttctttgaataacgtataaaattctggaaagcgaacatagatagtaaaaacaagaaaaaaatagagtcaattctaagtaaattaaatcctatttgtgaaagtataaaaacaatactaaaagaaaattggagaattgagatttcaccatatgtacatagaaatgaaattcaaaagaaaaacagtgattctcagattttcaaggcactcatagttttttagtttcaagatttaatgataatgtctcgtccttttacaaatcattaagttgtaagagagttttgcttctttttgaaagaaaaaaaatactactcataatttactttatgtttatcataaattatgataactcgactttactgcaatgtgtttgcttgtcagtaaaaacatgggctggcttcaaatccggatgattgcatgtctcgtgactcttttgtagcctctcttgttggccaactcattccattttctcgttttaggctctttcttttttttagtcacaaagttgaccataccaacatgcaagaccaattattatatctctttttgacataaaccaattattatatcttcaaaattagaggtttttgaccaccactctgatatatttttggcttcgaaaccaaccaacaaaaaacatagcggtttaaaaattaaaaaaccgtctttatcataaaccaaaccataaaatgcagtgattcaccttctaatcttctgtttgacgtacaagtgataaatgacttcaaagctactcccgtttctttacgagtgatttcatttcatcataaagaaatatgtgttgctcttgttcttagaaaattatttctcccagtcctttacaataatgtagatttcttctgttagtatgataaatatatatatgattgaatgtatatatttaacatgttttacgaaaaaagtcagtgtatactatttatgggaaaagtatcactaacttcgaaatatagttgatatttgttagttttatgtctactttaatttaagtcatttaatcaaaaattataatgttgaggtccataaactttaaaagtcccaataatgtgtaattaagttttagaaagaatacttattggattttcatctatgactctatttagaaaagttgtgtctacagtgactagctgcaaaaaaaaggttatgtatagtatcgattgccccttaaaacggagtgaaaacatgttttcttgaatcaaatccaaagtttacaaaatagaggaagatttagatatggtctctaaagtctaaagtagtctaggactaggagggcaatcttgtgaggtattagtgatgttcttttcatgtatttaatatataaatgtaagtttgctgaagcttaatacattaatgaatatgaatgcatgaaaactcgataaagcaagatacgtgcgtgttactactatttgaggtttcgttcgtgccttttagaatagacctattgatactatattttatttcaataatttgggttagattacgcgctaaccccgtgattgatttgttttttttttgtctttaataataataattaccgaatcttaaaacatgataatgatacgtgtgggtgtgtgacattatgttctcttttaagattctatatgacgtcatttcccttccaaatgacatttgatttgcccttgtgccgatgcatagttttaggctctatctctttccttttttcgtgatgacaaggttaaagccttataacctcttggcccaataaatttgtatttgtatatgtaatatgttagatcaaaatgttttactgtgcaatgttattttacttggtttaatatttcaaacgacaatgttaccctgaaatagtataatagctagagatccctacttgtaaatatcaaaacattgaaaactatttttctgaatcatttggtgtaaccggctaagttatattattggtcggacaccaaatattatagaatagaaaaataaaataaaataaaaggatgcatgagtgagtcatttgttatggaagagtagtgaggacaagtgtctaatacactgcatacgggtacccccaaaaaaaaaaacacaaaggtacattgaatcacgtggctttcacgtgaacttcacgctctgctttttttacttcttccattgtttggtctactttttcctttcaagagaatgctgccaaacaccttgtaggtcctatcaatattttttgtgggcccagcccattccttattgttcttgtactgtgaatgttcttcccacaaccacgtgggctttttggcccgttctctctctctctcctccccaacacttttttttttgtcgtactatcggtttgtgaaacagagatttgttgtttcactgatgtttacaaaagatatttgtctatgttgtggcaatctgatattctgacggatgtctattattatatttttaagtcctttctatttgtattttatgtgatttcgtttttggaaacgacatcccttgcatttaaataatctttttataatttataaaggcacaataaagtatcaaaaaaaaaatctcaaagatgctaagattcgacttatataaacagtggtactgtacaacaggaaattcattgcacctgaaaaaataattaaaaacaggtgaaagagataataataccaaaaaaatgaaaaggaaagaaaagcgaaatataaaataagagcaaaagagtctgaagttgatcaacaaaagaaagattagctttcacttacttccactgaagaaataacttttggaacattcaacaagacaacaaaatatgacttccccatcatccaccttcagaccaaattaagttcttcaatcttgtttccctgtttcacacacatatatatatatatatatatatatatatatatatgtgtgtgtttgtgtgcagacgatg

SEQ ID NO: 14427 - DNA, 3000 bp, Unknown
  misc_feature (1)..( 3000): cDNA_ID_2730084_gDNA_ID_2684118_Annot_ID_137161 3000 nt of promoter + ATG
ggtatgtaatctttttgttctgagacttaaccttttttcttgtgggtttactctctgtgaagttgaactttgattttataggctttcattccaaacactggtcgtggtgtacaaggtgcaacctctcattgtttgggacaaaactttgcgaagatgtttgagatcaactttgagaatgagaaagcagagacagaaatggtgtggcagaattcttgggcctacagtaccaggacggtaaatacttggaagtacttagattatttttctcatgtgctctacaactgttaacttatcattttcaaaccttttatagattggagtgatgattatgactcatggagatgacaaaggcctggtactccctcctaaagtcgcatctgtgcaagttgttgtgattcctgttccctacaaagatgctaatacccaaggaatttatgatgcttgtactgctactgcatctgccttgtgtgaagccggtatccgtgctgaagaagatttaagggacaactactctcctggatggaagtattcagactgggaaatgaagggtgttccattgaggattgagattggtcccagagacctagaaaatgatcaggtcagtccgtttaatatctcatcaattccttcgacatataatattgaagtaagtgcctggtttaaatatgtaacttgtaatgtagctaaacggatttcatttatcccataggtcagaactgtgagacgtgacaacggagttaaggaagatatcccaagaggtagcttagtcgaacatgttaaggaactgcttgaaaagatccagcaaaacatgtatgaagttgctaagcaaaagagggaagcatgtgttcaagaggtaaagacttgggatgagtttatcaaagctcttaacgaaaagaaactcattttggctccctggtgtgatgaagaggtatgttacagcaaaaacttcttattccagcttatagaattaaaactcaagaagataacaattttaagttccttaaacttaaattctttgtaggaagtggaaagagatgttaaggcacgtacgaaaggtgaaacaggagcagctaaaaccctttgttctccatttgatcagcctgaactccctgaaggtcagagaccctctaaatttagaatctgtttgagaaatttggctcataaatttagtccatccattgacacgaagcttcaatgttttcgatgcaggcactctctgctttgcttcaggaaaacctgcaaagaaatggacctattggggcaggagttactaagtgttcatcatgttttgattcaattcatgaaaatttacttttggcttgtaaagactctctcaagtgcattgtgctttgatctgatattttgaccaaaagctatttgagttattttgactgtgattgcactaagaattataaagagttgtttgattcaaagatattgatggaaaacggtaccgaattcgttttagcataaatttcagaccaatattacgtaaaccggaaagtggcctggtttactatttgttaacggaagagaaccccataatcatatcccaaatgtcgttgttaagattaattaatcacattatgttttgttgcattcagggaagcctgcaaagaaagtggacttattgggggcaggactgcaggagttacaaagttgatgaaaattgcttcttcttgtgtttctcttgtttactttggtttagactcgttttcggtttggttttgttttcaggcgtagatttgatctattgactattgattgatagattaactgatgatattcaatagtatttaatctatggatctcaccattaagctctgtttttacagaaaaaaattgatttgtcttagtcaatagtgaatatttgaaataattgtttatatagggtattttgaccagataatccggtccatgatggtggtatgtttgctgaataattaaagggggggtaattaagtatagtaattatggatgttgtattgttttatttatagacaacaacaagtctgtctcattactatgcctgtcttattaattcttctctctaatttcggaatataatttcaaaaaatcccttcaccaattctagctctttttctggtgtccatttatctttttttaactgaaattatgaaaacgtataattagcagagtcagtcaactctcactacgttacgacttacgagaccaaacgccacgtgtcacgtgatccgttatcttcttccaactaaacgacagcgtttcgtctcattagtaaaaaaaaaagaattacagagcttttcaaaaaacccttttttgcttcaatagaatcaatcaatcttcgatgtaagaagaatttgaaggtcacaattttctctttatcctttttataataatattcttttagttcggatcacatgaaatacgctgattccttcccaacaaaagaaacaattgatttataagtgttgttcatattaatacagactgggtttctctttctctctgggtttctctcagtgaccctctttgtctctttgtaacagaacatcaaataaggtatctccagacatcttagatatcatcgaatcgaatgttcttcttcttctttaattatggtttaaagtctctaattatatcttggttttcgtaggaggaagatattaaaaaattggtaatggcgatgatcatgggtacggagaaggtagaagatggacctactgcttgaattttggcgggcagaaacggtctctttcaatgatttttatgtccattgtgggttccccagtttcctctcaccactgacccatctaatcaatctttgcaacttgctactactatccatccatccatgagagagaaattttttgtgattcaaagttttgatttttagctaccaatctatgagtgagtgactgagaaacagagaaggattccaagctgctaaagattttttgtcaagatttttaatttaagtttcctggaggaggagatcacagatcttcttttcatatg

SEQ ID NO: 14428 - DNA, 3000 bp, Unknown
  misc_feature (1)..( 3000): cDNA_ID_2685791_gDNA_ID_2684118_Annot_ID_137162 3000 nt of promoter + ATG
cagaatgtttgaggaagataagattagacgcacatgattttatttgcaataatcatacaaagccgttaaacgttataaaagactaataaaaagagagggcctctcaaggttagcttcttcttccattgcaagccgctcctccacaagctcatcaatacatgttacctccggaatctttgcccgtggctcttccatcgccttattgttacaccggcagttgatctatgaaagagtctcaatgaggctcttgtggattatcaaagtatatctgccaccaaaaccaaaacatatgtttagaagaacaataccttaattggtttggttcatatacgatcaagcaatcatcacctagagcatggaaaaaagatctaaagttgtctgcttttttacagtccaccattttgaaggcagagaagccaacagatgttaagcatggcaatcaactctagatggtaagcaagattgtgaatctgaagcatacctggttactacaatgcaggaaggttttgacaagtcatctgatccttgactaactctgttattgcgtctctcaatctctcataatcctcagttttgttatagacctgatgagagatccgaacatacgcagtaattagtccactgtctttgtctttcactccttcctctccatccctcaatccgagataaaaaactggaacctcaactgagtaatgaacccgcagatatgaccgcaacttaatagcatcttcatcacttccaacacagagttttgaaggtaaaccgatcataaccatcccaacacacatttctggaggtgaccctagattcgttccccaagcatcagccagcattaaacccattctaacagcttcatcatggttcttcatcattatcccttccatccctccctcgaacctgtttacaaactccatcacagatggaaccacaagctgtgaactgtaatccctagtcccaatccaggcactttctataggcaaaccatttccaaactcatgagacaccacagggtgatgaacatcagactcagaaccacgtttcttacaatagaaaaacgcgatagacggtggacaaaagaaccatttatgcagattactcacatagtaatcagctccgatttctttcacatcaactttaacactaccaatggcatgagctgcatcaacaaaaacctgctccacaccttcctctctgcagatcttaaccaattctcgtaccggcatcaaaacacacggcatcgacgttatatgatcaatgatagctaacctaaccgttctaccattcgctctacctttctctagtccttctctaaacttggagataatctcttcgttcgaatttacagggaaaggtaacctaacctcaacagtagaacctcccacacgagagacataagcctgaatcgacttcttcacactctgaaacgcacagtgaaacatcactacagtatcttccttcttatacttcccttccgagaaacaccttccaactttctgaagaacaatagcagcagcagtggtggcgttatcaacgagagagacctcatcaacatcatcggcgttgattaggtcactgatcacagttcgagaagcgagaagtccacgacggagaccgttgaagtagaactcatcaggctgacggagataacgaagctgccactcgcgttgcgcctcgagaacggagccaggacagcacccgaagctaccgttgttgattctggcaacaccggtctggtggtgagcgaactcagagtcgatatctgactcggttaataacccagcgagacgtggcttcttcggtgcgcggtgattgtgactcatcgaatcgccattgcgccgctctcccgcctccatcggaattgaaaaaaatcagagctagggtttcgtctcgaatcccaaattgagagagagagagagagactgtgtgggtttttgggggtcaaatcattcactgttggtacgtcatcgttgatttttgtggtgcggtaacacttttccgcttcccgacaattcataaaaaaaaattcaaaattttagtgaaattaataattatatcattttatatgcgttacacaacgttaaataaattttaattgacatgtgatgatcgatgatcatttgcatccttgttagatttgagtttaatcatatactactaatttatcatttgttaacttaaatgttaagatttgaccgttatttcaaatttgggctttagtgggccattaaggtgggctgttactaggtcgagttataatgacatgtgaggattgattttactcatgagtaataaaatacagcttttttattccatgacctaaccattattcaagttgcaaatggatcgactgcgaaactggattagaatataaatccatcttttctccacaactatagtataaataattaatgcatcgatcgttgacttattgggcttggcccatgtaaactaagcatttaggcaaaaaccagatccaaccctaacacgtggccgtatataattggaagttcagtaacaaagctcgtcaagcgagtcaaacgttcgcaacttgtaacgctattttgctctctcgattcctttctctcttctcttatctttgctgcttcttttgctccgccgtcttcagctcagtcctgcttcagctctccggcgaaattggtaagttcttcttccctttacctcaaacgtttcttattgttccgtgaatctattgtgattttggtaattcgctaggatgtctttagtgtaatccattgtcgtgtttcttaggttccttagctttttagttttcgccggattttgtttttgtgtgagtggacagtaactcgattttggttgagaaattgacggaaatctcaaacgattcgcagatcccgaagtagcttgccattgattttactaatccattagcttggtagtgataaaccttgattttcataactttgattgtaattggatttcgttattggtaatgcatttcagaagaagaaggttgcaatg

SEQ ID NO: 14429 - DNA, 3000 bp, Unknown
  misc_feature (1)..( 3000): cDNA_ID_2730077_gDNA_ID_2684118_Annot_ID_137164 3000 nt of promoter + ATG
agagagcaaaatagcgttacaagttgcgaacgtttgactcgcttgacgagctttgttactgaacttccaattatatacggccacgtgttagggttggatctggtttttgcctaaatgcttagtttacatgggccaagcccaataagtcaacgatcgatgcattaattatttatactatagttgtggagaaaagatggatttatattctaatccagtttcgcagtcgatccatttgcaacttgaataatggttaggtcatggaataaaaaagctgtattttattactcatgagtaaaatcaatcctcacatgtcattataactcgacctagtaacagcccaccttaatggcccactaaagcccaaatttgaaataacggtcaaatcttaacatttaagttaacaaatgataaattagtagtatatgattaaactcaaatctaacaaggatgcaaatgatcatcgatcatcacatgtcaattaaaatttatttaacgttgtgtaacgcatataaaatgatataattattaatttcactaaaattttgaatttttttttatgaattgtcgggaagcggaaaagtgttaccgcaccacaaaaatcaacgatgacgtaccaacagtgaatgatttgacccccaaaaacccacacagtctctctctctctctctcaatttgggattcgagacgaaaccctagctctgatttttttcaattccgatggaggcgggagagcggcgcaatggcgattcgatgagtcacaatcaccgcgcaccgaagaagccacgtctcgctgggttattaaccgagtcagatatcgactctgagttcgctcaccaccagaccggtgttgccagaatcaacaacggtagcttcgggtgctgtcctggctccgttctcgaggcgcaacgcgagtggcagcttcgttatctccgtcagcctgatgagttctacttcaacggtctccgtcgtggacttctcgcttctcgaactgtgatcagtgacctaatcaacgccgatgatgttgatgaggtctctctcgttgataacgccaccactgctgctgctattgttcttcagaaagttggaaggtgtttctcggaagggaagtataagaaggaagatactgtagtgatgtttcactgtgcgtttcagagtgtgaagaagtcgattcaggcttatgtctctcgtgtgggaggttctactgttgaggttaggttacctttccctgtaaattcgaacgaagagattatctccaagtttagagaaggactagagaaaggtagagcgaatggtagaacggttaggttagctatcattgatcatataacgtcgatgccgtgtgttttgatgccggtacgagaattggttaagatctgcagagaggaaggtgtggagcaggtttttgttgatgcagctcatgccattggtagtgttaaagttgatgtgaaagaaatcggagctgattactatgtgagtaatctgcataaatggttcttttgtccaccgtctatcgcgtttttctattgtaagaaacgtggttctgagtctgatgttcatcaccctgtggtgtctcatgagtttggaaatggtttgcctatagaaagtgcctggattgggactagggattacagttcacagcttgtggttccatctgtgatggagtttgtaaacaggttcgagggagggatggaagggataatgatgaagaaccatgatgaagctgttagaatgggtttaatgctggctgatgcttggggaacgaatctagggtcacctccagaaatgtgtgttgggatggttatgatcggtttaccttcaaaactctgtgttggaagtgatgaagatgctattaagttgcggtcatatctgcgggttcattactcagttgaggttccagttttttatctcggattgagggatggagaggaaggagtgaaagacaaagacagtggactaattactgcgtatgttcggatctctcatcaggtctataacaaaactgaggattatgagagattgagagacgcaataacagagttagtcaaggatcagatgacttgtcaaaaccttcctgcattgtagtaaccaggtatgcttcagattcacaatcttgcttaccatctagagttgattgccatgcttaacatctgttggcttctctgccttcaaaatggtggactgtaaaaaagcagacaactttagatcttttttccatgctctaggtgatgattgcttgatcgtatatgaaccaaaccaattaaggtattgttcttctaaacatatgttttggttttggtggcagatatactttgataatccacaagagcctcattgagactctttcatagatcaactgccggtgtaacaataaggcgatggaagagccacgggcaaagattccggaggtaacatgtattgatgagcttgtggaggagcggcttgcaatggaagaagaagctaaccttgagaggccctctctttttattagtcttttataacgtttaacggctttgtatgattattgcaaataaaatcatgtgcgtctaatcttatcttcctcaaacattctgcttgcgaatctcctgtcgcagttccaataatttttccttattgaaaactttttccctcacattgaaagcatattcatagatatgtaatgacacctaatttatcattgttttgtatgattctggttcgttttcacatctatgtctattatgtctatttaccaacttcaaagttcaattaaaaaagggtcaaaagtactaaattgattccgatgaaacctgtcaggtcaaatcctactaaataataaccaatgggtattcctggagaatttgaaactcttgagatttgagttaacttgataccacgtgtcatccatcaggcggtttatcggagaagaagagtcttaaatccggcgagtaagaaactccgactgttttttgattcagagctaagcaaaaaaagcgtgattgtgttgtggagtagaggaagaag

SEQ ID NO: 14430 - DNA, 3000 bp, Unknown
  misc_feature (1)..( 3000): cDNA_ID_2730073_gDNA_ID_2684118_Annot_ID_137165 3000 nt of promoter + ATG
tgaaacttacaccgtggctaactgggttggtccagctaactggatccaagaagccaacgtgcccgtccaactaggattgtaagaggacaacacaaaaaagttaagaataaaacagtatgtgataatgttaaggtaacgatacgacgtcgtctctggggatcagaactcttttttggatactatatacaaagatagggttctagacgtgttgagatgatgtttgtataagattgctttcgtttcacgtgcaaaagaggaaaaaaaattgttttgttattttttttgtagtacaaataattaatttttttttatcacatgttgtatccttaagaaaattgatacacaaaatattttaaataccatcatttgctaaagtttaccatattccactttcatgattattcttacaactacaaaaataaaaataaaaaaatctagtaaaaataaacaaaccaaagatatttatttcacatacgtgttaacagacatgtactagttttgacttttgacaaatattcacagattttaattattttgcattgctattgtttaagtctagatagatatattttttatgagaagtgtaaaatgttagcaaaagcgagccctacatcacctaattatagtccacttcaaagcgaagctgtcccatagataagacttcaccaatatctcacacaatatataagtatagcagtcttctaccaccagaaatgtcacacaactcctaagccaatcttttctttaatcaagtcaatcttttcttcaatggctttttcattaaccagagtaaaccgagttcttattcaagcatgtgaaacgaccccatcagtagtgttggatctgtccttaatcgataatattccggttctacgatgtttcgctagaacaatacatgtgtttactcatggacctgatgcagctagagccatacaagaggcattggctaaagcacttgtctcttactatcccttgtccggtagattgaaagagttaaaccaaggtaaacttcagatcgattgtaccgggaaaactggaatttggttcgttgatgcggttactgatgttaagctagagagtgttggttatttcgacaatctaatggaaataccttacgatgatctccttcctgatcaaatccctaaagatgatgatgcagaaccgcttgtccaaatgcaggtaagtatttaatctacaatccgctagaaccggtttgtttgacaattagtaccgatcttgaattatgaacggtagttttcaaaatccggttcaacggttaataaaaagcagttataaattaaaccgattagcttgacgactgtattcgactgaagttaaactgaaccggattttataatgttactgcaggtgacccaattctcttgcggcggtttcgtaatgggccttagattttgccacgcaatttgtgacggccttggagcggcccaattccttaccgcggtcggagaaatcgcctgcggccaaacgaatctcggcgtctctcccgtctggcatagagatttcattccacagcagcaccgtgcgaatgatgtcatatctccggcaatccctccgccgtttccaccggcgtttccagaatacaagctagagcacttaagctttgatatcccatcagatttgatcgaacggttcaaacgtgagtttcgtgcgtcgaccggagagatttgttcagccttcgaggtcatcgccgcttgtttctggaaacttcgtacggaagcgataaatctgagagaggatacagaagtgaagctcgtattcttcgctaactgtcgtcatcttgttaatccgccgctcccgattggtttctacggcaactgcttcttcccggtgaaaatctccgccgaaagccacgaaatctcgaaggagaaatcagtgttcgatgtggtgaaattgatcaaacaagcgaaaacgaagctaccggaggaatttgaaaagttcgtcagcggcgacggagacgatccgtttgcgccggcggtgggatataatacgctgtttttatcggagtggggaaaattaggattcaatcaggtggattatggatggggtccaccattacacgtggcaccaatccaagggttgagtattgtccctgctggcatcgtaggatctgtgccgttgccgaagaaaggtgtacgtttgatgacgtggtgcgtcgaggagactcattgccaattgttcgatgatttgatgacaaataaattgacatctaacaaaaccgaataatcactaatccagtttattaaaatattgtatagtggaatttgggaaaacgagtaagaaaattcattggctgcttgaaagttgattcgttacgtactgaagtgtaatgtgcacataataataataataaaaattgtaaagaaaaagttatgagtcattcatttgccagctaaaacaaatgcaagttgcatataagaaaatcaatctgaatttgatattttgtctgcatacaatagaaatgcggttaatggcaattgttttatactgtatgaacaaagcaaagtaaatgttgattagtcacactaaagtttgaaagaaaactcgttttttggtactcttttctttgtgaaagaaaaagttaggtgctaataagactatccgcagaacagagaccagaccacttggcgtctgacctgtcacgtcataacaaggtcgtttttgacgactctagtccttgtttctggaagtaggtcctgaacttccacttgaatcaattcaatagacgtaaacgtcttaagagaagttcttgaaatcgaaaatccactgcttcttcttcaagtaatgaattagagtatattatatattcaaccctccacgatccttgtttcctcggctactaagaaaaggaagtgtatctgtgtttttcaggtacatgcttctctgttttttgttgtccaataaagtttaaggtttcagttttctagattttaaagtttggatttttagctttggttttcttgataggatcaaagaacaatg

SEQ ID NO: 14431 - DNA, 3000 bp, Unknown
  misc_feature (1)..( 3000): cDNA_ID_2114026_gDNA_ID_2684118_Annot_ID_137167 3000 nt of promoter + ATG
tttcagctctcaaattcaaaagacagatagattcaaaaaccctaattgatcgaattcagtgatcgaaaatctcgcggagaaactcacaaacgaccgtaatcgaaaaagaagagaagaagaaacctgagaaggatcgggacgagaattaggaggaaagccgagcaagatcttggcttcctccacctccattttccaaaaagcttcccgcgtctacggtttcgcttcagagagtcggtccttcatatattaatctcatttttagcttcagaatcatacgtgtacctctcacaaccactgccctacatttcattttctttcgtaaatatatagttttgaactggaccaatatatactttttaaaaataaaattttgtagaaattgttggaaaatgattaaaaaaatgttcaattatcacaagaaaattaaaatttagtaaacagagagtttcaaaatatatatctacaaaaattcttatcaaaatgttcgaatttcaaatataccacaaaatcttattttagaaataaaaagttcataaaatgtcgtaaatgatttgagaactttcttctaaactctaaatatcattttctttttaatctaaaaaatgtaatatcattttgtcatcatcaactaaaatattacacaaccgtttaacccgaaaattaacgcgcaattcactccctaccatatgtaattattaacaaaaaaaaaaactaaaagctagctgccaaatatagacgaactataaatatatacaaaacatgcattatctttctagctatatcaaaaaacctctcttcttcctccgagatccgttcctttccgatccctttctccgttcatacgaaaacacaatcatgaacactccaatcaaactcttctttctcttcatattcgttgccgcaaccgcaacggctaaaccagtcaaacgaacgaactaccttttcacaccgcacgccaaagcagtcgcgggaatctgcaccgttatcccaacggacacaagtctatgttgcaaaacccttaaacacgttcctaccaatgaccccatcgaactaatccgagcattagtggctgccgctgaaacatccgtcaaacaaagtgtgactttcctctctggaatcaaaccaaaacacatgtcagacgcaaccgcaaccgcagtggtcaacagctgcgagaaaaacttgaattacgcgttggaagatttcgccgatttttggaaagctacggggaaagatgtaacgacgttggctcataattattttacgtgtaaaaaagagttaatgtcaatcatggggtatcattcgacttgtttggacgatattgaagacaagattttgttgaaggaagtggggattgggattggagttgggaagaatctaacaagtgattcttttgatgtgtttaataacttgaatactattttcaagacttttggtattaaggtgaagcttaacgaggaagacacttcgccccgaccgccacccttgtctgattattattactgatgatcgtattaagggattggatgtaataattaattatatcgtgtaaggcctagagcaatcgcgaatggaatcatagatggttggttctgtcatgtatgattatgcgtcgtttgtgatgtaatgttgtaggttttatacatgtacggacggatttcgtgatgattggaaaggatatattaattaatgaaatgttattattttttgtctctatttcaacatttttcttttaaatacatatcgttaatgataacaaaagtattagaatgatgatttagacatttagcctcaggaaattttgaaatctgcaaaaaagttatattatctgctaatctcatttgaacatatccacagtccatcgtgtattcgagttacaagttttttttctctctatataaatgagagtggtttaattatgcagttacggttgttgacaattgacaattaaccggttgttaactgttaaccactgcgaattaacaaggctaactacacaattaaatctctctaatatcgtgatatctatgatgcaaattttctctctcttttttattatcatcattccgtaatcgttattgctattttagtattttttaccgttttgcgtcatcaataatataattcgagcgtaacgacagtttaccgtatacaatagctcatttggttgaccaaagtctaggaagaggttgaatcatatttgtttgatttattgagtatcatatgatttcggttttttctgtttttctattgaataaaagcttacgaattcggtttttctattcaaacactttaatcaaaactaattttgaatctttaagctcataatcctttcgttataagacataaattagtataccattcatgcaatgataccgtcatagagaagacataatttcttactagctaccaagttttattgtagtgtaccaactagttttaaccttaaaaggatgagagcaaactctcaataagaagttttcgaatactttactttcggataaataactaaacttaggaatgaataatccaaaatatattcacaagattagaattagaggatatgttatatgtataagtaaactagagttactgccacatacattttttttggttggatctacgttttatatttttagtaatcgaactcttgatcaggacataatcaaatcatcttgtggtgaccaatttttagtctcatagccaatatttgattagagaatttttagccattcaacgaccttaaatctctccctagctccatgcaaaccctaattttagaaactacaaatcctataagaatgtctccacaatgcaccacaatctctaccagccccattaataaaccaccgggctctgtttcaataaaaaaaatcccctccctctcatatttacctcccgaataaaaccggagggagagaaaaaacataaaaagcaaaaaaaaaggtaaaatcaaaaaggggaaaaatatataacaacaaaaaaaaaaagttagaaaaaatg

SEQ ID NO: 14432 - DNA, 3000 bp, Unknown
  misc_feature (1)..( 3000): cDNA_ID_2730060_gDNA_ID_2684118_Annot_ID_137170 3000 nt of promoter + ATG
tttcttagaaatttgttttttctttattattagataaatagtataatatttatattccctattgatcaactgttacgtttattgactattttatcaaacataccaaaaaaaacatgaatatctcgtaaaaatttgtggaaaattgaatgtgcaatgaagaaatgagtttgaaaaggtcgtgtgacataagtataatacaaattactcgataagaaaacggaaggaagtttcgtcgggctaacaagcattgcttcgtgctcacttagaaagctcttgttgagctaatgatgagtttcaaattcccttttttttttttgtctgtgcctagtaaacaaacatttctctgtaaagaagtactagttgatgtaatatatttaaccttttacgtaaaataaaataaagtttcatcgtggaaagtggaaacactgacgagtgaggagtcttggtcgtcaactaggagattgagattcctttgaagaagattgaagagaaagaagtggttttcgttgataacagaaagtccttcaaaacaaaaattccttttcgcgatcggcgatgaatacggcggggaaagaagatttgggaacggcggatacggctgaggctcagtacgtgatggcgaagacctcagtatggtgggatatagagaattgtcaagtccctaagggtcttgatgcacatgggattgctcagaatattagttcggcgcttaagaaaatgaactattgtggtcgggtctcaatctccgcttatggtgatacgagtggtatccctcatgtcatccaacatgctcttaattccaccggaatcgagctccaccatgtcccggccggtgaattccttaaacccttttatggttttctaaatctagatctactctctttttcctttctttttatttgtttttttttttctgataataaagatctgctagtgagcttgaatgttgttgatcgttgatgtatgccttatgtttcttttcattcttgttttttgttaacaactaacgttgtaggcatttataatcattggttgtattatttcacttctcaatcgaaatcgttttagggttttatactgtttggtttgctgttgattttgactacctcgatcgttgttattgatcaaagagtgttaataaccaaagtgtttcgttttccttttttttttgtgtgtgtgtcgatgtgttatttcaggggtgaaagatgcgagtgacaagaagattctagtggacatgttgttttgggcatttgacaatcctgcgccttcaaatattatgttaatttcaggagatagagacttttccaatgctcttcacaaattgagtctgagacggtacaatattctcttagcacaccctcctaaagcatcagcgccgctaagtcaagctgcaacaacagtatggctttggacaagtctattagccggaggaaaccctctcatacgaggcaaagttaaaacctcacaacttgttgccaatgcgtcaacttctagtaatgtcatgagtagtcctcctcacaatcagtttcctgatcctcctagatcaggtcctttgcatgctcgtcagccttacctaaaccctgatccttttgtgaataacagagatcccaatgctgccagaccaggaccttctaatatgcggccactttgtcctaatgctatccgtcgtcatcgccaagagaagctggaacgcgctctccctctactgattttattggtctttatgtttatgatacttgcaactgtgaactcaaattaaatgctgcatgcaccattttcataataatgagctgtttttggctgttgccgtgaagatgatttgcttggagctgcagactacggagaacttaatcaactcagaagttaaatgctgcagccactatgtctttctctttattgattcttttctttctcagcttgtgttttcgagcttagttgtgtgagtatttaccctgatgtgattatacgcaattacgcattgttttatctccatgggagaaatcacgattttgaattccgacgaatgattttattgttatatatttttatataatttgtttaatatttataaccatccatatatttttcttgtaaatcctaattcatcatcgacaagtttagcacaagggaacttcttttaagttttagctacaaacattcatattcgataatgccagaagtaatgtacattgtcactcaaagaacaagaagtgggtacattagtgttatgcgtattatataatacttttaaacaacataatgccacaatcaatgattaaagtagaaaattttgctagaattatctcatttattaaaaaggacggctttccgaaatattaattttaaccaactattaagatgtcgacaataatcatttgttttatcaacttgtttcttgttttcatactaccacgttaataaataggcttagcttaggaaatttgaaaaacaaaattcaccattttcaaatatttatatgtaaaatttgaatcaaacaaaaagtatatagaaaaaacattgactactgtattagataaaaaaaaaaaagatttcaagggaagttaggacgtaaacgtcgtgacagatggaaaacagagagaagttttcttcgtgaaaaacaaaaacggtgagtctttttcgttgaagttgaagtagaagtcatcatggtcaacgtcaactacaagagaacggacgtaaacgaaacggtgcacgagagcgtccactaaaccaaccacagtatcacaccactactcaaccgatgccaacaaggcataaaccacgactctccaccaatcaaaacgcttcactttttctttcctaaactacccttcccctcgccgatactgtagggacaaaattgtcaaagaacactcgcttcatcatcagggaaatataaagggaagaacagaaaaaccttttcggctaataattgaaaaatcccttattcgaagattcctttggcgattcgtagtagtagcttacggcggcggaagatcgatg

SEQ ID NO: 14433 - DNA, 3000 bp, Unknown
  misc_feature (1)..( 3000): cDNA_ID_2730052_gDNA_ID_2684118_Annot_ID_137172 3000 nt of promoter + ATG
aatacctatagatcagacaaaggcaaatcacaagtagtaggaacggattcttcttccacaggaagcaaacagcaacgtaagaaaacttctaagtttcacagagtacggcttggagatggatcaatggctgccttgctggatcttaacaattctactcgcgagtctgaacaagaatctaaggatagtaattccaacagtaaccaaaatcagaccggtggtttaccggttcgtggggtttggcgtaaaggaggtgctaaccttttctcgtaaagaactaattctctctctctctctctatgttattttggcttatgagtaaagtgtgcgattagatgtttactctctcatttttttgtcagagtgatagagagctttttgagcaaaatttaatttgatataatatggtgtttttgctttttctatatttcatctatttctgacttaattaaattagtctttatttggcattaaaaaaggaattagaatcgtaagaaataatctaaacgcaatttttaaaaatattttgtttgaagtaatttatttctttaatgttacaaaagagggttgattgagcaaattttattggtatagtaagttgtgtaaatattgtgtttatcatcagaaaaatttctactatatttttttattttgtttttttttcacagtgttaaatataaaagttttaatacatattagcataataaagtaatggaaaaaaaataaaattacaattaaagttttaatactttttattattaagttttaaaagggaaatacaaatgtgtgattacaaatccaggaaccacaattgaagtttataactgaaaaacaacataagataggtaatacacccaaatttatccatccttagatcccttaaaggtttcttagtaaaaagtaacgaccaaattctccgaacgagcctcgaactctcccaccctatcagctgcagcacgtatcggaagcagttgaatatcatccaatccaattggctgatacagatccaccctctccaacatacgaccataacgaatcagatactcgagaacacgtaactcgtgcgtaccaccataaaagctccacacctccactttcttaagtgttttcttcaaacattcatgactggtattctgcccccaataagcctctggatcgatctgaggcaccatctcttcgatgggccgaggacccaccatctggaatgagagtgtctccagatacggagaactgttaagcatgaatctgattccaacaaactcattaggttcaaaatttgtcttcagaaccaactgtcttgtctccatcggtgctttcagtcgcaccgggtcttcacactcttggatcaattgaaggacatacggacagattgtgaatgtcttagcagacaacatactgtagagaaatccactgattattgctcctgcactcacgttgtaacggctctcttcacggtagtccagatatgcctcctccattaacttgttcgcactcgcgaactcaaagcgatagactttcccaaagtacttgaagatctgaatattgggcacgtccagtgtggtttgctgcgcggagaaggaacaatacttgaaaaccaacttcattaaccggtcgttatatccggttatcgcatcaagaccaatctcccaacagtttttgatgttcaagatctcgagaagaggtgtctttgctatcaaagccgataacatctcgagacggatccagcggaagaacatggttttcaccatacccggtttcgcgagcctcgatggttcaaaccggcaaccgaataacttcaacgtcacgagactggtaatcttgtaaaaactctccggtaatttgatcaaacccggttctaattgtgcagcgtcgttattggtaacccaacgaggttctgagaggtcaagaaaaagatgcttgacattcttggagacagcgaattcgatcagtgtggtgaccccttcttcaaaagcatacgaattagagagacgaagctcgaagctttcaacaactccaccggtaaaattgttaacccaaccaaccatataggcaactaatgcagccctttggtaatagcgagcaacggaatcatcagcgaatgtcacgatctcgtcctctctgaaagagatgtttctcgtttcgcgacatatgtgtctccagcgggtggaaaggcgactggtgctcaaagcctccttgaaggaaaggttcgaaatgatcaggacgagcaggaagtctgaaagcgtcgaaatgatgtccactgcacttcctgagtccattgttaatgattttggagtaaaagtaatggattcaggaagagaataatgtgtgtggcgtgagggaaaacagtgctcttccttgtctttatatatatttttgaaaggttgcgactttttgttcgtttggcggttctcgtttctctaaccgctctttttacagaggttagggtttgtccgttactcattgaagaattgcaacgatacgcattttctaattaattcacaaaagccatatttaattaataatcgaacccgactgggccgataataaatttacttataataggctttatttttacgacccaattaattaggcccactaattattgcggttaaggaacgttgactttaagtcaaattagagagagcacagtccagggactaaagtgggtcccttggatttcttcctctcttcaccgatttcttagatcttcgaaacctctctctctctctctctctctctctctctctctctctctctctctctctctctctctctctcgttcgtttggtttttggatcagtgtaagcttctccattattttcggattcgcttccttcgtagtttgttcgtttgctctgatttgtaatcgtagcttagtttccgtagattctcaaatgataacgcgctttacgagttttgggtgtgactaggggtttctctctgtgttttcttattcctcaatgttatttcgaaattgaatgctacagatacagagattcaatg

SEQ ID NO: 14434 - DNA, 3000 bp, Unknown
  misc_feature (1)..( 3000): cDNA_ID_2730044_gDNA_ID_2684118_Annot_ID_137174 3000 nt of promoter + ATG
atcgttgcttccttataatctgatgctcttttaagtatacattctgacttgactttcctctgcttaggtttttgacgggcatggaggaccagaagcagcagcatacgtacgggaaaatgccattaggtttttctttgaagatgagcagtttccacagacatcggaagtgagtagtgtttatgtggaagaagttgagacttcattgagaaatgcgtttcttcaagctgatctagctttggcagaggattgcagtatcagcgattcttgtggtaccaccgctctgactgctcttatttgtggaaggtacgtgtttcattcagttttgtttagttctcaatctatctttagaatcttaagagatctcttgcgcatatacgaagatgtgcacaaaggtaaataaatctattgttaggatcttaagagagctcttacatatactagattgtaagtatataacctgtgacatgagcaatattggctatggttttatacttttggttactctttctgttgttgtctttggggtttaactgtgattttctcatgggatacttatgttcttgtcttttgcagactcttaatggttgcaaatgccggagactgcagagcggttctatgcaggaaaggcagagcgatagacatgtctgaagaccataaaccgattaatctacttgagagaagaagagtggaggaatccggcggtttcatcactaatgacggttacctaaatgaagtcctagctgtaacccgagctctgggcgactgggatttaaaactgccacacggctctcaatctccactgatctcggaaccagaaatcaagcagataactctaactgaagacgatgagtttcttgtgattgggtgcgatgggatttgggatgtcttgacgagccaagaagcggttagcattgttaggcgtggcttaaaccggcacaacgatccaacaagatgtgcgcgagagctagtgatggaggctctggggcggaactcatttgataatttaactgcggtggtggtatgtttcatgacaatggacagaggggacaagccggtggtgccattggagaagagaaggtgttttagtctttcgcctgaagctttctgtagcttgaggaatctgttggatggctgaaactagtgtgttttctggtgaaaaccgatgattatataattgatgatgacgaataatctctcccacggctgcttttgtatttagagattttacgcagctgagagaactcttttgagatatacttgtgtattaagtgtgtttgttgtgtgcacagtatgcgattacagttttgtgtacatacatactgttagttgtctatgaataacgaaaaagaaaagattaagtgatcgccactttgtcaagataaaattgcatctttatttttttgatcaagataaaactccattcaacacgaccatttaaaactaggaatgtatcatcatttcgagactaactttcgttcttcgcttaataagatttacaaattcatgcagcagaaactatttttgaacaacttcagtttaaagataaatcaaacttattcaaaaatcattagcaacacgtttagaaaccaaaaagacaaggctactactacgcatgagagcagccttaagaatcaaagcgtagaaactaatcactcatcacaaaactaaaatcctagatcgaatattattcgagaattaatcacttgactaaaaagaatacaagacaaatcataaattccgctacgttgccattgcaaatcatctataaatctgcaaacaaatgatttgaaatgctctcacaactacgttataggatgattcaagaagtagcaaccaatgaatatcaaagtatagaacgaacaacataatgaatatccataaaatcctaaaaccttccataatttataatccagaacgaaagatgttcaacatagaatccatgataactcaaattaaagagcttacaaaattcccaaatagaaatgcagtttttaaaagataagagagaaagagaaggatcgatctaccgctacaacagatcaagcttcaactccttctttctggtaaacgtaggtgagtccacacttaccacagtaatggcgatcaaaatgactcgccatgaaagtcccagctccacaggttgcgttagggcactccttcctcaaacgctgaacctttccagatccatcgattttgtaaaactgaagaacagcgagcttaaccttcttatgcttgtgcttgatcttcttcggcttggtgtaagtcttcttcttcctcttcttagcaccaccacggagacggaggacgagatgaagcgtcgattccttctggatgttgtagtcggcgagggtacggccgtcttcaagctgtttcccggcgaaaatcaatcgctgctggtccggtgggattccttccttgtcttggatcttcgccttcacattgtcgatggtgtcggatgattcaacctcaagggttatggtcttccccgttagggttttcacgaagatctgcatcttttgaggcaacggctgctgaagattatcaaaatggggattttgtaggcgaaggagacctctagggtttcttagctcaattacgttactacccttattttatttgggcttagttttgggctttcacagagcagtctattgggccattaagctcaccaaaagttataaaaaaaagaaaataaaaatggagatgcagggaatcgaaccctgtgcctctcgcatgcaaagcgagcgctctaccatatgagctacatccccgaatgattctcaacacttttttaactaaatagtatcaacgattaatttatttatgtatttgtttgactggccttgatgattaggagacctttgatattcttcttcatctagcccttttatttagcgagccctctttcgagaaccctagatctctcttgctcatcaatctctattgttgtcgtttcgaaacaatttccttatctcgatctcaaattcaggaagagacatg

SEQ ID NO: 14435 - DNA, 3000 bp, Unknown
  misc_feature (1)..( 3000): cDNA_ID_1026676_gDNA_ID_2684118_Annot_ID_137176 3000 nt of promoter + ATG
agcagtaatggttggagggtgtgttgcagctatgcctctccttaaaatgatccctacatcagtcctttggggctactttgccttcatggcaatcgaaagcttacccggaaaccaattctgggaaagaatcttacttctcttcacagctcctagtcgtcgattcaagtaaagtctcaatcattttcatcttcttttactctttcaagaatcattactcaattactcaacaaatttgcagggtccttgaagataaccacgcgacattcgtggaaaccgttccattcaaaacgatcgcaatgttcacaattttccaaacaacttatctcttaacttgctttggtctcacgtggataccaatcgctggagttatgttccctctactgatcatgtttctgatacccgtaaggcaatatatcctcccaagattcttcaaaagtgctcatcttcaggacttagacgcagcagagtacgaagaagcacccgctttaccgttccatctcgcagtaccggtaaacgactccattactaattcgaatcaaaatccacttttttagcttcttgaaaaatcttattaaccgattttggattttgcaggaagctgagatgggatcaactgcttcgtatccatgtgattctgagattcttgatgagtttattacaagaagcagaggagagtttagacacacatgtagtcctaaagttactagttcgacttcaacaccggtttataatcggaatctctctcaagtgtttagtcctagagtgattgatttaagaggtgagatgagtccaaggctctccgggaaaggccaaaatagtccaaagccgagtcctttaaacccatcatcatcgtcgaaatgagtttaccgatgatggaggcttgataaaaccggaggagattatgtttaaaattagttaattaattgatgttgtatcttatgcattcttgagttttttttttctttttacctatgtttaaaattatgtttgcatttctgttcttgatttagaatcattgtaaaatctctctaaataccatgtcaaatgtcggtaaaacattatactatgtaataataaagccatgaaacatcagcttataatatagacgttcacgataaaagaaagttcgagagaaaaaatctaacggaaacatgaaaataaagaacaacaagaaaagttagtggcttttgccttttggttatgtggttgtcttaaactgtgtttgttgcgtctcgatttttattgtcggatcagagattagattaagacattctcattgaccatttttccacgcgtaggtacagtaacttaacctgattaaaaccattctagtttgactaatataatgttttaaagatccttcgcagaatttaaatacaaaaaagggctaaaagttgcacctttttcttattaatattatagtcgaaatcttaaggccaactattcccttaaaatccaacaaggaagaaaaccttactgaatccaatgggcttaatactttcagacagtttaaagatttatggctttcctcgaaattatgatccattaaatgcgtgtctcctcattgatgatcatcagcaaatcgtgtgtcatattatattaaccctaatcataatatattaatactataacaccagcaacattatgctgagtcatacatatatatgctaataagtactagtagttgttaatttttattggtaagataccataacactagttttatattagactttacacgaacaagtttcaaaattttagcaacgcattagatcttgagcatcttggtttcgtctaaagaaacattatttagttgaatgtcttacatagtaagacaaatatttttgggtaatatataaaaaatgtgataatttttaacttttaaattagtatttaggttaaattagatcatacattcttaatatgataacaaagtgtattaccgccttaatagacagtttttttataaagaatggttttgcacctactctatacaaataacatgtcttattatattttcgaaatgttaaacttactcatattgcttaggacaaaatttttaagtaataaataaaacgtgtggtaattcttaaatttggattactatgtcagtttagatattttaattaatttttccaatagtcaaattgagaaggaaaaaacaaccacataaaataataaattaggtaatggctttggatcatagagagcacttaacttgttgatctacgcaatgtgtaaagcttgataccactaaactattattcgtgacaaaaattaaaaagaaagaaaagactgctgacctggcatgacagatagttaaaccttgggaggcaagttcatcctggtgattttaacggtccagattcatctagatgcaacgccattgtgtgattaaagatcgtcacttgcaggtgtgtacacggacaaacctttagagattctggtcgagaaagttctgtacttcctaaagtacccctaaacatttaatcctattacagaaatatccccgttatttccaaagaaagtcctcggaagttggtaaaagtttaaaaaggagtggttcagaatccgacgtcgttcgagggtacgcgcgtcaaagctcgaatgacacgtgtcataattagggcttagtcttagccgtgtgtaatccacaaactaaacagagatcataatctacataagcaaccgactcgccacagatgatggccacgtgtcaactgaattttaccggttacccagtcacccataatcgagtctttttcttcttatatataatcagagagaaaaagcccacgcggctcagaaatttcgtccacgagaggaataaattcacacgcgaacttcgatagttgttaattttcgttgaacacaagtgacgaatttgagagagaaaaaaaaagaaaatcagagataaagaatttgagtttcttggaattaaaggatcgattttgttgaagtgaaattgaaattgattgtgaaaagagaaagagactgatg

SEQ ID NO: 14436 - DNA, 3000 bp, Unknown
  misc_feature (1)..( 3000): cDNA_ID_2730040_gDNA_ID_2684118_Annot_ID_137177 3000 nt of promoter + ATG
ctttgtgaaaaaaaacaaaagacatgaaatgagtgaaatgcatgattgaatctttaataatgtagcaaataatatgtacactgtagtgttgaataaattagacgatactattcattcaaaaaaaaaaaaaaaactagacaatactcaaaaaagaattgatatgtgtgagtttggtggacaacttttacaaaatctagatgaataattaatatgaaagttgatcaaactattaaaaacaaataagcagttttgctgttagagcagtgtatagagtgtgttaccctcacttggctcgacaaactgtaccagaccggtgaaaagagtctcgatgtcaaattagatgcatggctaaaatacaaattaatagagcaccgattacttggttagtcacagtcttcgattattgtcaaacatataacaactcttaaacagttaaacctgtcccaaataagtattcacttgattaattgatattttaaaatttttacaagtaaccaatccactgaaacaattacgccccgttaagatgtataaagaactcaacgtcataggcaggcgatataatacttcatataaatgagtcgttgactgcctttttcatcgtgtcgtatagagacaaaatcgaactcaatgtcatagactcgtaggcgtgtgatttgtggttaatcggttacatgataatttaaacaaaattcgtgtaatatatataactaaatgttacgtcatgtcccgtcctcgatctcaataatttaatccgggaaatatctatggagtatacacatagtagttgaccttttctcgaattaagtatagagacaaaattaaacaaaaacttatttaagatgagaagcatataaaccagaaagtgacattcattgtttatatagaaaaggttttaaagtaacaatcgttaggagtaaatgatagaaatatcttttttaagcatgcttttatttaggtccaaccatcaatccagacttatgattgaataaacctctctaacgaggaaaaacaagttcaaattaagtttttttttttaacgtaaaatagtaacttaatagtaatgaaacaaaattagacggtggattcaaattcaaactcatttttttcctaataactttcattgtgattgtctactcatttttatttttaagaaagtaaagccactatatatacaaagaaacaaggactacaaaaggcatactcacatgtgcagaccaaatgcgtacgtgtatttacatgatcttcattcgcaagtcagtcaataactttctaataattacgtagctatgagttataactcgaattctaaatgaaatcgaataggctggtttctcgtgatgaagagcctcaagtggctgcagtgttttcaagaattcttgttatgtatcttatcatacaaccaaaaaaaacaaaccaacgcatgtaatgatgatttctgatatgtttccatagaaacttcaagaggtttcatcataaacttcaagtggcatgaactagaaataaattagatgtcatcatgatattgtttattagaaaaaggtagttgggaaatatatggctgtgaattccaatattgtatgttgtggttgcgtcgaatgctaagaaatgagttgtccagagcacatggccttcaacctctcttcatacatacatttacgtatgttaaaacaaagaacatgtagtttatatttattgtgtaagtagaagatatatggtgatggtggttacatttttataatgaagcagttaatacacggtgtaagtacaatctgcagcagaatgttggaaggacaacttaacgtgttaaaatccaattcctaaagtaagtgacaaaaaaagaaggtaatgaaacgaatggtgattggatcatttaattaggtcaaactctgctttattcaagtttattaaaagatgttcgtatttgttaggttgagttcttactattacaacgtcagtgtatggattagatgtatattatctcgccaccaccccttccaaaagtgacccttttttcttcttctttttttgcctttacacaaaacatcgtacagttgcctttttaagaaagcaggtaatgaatgtttaagtcgtttcctcacgtagaagatttgatttttactcaataatactataacttttagtataaattttgaaaaaaaaattggacgtcttcgatcgaaggttttttctttttcttttcttgggaacaatgtggacattacttagaaacatttttaataacgtaaactgaactaaacttttcaaagatagagatttgaatacacaatctataactctaattttttagtttttctctcattataaatcatgtaactatgtgatgaataatgatttttacaataaaaaggtcaaaggtaacggtggtggctggctacattataaatgattatagtaatttttttataagcttaccgtcgaaaaacttgacgcgcttcgttaatccttcctaatgatttgttaataatgtccgtcattattagtattatatatagggatgcttcggcttcatctttcttgccaccaaagacatatactttgcaatttgcacagctgaaaccactcttcgtcactttcttgtcatccaaacaatacacagtcccctttttctccattattacttctcaaaaaaaatcatgtaaatttgttccatgaatcattcccaatcttcttcaacgagattcattgttattacgagctccttaatatttggttttttgcttttagctcttattgtctggatttttgtgcatttttcttctatcccctaaacttgtagtattgagaatgttctctaatatgggtttcaagtagtctccttttcgtgtctccctcatatcgggtttaaactcatcttctaactcttcttcgcgagtgtctaaccaaagaagctctccaagtgttcgacgatttgtctgatagaaaacgaaaaacagagtaacttaaaaacagagtaatttacagagagaagccaccatg

SEQ ID NO: 14437 - DNA, 3000 bp, Unknown
  misc_feature (1)..( 3000): cDNA_ID_1557475_gDNA_ID_2684118_Annot_ID_190881 3000 nt of promoter + ATG
cacattcacttgatagcgtaaccattagtcattttagtaccatcaatagttggactgattagtgagattaatgaacggctaagatccttacatgtatataacacacattggtcgtttttttattttatttttctgattatatcgaaaacaaacactttattaaccaaaccagtcaaatagattgatttgttctagatctaccaaaaccggtcaagggaattttttgggtaagagtaccgattcgtcaaaacagcatcaacgacaaaccggttagcagcttcagtatagtgaaccccatcccatacaattgctttggttacatcacgacaaatagttgaaccgggttgaccacacgttgcttttcgatcatagttgttaggtcttcctccataaccgcaacaagccatcaacgggtccacaaatcctgaaacctcataaaccaaataaaccaatcaaaaccggttaactaattaaaataggacttttatagatgcggtcgatacgcaccgtatagtttgaaatcggcggagagtttatatttgatggagtaaatatcaacgtagacgagagtggcgtctttgaattgggatctcagttcgttgcagagactaaggagtcctttgttgaaggctttggcgacttcattgtgaacccggaaacaaccaatcgggtcaagatccgaatcgttatgcaggtgaatcgccaattcttttggtgcacagcccaatgggcctgtgttgtgtacccaaaactttctccctccgtataaatatacagtcttcagtacaacataccaaatcacaaatcagccgtattaggtatggtttaatagtcaactagaaagttttaaacaattgcccatttgccccaagaaagttggaaaatcaaatatgggtagagttttttagttttacttaaataatgtccctgaagtttttagttaccgatttaccaccctaataagtttatgaaaaaataagttttggggctaacagtttacgtatatgtaaaaataaaaaaaaattgtggaagaaatgaagtacctgtatggctttctttatctcaagaagcatggaaggaattttttcgacaacgggtgcataggttaaattcgaatcatatagagcaagtaaaagatcgttttgtccaatatcgatcatgtacaacgcgtttctaaatccattatcatcaataaggtctcttctacctatcaacaaggaaacatattttgtaagtaattaagacgagatatgtataaattgtttgggacaaaagtaattaccggaagagataagttcttgagaacggtttttgaaatggacgaattgacgaatttgaatggcaagagggaaggaaaagatcggaagagcggtggcgcccgagactgcgaaattgactcctcttttgaaatttggtgaaagtgaatccaaatatggactcaaatatgtcatctttaaatgttcacctgatcatatatcaaaaggtttaatcaaatatataacattacatgtacataaaacatatatttaaagaattgaaactcttgttgaaaaaaaagagaaagaattgggactcacagtagaagtcaacgatgagtcgaccgtcaccgagacgaccagtgcctctatggaagaaggtaatgccatgagggagtccgataggaagtccaactccagcaagaactcctccggtgtcggagttagagtcgccgaagtttatcaatataggtttcttgtttgacttgtaactagtttcagagttagagcaaaccaaaagagagagacataaaactaagaagaagcattgtagagaggaaacagtgtaatccatttcttttgaattcttgctactcagataattttaatcaagattcacgatctgaagcttttacatatagtaatgtctttggcttagaaagtcaaattttttgaatgtaagtcaataagtactattgcaagtcgcattatataaatctctaaataatctcaaagtaaaagcaatcaatcaacctatagatccgatcggccatgttctataaggattgtcagaacttgttgagctattaaaatactccgtacaacttatttgattaatatgggccaaatccgaaaataaatggaccttatcgaatattttgttcgaagtccaggcccactaatcgagtgcgaaaaaacaaaaacaaatgcggtgagcgtggatcgaacacgcgaccttcagatcttcagtctgacgctctcccaactgagctatccccgctacttgttatcgaagctaaaataataaaataaatacaaatatttgtaaaagcgagaatttgtgattttttttggcaataagtagagaatagttgtgttccacgattcctcctctcacgttcgaagaccatttcttgttctttggacgaccatcggcgacagtgttaagtctagagtcttcttcttcttcggcgtagttttttccccggtaagtctccgttcatcgccgaatctgtatccctctttctctttttgtttacttgatcgtctctttcgattatgtatatcgcgatcggagtccgtcatctccagatctgtgtgtatgcgcttaatttcgttatggatgtgacatgatttcttgtgattcgtttccttagggttgatagatctgtatcctgcatgatcgttatagatagtgatctagatttgtcttttttcagatcgaaatttagatctcttattgttaatcatgttgattttattgaaacttgctcatacgaatgagatccgagagcatttggaaacataggattgctttgcgttgtaattgttttctcaagtgatggatattgaatctatgtgattgatgcaaaatgagttccagagaatttataatcctaggattgcatgataacttctttgctttgtgattgttttctaaagtatttattccatatgaatgctgcaattgagtatgcgtttagactgaaggtgttatttgaaaactctgaaacaggcttgaaaa

SEQ ID NO: 14438 - DNA, 3000 bp, Unknown; identical to SEQ ID NO: 14435
  misc_feature (1)..( 3000): cDNA_ID_1026676_gDNA_ID_2684118_Annot_ID_190878 3000 nt of promoter + ATG

SEQ ID NO: 14439 - DNA, 3000 bp, Unknown
  misc_feature (1)..( 3000): cDNA_ID_2730052_gDNA_ID_2684118_Annot_ID_190873 3000 nt of promoter + ATG
aaacagcaacgtaagaaaacttctaagtttcacagagtacggcttggagatggatcaatggctgccttgctggatcttaacaattctactcgcgagtctgaacaagaatctaaggatagtaattccaacagtaaccaaaatcagaccggtggtttaccggttcgtggggtttggcgtaaaggaggtgctaaccttttctcgtaaagaactaattctctctctctctctctatgttattttggcttatgagtaaagtgtgcgattagatgtttactctctcatttttttgtcagagtgatagagagctttttgagcaaaatttaatttgatataatatggtgtttttgctttttctatatttcatctatttctgacttaattaaattagtctttatttggcattaaaaaaggaattagaatcgtaagaaataatctaaacgcaatttttaaaaatattttgtttgaagtaatttatttctttaatgttacaaaagagggttgattgagcaaattttattggtatagtaagttgtgtaaatattgtgtttatcatcagaaaaatttctactatatttttttattttgtttttttttcacagtgttaaatataaaagttttaatacatattagcataataaagtaatggaaaaaaaataaaattacaattaaagttttaatactttttattattaagttttaaaagggaaatacaaatgtgtgattacaaatccaggaaccacaattgaagtttataactgaaaaacaacataagataggtaatacacccaaatttatccatccttagatcccttaaaggtttcttagtaaaaagtaacgaccaaattctccgaacgagcctcgaactctcccaccctatcagctgcagcacgtatcggaagcagttgaatatcatccaatccaattggctgatacagatccaccctctccaacatacgaccataacgaatcagatactcgagaacacgtaactcgtgcgtaccaccataaaagctccacacctccactttcttaagtgttttcttcaaacattcatgactggtattctgcccccaataagcctctggatcgatctgaggcaccatctcttcgatgggccgaggacccaccatctggaatgagagtgtctccagatacggagaactgttaagcatgaatctgattccaacaaactcattaggttcaaaatttgtcttcagaaccaactgtcttgtctccatcggtgctttcagtcgcaccgggtcttcacactcttggatcaattgaaggacatacggacagattgtgaatgtcttagcagacaacatactgtagagaaatccactgattattgctcctgcactcacgttgtaacggctctcttcacggtagtccagatatgcctcctccattaacttgttcgcactcgcgaactcaaagcgatagactttcccaaagtacttgaagatctgaatattgggcacgtccagtgtggtttgctgcgcggagaaggaacaatacttgaaaaccaacttcattaaccggtcgttatatccggttatcgcatcaagaccaatctcccaacagtttttgatgttcaagatctcgagaagaggtgtctttgctatcaaagccgataacatctcgagacggatccagcggaagaacatggttttcaccatacccggtttcgcgagcctcgatggttcaaaccggcaaccgaataacttcaacgtcacgagactggtaatcttgtaaaaactctccggtaatttgatcaaacccggttctaattgtgcagcgtcgttattggtaacccaacgaggttctgagaggtcaagaaaaagatgcttgacattcttggagacagcgaattcgatcagtgtggtgaccccttcttcaaaagcatacgaattagagagacgaagctcgaagctttcaacaactccaccggtaaaattgttaacccaaccaaccatataggcaactaatgcagccctttggtaatagcgagcaacggaatcatcagcgaatgtcacgatctcgtcctctctgaaagagatgtttctcgtttcgcgacatatgtgtctccagcgggtggaaaggcgactggtgctcaaagcctccttgaaggaaaggttcgaaatgatcaggacgagcaggaagtctgaaagcgtcgaaatgatgtccactgcacttcctgagtccattgttaatgattttggagtaaaagtaatggattcaggaagagaataatgtgtgtggcgtgagggaaaacagtgctcttccttgtctttatatatatttttgaaaggttgcgactttttgttcgtttggcggttctcgtttctctaaccgctctttttacagaggttagggtttgtccgttactcattgaagaattgcaacgatacgcattttctaattaattcacaaaagccatatttaattaataatcgaacccgactgggccgataataaatttacttataataggctttatttttacgacccaattaattaggcccactaattattgcggttaaggaacgttgactttaagtcaaattagagagagcacagtccagggactaaagtgggtcccttggatttcttcctctcttcaccgatttcttagatcttcgaaacctctctctctctctctctctctctctctctctctctctctctctctctctctctctctctctcgttcgtttggtttttggatcagtgtaagcttctccattattttcggattcgcttccttcgtagtttgttcgtttgctctgatttgtaatcgtagcttagtttccgtagattctcaaatgataacgcgctttacgagttttgggtgtgactaggggtttctctctgtgttttcttattcctcaatgttatttcgaaattgaatgctacagatacagagattcaatgagctgttttggctgttgccgtgaagatgatttgcctggagctaatgattatggaggtcacaatatg

SEQ ID NO: 14440 - DNA, 3000 bp, Unknown; identical to SEQ ID NO: 14432
  misc_feature (1)..( 3000): cDNA_ID_3017058_gDNA_ID_2684118_Annot_ID_190871 3000 nt of promoter + ATG

SEQ ID NO: 14441 - DNA, 3000 bp, Unknown; identical to SEQ ID NO: 14431
  misc_feature (1)..( 3000): cDNA_ID_2114026_gDNA_ID_2684118_Annot_ID_190868 3000 nt of promoter + ATG

SEQ ID NO: 14442 - DNA, 3000 bp, Unknown; identical to SEQ ID NO: 14430
  misc_feature (1)..( 3000): cDNA_ID_2730073_gDNA_ID_2684118_Annot_ID_190866 3000 nt of promoter + ATG

SEQ ID NO: 14443 - DNA, 3000 bp, Unknown; identical to SEQ ID NO: 14428
  misc_feature (1)..( 3000): cDNA_ID_3017066_gDNA_ID_2684118_Annot_ID_190863 3000 nt of

SEQ ID NO: 14444 - DNA, 3000 bp, Unknown
  misc_feature (1)..( 3000): cDNA_ID_2995974_gDNA_ID_2684118_Annot_ID_190859 3000 nt of promoter + ATG
tcacgcttgttagctatcatcactctctccactttatgttgagtctgcacaatgttgatggtttccatgtcattttttctttgcttacaccaaatagaattcaggaatcaaatgctgtttgctgtaaactcattctcaaactctgaccagaacggtctttatataaactcttgcttcgcgcattgtcagactgaaagacaggacacttggtttgctcaagattctcctcaactaaacggaaaggtaacattactcgtccaaaactgttcatgcggtttctatctcattaaacattaatatagcaatcacaagtttgttaaaactctctgtccataattgtctattatcagagagtcgcagagtctgtaggtgactggtacttcgaccgagcaaaaaatgtcaaagctatcgattgtccttacccttgtgacacaacatgtcacaatctgattttcgagtgagtaaatcgttgaaccccatttctctgattctttcaaacttataagttataccattattgccttaaattccttccatatttatcctaacttccaaatgtgcaacatttgtgtatctcaaatgagaatcatttagtttgtcgattcagatcataatttatatttgcatgaccttgatttttcgattgaaataagctttctttcgatgtttatttttatcgatttttttcatatatattctttgtgcagttttgatcaatcagctatagagatctcagcttcttcaaggttttgttttcctgtcattagagcctctctggtctccctaatgttgataaaattcatcctccaattcttagtttagtaggtatagtgaaaaagccttattctttcatacctcatttttaaataaccatttgattcaaatgtcgaatctagttagtgacaaaatccatgtcattacatagaatagtatatcaaaaagagaacaaaaaaaggaaaaagaacatattcctttattcattggactctaacacaaaacgtccgaatatcaaaaaccgatcatgaactcttcttttgagatgtccctttttttgaaattccaattgttaatcgctttaattttcacctttttctaccaaattgaagcgcacgcgtggtaacatagtgtaggttcgatttagtgcataaagtgttagctataaggaaaaaaattatacttcgattaacaagttcgatagaatttcgcaaaaaaattaatccctctaagaacggctctcactactgactgaaacaatctcatcatccatgaaaacaactactgtttatcgtatttacaaacgcaagaaaaggaactaaatccaactctaaaaactcgtccccataaagcataacttaaaaaaaacatcaaaaacgctaagtctataacttcaacaaaaagaagaaggaaaaaactaaaacagagaagtagatatatgactaagaagcttgacgtgtcgcagaagctaaagctaccgcttgtgcccacactttcaacctcgccttgacctcctttggatcatcacctaatttaataacataaatttattcagagacaaattcaaacataaataaaacataagtaaacatatttgactattactttacttaccaggactggagatacgccaggtggcgatgggtgagtcgccgccgctactagtctgagtatcgaaattcgacccggttgttgacacagatatccgacccggaaccggaacctctaattcgaacccgagatctctacaagctttcacttcttgtaaccccatcctcaacgacctatctccacctcttgctctcgtcaacaccgttaagccttctcttccaccgacgtcacactctccgttaactccctttttcttcttttccctcctttgcctccgtaaactacacttactgccatttttgttactctcattcgcatctaactcgccggaaactgtaagttttcttctccggcgagatggagtcaccggaagagagtaaaacccacgtgtctctttgtcggaatctgactctcgaacgttctcttttccttctccatcatcggaaacttccccatccgcctctgctccgtcgaaattctccagagatgtggaaacacacgaatctggttgattcttcgtggctgcttcgtcgtaagcagagctcgtacatatagacaatctcgacaaagaagaaaccattactaagctctcttcgaacgccatgaaagagaagaagaagtaggaaagtgaagagactgacgtttggagtctccactatatcgttataatggtgaaacttaactgagtcaactcgtgctttaactccctttgatcactttcatttatacccgagtctcgggttttgtgctatttacgtttttagccctctttttgtttgaaaacagcaatttttatttctactttaatccttttttgggggtaaatatctaactcactttgtttgattctatcattactaaaatagcttcggattactactaatcactgcatttatttgaaaaaccttggtcgatttttttactattttcaatagaaacgttacttttttcccctgggtcctactttaacgcggagatagaacgactctggttttttttattacaaaaaaaatccaccggaaagtagatttaattctcattaaattcaatgttaaaacaaggtattcacgtagttagtgacctttttttcgccattgtcttaatacgagattgattattcctacaatttccaaatttgttgtcgctctcaagcattaaaaagtgacacatgttcacccttataacttgtttataaacgccatagcccataatccaatatgggaagctttaactaatcgaccgtttattacatcactaatcgctaacatattaaaccatattttatccattaacgcggaatcggctaagagttgagactgataaaccaattcaggaacttaaaagtattagcccacttaataaatgccacctataatcttgcttcaacgaccaaaa

SEQ ID NO: 14445 - DNA, 3000 bp, Unknown; identical to SEQ ID NO: 14424
  misc_feature (1)..( 3000): cDNA_ID_2730095_gDNA_ID_2684118_Annot_ID_190858 3000 nt of promoter + ATG

SEQ ID NO: 14446 - DNA, 3000 bp, Unknown; identical to SEQ ID NO: 14437
  misc_feature (1)..( 3000): cDNA_ID_1557475_gDNA_ID_2684118_Annot_ID_137179 3000 nt of promoter + ATG

SEQ ID NO: 14447 - DNA, 3000 bp, Unknown
  misc_feature (1)..( 3000): cDNA_ID_2730032_gDNA_ID_2684118_Annot_ID_137180 3000 nt of promoter + ATG
gcattatataaatctctaaataatctcaaagtaaaagcaatcaatcaacctatagatccgatcggccatgttctataaggattgtcagaacttgttgagctattaaaatactccgtacaacttatttgattaatatgggccaaatccgaaaataaatggaccttatcgaatattttgttcgaagtccaggcccactaatcgagtgcgaaaaaacaaaaacaaatgcggtgagcgtggatcgaacacgcgaccttcagatcttcagtctgacgctctcccaactgagctatccccgctacttgttatcgaagctaaaataataaaataaatacaaatatttgtaaaagcgagaatttgtgattttttttggcaataagtagagaatagttgtgttccacgattcctcctctcacgttcgaagaccatttcttgttctttggacgaccatcggcgacagtgttaagtctagagtcttcttcttcttcggcgtagttttttccccggtaagtctccgttcatcgccgaatctgtatccctctttctctttttgtttacttgatcgtctctttcgattatgtatatcgcgatcggagtccgtcatctccagatctgtgtgtatgcgcttaatttcgttatggatgtgacatgatttcttgtgattcgtttccttagggttgatagatctgtatcctgcatgatcgttatagatagtgatctagatttgtcttttttcagatcgaaatttagatctcttattgttaatcatgttgattttattgaaacttgctcatacgaatgagatccgagagcatttggaaacataggattgctttgcgttgtaattgttttctcaagtgatggatattgaatctatgtgattgatgcaaaatgagttccagagaatttataatcctaggattgcatgataacttctttgctttgtgattgttttctaaagtatttattccatatgaatgctgcaattgagtatgcgtttagactgaaggtgttatttgaaaactctgaaacaggcttgaaaaatgggtctatccttcggaaagttgttcagcaagctctttgcaaagaaagagatgcgtatcctcatggtgggtctcgatgcagctggtaagactacgatcttgtacaagctcaagcttggagagatcgtgactacgattccaaccattggtgagtttctaactttgcatactctttctttcatctaattattattcatctctaaacttagtatgtgaaattgacacattgttatgcaatcatctcaagggcttaggttgaatttttcgtatcatggttggattcctagattagattggaacttgaatatatagttgcaagttttttcatttggtttgcatgcggtgtacttctacttgctcaagggcattcatctttgattcatggtttgtgtatgattcatagaatgagtgcttgaattttttagatctgtcgtattgacaatacctgttcttgctaggtttcaatgtggagactgtggaatacaagaacattagctttaccgtgtgggatgtcgggggtcaagacaaggtattgtgattacagtcctttaccagcattcgacaattactatagctaaatccttgattctccatgagctgtcctattttactgaatggcactttcactattccaatataaccttttttgtttgcttgctcatccagattcgtccattgtggaggcactacttccagaacactcagggacttatctttgtggtggacagcaatgatcgtgaccgtgttgtggaagccagagatgagcttcacagaatgttgaacgaagtaaaactcaaacaaaaatctccttctctaatgttacattatgaagcagttggcatcattttgtttcctttttgactgttgcaggatgagttgagagatgctgtgcttctcgtttttgctaacaagcaagatcttccaaatgcgatgaacgccgctgagataaccgataagcttggacttcactctctccgtcaacgacactggtgagccaaagaaaaccaaaccaaatctctttatttaccagatacctatatcgtaacatgaaaagctgatgtaaatcgttggtggggtttgttgaacaggtacatacagagcacatgtgctacctccggagaagggctttatgagggacttgactggctctctaacaacatcgcaaacaaggtatacaactttacaatttttgaaatcgtattagtaagaaattgattgttaaagacttactcaaatgtgtgattaacttgcaggcttaggagaacaacgtgtggtttggtttttaatcgaggagagtcttgtcttcttccttctatcttttgttctttcgtctcaaactcttatcatttcatactctttgttcttcgctctaataatttacaagtttttttttttgttgcttttatcctataattcagactcttataaaatggggcccaatttcggcggatattccaattttttttttttttttgccggcatccaatttctttaggcttctgcatttaccgaatatatttctttgagatggcccaaattcgtgagatgaacttgaaaaatgttggaacagaatccaaacagtattcaaacggtataactaagagaaatcaaaatcaacgtattttgattcctatatgtcatcaagtatactaataaaaaaaaaaactgaatttagaactaatccgcaaatctgattggatgggggcagcaccagtacaaagagctacagttcccgatttaatcataattaaatacgttgtaagaaaaatgaagaagaagttaattaatagtagatctccactacacttttaacaattacatacactcaaaatcttagcggcattttttctaaaggtttcccaaagaaggagagctcactttatctttcgtctctcttcttaggtctagggttctggtggagaagattgtggttgtttcttagggttttctgagagaaagc

SEQ ID NO: 14448 - DNA, 3000 bp, Unknown
  misc_feature (1)..( 3000): cDNA_ID_3017172_gDNA_ID_2684119_Annot_ID_190896 3000 nt of promoter + ATG
attgaacaagtaaatacatacatatatatgagataatttatggttctgccactgcatatcagactcttgccaacttatttggcaccattattaatctaatttgcttttattgactaccatgtttgtggtcaaatatttgactaattttgtttaggaatgaacctattaaatctcttactttgacgggatattttaaggaatgtaatatattgaccaagagattagggtatgcattttaaccggagtgaacataaaccgattcaaatcgaactttcatcaatgtttttccttcaactgaacggtttgatttaattttaaatcgaataaaactgataaaccatttttatttacgtatttctagttaaaatagtattataaatccaaacacgtttgattaatgtaaaataaaatttatttagtttaatttttcctaactctaagagccctaaatctatagggaaaacatacaaaatcacattgaattacttttccttttctaatagtcttactgtaatatttaagtaactagatattaacctccggtataccgcaagtaggcttatattttagttaaactaaaattttttattgtaaagatgatttataaatatatgatattattttatttgattttaaatgtatagtaaactgcgagttgtatatgttttgttgatattatttatattgtttagtgtttaagattatatacttgtattttaatttttaattttagagtttcacctgtagtataccatcttctattataattaatatcgatctaaaccagtcaattctaggattttccagcttgtattaaaaattgaatcacatcatacacataaaaaaatctaatacgttactaattattgtaatatataagattttaaatttttaaaataagatgtatgaaattgaatataaatattcaaattatgacccgttactcagtagaaagttttcttaaatctatttttgactcgttataatatattttcatgtattgaatagtttatatttatttttaaaaattcaaattatggcatatgcaaaacaaactctaattatttttttataacgatgatattatttttttgcaaaaatagaatcatatgaactataataattaataaaaaaataatttgataatttagatatcaaatctaatttgttgattttaattggttagttttttggaaattaataatgtatttcgtttttctaattaaattaaattaattaaaatttagataatttatggttctaccactgcatatcagactcctgccaactttatttggtactattattaatctaatatgctttctattgactaccatgtttgtgatcaaatatttgaccaattttgcttaaaatgaacctattaaatctcttactttgacgggatattttaaggaatgtaatatattgacattagggtatgcattttaaccggagtgaacataaaccgattcaaatcgaaccttcatcaatgtttttccctcaactgaacggtttgattcaattttaaatcgattaaaactgataaaccatttgtatttacgtatttctagttaaaatagtattataaatccaaacacgtttgattatggtaaaataaaatttatttagttcactttttcctaactctaagtgtaacaccccaaatccaatcccttgaatccaccctatttgttttgttaaaacaaatgtccatggatcccattgaagcccaagtgaagcaagtcacaaaataattagggttttgttacatgtgtatgtatatatgcttatatcgtcatcttcccgcatccttctcacgtcatcatctccagcaactcgttactaacttaagaacatcaaatcaacttgatcccaagccaccatcaccattgacgttgagatcggagttgttggagcgtgtggttttgtttttaatcacctacaagtgtggagtgaaagcgaatgtcacggatcatcaccattaaacaacggcttgattgggtaaggaaaacctaatctatttagaaagaattgtctctcctagccattgaatttgtggcagatatatcaagttagcttttgggtttttgtgtgaatatgtgaatgaaggaagcagttcaaatggtaaaattggtgatccgtttcccgtcacgtctgaaggagtttgggcgatttcttaacggttctgaatagatctcgttcccaagttttcagaacagttttccgatccaaaatcagaggtaagatcaatcgggaaatcgcgtttaaagttggtcaatagtcacaattttcagagcgcagttttttctaaagtatctaagaaacattgtagtttcacgtagaggttttcaggatcaatttcccgttgaatcagagagaatcaagcgtggcgtgaggtgtcattgcaataatcataatgtcaagaatccatagccgctgaaagagatagaatcgagattatattcaagaagttatgagtgtttccttctgggcaagtaactgcagaatgtatccacatctgtgctaagtataaatccagaacagtgtgtaactactggttttgcgatgtgttttcccgatggaccaaaaggaattagatcacgatcaagatgtctatggaaagatcttgcttcaaggaacttagagtagctgacatcttgtccatcggatttaagctccatccgtatttgactttgaaaggttgcccagaatcatctcaagttgcagaaacctagatatcagttctgatgcaacgtgggagattcatgtgagatctgatcgagatgaaacttcgtggacttattcatgatactactggctacatattaaacggtgggatcacgtttctaacggttagttctcgacttatgagtatgttactgagacagttttgtatgaagtaaaccatgacaagtttttattgtttgaatgggaaacgggttcggttggagctgaagctttgcagaagcctttaggactcatggagtaaggtttttgttg

SEQ ID NO: 14449 - DNA, 3000 bp, Unknown
  misc_feature (1)..( 3000): cDNA_ID_3017159_gDNA_ID_2684119_Annot_ID_190900 3000 nt of promoter + ATG
ttaaaaactatatattataaataaatcgccactttatagttttaattaataactaaattacactttctagtcccttttcatgtggcgtatatagacttttctagtctatctaaaaatacactacactatcgtgcacatcaatcaataaaaacatatattccaataacaaatctggaaaaattcatttcaattatataagttaaggttactgaaaactgccaaaaattcagaagaaattacggaaactaaatctcgttactataattacgatgtaattaccgttaaaaaggcaataaatctagtactagtgattaattaacggtgccattaaattcagttatgtgtgttttaagtgttaactacgagacaattcgccagctggcgagtcccacttccctgatttcatcaggcttttatatttattcactgcttcatagtaataattacttcccaaaagatttttttttgaattagaaactgaatatttaaaaaaataaataacttaacggaaactgttacctgacggcggattcatggaaacgtttatgagtctgtttttgacggagaacgtgaaggtcaccgccgggacaaaactccgttaataaacagagccatttcggagaatcaatggcggcgtaaagcgtcggaagaaacggatgatcaagagattcgagaatctctctctccgtcttagctctaccttctttgcttctgctcgcgagctcctttttatccataactttcgctgctaacagaggtaatttaacggcggtggtttctgttacggcggttagggatttgaattcggctaagaaaacagagccgatgtcgccggaaccgagacggagacggaatctgagatcggagagtgagagagatgatcggagtgaaggagggagtttcgaagatgagaatgaaccgtgagctgatggtgctggtgttaaagctgcggcggaggaggaagagcgagaaccggagcttgtgcttcgattcacggtggttccggctgatgtaaagcttacactctgtaagtcgtcggttaattcgtcaatccatggctccattttccgatctactgagagtgacgacgagagagagaagaagaagaagaagaagagagggagagaaagagagaagtaactgtgagattttgcctttttggggaagagaaaaaatagaatcaaaagaagatggcaaagttgtaatttaagggttgagatatggtgcgtttcgtaatttaaggtaatagttcgattgttaaggagatgatgatacagtattctataattgagatgttttatttatgtaaatagacaataattagggaattatttgagagggatttttgatttctctatgaatttttaagatctttggtataggatttgtttcaaaagagagaaacaaagagacatataaatctaggcccctacagaattaagataatgacatatacatatcttgtgtttgttctatttcagttgtgattactagtattttcttcgtatggtacaattataaataaatatctaatcactgtcttttgaatattatgtcaccaagtacaaggatggtgttattggtgaacaatttgtatcgtgaactcaaatccctattgcacgaacctcaggttagtggtcgactggtcgctcggcctcgttttcatttcctttgaaaccattatggtttagatattggtttaactcaattgcatatacctaaccggtttgactcgggtgaatatgttagataaggaaagtgtatataacccttgtattttctcattaatgaaatcagcagaaacattttaggttggataaggaaagtgtctataaccatatcattgaaagacaaattgcttgggtcgaaaccggttttgttaagtccggccctggatatattaccaatttgtaacactcgtcttaaaccggatattttctagtcagaccgaaaaaatacaagtgaaagaggttcaaataaattgataacttagaacattcataacaatgaccaaaacaaatcttttcaatgaggtttgtaaattgtaactatatatccgaattaaaaaataatcgtcataagtactaactgtttttcggagaatgaaatgggctatctgttgaaaaccttaggcctgagtttaaagaccatctgtacaattgggccaataagtaacgcattatccatcaacaaagtactgaaacatgagacacttagaccatctccatcgggggtttcttgtaagaatttctcacaattaaaaaaaaaaaataataaaaatgaaggaaaaagagtgtagaaagtttctcacttgagaaactctgagatactctttacaacccatcatgataattctcttctcattattggttcaactttttaacaaaaatatttttttaatcaaaaaatcaaattataatataatattaattttttgtttgtttgagaaactttgtgggtttctcatggataaaaaggcccttaacttgtcatagaagttacaacacaacatgaaagttaaacatcgccggccaaaacaaaaatatttctgtgaatttacacaaaattatttgcattaccgaccataatgttctcctcagtaccttcaacacaatacaacaatacattaacaaaattggtcttctagcattagcctcgtctctaaaatctaacatcttcttctactcctaatccaacaattgtttatgtatattcccaattatacccctctattactttgcttattacggaaaaggagttcaaagagcagaagaagaaaactcgtatatcccaaatctccaacttttcaggggaatgatgatgtactgtcccaacctcacggcttctctaacaatcccttcatatttaccattttgccactacactagacaatttcgtccttctcatttccgatcatctgataaaaacccgaatctcgtttctatcatccgagcaaaacccagaatttctcattcgcttaggtgctttgtatcatcttca

SEQ ID NO: 14450 - DNA, 3000 bp, Unknown
  misc_feature (1)..( 3000): cDNA_ID_3017119_gDNA_ID_2684119_Annot_ID_190912 3000 nt of promoter + ATG
atggattttaacggctaaaggagtgacctactacttttggagaatcaggttcctttctttcttcttcaaactatttatgacaaatcgaagattgggacgtcaagagggctagttgagataacaattagtttcttcgagggttctatttccatagatataccatattgtttagaagaccatcaattagaggcaaaacatcttcttgatctgattcgaataattaccatgcctcttattcctaaaaaagaaaaacaagaactgggtcttcctcgctaccttcgtcgcggccgcccttttctaaaactgatcccctcagcaacaaatcttcggtttagggggataaagttcgaactgaggaacaatgcaaaaacgctattggatataagacacaaaagaaatcttcttgagattccaccaatgatctttgatgaatttctcatcttgttcttctttaattgtgttgcctttgaagatttttatgcttattgtaccaagcacataacaagctacgtttttttcatgggatgtcttctcgaaaacgaggacgatgcgagattgctttgccgcaaaggaattataacaaactgtatcggatcagtgaatgagatctctcaattctataaggtcatcggtacagatagccacttttatctcaacgcgagttacttagctgatgttttcgaaggagttaatgaatatagttcacgaggatggcatgcatattggtcggtattcaagaatacccagcttacttacgatactcctcgcacatgtctttcatgttgcactggtttgacgattctccttctcacgacattacaagccgtctttgcagtgtatgcctattatcgtcctccgaagtgactggtgaggtctatacagagtagagatccaataaattcattcttggtaatatgtagtttcttgtttcgttatttcctcgtagttagtagactcgcatctttttacatatttttaaagataattgttttgtctttgcttctttttttttatttttttttattttaagtcgtttcttgtctctcgatattccctctatattattatcggacttgggaaagcaccaattgtaacaccccgattcctaaaatttaccaagagcgagacaaacttgcataactactcaaaaatctcatcttgacctggagaacaaaagaaaagaaaagatgaagggtgagtagcgaatttctcattaatttccaagtattgtgtgctacgatgataagatgcatgatagttatgtctcatgcctatagaagcatttcatgtacaaatatgcagagaaagtaaccattatgtttcgacaaatcccatccttatctcaattggctagaaatggcaatacaatacttgctattggttataatacatgtatcactttttttaaaggaaaatcatacatattaagaaaacatattaaaagttgattagaaatgtattattttttgtgatttataattttctatatttctaaatctctatatatacatttttgcagccattttgtgaaataaatcctgtagttgagacttatttacaatgacagaatatttgacaatcttcccaaaatctctccacattaaccacacgattggttactacagtaaaacctctataaattaataatgttgggaccataaatttctattaatttatagaggtattaatttatcaataaattaataattattaatttatagagagtttagactaattttgtaatttttaaaaaatattatgtttaaaataatttgtttttatttataatcattatttttctagaagtaattgcaaataagactaaattatcgtgtctataaaataacaaaaaagtgttttcgatgtagtaaaattattaaaattgaacattactaagaattagtataataaaaataaaaataatagcagattcatatattactaatatttctaacatataacttatatatatatatattttaagaagtttttacaactattaatttatgttattaatgggacaatatatttacatagggattttaaaataattattatcttattaatttatcgatttgtgtcattttttacactggtcccaactcaggaccgcatttttttattagtttatagaggttattaatttatcgagtattaatttatagaggttatactgtaaaataaaactttcaaaatatttaatatcatttaactactacaaaattatcatttttatattgtttttctacataactataacaattatattataatcatcaaaccgcagagatatttgatagcatttaattactacaaaattacaaaatatttagacaatgattcataaatatatcataaataagatcgataagttttttttacggaacgagttggcgggacgggtttgacaggacgttacttaataacaattgtaaactataaaacaaaaatattttataaatagatagatagaatttgcaaaattttataaatactaactttaaaaaataaattgtccctgcggtataccgcgggttaaaatctagtttagtagtatattataatacctaaatttttatttttttattttcatatgttgcttttttcaaaagtttattttctcttcttgtcacatatattgtgtttttctcctttttatgaatatcttagtatagaaaatgttatatttttaaaatgttaattataatgtgatggctaaaagttttaattagtgagatggtcgttaaaatctatcgtagtttataagataaaatctttattcaaattaaacactaaacaaaaaaattcaagaggacgaactattttacatgcacaagcctaatgttgtaaaacggctcttgggcccaggcccaggaccagaccagcctatatttttgtccctagttcttcttcttcctcgacggttagctttttttaagggttcaggttctctagcgatctgtcaactttttccgattgcaatctctggttatgttaatg

SEQ ID NO: 14451 - DNA, 3000 bp, Unknown
  misc_feature (1)..( 3000): cDNA_ID_3017103_gDNA_ID_2684119_Annot_ID_190917 3000 nt of promoter + ATG
ctacaactataccaccattgtcttcatcattgtttcctctctttgcttcttcacgagggttcattatattattctctaaatcttttgttgaggaagacgactaaatttggtttgagcaaatttggaattccggcgtgtaccgtagcatgaaaagaataaggcaatctaaaatataaaactaaatattaatattacagtaaaaacctctataaatttaatattgacatcaatgtattatagtgtacatgaaataagatctcatcaactaagatgaatattaacggtttagataagacattgacctttaaaattagtaacgaaagaccactgactaatgatgaaactaattaatagtcattataaaataataagtgcttctcgtttccctgatcgaagttccgcattgaatagtttaatagcacaaattggtatttctttatattttcttgacaatatcaaccgttagatattaacgttaacttcagagaaatcttgtcttcttattctaacgttaacttttattttaccaaatatctttttacagtattctcaatcaagatcaactgataaaaataaattactcacttttgacttaaatgcagaaaatatattaaggttttgaatggtgacagtgatttagatagtgtgggacaaatagttataacaacaatgtgatgcgataaaaaaaacgtatgcagaacaaatactgttaatatagaagaagcagtgtaaaacatttagtgtaggtttttattgtaaacacttaaactttataaaatgtggttcttactttgtgataaaagtctgactagttgtaaaaattgtgactgtttgaattcctctaattcatttgtctgcaattctaataatttattataactgtgaagaaaaaaagagaaccattaatacatcatgcatccaatttcctagatagataaatttattttactagttgatataaaatatgcatttgctggtaattagactatttttgtagtaatttttttttaaaaaacttgtctatatatatatatatcagatttttggcgcttatataagagattaaacaacaattttaattaagatgaatactaacggtttaaataagactattgacgttttcttaaaaaataaaataaaacaaaaaccattgacgttggaatatagattgttagaattcaattttacatatgtggctccggccaactttccggcgacttttccggtgatgtatgtcaccggaatcacccgattatggagtctttgaatttcttgtaatgagttttgaccagaagaataaagaccactgcataatatactactccataaaattaccctcagatccagctagtaaaaattatttttcgttatcaaggatgtgacaaagcttgcttaatcaagacccattttacatgacatataaacatgtttcagtggacggacctgaatcttgaggttgcgattgtaaaactaatatttagggttggtgtttttagagttgcaatccttagaacaacaaaatataagaaataagctgcgataatatttagaaacataaattgattggagaaaatgttgtacttaaaagttaaaacgttaaaaaaaactacagcttgtaaagtctaaataaactaatcatccccttaatcttgttatagttatggatttgtttaaacgaatttgtccactttgattataacactaagcttgggctaaaaaaccggattcgatacccaaactaataatcagacaaaaaaaactggattagagcgggttaagattttaggaattttattgggtagaattttaataaactcatgggtatctggtcgatccggagtttacccgttattcaaataggctacatgaaaaccaatcatataatttaatatcccaaatattaattatatttaatcttagtataataaaaattatctaaaattataatcataaatctacatatgtcaattaattttagacctaaatatccaaaacaactaaattattccaaaattatttgttatatttatcaaaatttaataaaatatattcaaatgtaactaaatttatttaaaattaacaaattttgtaagagtttatttgggaacccgatatttacatacaaaatacccgtttttattttttgagtatttatagggtttgaaactttttatccaaactgacttgagcccgattgaacccgatccgaaccggaaccgtatatttagatctactctagtggtaggatattagatacccattaaatccgaactcgaactgttttatttgattctgcaaaaaaaattattactggttgaattaactttaaataataaatagttttaatataatatataatttatgtcgtttattaatctgtgtgtaaatatcataaacatcatctatattaagtactatatatctaaacacgaaaatcagattatttttttgtttgctaaacttattagcagagtgaactagcattaccagaacttataccagatattatagagaataaatagcatctcatccaaaccacatgtaacaagaaaaaatatcgctggcttctcaactaatatagagaaaactaagacgttcaataggttaaccttagatccgattaccaataaattaataaaattaccactcgtcaattttaaattgatcttgtttcttgtaccattgacattgagaacgtacttcattaaacttatgttttatataaacaaagaccagagattaaataaatgaacaaaaactgtcacatgcacgtcaataacatgtatagttctactctaatgtgtatcgtatacgtagtgggtagtaattaaaccagattgtaagacttaattaattaatgaatgaagaagtgtcaagtcgttgagatcaacatcatacatccataatccattacttctacagttgtattacttatatatataaacaaaaattcacgttagcctaaacacaccaaattaacgaactacctcacacaactca

SEQ ID NO: 14452 - DNA, 3000 bp, Unknown
  misc_feature (1)..( 3000): cDNA_ID_3017099_gDNA_ID_2684119_Annot_ID_190918 3000 nt of promoter + ATG
agcattagtggcattttttgcgagagaggtatctccaaaatactcacgaggtatataaatagacactaatacttttgcatattatttattcttgttttgccgacgatgcatgacacatatatactatgttcattgagttgtgtaattctgaaaaaataatatcgcaacttatagattttattgtgtttttctttctgatttgcgtaaatgagtagagacgatacctcctctccctcccatgcccatgtccatcatgcccactccaagcgcgcccatgtcctcggaaacgctggtgaacaaattgatttatggcaaaaaaattaaaataaaacagataacatccaaagtgtgctttcttgtatttgctgtcttatgtgtctgttatggagtttagaaagggacattgtttacgactgagatgtatacgtccatcgtttttacgtatgaactattcgtaaacaatattttctttgttttgatctattcatgtaagactttgccaatattagaactctttatggaacacaatgttacatatctacacgaaactgaatacccagtttttttaagaaatacaattcagacagacacagtgaataaaactaagtaaatgatgtaatagctaggcgatgactggtcattgagagcttaccgcactaaactattgtttatataaacaaagaccagtaaaaaaacattcatgtgcatgcacgtcaataacatgtgtctacttctaatttactgtgaagcgtattgatgattaaatgaatgtaggaaaatatcaatcgatatgcatagaagatgtgaaaattagatttttactattaataattcaatattagatatgtatgaaagaaaaaaaaattaaagtcataactgtcattcttactttgttaatttaccaaatatgtcatgtatcaactattttatagtttcactatatatcaaatatcttaccatatttatgtaaatattatttagatatttaatatgttagcacgatatattcagtataacatgttattataattttaaattgatgatttcatattaatttgtatgatatggtaaatggtttaatatgatatatataaatttatcgtgatactatactagttaacatgttaatcaaatagttatctgtatttagcgcgatattatatacttgttaacattttaatcaaatagttatctacataaatcataaatgttttatgcaatccaatgataaatagtgttgtaaattttggatgaatagtgtcgtcaggtgtaagatgaacaatatcatgcttacagtatccggtaataaataatgttgtgagacaatggcatattaggtaaattaaatagaatataaaagatatttatgcctttaattttattctctttcatacttacttaatattaaactatttataataaataactaatttttaagttttccatacatatacattaatataacccttaaatgtaaagtctcgcgttgagattaaacatatcatacatccatcacccattacttctagagaaatatcaatggatatgcatagaagattcaaaaattaagaatctatgcatgatttttttttatttagttctctttcatctgactcaatttaataacaaaatatcctttgttacatatccacgcgcgataacaacaaaattatcagataaaagtttaggaataatatgctcattaatttatctttttaggtttaattttggtgtcattcttttttctcatcactagattacatgatcttttatctcttatttgttttctggtaacaaaacatcatatttgatgtaaatctgattttcaaagctttgaaatcgacatatttacttaacaaaaattttatgctaacaaaacaaaactgtgagatattttgctaaatgaaacattagtacgttacaattatttttaccgtacttttatgtcataatgaatgaaagaaaaagaaatattgaaaagtttatatgatatattgtataacttagcatattaaaaataaatctaacacattactaattgtatacctctttaacattttttttatcgcgatatcatatgttttaacatgatatatttctttacttacatgtatatatattattatcacgttaacttaatagataatcatcaatttataatatgttattcctcaagtatttgatgataagaatatcgataactattttattacattgctaaataatttgatatatgtgatgagggcattttcgtccaacttacataaatatagagagagaactaataatacaaaaaacaatgatatattcttaatttttgatttatctgggcatatagattaatatagcccttacttctataaacaacaattcacattagcctttgacgcaccaaattaatggactaacactcggtagtcacaactcgatgatattagacatagaaactactttgagtgttaataagagaggcaatatagccacgaaaatgttgaagaagttgagaagaacctaattatctcttaaagatccctaccattggacatgataattttaaaagcttcaatgaagatcattaactttagaattttcaaaatttaaaattagaaaattggtaagagcccctcatgacctcttaccattgcggattgtgatacgttcatgagaagttggcacgtgtgagaactaaagtgagagattggagtcacgtgtgaagaagcttataaatagtaagagagagtagagagaaaaggatcctgcgtgatcattgatgtgtaaagaggattagagctttatgtgctctgttcttgggagataagattgaagaactgtaactccaagcttatcgatttagggtttgtttcattgtaattgggattttaaggataagaaagagagattcatagtttcattcttatcaaatggtgcgttagtgtgctcggatcgaatcgaacgcaagaagattagggtttcaaaagttggggatttttgtcaatcgca

SEQ ID NO: 14453 - DNA, 3000 bp, Unknown
  misc_feature (1)..( 3000): cDNA_ID_3017111_gDNA_ID_2684119_Annot_ID_190914 3000 nt of promoter + ATG
gagagattttcctaatttggtaacttttaaaaaatttctataagatttctttcattagaaaatatatttctagaatcagttacaagtaaaacataataataatgtctagaaaacaacaccaaaagttttgatacgataaaatatgaaacctatagtcaaacaaagaacaaatatgaatttaagcaaaagtatattataaatatattttaaagaaattttttacttataatatatatatatatatatatatatatatatatttgatacatttatacaattattaatttatgatattgatgggaccatatatttacatagaactttcaaaaaaattattatcttattaatttatcgatttgtgtcactttttatattggtcccaattcgggaccgaaaaaatttattaatttatagaggttattaatttatagagtattaatttatagaggttatactgtagtttttttaaaccacacaatttaaagttttccaaaattttaaattttacaattgaataaaacaaaattaaatatcatttaactcattcctttgcaaaatagtagatgaagggttgaacaatttttctttataatttgggaaaaattacatcatttgccatatttttcaaaatccttatgcaatctgctatatttttcagggtcttacaactcatgccacatttggttggaaaatgtccattttgtcctcatcatttcttctctattttatctctctttcctcgatatccgtgcattttgaccatacaccattatctttccgaagacaaaacgaaacgttttagtctctctatcactttccctgacaacctgcacagattctctacatgtaactttcaattaaatttgtctcccaattttattcatcataaattctctgttgtatctagatcttgtccccgattttatcatctttcaaaattatcatataagatggcaaaaatagatggcaaaaaatagatggtttcagtttcagcatctctgtgaagacaataacgctcaactaatctgtggaccaaaatagatggcgaaaatctaaataaaattctaaattctaaaatgagaacaattgcatataagatgtaggattcataataatagagaaacatgatgaaatcgaggacaaaacgtagatgcaacagagaatttctattcggagacaagatctggagactaaaacaaaagtcttcctccaattgttctcctctaacaggtaatcatgtcccctaatgcattatatattacgttgtcccccaatattaggtaatcatgtctcctaatatattatatattacgttgtcctccgcagaattttggataaccaatttgcttaaataagtcatttttaaatactcaataacaaccgtagaagccacctgttctccaatattctgttccctaatcctttatgcttccatcatgatttttcgtcatgtatcatcacatcagccaaaagttgttatgtcaccatcttcgtcagagcgctgacccaccttaaaggtaattttgtccacgaaattccacgtataattaaatgtggtagattttgtaaggcaactgaaaatatgacatggattataatttttgagtggaatatggcaaattttgcaagattccctataatttattcatttttttcagtttttttggttaaatagttaaaaattgagatgaatagtcatttaacattttcaaccttttattttacagtcacatccaacatctaccgccaaaaatctattgccaaaactataaagcgacaactggaaccaattagcgcagcattttttctttttctttcttttctgaatttatttttaattttcaagtaaaaagaaccacatgtgaatcgaaaagtatccaatataaaaaaaaatcttgacacccggttaaccctagatagatccacaggctaattaatgactaggatactaatttagtaaataaataaatttaccacttgttacttttttaaattgatcttatacagttgaggacgcacctcatgaatgacatgaaacaaagacttgagattataaaaatgtaacctccacgtcaatgtgtgatgtgaaccttacccccaaaaaaaaaaatatatgtgtgctgtgaagcgtagtcgttattaaataagagtatgaagtctttaattaatgaactaaaatgtgaagtgtcggagcacatcatacatgatacatccataagccatgacttctaacgttctatatatatacaacaaacaactcacgttagctaagaaataccaaattaacgaacaaattcacaactcaatggatctatacttaataaccactttgagtgcgagcgtagcaacctttctttttcttcccatactatggataagagtgcagaaatcgaaacggatccacccggaatataaacaaggtttgatctttaatgatatatgtagttctcaacatactaattaaacgtataatataccattcaaactactattcaattactttataaatatctcttctgattttctgagaatttttgttggttttgaatttctctcaagaaagtttctctattctacgtagtagctatggaaacttgcttcggttttgttttttttaactttttaaaaaatttccagttttcaatctcgtaaatgaaatttacatatatattcaagtgaaagaaaactttaaggaccatttttagctaagaggttttcaaattaactttataatttaaagcactttgatacgtacgtttctattctactagaatctgatcctttcagtcgagcggatcatccaatagaaattatttttaaaaaaaagaacaaaaacaattaacatacaagaacataaaaaatagttaaataacctcttttatgaaaaatgcgagtttatgaaaaaaaaaaaaaaaagataaagaagaaagtaaacaaaaagtatataaacaaagaagaagaaaataatactacgtgcatgcttcaccgtaatcgaaagag

SEQ ID NO: 14454 - DNA, 3000 bp, Unknown
  misc_feature (1)..( 3000): cDNA_ID_3017133_gDNA_ID_2684119_Annot_ID_190908 3000 nt of promoter + ATG
aaaaaagaaaccctacctcgtcgcagcccccaataaatacctcagcagaaggaaaacaactcttttcagttccattgcttatcattttctctgtttctttattcatttgtgttttcgttttacattctttctaatgttttttatttaacatcgagtcttatgttgctcgatatatatatatccatctgattgcaaatgatgagttaaatcaccattgataaaagaagctcaattgagcagtgttggaaatctaaaacttccatgactctgatgcaaattttgatcaagaaaaatcatatccttgatcttttttttctgttctttctcagattttgttaataatcactgaattttgcttttcaaatgtatttttctgtttaatcttaataattctctgcgtatttctcactagcgtttttaaatctattttttctattaatctttagtgttttttactaacaaggctgcctaaaaataaaattgaatttgatcaagtgcaaattgtactgtacaatatgtaacgaatttgatcactatataagtcacaatgatgagaaagtgaaccaaaaagcttcattcatatacaccaagacgaaaacatgaagaagatggaatcaatcagaagcggttttggtgccccaatagccgttaaaatgttgatattattacaaatctcataactaaacaaaaaaattaaccaacaatttctaagaatcgatgttttacgacgcatcgttatcgttgtctccatcgaaatattcatcatccctttggatctgcttatcccgtgaacgctctgaaacattccatatataacattagtcactaagaaaacaaagggactaaagtagagccttgaaggtggttatcgatacttacgatccacacgtacatccgggttttgttcgtcttcatcaaaatccggtatgtagaaatccggtggaacctaagaaattcaagtaaaaaaactgatcagtgtaagattgataaaagcatcaatgtgtcctatgatgatctgagtttacctcctgcatctgtacgcttggagcgtgttgaatgtatcgcaaattctccaaaatctgcactttgatcgaactgatgtacgatttggtattaagattctcctgttttcatttcaaacacacaaaatgattctcaatctctctttagattttgttaaagcaatgaggaactataagttacataagagctccttacaatgtgaccacccggtatcttcaaagaaaaatccggcgcaaaatactttatgtagtcgttttcaggaatctctgcagaaacaattaacccctgagccccaaaacattaaactttctctgacaaaatattgaaacaaacttttactaaccattaggaagttctgtatccaaaagaatgccagtctcaacggtccaacaacgagctacattctcctttgtgtatcctccacctcctgtaacctaaacaacaatcggaaaaaaactgacttattcgtagagaaattaaacacattcagcatgtcctgtgaaaagcatagagaaagccatttcaaaacccaattcgcaaagaaattagcaaacgggagattgaaagagagaaagagattttgattacaagaagaaaaagcaccatcaatagagagattaaagcatcctagtcgataatatgagtttgaatgtttgtagaggatatattaaaggcttataatgtgtggaaagccagatgcagataagaaggtaccgttagtgtttttttggtttttgctggactttggaactctttttaggagatttttcagagcattttcattgaatttttaggtctagctaatgtgagtatgaatgtttgatgtttgcagaggatatattgaaggcttataatgtgtggaaagcgagagggaatttcccgcccgatgcagataagaaggtaccgttgttgtttgttgttgtttgctggactttggaactctttttagaacactttcattgagttttcaggttaagcttatgtgttcgtattgcaagaaacacaatgcaagtttgttcctgatccatatgatggtggagctcaaggttttgagaaggtaattaccattagagactaagccagttgtggattagtaactttttggtttaggcagatgctacctataaaatttcagctatgttgtcttttcaaaatggttgatttggtttataagactttactatggcattagcataccattgttgtcactcccaaattgccttccgttcgagaattttgcaagggggaatgcttatatttcctgtttgatctattttgttaggacaaaagtcacttggaaagttgaatcttgatctgttacttgtctagttgtttctttcataggtactggacttgctagaagatgcttgtgagtctttgctggacagtattataacagaaaaatgatgtgaagcttgaaacttgctgatataaatcttgttaaactgaactctttacacgattgaatgatatgaactctttacaagattgaatgatattaactcttttgttttatcattattattattaggagagaaatagaaagaaaaaaatatatattgtgtggacgtaactttgtttgagacagtgaatggtggagcatagggacagtaattttgtcgtttgcaatattttccacaaaatctcactatattttccaggaaacatccatggagtttagagtcgtcaacgatctatatcttcagtcacacaaatcgtttcaactacaaaaattacactaaacccgtgtgattcttcaactctctagagatttctcatcctttcatgtatcggtgagattttccaactatttttaagttttgcttaaggttttatcactgtggaatcgaattgattggactggctcttgatgattatgctgatattgatgctttgattagtgttttgagctcatttcttgattatgtgttcttgattttatattaatttcttgattcatcgataatcaaagttctc

SEQ ID NO: 14455 - DNA, 3000 bp, Unknown
  misc_feature (1)..( 3000): cDNA_ID_1388438_gDNA_ID_2684120_Annot_ID_190920 3000 nt of promoter + ATG
ttggtagcggctaatgcaatatgaaatgaaaataaacatgagaaagatgatatagaataagtttgtactagaaaatattaccggtatggtaaagcaattatatagttacatggaatgatatttgcagtaaattgttcaaatatatgggtgtgtataaagtggctatacatggaatgatatttgcagtaaattgttcaattatgttgatcatttgcttaatgttttcatggtaaaagatgcgattagtggctgtccaatacataaacaatgtttgctacaagcttcaaccctatcctctcttgcggttatctcagaacctgaagatgaaggtgataatacccctatgactaaatatttccctgtcttttttttctattttcgtattgttggtaaacttgaaatgtcataagtcaagtttgtatatttcaggagttggatgttgaatctttatgccatgagtgtggtcttgagacatgtactgatcctgatgggttcactgttttacccgtgaagcagtcaacctttcgtagtccagaggacaagttcaaagtttatgatttgattggaattgaacggattaagatgtcgatttgaacctcttgcatgttgtaatgcttcatactctcttatgataagaagaaattgaatttctaaaacacctaagttatataatcttatatcaatcagatagtatccatatatatatgtaaactacagaacttgaatgggttcaactggttatgacattttggtgactaaaccatttcttagaaaatatccgaccggatacggttaaaggattgattgtttacttttttttttttttcacaaagctaattttattatcagcacaaaccatatcagatacataaacccgagtgaattacgggacgacaaagccggcaggatataatcctccggtacacaagccggcgaggaatgaaaccccgacactaagccccgacatggggaaacgacgtagaaagacaaaataaaacatgattgatgattttacacataaacatagttctctctttaaccaaataaaccaagatcgaaaattaactggcatcggagatttcgtcggagattgagacacccactttaagaaaatttgatcttcttgccttacttgataattaaaaatcttcagaagaaaaaccttgggatactttggatggcagacggtggaaactcagctaaacatgcagagaccgtcgagaacgccgtggccggagatatcgactatgcgacttgaaccggtagaaagaacccaaaatctgggcggatttcgccctagatccgtattgttgaagctgtgtgaggaaacccaaaattaggtcacccaacccgaatcaccacaacaccgacagtgagtggcatagagcgatcgtgattaggccagggagtatttagtcagagaagaaaaccacgctaatttgcaaaatcaccaatcgaaactatagatctaataagagaaattgaggaggaaacgaaatcgaaaccaacccagaaatctccttaaccacaacttaaagagacataactgaacataaaccaaaaagccaaaccgacgtcatgaccgtggtggctcacaacgccggcggaattgaagcggtgcttttgtttttaagagagaaggaagaggatatattttttttttttttttttttttttttgaatattaaaaattgtttacttatgttagctgattaatattagtagtatcaaaaaccgtctgttacaattttccgataaggccgtccaattggttcaattggcttcagcccgacatccaccggcttagtatgcggcgatggtcggctttcgtccagtaaatccggctcccattagcggttttggctggcttggtattttcatctgccgtgaatcgctgccgtgaatcggttttatgccgatttcttttagtcctctttagtttatcttttaaaaatctctctgatctatgtttggtggtgccaacctaacaatttctcgttcaacggtggtctccaactagctccttgagttttgttttgttttatgtttccggtggtttccagtgaggttatgcggatatctaatccgaccagatcgggtggatttgctgctttttctcttggatgttctcaaactggttcttcagatctttggttacaacaaatcttcatcggtaattatgttcaatgtaatgaaagaagacttgtttccagcatattaagattgcctgtagctgtttcaacattctccggtgacaagcaacaacaaaaaacgatgcttaaactttttccggcgtcgattgtgtttacaatagtcggagtaattaacggcgaaggatgacggaaagtttccaagcttttcttgcaacacgtttcatctacgtatctttgtgtttgacacgtgtattgagcaaaattttatctttaagtgatgtagccatttgggccattaatgggttgtaaccattgtgatgtggattttaataaaactaaaccttcagtgaaaaaaaaaaaaaagctgattaatattaaaaatccaaccagtttataatccagaacaacggttttcttaaattgactagtgacccaaattcttaaataggctacaaaaaccgcaggcccatttagtaatatctatttttcgtttgactgagagaaaacaaaacaccatccaattccaacgcacaaaaaaaaaaaaaaaaaaacttatcggaaacagaaaaaagaagagagagagctatcaatcgatcattgattgattgcagagaagcagcgaaagagacatttccaaatctaatctcaatccaatccaattcaggttttttccatctctctctgttgagctacttctgaattagcttcttctatgttcgatttccagctgttgatagtttagctagagaatcaatttcgaatttcatcttgaggaagcaattttagtaatttaggttttgaattttccttttgaggtgttgtagggttgttgctaccttcacgaatg

SEQ ID NO: 14456 - DNA, 3000 bp, Unknown
  misc_feature (1)..( 3000): cDNA_ID_3017265_gDNA_ID_2684120_Annot_ID_190922 3000 nt of promoter + ATG
ttggatgacttgataattaaccaaagattttagtgaacactaacccacaaaatttctgaatgttttgaaagatatacactttcaataagtgaaaaaggaacaaccccgaattagtatctttgcgcaaacatgagagaagaaaaagagtggaacatagaatgggtgagagagtgacaagtgtaaaccccacttccattaggttcattcccatctttgccaaatggattttgcggtttggcttgacatcaacgctaacagccagactcactccaccatacacctaaaaagagaaaaaaagcatacaaaaaggcttttatagctaaatgaataaaagcatttgcatcagaagatttttgaaatcattattgtgaaaaaataaaatcaaaagtaaaaccttttttcaagttgacaaataaaagaaaagaaaccctatttttcaatggtaacccactttctcacatttttctctttattctcctctatagtatgtgtgtgtgacgggttgctccactaacttttgtgaaggtaagtataaagccggtgcaattatgcgtttctctgtttgtatttgtaatctttatacaaaccataaattggaacaaagactaaaatgacagtaacaatataagtgaaaaacataatttcattagctttaagtcacgaggcacgaccattgaacatgcgagaaacgcgtgtacccaaactcattggttagttttgagagcagcagcgtattcttacacagttctcatatgtttaactccattcactctctcaaaaggttcccatctttatcaaaagacttgctaaaatcttctctttctttctcctttcatcacactcttgagtccttgtctctgtttttagtcacctgaagaaaaaatatatggagaacggagaatctaaccaagaaaatctcaaatctctcaaccacgacgaatcgcttaagaagccatctgcttcctccgtcgttgtagataggttaaaacgtgatgaatggagcgaaggagctgtttcgactttactcgaagcttatgagtcaaaatgggttctcagaaacagagccaagcttaagggacaagactgggaagacgtggctaaacacgtgtcctcacgcgccactcacaccaagtcaccaaagactcagactcagtgcaagaacaagatcgagtccatgaagaaacggtaccgttctgagtccgctactgctgatggctcctcttggcctctttatcctcgtcttgatcatctcctacgtggaactcagcctcagcctcagcctcaagctgttctgcctctgaattgctctgttcctctgctcttacttgagccgccgttgcctgcggtggctcatccgccgcagatttcttacggatccaacggcgtcggcaagattcctaaggtctgatcacctaaactaaccaaatttgggagattttctaatgaagttattttgtgtgtaggaagacggattcaagccggagaacaaaccggaaaaagatgcggagatggatacagacagtagtacgcctgtggttaaaacgaaggtgagagggaagaaagtgaagagaagatataaagaagagaaggaagagatcgccggaagtatacggtggttagcggaggtggtgatgagatcagagagagcaagaatggagacgatgaaagagatagagagaatgagagctgaagctgaagctaagagaggagaattggatttgaaacggacggagataatggcgaatactcagctagagattgctagaatctttgctgctgcagcttcttctggacagaacaaaggtgttgattcttcattaaggatcggaagaaattgagttctgctttttatattggagactcaagatgttgtgtgtacataccaagtgttgttttgtcaaaatttctcagagagagaccaataattgtttcctggggtagatggcgatttccacatttctaccagcaaatgtatgcttttgccatatgaatatcatcaatctttagtcaaagagatgctaatactgtctcaaatttgtgtgtgtttaagtgttttaactcttcaggtagagatttacagagaatgcttggtagatagttcggttcgatcagtttggtcgtgttagagattgtagtgaaagagaaaataagtcttagcaaaagaatgcgagacaactgtctagtattagtggagatgaaccagctttttctctttgcatttctaatatggagttttttttggatgggaaattgcactatgatagtatgattagtggttctagtctatgtgttttgaatgttagcagttagattcttgttagggatagttgatgaaaagaaacctaaatttgtagtggtggacacattgttctctgctgtctagagagtggccgtgactactagacccaccaaccggcctaagcttgcctgtataggggtgggaaaaaatagaataacaccaaaaatgaaatgctcaaatgacaaaatcaaaattgatttccttcaaatatatctaactagactattgtttgtaaaaaaacaaaacagaaccgaatcgtaattgcacaaatgactaaaccatatattcttcccaaaaaaaaaagaccaaaccgtatacgaaaggtttgatttggtatcgatttaaaaagaaaatctgcaaaaccggaaagaaaaacaaaacaaaacttaaaatcaaattttccaaaactatatatgtaaattacaaagtgtagggaaatgtgaaatgttctagattcttacttgagttgaattttgaatgctgcatttgtagaaatgcaaatttgtgtacaagtcagaaccggtgtaaattaaattgacccggttgccgccagatttaattcgctgagagtactgtaccggatttggttctcttccggtttattccaaataatagttcggtaacagctttgattggttcgtttcttcagagtctggtttgggacttgggagggaagaagatctcgttccctctaagccatg

SEQ ID NO: 14457 - DNA, 3000 bp, Unknown
  misc_feature (1)..( 3000): cDNA_ID_2998410_gDNA_ID_2684120_Annot_ID_190924 3000 nt of promoter + ATG
acatttttttacgtttgttgatgtaatgtaattatgtaaacacaaacattttacctacattagaatttctatttcaaaagagaagtaaggcaagtcatatttttataagttcaatttaattatgataattcctttattatatcatgcatgtcgtacaaaatacaccaaagtctaaacattacatcttcattaagtcctgacaaatattaaacagttatacaataaactttagaccctaaataaagtcgaaccaaatctaaagtcatttacaaataaactaaatctctaattcaataaagcccttaagtaatgtcaaatctttgcaaactctaacattatactggtgttgacgtggacttggtcagaaatttgtgtaccttggatgctttccaaacacagacgccttcatctcagatccgggttcgaacctcaaggtgactccacagcatgcataactcataactcctaacgtcttttttctgcaatcggtaagagaaaactgcaatccaaaagttacttgcttcttctctttgacatcttccataatgtatgttccaatcgaactaatgttttcgtcggagacaacaacagaaactttaagaagctgaggacagcggtatcggaggttgttaatagtaaacagcttacttttgtggaggtgaggtaaagagagtaacattcttgtaaagaaatgaaacttgaaagtctccttgaagacatatatagtcaccaggaagatctgcagggatccttatggacaaatcccactttgcactaagacgagtctatgtgatattaagcaccatgaagtccatagaagctaattctacttttggcgccggacgtttgcattcgttgatgagtataaaaacgaccaaaccaataatacatgcaatgacacaaacgatcaagaataagctgcagatcctctttcttgtactgggcgtgggtggtgtttcatgtgccattgtgtgctattggtttaaagagagacgagaagattttgttggagtgcaggaggaagatgagagagtttgattaatgttagagatcctcctcaagcctcttcctctcactacttaatctcatcagtcctcaactactagattaaaggctttcaactacttatctgatcttccttaaaagtttaattgttttattttcattttcttttgtaaaggtaaagaaatactccgttttattctcacgtgatttttttatcgtaggtacatttaatacaactccaagttatgactgggaatatataaggaaaaaaaaaaaagagagcgtaatctccattggtgagatatttcaaaaagtttctaaaaaaaataaataatgatattttattatgatttaacttctgtccaattataaacacacatatacacatagtctcttaatcattattctaaagtttctctgcagagaaactattctcaatctctcttctactttattatcattttatattttttagttaatgagaaactatatgagagactactgatggagatgctctaatttccgactactcctactatgtttgggactcttcccattgtacagtgttaaggtcaaggtctgatactaacataaatttagaagtggcgtacacgcaaactagtgggattaaaaaaaaagagtattaaagatttaagaaagagtattatatatttagtcaaatgggttattatatactaaataggaaacaaattaaattatgcaaaccgcacttaaaaagtttttttatgtataagttacttcattatctagactcttgagttatccgatccattgatattaataaacactgaaagaatttgtttccattagtttaaaaggaattaagctttttaagtgcatttcacattttaaaaaatagaaaagaagaaagtaaaacaatgttgttttttaagggaatgttgatcggaaaaataaagtgagtttgtaagcttaagacgtgtaacttttgagtaaatttccgacgagatattcatttttggcttacatttgttaaatcgtgtaactttattaaattttacatttgttatattttcgctgcaaccactttttttcttacaaaacgagtgactaagtggagactaagaacaagcaaagctacttacaactacatacaagggtcaaaattttctttggttcaatccacacaacatgaaaactctatcaaattatatcaaatattttagtatagaggatattgacatatcacattcaactcttaagaaacaaacaacaatgaagatactttacaccattaatttttttaataattgatggacagcactacatagtggagaagaggccaatgtgagatataacccaccacatggtaatgagtattgggtagttttgatacattccataatatgcaacaatacataatgcatttatgtcggtcttccactttctactcctcacgtgaaacctttgatctttctctttgagaaaaaaaaaattcaactcagtttctcggatctcttaaacaataccactccacacgttcctctgctatttcccttatcgttgtataaattggatatttatcaaaactgtaactattttgttagaatgagaatcggttttatcaatataccgatttttttttttttttgctaagagtcaatataccgattaatcagctagacttccagtttgacttgattaccattcgataatgagtctaaaaattacaacaccttgggtaatgagtttttgtggatggagagcaacgcgcatgtcgatagagaagagagccaatattagtgtggacccaaaaaacagatagaaacaacgaaaaaataggagatggaatacagactgttctctctacgatatacaaaaccccactcttcatttttatattcttattactttctacacactcatcgtatatcactcactatataaacacacactcacacattcactctacaaacactagaaaccacaaagacaaaatcaaggtcttaaacaatg

SEQ ID NO: 14458 - DNA, 3000 bp, Unknown
  misc_feature (1)..( 3000): cDNA_ID_3017261_gDNA_ID_2684120_Annot_ID_190928 3000 nt of promoter + ATG
aacattaagatgcatatgatgtgcccacaaaaccagcatgttggaccacttcggatcaagttttatattacaaaaatgatagttgaaattaaggtgatataaaatgtatataaatagaaagtggtgatataaaatgtatattaatagaaagcaagtacctgaattgatttgttctggcaagaagatatacttgattagaatttgttgactccaacttgtgctcatcctcctcctcgtagcagaggccgtagtggtggcgcgtggagctcaatcgccattttttcagagcagccaccatgacctgagcaaccctcgtgaagggacttcccaccggaacttgttttcgatattttggaattcctatcagaaatatcactatagctatcaccacacttcctgctattatgctgaatcctagtgaccaactcactcgttcctgtgaaaaaagaaaaaaaaatagtaatggtttgatttgagatataattaaaaagcgataattttttcacaatgtgagggaaaaaaatgaaaaataaaactgaaaaataatatcatcaaataaattttgtattcctgccaaccatgttagttattatgccaaccaatttttaaatatgaaaaagtttacgtttatatatttctacattatttaggttatctaacgtgaataattactgaaaccagcatatgaatatcttactaaagctaatattcttacaaaaccaaaaatagagttaatgttaagacaattgaaaagtaaaagacctgaatgaagatgagtgcaagaacagctatggaagaagcgaggactatggccatataccaataattgaagaaagatgtctttgctgctttctcttccgcattggcctctccaaactggtcagctgcaaaggtcatgacgcatggtttatgccctccttctccaaccgccatcacatacaatgccataaagaacactttttctctcatccgccgcgccaccaccgtcaccgacaatggcaacatgacaatcccctgaaattcattgatgaacgtgttcatattagtccgagtttgagtttgagatcttgaaaaatgagtcaagggttaggtttggtaacgatatgtagaccaagagatagatgaaagaggtcaagagaacggttttgaagcggcctaggatggagtcagctagaaacgccccgagaatggggaacatgcaagaaacaccgatccatgtgttgatgtttttggctgcggtggccgtggactggccaagttcgtttgttagaaacgttattaggttgcttgcaagaccgtagaacgcaaatctctctgctatctccacaactgcaaaagattaatgaattaccatctcgacaatatgaaattagaaagaaaatatatccaaatccgtgagtgtattcagtataccgatgatgaaaagggcagcgttccagcctcctttggttcgtttattgatgagggaggtcgaatctgccatggctgagcaaattttgctagtggaagcaccttgagattattgtgagtgtatctagacgtttttctacaggtagggagatcgttgtgatcaccgagatgccttttttatatttgaaatttgattctgatctctaggtaagtttttctattgcatgtgtttgtttaatataagcatttattatataagtgtagatgctatgactaaactaatttagatgctgtaaaccaaacaaacaaacaaaaaacgaatgaattacttcctatattattaaaattttatccaaaataatatgttcaaagatcgaaagttttttttttagttattattaatgatgaaattttcattaaaaaaaatataagatatatctcaaattatttaataaaatttaagagtaaatgatcaaattaatccaaaacaaaaataaaacgatgggatatactgaaagagtaaatgaattacttctatgtattatatttccgacgtcttccttgcttctcacaccaaagccactccagtgcctttcaacgtcgcctcaggttttgttcttttcttgttggcttaaaagtttaccaagagttaattactttaagcttgttgttatattgttttattctggccatggactccagaattatgcagacttcgtcccttgacactgccttctcctccaaattcttcaatggacatcgtttctcctccgttgtttcgtccttgaaacctgactcgatcgtctttcctcggaatacgacaagaacaagaagggcatcttggttttatccatgtcaaagaaagatgatgacactcatcatagtctgagctacaaagattctggtgtgaatatcgatgctggggctgaactcattagacgaatcaaggatcggacagtttgaggcagctttgagaatattgggagaagttgagaatggcgactatgttgcataccgcatcggacaagttatcgatggtgaaggcgtgacctacaattaagaacaacatgttacatgttgtgtgtacactttttttttgtttggctttttagtgtgtttttattaagcacttaccactgagattttgaaaattacaatctttatcttcattcaactaaattaaacgtagaaaacaaaaaattaatttcgttttacaacattaaaagaaaaaaaagtaccgagaaaaaagattatatagatatgggcctgtcttgttgggcttaaaagtcactcgtcctttcattaccaacatcatataatgaaaatttgacagatatcgaaagcccaataattcgttgactcaaactcgatcatagacgtaatcatgcgaacacgacaccacgtggcatttgtcgttttgtgaagtagtaggattggatattctcagtgaatttgttctctgttgcttatgttccatcgacaaatgacaaatcacacaaaaatggatcgactttgatccttccttggcaaccttacgcgacgaatcattcattctccttaaattcacagctagtaaagtaagtaagcatg

SEQ ID NO: 14459 - DNA, 3000 bp, Unknown
  misc_feature (1)..( 3000): cDNA_ID_2990899_gDNA_ID_2684120_Annot_ID_190932 3000 nt of promoter + ATG
accttattctctcacgtctcttaacaatctcgacgatggttgccttatgcatatcctcagcttcctatctccaattccaggtaaaattggtttctttttcgcatctattactttggttttctcatacttttatacttctttgttcaattctgcttttaattgtttcgttgtttgtaattcatttagaaaatttgaccaactgtttcacatcttaatgacggttctgtgtctcaaatttactactttgagactttgcagatcctaatcaaatcataattgaattcaattctaatctccatgatgaattatctgtttctcttgacttggtgtgtatgtgatacagctttgtagtaatgtaacagaatcagcaagaaagcttttgactttgtattgaattgctatgttttgatctgtatggtgttgtgtgaagctttgaaaatttcgtattttgtttgtatgattgacttgggcatttgttgcgtactacagtctgtttcaatgctgttttgtgtatctcttgtgagtttgcagataggtataacacagcactcgtttgccacagatggagatatctggcgtgtcaccctcgcttgtggctccgtgttgaccgttttgtcaaggatttatctcagcctggagttttcctcaacattgagtcagctgtatctgcagcaaggtttgtaatattatcagttacgttatttacacttctttgttattcgtaaaagggtccataaatctaaccaaattgtcacctctagacccggcgataccattttaatagtagccggtgggaactatcgcgtttctaatattcagattaaaaagcctctttgcctggtatgtctttcaaagaatatatgtctagtgtaattgcttgatatttctgaaagaatcgtttataactttctctagaaatggcaatgtgaaattggtctactttcacatgtttcttgagtcttgccaaaaaaaattagacttcaaaaatcgcaagtagtgaaaaataatttataggacttagtataaaccatttataccaacatctgtgtagtatccaagaaacatgtgaacatatggtaacatatctattctcatgaggatggagattccattccatgccataggtctcggcatctgagatcagtatgcattgaagagatccagagaaaacaatgccacgtcttaggtaccaaaatagaaatgaaagatatcttaagcttgcacacaattactttcaatgccacaactggaaactaagcacgagctgtttgtgacatggacgttttaacgagtgttaaagaactagaacttgatgactaaaattttctttgactgtcgtgagaactcgaaaaaaagaattcagttcgacttcaaagtcttttatgcacttgccacctacctatcagtaatgttccttttctcatactgggcaacacatggaatgactgtaagctgtaatgaaaactattgaaagtagaccttggtgtatgaattaggatgaaaagatagagttgcagaaatatgagtgatttatcatgaatgtatggatgcacacccctagaatacctcagtgtagattaggggttggcttatcagtgtccctagtttcagttaagtggaagaatgtacgccttgaggttgaaaggagttcctaagctattgaaagtagatgccttgaggatgatgttgatacataagtctcaatgttcgatagtagtctcagttttatattatcttcgctttgttcaggtcggtggaggcgagattcctgatgaaaccaccctcgtctgtgctcgtggttcagacaggtttggaactcatattccctcttaagacatttcctctctacagttgttttcaaaattctttctgggaggttttagcttcttaaaagttgttgaataccgcatttcccattgatgtttaaagaaaaggaaaatactttggtatacggctttttgttgttgggtttattgtgcagtgccctggaactgttatcaacctgcaagcttgcgaatttaacagtaaaagcagagctcgggtgctgtttgcttcataggagtggaaggctaacgattgatggatgtgtgcttcaatgtgagacaaaccctttggatcatctctcatgcccaatcgtgagcactgctggagatgaagacattgaaaatatcttaagccatgtggaagtgaaagaaactgttactggaaagattaaagcaaacagtgtaaccgttttgcagacaagaatcgagggaggtgcaaaggctgtttcaacaaggggagacttggttctgcagcgtgttcgagtcatgtattccaaggcttacctctatttctggtttgatgtagattatgaatgatttttgctggttttatttatttttcttcttctgtctgtaacattagtaatctgtgtgatgatgggaaatgatccatcttcatttgtactttgtgtttccccttaagaccagacaggtcctttgttgtatgcttattatgttcagaaataatgtcctttttaggacgaattgccgaattcatttcaattggatttttataatttctgcttagtgtatcttttgtgataaatggtttctttcttcactgttatcaaaatattagagatttttttctctcaaaaaatattagagagaatttcaaacaatgcaacagaaaacagctttattatagtaaagaaattgcaacaattgttgtagacaatgacttcaacaaaaaaatattctatacaatgaaaaagtatttctaaaatgtaaataaaatgacatattcagagtagattttttaggaaaataaaacgaaaactgaatgcataaaagatgataaatacgaataattttacatattaaaataaataaaaacattgaaacaccaaaaataagacaaaacctaaagtatataaagccaacactctccagtgtgcagtcgttccaagtccgcttatcgaattctccgattccaaaagcagcagaagaaaaaatg

SEQ ID NO: 14460 - DNA, 3000 bp, Unknown
  misc_feature (1)..( 3000): cDNA_ID_3017235_gDNA_ID_2684120_Annot_ID_190936 3000 nt of promoter + ATG
aggtacatactttcattcaatttatcataaacgtgtgagcaataaccagcagtctgctacgcatagtacctggtcctcaactgagggttgacccttatgctcacgatattggtcagccttaagagttacacgtacacttgggacactttgggatgacagaccattggcttttccagtcaatggaaattgctggttctcttgttgctcaaactcagttctaatatccaatcctagatcttgagagtccaacattgatgataatgattttgggctattggatacatctttagaagatgaccataactcatcaccaccgctgagactgccatcaccaaatatagggacatcattgctgcaaaaccatcacttgtgaggatattgtgttagaggccaatgtgcatgaaacaaattggacacaagaaataaggagctagtatttttttcattattacacctttccaccatattcacatctggtatcttatagttctaagacgaaatcaagtcagtaaataacacattttatacatggtagaaaaggagtatgtcattgaaaagttaccgcctagcacagtgaggatgagaagtcgttttacctgaacattcgatcaagatcatcaaaactaccaatgttggcccagctgtagtcatcaaaatcaccttgctctttactctcatcagagctatgaaaaatatcagggcctttcccaagttcagacgttttctctggtaaaaacagagtgagcacacaacttttaaaatgattagattggaaagaacgtacccaagtaaaacatgactgtttcaagagaaacgcaccacctcttgttgaatcatatctgactggctcagctaagcattttgaaagttcagtcgcactcaaatcttgatcaacctttgtagcattagttagcgacgtgtcaggccatgagctcatacagaaatctggctgaggaagcccctcatcaacattatggctcgaactgctccccaaatttttatcatggaggtcaattttagtcccagttatcttttgctcagctgtcttagattcctcaatctgttcctttttgttaagttgttcacttctgactttaaaaggcacaatatggtcgcctgtctcagcatcatcaccccatatcatattagtaagctgaaaagtaggttaagaccataaaacaagtagggatcaggcacaaagcaagtattaacaacaagccaccaaaactaaaatatttaagaaccaatgatactagagactgataaattacaggatgagtgattcaaaacctgatcgttaaccaaatccataagaaaacagaattatactgattccacataaaaattcgtatatatagcaacagaagaaacttacctcttcttcttcccaatcaaacatgactggagaaacaaaatcgaatcacagacccaaaatcaagctccctgattgctccacacatcgccagctccacaacgaaaaaaatccaggaaaaaacaacaagatcaacaaatcggataacgtaaatccacacacaataataaagtggaaaaaacgataaataaaagaatattaaactgaaaaagcaacaagctttgaaaaaccttgattcagcagaatcctccttcgtgctcaaaggatatgggaagagaaaggagttacagtggaaaaaagaaaaaagagtttttttttgtatgaaatggtcacgtgccaaacgagtggctgagagagaacgggttgccacgtcagacgagaaggccgtatctaaacatgtggctgagagtaaacacgacttgattccatgacagctcattttgactttccctggctgtggtcttttgttgacgtttttttaatattttcatgttatatcggattagtgttcgagaaaagaagagacacacaattgggtaaatatgtttttaaaagagtggaaccagtgttcaacttttagatttggtggggtttgagttcatagcgaccacaatttttatcttatatgttttaactaatttagctttcattgatatccactttttcaaaagtatttgcttggatcagtttattgaaaaggaactaatgcgttatcctgaacagttcataacgaaacagtggatataaatggttgcaattgatatatattttttaataagtgtgtttatttttcaattataatgaaatcgttttcgtccttgatgactaggttgaaaattttcagaccttgttaataggctttgtgcctcgattgtttatgcgtttgtttatcttgtgtttgtactttgtatttcgagattaaaacgaattgttggtaggggttactcttgtttcagaaatgatcacgagttacgttagacacatattaagcagtaaacattgttgctagcttgtgatagatcatagatagagtgagtctgagacaaaagcaaattagtgtatatatcaaaaatagaaatgtgctacaaacccgttattgctgacttgataaatttgtacttgttacatgcgcaagattttagtgatctacaatcatgaaagacgctagagaatatgtttctaagaaactggtacaagaaaaaaattatgttgtatacaaaataaaataaaaatattaacataaaaaagagtgatgatcttgtcttttaaatctaccaatttagccactaaacaaattcctttcgttcatcaaagtccacaaattcactgaaagtaatgattccaagcattttttcccaccaattcaacaatttttaagtacaacactttagtgattctaatttacaaaaataacattttgttgtaaaacaaatttagtagtactagaaatttccttttcagggagatgcaaaaattcaattatcacactgctattttggtcgaggtgtaataaaaaaacaaggagacaattgcggcgtggaggctttctgtttacatgcagcacaagaagggccacatgacatgacatcatgtgactctgtttcccatagtcagagaaaagaaaaaat

SEQ ID NO: 14461 - DNA, 3000 bp, Unknown
  misc_feature (1)..( 3000): cDNA_ID_3017239_gDNA_ID_2684120_Annot_ID_190935 3000 nt of promoter + ATG
atttctcgaagtttttcttcagatgtggatatttgcttgtgttcttgtgatccatttgaaagtatttctgtgtgtctcttgtcttctagctctttcttaagcttcttctgcttcccctacataaaggatcctaccatcacgtattgaaggaaaaactgcaaagatgataccaccacaaagtttcaaaccttaccaaaaggtattcaagatctctcccgtcatacaacatctgatgtgaatgataactaaagcgatgatgcttagagaaaaagtgatcaacggcgcagccacgagtgttatgctcagggcagagaggaacttggcggacaagaacagtgaactgatcagcacgatgtctaagttctttcatttgttgaagccttatcacaagaatctccttatattcctagatggagaagatccagtaaataaacctattctataacaaaaaaaaatccgtcactgatagacaagagtaaaagcttaccttatgcaacaaaaacaatgcatagaatgatatgcaccacaagcatgagaaatgcacccataacctaggaaaattaagacaagatatcaagaaacacaactctaagagagatgatgcaaaattaattaagacataaaaaggaaacggcttacttgttagaacctcgtgtgatatttgatattgtgaaagcatccattgaatactctcttcgtgtcggtaaatctgactcattgtaataatcaaccggaagaagtagtgatgctccaagtaacgaacacatcaggaagaatctaattctgcacatagttcaaagaatctgataatcgtgtttatatgcgagataagaccaaatcttccttacccgaatttgaagagcctgatgaggacgagagcatcaaggccgtggcggctgaggatctcgtcctcggggacacggaaggcgcgtgggatccacgcaacggaaggaaggaaacgagggaggcaaagggatgagtgtagagacagaggacggtggtggtggcgatcggagaggcggcgagcatagtatacgacggcgttacggggctgcttcttgaggacggagaagagccagagtgcaacgacggcgagtcctatgttgatcgacgccgacgctaacaagctttctggcgtcatattttttcttttctctgactatgggaaacagagtcacatgatgtcatgtcatgtggcccttcttgtgctgcatgtaaacagaaagcctccacgccgcaattgtctccttgtttttttattacacctcgaccaaaatagcagtgtgataattgaatttttgcatctccctgaaaaggaaatttctagtactactaaatttgttttacaacaaaatgttatttttgtaaattagaatcactaaagtgttgtacttaaaaattgttgaattggtgggaaaaaatgcttggaatcattactttcagtgaatttgtggactttgatgaacgaaaggaatttgtttagtggctaaattggtagatttaaaagacaagatcatcactcttttttatgttaatatttttattttattttgtatacaacataatttttttcttgtaccagtttcttagaaacatattctctagcgtctttcatgattgtagatcactaaaatcttgcgcatgtaacaagtacaaatttatcaagtcagcaataacgggtttgtagcacatttctatttttgatatatacactaatttgcttttgtctcagactcactctatctatgatctatcacaagctagcaacaatgtttactgcttaatatgtgtctaacgtaactcgtgatcatttctgaaacaagagtaacccctaccaacaattcgttttaatctcgaaatacaaagtacaaacacaagataaacaaacgcataaacaatcgaggcacaaagcctattaacaaggtctgaaaattttcaacctagtcatcaaggacgaaaacgatttcattataattgaaaaataaacacacttattaaaaaatatatatcaattgcaaccatttatatccactgtttcgttatgaactgttcaggataacgcattagttccttttcaataaactgatccaagcaaatacttttgaaaaagtggatatcaatgaaagctaaattagttaaaacatataagataaaaattgtggtcgctatgaactcaaaccccaccaaatctaaaagttgaacactggttccactcttttaaaaacatatttacccaattgtgtgtctcttcttttctcgaacactaatccgatataacatgaaaatattaaaaaaacgtcaacaaaagaccacagccagggaaagtcaaaatgagctgtcatggaatcaagtcgtgtttactctcagccacatgtttagatacggccttctcgtctgacgtggcaacccgttctctctcagccactcgtttggcacgtgaccatttcatacaaaaaaaaactcttttttcttttttccactgtaactcctttctcttcccatatcctttgagcacgaaggaggattctgctgaatcaaggtttttcaaagcttgttgctttttcagtttaatattcttttatttatcgttttttccactttattattgtgtgtggatttacgttatccgatttgttgatcttgttgttttttcctggatttttttcgttgtggagctggcgatgtgtggagcaatcagggagcttgattttgggtctgtgattcgattttgtttctccagtcatgtttgattgggaagaagaagaggtaagtttcttctgttgctatatatacgaatttttatgtggaatcagtataattctgttttcttatggatttggttaacgatcaggttttgaatcactcatcctgtaatttatcagtctctagtatcattggttcttaaatattttagttttggtggcttgttgttaatacttgctttgtgcctgatccctacttgttttatggtcttaacctacttttcagcttactaatatg

SEQ ID NO: 14462 - DNA, 880 bp, Unknown
  misc_feature (1)..( 880): cDNA_ID_3017198_gDNA_ID_2684120_Annot_ID_190949 3000 nt of promoter + ATG
ctttaccttcattataccaagaagtgagttttagttttagttttttgagagagaattaagaaagcaagaaagatatgtatctgaaagttttttcatattttgcagacaagggaagatggtatttatgcagggaagagaaggaagttggagaaagaaatgtgtaccattatacattaataatccttttattggactcgtcacaattttcgtctaccatatttatatttactgtactgtgtacatcagattatgttggatcacgttctcttctgttgtttcacttatcaactttacatgtttatcattgttctccaattgcttcgaataaattgtatgataacattctgtatttgtttaaattatatactactagagtactaggggtattttctttgatttcagacttttgtttatgatttgttacttgtttcacataagaataattggtcaaatttatttggtctctctttctcgcaaatcatatacaatatacaactctaatcttctccaccaaactctaatcttgttcatctttttttattcaaatagtttagaaagttcaaatatactaatctttatcaaagaataatctttagtcaaattttaataatgaaatcaaatatcttacaaaatggaaaaacaaaaatatgggtgtttgatttttacaaaacaaagatggaagagcaagtcagaagtcaaaatagctcgaagatgtaagtgacggcgcctgaatactcttggctggtagatttcacctacctcatttttttcatatatctcaaacgtggaatcgctgttactcagtttttatatataaaaataaacactcgctcttcttcaaccaaactcatttccaaaattccacaaagtttttcaaatg

SEQ ID NO: 14463 - DNA, 3000 bp, Unknown
  misc_feature (1)..( 3000): cDNA_ID_3017202_gDNA_ID_2684120_Annot_ID_190948 3000 nt of promoter + ATG
ttctttgaaacacaaacatttgcagacaacatctttagattgtgtttttgattattatcggtgtgtgacaatgatgtctcaatcttttgatacatttcaagtatgattaataagttactgtgactcaagccacacaaccagttgctcggtttacacagaataataaaaacgttatgactcaaattgttttccaatttggttcgataaatttgcgacccggtttgatattatggttcgattaaaccagaacaaaacaaccctatatataatttcttttgaaatgaatgagaaataaaaaaacaaagaaattcgaagaggtttttttaggttttcgaaaattcaaattacaaaagtaatccatcccgctgctctatagaaatatatttcccgatccagttccagtgtcagttgctttatctgtaaaaagcaaaaaagagatgagaggcggagccgcgggaaagagaagaacgacggtgggtttcggcggagcgccgccgccacctccaccatcaatcgagcaacaacgtcacctctttaactcaagagactccgacgccagtttcgccagcagccgtccttcatcaatcggtttaggcggccgaggagcctccgatgacagatcttcgatgattcgattcattaacgccttcctctccacacataacttcccgatctctatccgcggtaatcctgttccttctgtcaaagacatctccgaaaccctaaaattcttgctctcagctttagattacccttgcgattccatcaaatgggacgaggatctcgtcttctttctcaaatcgcagaaatgtccttttaagatcaccaaatctagcctcaaagctccaaatacgcctcacaattggcctactgttctcgccgttgttcactggttagctgagcttgctcgtttccatcaacatctagtatctaattccacctccgtacccgaagataactccatgaatttcttcgcgattcaaagctttggtcacttcattcgcggcgaggatgataaggttaacgatttagattctcaatttttgggtaaattggaagcggagaagactagcgtcgctgaaactatctctggttgtgagaaaatctccggtgaattggaggctaaacttgagtcactgaggaaaggtccttcgaagaaagagtctctggagaaagttaaagccgatttggagaatgacgtaaacaagttccgaactattgttgtggagtatactgataggaatccagcgatggagaaagttgtggaggagaaagctaaggagctcaaagctaaggaagaagagagagagcgaatctctgtagagaataaggagttgaagaagagtgtggagcttcagaactttagcgcggcggatgtaaataggatgagaagagagttacaagctgtggaaagagatgttgcggatgctgaggttgctagagatggttgggatcagaaagcttgggaactcaattcacagattaggaatcagtttcatcagattcagacacttgccattgactgcaaccaagctctcaggagattgaagcttgatattcagttcgctgttaacgagagaggggaaacacctgcagcggtgatgggtgtggattataaatcggtggtgaagccagctctgtgttcgttgtgcgatgggatcaaaggaagctcggcggagaaagtggaggaattggtcactttacagcaccataagtctgaaatggcttcgaagatcgaatccaaaaggagtcttcttgggtcaattcagttgcagatcaatgacctcgaagaaaagatgaagttggtgaagaaggaaactcaggagttgagtacaaaatgtgatttggaggcgaaaacattggttgagagtgtgaaagctgaggctttgaatctggaggttgtggagaaagaagctgctgagtttgtaaaagcttcggagcttagattgcaagaagcagtgaaggagagtgaagaggaggtccaagcatgtgctgcacaactctttgcacttatcgattcgatatcgaaacagaaagagtacatggattcgaagatatcggagatcaaaaccggtgttgctgatactgccagtgctgtttcagagatatacaaagccaacttcaagaagaaccttggtatctagtggttggaatcaactgagccaagagattgttaaaagcgtgagtaattcctattgcttttgttcacatagtcgtattagcatctatgtgtggtatgtatgagttttcaggatggataattgaaattgctcagctatgctagtagtatataaatatctgtgtttcttttttcattgaaacttagatgataggcacataatctaatattcacaatgtttaactcaaagaacgctgttatgatcaagttacataggatttccaatgaatacactcttaccttctttttaccataagctgacttaggtgactttgattcttattcggtttatcccctcgggtctcttgaagtcaggctatgtttgcagctcctcggttgtaacctctttgggttaccactttcttcagtctcactgagttcctcctttacttgtttaaagcttgcttactcatgcatcatatgtggtgagaatatcttactgatgatatgaataagagagagtagctatcaaatcaagaaaatgagaggaaggagttaaaaaagacaaaggaaacctaagctgcttatctataaagccaacacattattcttacccttttgcccacaaagtaaatgacacacatcaactaaagtagaaatttaaaatgcctttgaatgccttaatttgcatttttattaaattattaacagaaaaaagatatgttggttagtactaatccaatacaatacagaaacgtgtcaagtatcctaatcaataatggcggctccacgtaagacaaaaacaaattaaggaaagagcgagagagagagagagagagaaaaaagaagaagaagaatttgaggcgattgggtaagcgatg

SEQ ID NO: 14464 - DNA, 3000 bp, Unknown
  misc_feature (1)..( 3000): cDNA_ID_3017205_gDNA_ID_2684120_Annot_ID_190947 3000 nt of promoter + ATG
acaaatcttaatacgtttttttattttgctggctctgaggcaacaaactttttttacaattacttctttgtcatccccacttaatctggccttaccgtttttatttggcttcccgggttatgcataagaagatgtcaagtaggtgagaggttggtgtgcgtagggaatttgcaattaacacgtgtttattttaactctcttcaattttaaatggtgagagtagacgtagcaaactagtctaatcgcgaactaaaccactttatattttttgaacgaaatagaaattgttgtagttttctataaattattttttaataatctccaaatagagcaacgtatccacttatatatataaccttatctctttttttattggagaaaaaaaaagtacactgtgataatttgaactcatatatatacacactagttgtgtgtgcttgtcttaagaaaaaacaatgggatcaatggctcagaaatcggttttgatgttatgcggagagttcatggaagcctacgagactatagtacctctctacgtcctccaagcgtttggtgttagcgtccactgcgtttctcctggtcgcaaaactggcgacaagtgcgtcatggccgctcacgatctccttggcctcgaggcatttctcgaatctttcactttttcttcatttcagtttttttcccttgcaatcgttctttgcatatttagtaaaacaatgcgatcaaatgctcataattgggtggactttcccctttattatctttatccaaaaagtttagataattgggtggtctcaacccaaaatgcatgggcctactcttaacagtaaaaaagaagagtttcaatttgacttttacctttttacagatatacaccgaactggtggttgaccatctaacactaaacgctaacttcgatggcgtcatccccgaccaatacgacgccatcatcattcccggtggacgtttcacggaacttttgagcgccgacgagaaatgcgtgagtcttgttgctagattcgccgaactcaagaagctcatcttcacgagctgccacagccagctgtttcttgcggcggcaggtctgctcaccggtggaatgaagtgcacggcgttcgaaagcatgaaaccgtttatcgagctctccggcggcgcatggtggcaacagcctggagtccagacccttttcgaaatcactgattgtgtcaaggacggcagtttcatgtccactatggggtggccaacgcttggccatagtctcaaagttttgttagaatcacttggctccaagatttctagctctaaagagaatcatcagacttctttgcttttcttgattggggtaagtagcttattttcataagactctcttttagactttatatattggaattaaaaaaatggtctgactaatacgtaattttggtatatttaggattgtgttgaagattatagtatcaacgtaccatttaaagcgtttcaagctttgggatgtaaagtggatgcagtgacgccaaccaagaagagaggtgagaaatgcgctacaatcgtacacgaccttgaagacggacggcaacttcctactgagaagtttggtcacaacttctatgtgaccgttgcgtgggatgatgtctctgtggatgattacgactgcattgtggttcccggaggaagatctccggagctcttggtgatgaaccccaaggccgtcgaattggtcagaaagtttgttgagaaaggcaagtttgttgctgccattggaatgggaaattggctacttgccgccacaggcgcccttaaggtaatatacaccgttttacaaaaattcgttttactattctaaagacttaaaagttaaaactgaagccgaaccaaaccatattttaatttaaacgaaacaaaaatgtcaagataagttgctctaagcacataggaatctcctatggttatggttatgactaatattattccagcatattgttgaaggttagtaagatataattcatcacatttatggcaccacttccttagcatagattataatttttgccagcttgttataactcatctaattcccattgtggcatgctatattattacattgcagaagaagagatgtgcaagtagttatgggacaaaggtggctgtgaaggttgctggtggtgagatcgtggaatctgaacggtgcgtgaccgacgacaagctggtcacagccgcatcaacttccgatcttcctgcctttttgtatgcattgtcgactgcacttggtctctctgttgtattctaatgtcaagtggtgctttaacgtctaatgcctaaaaaaataaaaacatatctttgtatgtcgaaatataaggtcgtccctctaattatttatgtacaagcttggatttgcatatatatatgggaagaagagttgccacacttgcttacacctcttctaattgtgtttttttataagaaattaccactatcaagttgtcattctcctcgttttacatttggtaaacaagctctattgaccatttatgttgtaacactacttcaagactaaagttgattagagatagcaaaatctgtcaccagcaaattgtgtttccttgttaaatactagtaacagattccaaacacattaaattttgtgaagttaaatttaacaacatactataaaataaaacaacacataaacggattaaagacgttaatgttcatccaaaaagtatactgaacttttaaataatttaccgacgaattgtactgtttatatccgaccaatatagttaatcacattttaatcactgcataaatttactcataggaattacaattaccgaattagtttcggtttaaaatttgttggatcaataaaacaaaaaaaaaaaaacgatgccagaatattccgttcgtcggcgtagtctttcccgcccccaaattatctgagcaaaaaccctagactctcgatttcgtcacgattttctcaatcaccttcactatactgcttcg

SEQ ID NO: 14465 - DNA, 3000 bp, Unknown
  misc_feature (1)..( 3000): cDNA_ID_3017209_gDNA_ID_2684120_Annot_ID_190946 3000 nt of promoter + ATG
gttctcccccaccaccgtactactctccttcacctaaagtgtactacaagtctccaccaccaccatatgtctacagctctccaccaccaccatattactccccttcccctaaggtgtactacaagtctccaccaccaccttattactcaccttcccctaaggtatactacaaatccccaccacatcctcatgtatgtgtttgtccaccaccacctccatgttattctccatcccctaaggttgtgtacaagtctcctccaccaccatatgtctacaattccccaccaccaccatactactcaccttctccaaaagtttactacaagtctcctccaccaccatcttattattctccctctccaaaggttgaatacaaatctccacctccaccatcgtattcaccttctccaaaaactgagtactaaatttctcggctgcctctatatgagtgaaactaaaaaatgtaattcttaaataagttatcgaatattattcgattttatctttccttttgttctcgttttttaatttctcttatctaatcaatttttaattttcttgggatttggctacaaaattttcttttatttgtgtaacgattgcttgcgatctatataaactcctttgcaaattcttgactttgtatcgtttaaataactatatgatcctctaacatggatcttgtctttggacagcacacctaaaagcatgaattattttaattctagtatgtcttcaaccttaacgatccacaatttttaactcttggaggtttcattttcctacctaaatctggtatggattaaaaaagaaaactcaaactaaaaaacaattatgagacgacaattcccaaagatatcaagaagacaagaactacattttactccacaactatattctatcgcattatttttattaaaagattttcattgatataaaaggaattaaaaaggaactctaatcgaaccattacatccaaccacaaaagggaaaaaaaaaggtgaaagtttaaaacatgaaatagctaattcaagattttatatctttatttttccgaaatatttttgtcccttacgattaaattcaataaaccaaagaactaaaagagtggttgtctagtggtagtacaagggaattggtttctttgtacaccgggttcaattctgtttagaaacagagaaatattctttaaatgaaaatggactaaagactagctccggatatagaagaagattatagatccaaattccaaaactttcgcgagcccgaactttcttagctaaacaaaaagaaatctaatataaaaataagaagaagaaacaaccaaggaacgataagaggtaattatgctataaaaagcggtcacttgtcttggttctcgaggatagaaatcaagtttgcacaatcggaagcgaaaataccaaacatcttgccggtagagatcatgcattaattccattgcccataacagataatcaaattctgcatggagcgacaataaactccgacggctacttctgagaccttgatgaagaactaagttttgtttcactagaacccaactatatccgctcagagccatcttcatgccaaggcgcattaaacagagatcaagatagggggatctagattaaacgttggaggtgtgacagaaattatggactcttcttttagggaagcttgtttccaagctgcaagatgttcaacgctcacaaatatgttagcatatgatatgattaggtttttgaattctatatttttatatgtcgcaagcgcactacaattaataaatcttcttagggtagaatttcaatccataagcaggctactaattataccatgaatactaccattttcccctcttttttttatttatgataaggtttctacgttagtaactcttatatatatgttttgactgttacacacttgtggaatcatgatggctggattggtgattcgaccattttgacattgaaaaccggtctccctccaattaccttgaagcgttatgcaataagtgtaaatgtctgctttcgaatggttttagcagtccatgaggctaatcgacccaacccaactcatagactatagagttacatcatttccgttgcatgtctcttgtgacacaaagaactaaacaagataagagagaattagagaagctataaaacataaaatcactacatgtcacatttatcatttactatgttgaatatttttaccgttcaatttaaagaaatccaacaatatgcttaaaataatttttttgattaatgtttccaaattctatatgttcttttaatcatatggtaattgattattttcgaccattctgataaagtttggagtacactgtatttttttttaaaaatagaagaaatgtatatataaattaactaagaatatattaagttttattgttttaataaagtagtttcattgctgcatgcactctgccatttacataaaatgcaagccttgtaatttacttttcttcattaattgtttaagatttgttttcaattttaattttgttaagaaaacaaatcttaatacgtttttttattttgctggctctgaggcaacaaactttttttacaattacttctttgtcatccccacttaatctggccttaccgtttttatttggcttcccgggttatgcataagaagatgtcaagtaggtgagaggttggtgtgcgtagggaatttgcaattaacacgtgtttattttaactctcttcaattttaaatggtgagagtagacgtagcaaactagtctaatcgcgaactaaaccactttatattttttgaacgaaatagaaattgttgtagttttctataaattattttttaataatctccaaatagagcaacgtatccacttatatatataaccttatctctttttttattggagaaaaaaaaagtacactgtgataatttgaactcatatatatacacactagttgtgtgtgcttgtcttaagaaaaaaca

SEQ ID NO: 14466 - DNA, 3000 bp, Unknown
  misc_feature (1)..( 3000): cDNA_ID_3017251_gDNA_ID_2684120_Annot_ID_190931 3000 nt of promoter + ATG
tttcaagctcaaatctggaatcttttctccggtttacatcgaccttcgtctcatcgtctcttatccatccctcttaacacagatctctcaaactctcatctcttctcttccaccttctgcaaccttcgacgtcgtctgtggtgttccttacactgctctccctatcgccactgttgtctctgtttccaatggtatccctatgcttatgcggcgtaaggagattaaagactatggaacatctaaagctattgaaggaatcttcgaaaaggatcaaacttgtttgataattgaagatcttgtaactagtggtgcttctgttctcgagactgctgctcctcttcgtgctgtggggttaaaggttagtgacgcggtggttttgattgataggcaacaagggggtagggagaatctagcggagaatgggattaagttacattcgatgattatgttgacggatatggttagggttttgaaggaaaaggggaaaattgaagtggaggttgaagtgaatttgcttaagtttttggaagagaatcgtagggttagtgttccaagtgtggagaaacctaagcctaagcctagggttttggggttcaaggaaaggtctgagctttctaagaatccgacagggaagaagctgtttgatattatgttgaagaaggaaaccaatctttgtttagctgctgatgttggaactgctgctgaattgcttgacatcgcagataaggttaggatcattcttggtatcgaagtttgaagactgttcattagaattatgttttagtgacatcttcttccaaatgttttgtgttgatgcaggtgggaccagagatttgtctcttgaagactcatgttgatatactgcctgatttcacccctgactttggctctaagctccgtgcggtaattacttttgtactaatttgctctcacacatcttcgaaattctgtttctttgataggtttagttatatagagtaagtgaagattgtaatatctgcaatagacatgagtctcatgtctgttactgattaattggtctctttgatactcattgatctattgtttattgttactttagattgcagacaagcacaaatttctcatatttgaggatcgcaagtttgcagacattggtaacactgtcactatgcagtatgaagggtaatttttctacattatgtcacttagctttcattcaagtcttttcgagttttcgtgtgccaattttttctggtttgttcgcagaggcatctttaaaatattggagtgggctgatattatcaacgctcatgtaatatcggggccaggaatcgtggatggcctgaaattgaaggtatttttcatttctctttattaccagattatagattcttttgtttttctaatgttttgttgcattcctatatgattgcagggtatgcctcgtggtagaggtttgcttttgcttgctgaaatgagctctgcaggtaacctggctacaggagactacactgcagcagctgtgaaaatcgcagacgctcattctgattttgtgatgggattcatctcggtgaatccagcatcttggaaatgcgggtatgtgtatccgtctatgattcatgcaacacctggtgttcaaatggtgaaaggtggtgatgcacttggtcagcagtataacactccacactctgtgagtctctcccaaccttaccacatttatcttacatccattgttagtattctagtctgaaatataatgttgattgctcttttattttattttaggtgattactgagaggggaagtgatattataatcgtgggacggggaatcataaaggcggaaaacccagcagagacggctcatgagtatagagttcaaggatggaatgcatacttggagaaatgctctcagtagattcgatcctgagagatggctgagattttttgtttttgtgttctagtgctataagattgtgctagtttttgtgtgatttatgtgaggatggattttaagactcatgtctcgttgattgtttacttgattgagtgattctcagttctcaataataataaagtgaagcgtggcgagtagttgatctcatatgatttgtacggttgatcacaatttctggatcctttggatttggccgaggcattttgtcaaatgtaactcaaatcacgtaatgaatcaaaacacgaagagataatataaagactaatttacaggttaagttacagtcgcttacacacagggcatgtgcgtgaaaatgttgccaaatactcaagtactcaggaagggatttcaagtgtagaaagacttctgtaacaagtgacagacttgctatttcatttactcaaaaatgatcataaaacaacttcaaattctattgggcttaaaacttcaaaactaacttgctattttgattagtcttgaatcttaatacattgttttttaagattgtaagcccacaaattgtttatatcaatctatgtgggcttaaacccactgggtactcaaaacccggataaaattgcaagcccacaaattgttttccaaatccaaaaaaacacgggcttaatatgggcaggtcttgttttacacaaagtctcacacgggtttactctattgggtcgtttttttttgttagtagttatgttagtaaaacgacggcgtttagatcaatttatgtgaatttaaatataaacattatctccatatccattgttttgaaaacggtgcacgtgtagctatctcattggttagaaaaacacacgtgaaactctctaaattgttttgctgagctggatgagagagaattaagtcaataacaaataagatttttttcccgttttttctttaaaaaacataaaccctatttagtcattgactaatttcattgcgatttattttctttttctttcgcagaggtcggactcgaaacagaagaagagaaagatgagattttcctaaagcaaatctacaaagccttataaatttttttttctggcggcgatg

SEQ ID NO: 14467 - DNA, 3000 bp, Unknown
  misc_feature (1)..( 3000): cDNA_ID_3084000_gDNA_ID_2684120_Annot_ID_190926 3000 nt of promoter + ATG
tgattaatcggtatattgactcttagcaaaaaaaaaaaaaaatcggtatattgataaaaccgattctcattctaacaaaatagttacagttttgataaatatccaatttatacaacgataagggaaatagcagaggaacgtgtggagtggtattgtttaagagatccgagaaactgagttgaattttttttttctcaaagagaaagatcaaaggtttcacgtgaggagtagaaagtggaagaccgacataaatgcattatgtattgttgcatattatggaatgtatcaaaactacccaatactcattaccatgtggtgggttatatctcacattggcctcttctccactatgtagtgctgtccatcaattattaaaaaaattaatggtgtaaagtatcttcattgttgtttgtttcttaagagttgaatgtgatatgtcaatatcctctatactaaaatatttgatataatttgatagagttttcatgttgtgtggattgaaccaaagaaaattttgacccttgtatgtagttgtaagtagctttgcttgttcttagtctccacttagtcactcgttttgtaagaaaaaaagtggttgcagcgaaaatataacaaatgtaaaatttaataaagttacacgatttaacaaatgtaagccaaaaatgaatatctcgtcggaaatttactcaaaagttacacgtcttaagcttacaaactcactttatttttccgatcaacattcccttaaaaaacaacattgttttactttcttcttttctattttttaaaatgtgaaatgcacttaaaaagcttaattccttttaaactaatggaaacaaattctttcagtgtttattaatatcaatggatcggataactcaagagtctagataatgaagtaacttatacataaaaaaactttttaagtgcggtttgcataatttaatttgtttcctatttagtatataataacccatttgactaaatatataatactctttcttaaatctttaatactctttttttttaatcccactagtttgcgtgtacgccacttctaaatttatgttagtatcagaccttgaccttaacactgtacaatgggaagagtcccaaacatagtaggagtagtcggaaattagagcatctccatcagtagtctctcatatagtttctcattaactaaaaaatataaaatgataataaagtagaagagagattgagaatagtttctctgcagagaaactttagaataatgattaagagactatgtgtatatgtgtgtttataattggacagaagttaaatcataataaaatatcattatttattttttttagaaactttttgaaatatctcaccaatggagattacgctctcttttttttttttccttatatattcccagtcataacttggagttgtattaaatgtacctacgataaaaaaatcacgtgagaataaaacggagtatttctttacctttacaaaagaaaatgaaaataaaacaattaaacttttaaggaagatcagataagtagttgaaagcctttaatctagtagttgaggactgatgagattaagtagtgagaggaagaggcttgaggaggatctctaacattaatcaaactctctcatcttcctcctgcactccaacaaaatcttctcgtctctctttaaaccaatagcacacaatggcacatgaaacaccacccacgcccagtacaagaaagaggatctgcagcttattcttgatcgtttgtgtcattgcatgtattattggtttggtcgtttttatactcatcaacgaatgcaaacgtccggcgccaaaagtagaattagcttctatggacttcatggtgcttaatatcacatagactcgtcttagtgcaaagtgggatttgtccataaggatccctgcagatcttcctggtgactatatatgtcttcaaggagactttcaagtttcatttctttacaagaatgttactctctttacctcacctccacaaaagtaagctgtttactattaacaacctccgataccgctgtcctcagcttcttaaagtttctgttgttgtctccgacgaaaacattagttcgattggaacatacattatggaagatgtcaaagagaagaagcaagtaacttttggattgcagttttctcttaccgattgcagaaaaaagacgttaggagttatgagttatgcatgctgtggagtcaccttgaggttcgaacccggatctgagatgaaggcgtctgtgtttggaaagcatccaaggtacacaaatttctgaccaagtccacgtcaacaccagtataatgttagagtttgcaaagatttgacattacttaagggctttattgaattagagatttagtttatttgtaaatgactttagatttggttcgactttatttagggtctaaagtttattgtataactgtttaatatttgtcaggacttaatgaagatgtaatgtttagactttggtgtattttgtacgacatgcatgatataataaaggaattatcataattaaattgaacttataaaaatatgacttgccttacttctcttttgaaatagaaattctaatgtaggtaaaatgtttgtgtttacataattacattacatcaacaaacgtaaaaaaatgtttgtgtcattaaatgtttatccacgtactcttcacaacgatcataagtcataattcagaaaattcctttaataaatgtgaactgaataagcttttgtatagtcatcaaataaaaagtcaactgtacaattaaaagtccgcaaacatctcgatcgtctaagagacgacttttctcgtaactttatgaagaatatacaatagtagtggcttgatcgcgtccacacatttacattgcgacttttcttgcatgccgtctcacgcactatatttaggcaaaacacaattgtcttcatttcaagactagttcttgttttctccatattcctcaacaacatcaaa

SEQ ID NO: 14468 - DNA, 3000 bp, Unknown
  misc_feature (1)..( 3000): cDNA_ID_3017391_gDNA_ID_2684121_Annot_ID_190963 3000 nt of promoter + ATG
ttttgatcggacgattaagattgagcaaaatagagagagatagagagagattatgttttggatataatgagaggtattagagagaatcaagggtttatatagaggtattagggtgagtggtttagtcaaatccacaagacttttaattaatacaaattcaaatttatccatttaaagattgatcagataagatatctaaactgtgtttggtaacttattttttaatcgtaatattctattggttgtttacatatatgttatgatttggtgagatttagagtaaatagtgattaatgtttttgaccagattttatgcttcttcaatgggacctagacgacgtatttcacaaggttaatttattaggggcttatccgttgttaagatagtactattaaggggagtaaaagatactattaatcctcctcttttgactccgaatattttgtttgttttggataactttctttttcaataaaataccattcatggataattttttaggcaaatctaccaaaatcgaaatgtattaatgaatgatttgttataatttaatttcgcaaggttaattacgaggggcttatatccgttgttggataaatatgttaatatcctcctctaatttcgattatctcatttgttaggataacttttatttccgattacacaagatattatctcatgtaaatctactaaatcgagaaatgcaaatctgttacaaattttataaacggggctagctttgacatgtatgatctttttatttatcagagactatctaccaagtaccaacactatttggtttcctatttcccaagttatattttatgcatcagttatcactactaactaacgactatccttcttcttagacgttttattccacgtaattaaagcgatttattgatttccaaaaaaaaaaaaaaaagtgaagagaatttttaataaatgctaaataaaatggatattttaaaacgcaacgaaagaaaaccatatgttacagatctttttttttggattactgattcatatatatgtggatgatttataatgtctataaaaatctagagttgcgaattatctaggcatgaccaaaatctaactgtaactgtatttcggaccgtaatcggaccgtttattaaccgtaacccaaccgtaaccgtataaaacggttaataaccgtaactgttaaccgtgaaaatagattcattacggttaaaaaaatataataaccgtaaccgtatcaaaaccgttggttaaccgtacgtttaaccgcgcggttaaccgtattattaaaaccttaaaaatatagttgtaactgtgtataattctaaataaataattattttactaaaatagtaacttaaatcgtttaatatgcccactaatacgatcgaagttactccactactctttttaccataaatcaaatcataagtagttcatattattattatttatactctaaaaactgtttcttagtgctcataacatcttttctttattattgtttttgtttgaaaaatataattaattaaatcattataattataaccattaatttgtatattcattggtttatttaaaaaaaatagatagctgattcgctataaatatttgaaacacataatcacgtaaaataattattatttgatatatcactatttatttatttattttattataaagattaatataatattttgtctcatatattaattatatcataattatcaaataaccgtaaccgtatctaaccataaccgtatttaaccgtaaccgttttaaccgtatatataacggttaatgttaaggttaaaaaaagttataatcatatacggtggttaataaaccgtaaccgtaataaccgtaaccgtggtcatgcctaaaactatctggataggtttcgatgataacagtgatataagctaaatcatgaaatataagtaactgaatatattactatgtaataagttttttgctattcaaaatttctatgattaaaaaaacttagctaatgtagtttggtagtcaaatcgtatactaaaccatcattagctggttatcaatagcattttaaagaaagttaattaaaccggctgaattggcctggttgacacgaacaaaatgaatgctagaaattagagaaattttgttagtacaaggatgattatgtaaatgaaggataataaaggggtcaattttaacatttattaaaagtcatggacacaccggtctaacgggtgcgtcggtcggcgagaattacgctgtaaaaaataaaataaaataaacatgtaatgaaagaaaaaaaaagaacatgaggaataatcatacgaggcgaagcgcaccggaggaaccataagtcgataaacccaaagcttagatgaacggtgagttgacttctttccgattttgacccaatcatctatcgccacgtcatagggtactgcgtcctctgcaatccataccctgaaccggcaccttctctgtctctcccccaaatcgaaaacctaattcgatcgtcgtctccgacctacatctgccggaaaatatcttttgaccagtaagattgttttattccttacaccattatttcgggtttttaattttcgattttggattgatcgattaagccacttagactagtccctgcgaaagaatgagactgagaagttggacatctcgatacttttggaaaccccgatttgttgatgactcttgaatctatgggacggtgaatcccaaagaatggttccattttaagtttgttttgtattgttggtggaggctggatgattttgagagcacttgtacttgagctttgttctcatatcttgaattagacagtggaatagaaaagatgacaactttgtattagtaagatgatgaacacttgtagctcttcttgctagatatttgattagtggaattgctgttttccctttttttgagttgcagtggatttcaggattgataatggagtagctgctgggatgatgatg

SEQ ID NO: 14469 - DNA, 3000 bp, Unknown
  misc_feature (1)..( 3000): cDNA_ID_3017355_gDNA_ID_2684121_Annot_ID_190974 3000 nt of promoter + ATG
agaactgaatccccatgcccgttgataattggtatgttatgcatttgatcgcactagattttttgatcaacttgatctttttattcttattaaattttgacggacctagctagctttattttatgccagtgcgaaagatactaatattgaaaattgggtggtgagccaacatagcacaagtggcaaaaggcaaactactgaactatacattaaaattttgtgtatactaaaaatgtcttctcttctattaaatctaacaaagaaagggaaaaatagttaaggttacgtacttatcaataatcaatctatcattcgatgttagaaagcgaccaacgtcataagttgacattacctgaaaaaagaattacagtggaaatcttctacttcgacgacgcgcgttaacatttgtatatatatattaacaattgtaactttattaaagatttctttactttactgcgattgaatattatgatgacttctttttatttattctttgtgcaaacgattgacgaaagaacctttctatagtataaaagaagtactaaaaggtacacctgttctctaaacaataaacatgacatgatatatgaatatacttctgattaacagcgaacatggactaaaataaaatactcctctctttttctgtcgacagatatttttttatctacatatcgttaaatacttgaattagtatataagacaatccgatgttttttttttagacaactaatattgtaattgatttggaccgtttcagccatatcccgtgttattaatacagtatgcaaaccattttggagcgtacgatcttgatccgtttttttttatttattagaccttcgtataccctataaaaatttgaaattgagtatctaaactgagtttttaaatcatatacactgtacatttgattcaatttagacaaactagttacgtgccaacacgaaaagtaaactagatataaatatataatccctacaccgcgcgcataggtaatggaaaaactaatcacactaagaaatgtaaagaagggtttaaaaagtaaaaaagatgtccacagcaaataggggaacaagcacattgctacaagatacgtaaggtaggctttgtatattgttgaagattccacgtatggagctaaggaatcttgaaagagaatccgaatcttagaaagaaaaatagacggtcaggattcttcatatctctccactttaagaatctgttttaaggagaataacatgtaacgacaagagaaagtggatcattcgtgacataagcgcccataatttgatgtttactttaatgccccgggtaacacatactttgttgttctcgaagtatttgatatttcattgaatcctcttaattggagtacataagttctcacttctcagcaacgatgaaataaaaaaaaatgacaaaagagagttctaaaccacactaatctctaaattgtatctcaagagatcactatatgaataagccagctttgataaaagtttttaagtgttgatcgaaaatactgactaacgcttagatgattaatttatgtaaagatgatacaattattgtttttctatggtgtttaaatatttgtggtcttctgctatttgcaaatatttaattaattttcatgtgtattaaagaattgttatatctctgccgacagacgctcctatactatgggagatccaaagcaaattttaaactaatatgtggtctattaatttaaaacaaaatggcttaggtttaggatgatcctcggtattatatgcaaaatgcttaaattaaatataaacgaaagtaaacaaaaaagagtgacatatataagcagtaaacaaaaagagtattttaatgggaaaaaaacatatacaactattgtcattaagctcacgacagcatagcaaaatatatatagtcgaagattactgtatcaatggcaacaaattatatatgaattatcttaatcttaccgattactagtcaaaacactttgaatgtctccacattacccattttttttctatacttcccaaacctacctctgaatctgataatacagtaactacatgagtaataaaaagtctaaaaaagagaagagaaatgagtttatttccatatttttgtcgctttaaaaggttttgtttgataagggaaagtcggcatgagaaagaggagaaagtgacagctctctgataaaaagagggaatgaaggagaagaatttacgtcagattacgcaattttatgtcttccccaaatctaactgttgtccacgtgtcattttcctcttcactgtagatttaacttatcctcctttgtcatccttttcattatctgtattttttgttctttctttttctgttttgcttaaccttttctatatcctttttaaaataataataaaatctctatcaattcaatatttttttttgcagtaatattatttactgagagtcacctttaaagaataaaagatataaaaaaaatccaataataaaaaggtaattgtactttacttttcacattacgtcatccgtggtagtggggtcgattaggacgcatcattttttttttacggctcagtgactcacacacacacgccaaaagcagagtttattaaaaacagagtaaattcgctattccaatcaaaaggtgaaagaaaaaaaaactcaagagtctctcctccattaatggaaggaaccgtttctctttctatgtgctgattgctgatgtagctcccacgagctcaagagtaagcttctaccgcaatttcctctaactgaaaccaaatcggctctttactaattttacaataaagtttcctcttttatctttcctctctggctaattaaactttctcttcctcaataccccattcaagtttcaactcttctacactgtgtcttacagcttcatgctccaggtttaggtctaaaactcataatctggttctctttttttcggtggggtttgtttacttttgctactagata

SEQ ID NO: 14470 - DNA, 3000 bp, Unknown
  misc_feature (1)..( 3000): cDNA_ID_3017359_gDNA_ID_2684121_Annot_ID_190973 3000 nt of promoter + ATG
aaatacagataatgaaaaggatgacaaaggaggataagttaaatctacagtgaagaggaaaatgacacgtggacaacagttagatttggggaagacataaaattgcgtaatctgacgtaaattcttctccttcattccctctttttatcagagagctgtcactttctcctctttctcatgccgactttcccttatcaaacaaaaccttttaaagcgacaaaaatatggaaataaactcatttctcttctcttttttagactttttattactcatgtagttactgtattatcagattcagaggtaggtttgggaagtatagaaaaaaaatgggtaatgtggagacattcaaagtgttttgactagtaatcggtaagattaagataattcatatataatttgttgccattgatacagtaatcttcgactatatatattttgctatgctgtcgtgagcttaatgacaatagttgtatatgtttttttcccattaaaatactctttttgtttactgcttatatatgtcactcttttttgtttactttcgtttatatttaatttaagcattttgcatataataccgaggatcatcctaaacctaagccattttgttttaaattaatagaccacatattagtttaaaatttgctttggatctcccatagtataggagcgtctgtcggcagagatataacaattctttaatacacatgaaaattaattaaatatttgcaaatagcagaagaccacaaatatttaaacaccatagaaaaacaataattgtatcatctttacataaattaatcatctaagcgttagtcagtattttcgatcaacacttaaaaacttttatcaaagctggcttattcatatagtgatctcttgagatacaatttagagattagtgtggtttagaactctcttttgtcatttttttttatttcatcgttgctgagaagtgagaacttatgtactccaattaagaggattcaatgaaatatcaaatacttcgagaacaacaaagtatgtgttacccggggcattaaagtaaacatcaaattatgggcgcttatgtcacgaatgatccactttctcttgtcgttacatgttattctccttaaaacagattcttaaagtggagagatatgaagaatcctgaccgtctatttttctttctaagattcggattctctttcaagattccttagctccatacgtggaatcttcaacaatatacaaagcctaccttacgtatcttgtagcaatgtgcttgttcccctatttgctgtggacatcttttttactttttaaacccttctttacatttcttagtgtgattagtttttccattacctatgcgcgcggtgtagggattatatatttatatctagtttacttttcgtgttggcacgtaactagtttgtctaaattgaatcaaatgtacagtgtatatgatttaaaaactcagtttagatactcaatttcaaatttttatagggtatacgaaggtctaataaataaaaaaaaacggatcaagatcgtacgctccaaaatggtttgcatactgtattaataacacgggatatggctgaaacggtccaaatcaattacaatattagttgtctaaaaaaaaaacatcggattgtcttatatactaattcaagtatttaacgatatgtagataaaaaaatatctgtcgacagaaaaagagaggagtattttattttagtccatgttcgctgttaatcagaagtatattcatatatcatgtcatgtttattgtttagagaacaggtgtaccttttagtacttcttttatactatagaaaggttctttcgtcaatcgtttgcacaaagaataaataaaaagaagtcatcataatattcaatcgcagtaaagtaaagaaatctttaataaagttacaattgttaatatatatatacaaatgttaacgcgcgtcgtcgaagtagaagatttccactgtaattcttttttcaggtaatgtcaacttatgacgttggtcgctttctaacatcgaatgatagattgattattgataagtacgtaaccttaactatttttccctttctttgttagatttaatagaagagaagacatttttagtatacacaaaattttaatgtatagttcagtagtttgccttttgccacttgtgctatgttggctcaccacccaattttcaatattagtatctttcgcactggcataaaataaagctagctaggtccgtcaaaatttaataagaataaaaagatcaagttgatcaaaaaatctagtgcgatcaaatgcataacataccaattatcaacgggcatggggattcagttcttttagcgatattaattatatgttgctggcgaaatcgttcgctgtagtctttttaagctttggaccatccatcttagataaaccaaaacaggcctaaacatacaagccgaaatatggatccttaaggcccattatgtgaaattaagaagaattcaacaaatatagtttttttttccctttatttcttaaaatttatctattggatgatcaacaacaaagtcaaacaatattgttgtcgatttcatttcagcttgttcgtaacaaatacaagtttcttgataaagtgtaacaaattgactaattgaaatgtcaacctaaattaaaaagagaaacttttgcgaaacacagaaaaagagaaagagagaaaaggcaggcagggataaatcaacggactttccctgggaagaaaaaatgttcaccggagaagaatgtcctccatgatcttcttctacaggttctctctatgtctgtccgcattgagtatcgcattcaccattttatgtatttcattgctcatcaaaggatgttagatttatccatgtatttgaggaaccgatttctgttgaacgggatcgaatgattcatgtttgtagattactatgtcatcaagttttcaaatttcaaaccttttctatctgggattattgagatg

SEQ ID NO: 14471 - DNA, 3000 bp, Unknown
  misc_feature (1)..( 3000): cDNA_ID_3017301_gDNA_ID_2684121_Annot_ID_190991 3000 nt of promoter + ATG
ttaattgatttataaatacataatatattgatgtgttcgtgtctgacggtgccacaaaacaataagaatataatatccaataactcgtgaataatgccgtaagcgtaaatgatgtaagttatcaaaccatacatcaacgtgacaacgtccatgggttcttataagttacaagttttgcatattcgacttttatttagttttctttctccacgtttaacgttttagaccacaaaaccaaattgatttttcttatagatttctgatattattgtgttttttttctttccttttgatgaaagaagttttggatgaacaaaagtgaaatgttttatgtctgtatatatatattgacccctaatttggtaatactactaggtatagccattcattttattgtatccaatgtcattaaggaatcttgaactaatttttttcccttttatatcgtaaacctttatgcactctcttttacaaatacgtgttattcacttatagtatttggcatttaatgaataacttcgacctataagcaaaagctattgaaacgtttctttggtgttagataattttggattcaaacatgtcccgtacctatcatgttttaataagtgcggatcagatccgaacgaaatatttagagtagttgagttgatatgaatgcatattattgcagtggtctagaagaaaatgggagtagattagtattgactaagagcctttagttaattgtttaatgctttgcatgcttcaattaagaaagcccattcagtttagacataacattatgtctacttggttttgtttaaacaattacttagtttgaaaacttcaaagttctttatgacatactccctccatttctatgtaaatattaaatgtatttaataatttttgatcaatcatataatacattatactccctctgttcctttttgtttgattgtttagaaaaaatacacatattaagaaaacatattaaatgttgattataaatgtattattttcagtgttttacaattttctatacctctaaaccaatgataattaactatttttcttgaaaaattacaattcaccaatactaaccaataaatattacatggaaaacttcaaaaatcaatcttttagaaacaaattttttttctaaacaatcaaacaaaaaggaatagagggagtagtttttattggttgcattcattctatttaatgatatttttataaaaaaagagaaaaattatatatttttttaatctgtttgtaacaactttaaacatcacttaaaaagaaacggaaggaatatatgagagttagtgagatttaggcatgtgcttgcttcatcattgggcttattaatttataaagtttaaatttatcaagcataatataatatgaagtcagctttgccgccacagttgatgcatggcctctaattattggagcattgtacgtgatataggtgttaatggagatggtttgtaggtctttatcaatacggaatctttatcttaccaagtcatttctaagtgttgcatctatgtataaactaatattggagacttcaacaaaaagtagtatatatatacatggtttgcacattgtgctatatatatgtttagatatataactcaaaaacacctttattgcttaacagtctttggtcggaggggggtttggtgaggaagacaatgaaaattattattattaagagaaaagggaatctttctggtttcaacacaaactaatctcccaaaaaaaataaaaaataaagctagcaatatttagaagacctaaaagagttaattagtgactttaatgtgaaactttttcataaaaaatgaatgcagcgatttgttggaggccaggattgcaaattgtttttaaacttcgaaagcaacaaagataaaacatcttagaaccctaaagtaaatccttgacgttagagaaacaagcttacttaaaatctaacttggagatgaaaataaagatttactgatttatgtaggaatacgaaaccctaatttcttgatttaaatcaaaatggaagataaatgtgcatcaaaactctgttttgtgtgtaagattcttcttacaggtttcatcttccatgggatataaaagaatttgtgaacgtcaatgtagcaaatgaattcacatcaagtagtatttccattgatgtctcaggacgtcctttcaatatctcatctcttactacatcaagaagattttctggaagctgcacaacaccattcaatatctgcataaccacactcatatccggtcttattgactcagattgatgtgaacacaacacacctagcttcaaaaccagctcaatctctcccctgttttgttcttgacgtatacattcctctgccgcatcgaaaatgttcccatttacccaaagctctaagatccaatccactagaacttcttcattttccgcttcacgtcgctcaatcaaccttctaccacaaacaacttcaagcataaccaacccaaaggcgaaaacatctgtgcttgtagttgctcttgttgaaagttaaacttgattttgaatcaagtttaattattggatcaattatccaataattaattatggccaaatccaagttctagagttttctctagaaatatcatcatttccacctccttaaaggattctagaaattttctagaatcatcttccacctccttaaacataaaaatctagatactctaatagaataatctagataatttgaataatgtaatctagatcttatgtaagaactctctagacttaagattaaaatattttagatattttgtagtttggaggctataaatacctcctccccctctcaaatgttgtaatgttgtgaagttgtattcaagtttaaagcaaagtaataaaagttctatttcctaaaaaactctctcaaaacacttaaacactttctccattacctctaaaagaattttactctaacaaagtggtatcagagcttgaagatcctaaag

SEQ ID NO: 14472 - DNA, 3000 bp, Unknown
  misc_feature (1)..( 3000): cDNA_ID_3017315_gDNA_ID_2684121_Annot_ID_190987 3000 nt of promoter + ATG
aatttgtgtatccagatttctgtaactatataccattaacaaaaatctacaaacagatccgatatttaaaagttataaagatataatactttattcgaaagaaaaaaaaaaagttctaatacttatgttcaataattatatcatgatatcttggagatatagacttcgttgtggttcctttttcccaactagttaagtatattttttttgctaaacttggtaaatattataaaatgaaagttaaggtatgacataagcattacctagagctagggagagtcaccttggtaaaaaagaaaattaaaataaacaaggctacaataaatttacacttgtgaaaaattgctaactaagtaatttaagtgactaaatgtagaagaaaataatcatagttaatagaggacgtgaccatatttctcacgaatgcattcaaatgtacggaatgcactaaacaaaatgatgcttgcatgattacatatttacatctattgtcaggataaatatttgttaattgtatttatttattatatttttaattacgaatgtacaaactttttagtatatgtttcaacaattcaatggttttttgttgttgtttaaatcgtagtacattcaaaagtcaacaataaaatttaaagtgtattattgacgttctgctatattacaattacaaaaccacaccttttctttttgttgaagttatatttgaactcgtcatatggctgctgactgctgaatttttctatttccaccagttaattcatatgtcccatgtatctgtagttgatcgtataaaaagacacacgcacgcgactgaggtggcgtgtcagcagtatatgaagaagaaggaatgttgggaaggagacttgtcagttgtcactttgggttaattgttttattttttcaatcttcttgcttgaattgtattccaagctcatatcatttcattatttttcttacttcctttctaacatccacaccgtgatttctcttctttatattactgataaaactctaaaatatcaattacacttttatatgaaaacatcaatgtcaagctggttgagttttagttttgtaaatatatgtttagtactcatctttgggctaccagataatgacacaacttttcaatcctaattagtataactctattttcaaaaatttaaatagtacttaaaacaattataccccgcttaaacagaatttaactctattttcataaaaaattagaatttaattccagtacatatttcaaatatagttgatcactagttaacattttacataataatcttttacgtattttgaagatgtataatttcagcaggtttgaagtctttcactcataaaccctacttttcttttaaaaagtattatttcttaaatgcataattagttatgcgttaaaatactaaatttaaaattctggtactattattttaaaattttcgtaagtaaagcttgtgaatataaccgttgtcgagtgaaaataatttgatttttttaatgaaaaaaaaaaaaaaaaaaaaaaaagagggggacaaaattttgacttaactgacataagagatctagaaggtgaaaccacgcgcgtgtggtagtcagaaacgaccaaagaatcaacctcgtccttgataataaaattcttgagattggtcacaccaaaacaaaaaaaaaacgttttatcattgcttcttcaatagtatcaactgacgtaatcatgataagtctacgacaatatccctccaccaaacctaaccgttttggttcaacatttaacaattatgatgagtttaatttttttattggagactgttaccactcttagctttcattatctataacctaagtctggttaattcatgattatgtcaacagtttctttggtcgaattttgatatcgagtttggtttctaggttttagtttccttaaatgtttgtctttacaatgaagtaaagttaaaacaacattgagtgagaaagtggccaactaattctctctgtaccatcaatccaaaattaaattgatttgatttgattaatcaaaaaggtggtcagagaaaaacaaaagaaaaaaaggttttaaatttcttcccgtaccagctagacccagaatcaaagtagcatacttttgctacatattcaaagtaatttaacccccaaaaaccaaaaagaatgtgttagaaaagcaacaagaagaagaagaaagcaaattaatagacaaataatctttcttctctggttgcttctttttatttctttctctggaacagcttttctctgttactttacttctttgagaaactccataatcaaagaggtaagtgattcatgttgcttgtgattatcccaatggttttgttcttttaggttttcggaaataaataattattcttaattaccgagttgtgtataatttgtttttgttagtttctctgatctatcccttgtctaagttatcttttagggtagtttgttttcagggaacaatttttatcagtataatatagggaaaattttccaaacaaaatcgataataatactaatatctgcataaatacaattctagccagtatgtgttatgatcagtttacctaattgggttagaaagatggagttcgatttaagatatcttaaaagttcaaaaaaaaactttcctttttcatgaaaagctcaacaacttcaaaatctttgttttctggctgtttcctcttgtcttcgattgttcttgttctttggatttttttgttttaactttttttttgtctgaaactgctgtttcaatttggaatatgttgcaggagtttttgaggttgaagctgttcctccttggtaaaacagagcaattatgctaacttgcgccgtcttttcaaatcttgaccatcatcaaaatcatcagtaagctataaccatctgtttataaccatttgcttgaatcaagaaaaaaagtttatcttctgtttcttgttatgaacagttgaaaggaatgttcaagaa

SEQ ID NO: 14473 - DNA, 3000 bp, Unknown
  misc_feature (1)..( 3000): cDNA_ID_3017325_gDNA_ID_2684121_Annot_ID_190984 3000 nt of promoter + ATG
ccctctgcctcatattcccatgagagtctaaacaactttaaggtgaaataagtttcctaaagcagtaaatgatatttaaccttagcaggaagttcatctgtgggaaaattgaactcttcaccccacattggatttctcgagccagggaccatagaactgtaacaagcacagagctactacattaacattagaccatcaaatgtgtaagcactcaacaaccaaaccaccaattatatgttttcactttttttagatggatagaggttgttgttggtaagaagctaaaagacagcggaaaagagcaggaaagaaacatgacatcgaaaaagttgctcacatgttcctttgaaaagttataacactaattgaaaaggatatgtaacaacctgaatcgcttttctgatccacaattaacaatagcataaggatctgatgttccatttaagttagcaccaattagattcttagcagccaagagttccacctggaagaagatcctcacattgatgcaatgttagtatcctatctatgcacagatgaatcataagaatcaggagaagcatttaccttgactatataagcagcattagtttgagtgtctcctctcaagtgtcctatctacaaaaataagtgcagaaactgcaagtcaaaaaatttggaaaattacccaattagagaaggggaaagctaaaattcattaagaacccacgagatttctccggctaagtaaactgagaaaccgatcaatttagagaaatgaagaagatgatataaaaaccttgtctttgtcaaaggcgtcaccggaatcgagattctgcatgagacgagaccgatcaaatccaacaccgacgacatcgtcatctccgcctcctctgtaagcgaatagccaataggaagcgattaaaaacacagaagcgaccaccgcgacctcaatctcccacgccgacggtaatagaacttccaccgctgactgtaccatctcgatcaacggagttaaaaagtttaaatttttcgaaacgaaaagcgcgatcaagaggattgtctagggatttatcctatggaggatcacaacacagagaatcaacattattctggagagaagaaacttcgccttctttagaagaagaacaagtgagtcaaaaaaggacaatcgctgagaaagaaaggattttggaaagaaaagtagaaactgagaaattagttgtaaggacggagttacggaaatacccttggaactgtaaacagttactggctgtgggactcgaggactgtgaggagaattcgagggtagttctggtaattaagaaacttcgaacgtaaatagtaaccgtagaaaagtcgtacgaagactttttataaactgaaaaatgaaaaatcttgtcgtgatgtatattaaccaaattttcttactggttgaataaaaagggaggccaaaaacaaaaatcgaactagtcaaattgaaccaaaccacactaattacgttaagtttggtttaaaatttcaataaaaactggtatatgactcaaatccgtgaatcaaattagagtttcttacttttctattgactcaatggtttttatttgttttacttagaacaaatttgtaaaactatattaaaaaacattaaacaaaagaaacaagtgtaaatatataccttagatcatttaattaaaagctctatttatagaaatgtatattcatattattttttttgcatatctaattaacaattaaaaaatccaaggatacaatagatttgatttctaaaacctagtaaaccggataatgatccataataagattaattcagttaatttatcggttcggtcttaataaagtggttttaattgtagaaaaggcgaatggaaagaggccacgtggaaaacaaaggagacagatagagagggaaggacccgttttaggttttttgattgaggtataaatagatttcgatcagtagacgtttttttaagttgcctttacacattctcttttgctcctcctccttctctcttactctcttctcgccgcaaaacctcacttgctctctctttctctctggtatatctcattatctctctatcttctgtgttgttgtatatatgtatagctctaacttcgattctttacgagctcaatttctttgtttagatggttccaaatgttttacctttttactttttttaatacctttttgtctttgttgctgccatgtgagctcaagctctgttcttgttagtgggttaaattcctttcttttatggatattctgattctttgagcataattgttgagaattgaagtcagttttgtctcggttactcaaaagtttcgagctttgtatattgctagtgatagaggcagcttcaaatccgaacaataggaatacttagagtggactttgattgtggtgcccctgagatttactctgtttatttggttgcaaatattgtacctttgcttttacctgccatgtgagctccaactccgttctttgtcgtttgctagcttcccttttttaaatagttttcagattccttgagtataattgttctgaattgaagtagggtttttcttggctgctcaaactttgtagattgctactttgctagtgatagaggcaacttcaaatccgaacaaaaaagatacttagattgtgcttctcctgagattactttaaagattttactttggctatgaacaaaagcctatagctttgtcttttatagtctaatttaagtaatgaaatcccagattcttagttaatttagagaggaaaatgggtagtttgaaaggaaagtgatgagatttcaagaattctactaagattttatattgcttgatgcattctactttcaacctgaatgttagtagcagaggtactgacagtcttttatccgcaggatctttatcggggagcattacccgcgttttaacttacggtttccaatgtgaactaagagtgtgttatcagttgtgatgactgtggctgaaccacac

SEQ ID NO: 14474 - DNA, 3000 bp, Unknown
  misc_feature (1)..( 3000): cDNA_ID_3017331_gDNA_ID_2684121_Annot_ID_190982 3000 nt of promoter + ATG
agtctgaaaaaaatgagaaattattgcagttttggtgaacataccaccaaagtcatcagccaatcccattccatctgagctcaatctcttggtctctgtaacaaaaaccgcagcaatatatgaatgatatgctcaaagcaaagacagagttatggagttaataatgttacaagtacattagtctcttaccgatataagaaaagaggttgtgacatgccatatatgaagctatatcatctgtgctctcgaccttcttacgctttcttctcttctttgctgctctttttttgtaacacggattagagaaaggcaatgactttatcccctcaccacaactttccaacacagatggatcaatattagcttcaagcttttcttgatcatataactcaagctctttcggatattctaatgcccgagactctaactctctaattcttaactcaacccacttggaccgccacatcagtggcctgataaatctcctccagtggttagttagccttttcttcctagaaaaaacacacggaagagaaaactaattacagaacagcaagaacagtagaaaagaaagaacacgagaaggatttaggcagaaaacacacctaaaatgaaaaatgctgctaaaagaatcataagcaggacctagatcggtttcatcccaataatgagattcgacctcagcttctccggttagtccatcaagcaacatttcagcattctcagatgcagtgtcggaaaatgagcttgagtattcagtagcgttcgggtcctcatcagtggtggaagtcttgttttcatcagattcaactatatcaacatccaattcctcaccaccagaaactgaagtaacagtttcctcacttgtattagcactggtaagaccacattctttatgttctcctccaggactttgctctttctttggcgataacctctcaacatcgaattgcttactttcttcgttgagctccatgtgtggttcagccacagtcatcacaactgataacacactcttagttcacattggaaaccgtaagttaaaacgcgggtaatgctccccgataaagatcctgcggataaaagactgtcagtacctctgctactaacattcaggttgaaagtagaatgcatcaagcaatataaaatcttagtagaattcttgaaatctcatcactttcctttcaaactacccattttcctctctaaattaactaagaatctgggatttcattacttaaattagactataaaagacaaagctataggcttttgttcatagccaaagtaaaatctttaaagtaatctcaggagaagcacaatctaagtatcttttttgttcggatttgaagttgcctctatcactagcaaagtagcaatctacaaagtttgagcagccaagaaaaaccctacttcaattcagaacaattatactcaaggaatctgaaaactatttaaaaaagggaagctagcaaacgacaaagaacggagttggagctcacatggcaggtaaaagcaaaggtacaatatttgcaaccaaataaacagagtaaatctcaggggcaccacaatcaaagtccactctaagtattcctattgttcggatttgaagctgcctctatcactagcaatatacaaagctcgaaacttttgagtaaccgagacaaaactgacttcaattctcaacaattatgctcaaagaatcagaatatccataaaagaaaggaatttaacccactaacaagaacagagcttgagctcacatggcagcaacaaagacaaaaaggtattaaaaaaagtaaaaaggtaaaacatttggaaccatctaaacaaagaaattgagctcgtaaagaatcgaagttagagctatacatatatacaacaacacagaagatagagagataatgagatataccagagagaaagagagagcaagtgaggttttgcggcgagaagagagtaagagagaaggaggaggagcaaaagagaatgtgtaaaggcaacttaaaaaaacgtctactgatcgaaatctatttatacctcaatcaaaaaacctaaaacgggtccttccctctctatctgtctcctttgttttccacgtggcctctttccattcgccttttctacaattaaaaccactttattaagaccgaaccgataaattaactgaattaatcttattatggatcattatccggtttactaggttttagaaatcaaatctattgtatccttggattttttaattgttaattagatatgcaaaaaaaataatatgaatatacatttctataaatagagcttttaattaaatgatctaaggtatatatttacacttgtttcttttgtttaatgttttttaatatagttttacaaatttgttctaagtaaaacaaataaaaaccattgagtcaatagaaaagtaagaaactctaatttgattcacggatttgagtcatataccagtttttattgaaattttaaaccaaacttaacgtaattagtgtggtttggttcaatttgactagttcgatttttgtttttggcctccctttttattcaaccagtaagaaaatttggttaatatacatcacgacaagatttttcatttttcagtttataaaaagtcttcgtacgacttttctacggttactatttacgttcgaagtttcttaattaccagaactaccctcgaattctcctcacagtcctcgagtcccacagccagtaactgtttacagttccaagggtatttccgtaactccgtccttacaactaatttctcagtttctacttttctttccaaaatcctttctttctcagcgattgtccttttttgactcacttgttcttcttctaaagaaggcgaagtttcttctctccagaataatgttgattctctgtgttgtgatcctccataggataaatccctagacaatcctcttgatcgcgcttttcgtttcgaaaaatttaaactttttaactccgttgatcgagatg

SEQ ID NO: 14475 - DNA, 3000 bp, Unknown
  misc_feature (1)..( 3000): cDNA_ID_3017335_gDNA_ID_2684121_Annot_ID_190981 3000 nt of promoter + ATG
gtataacgagtactggctaaagattaagcgatcatcaacaagtctacctggtctggtaacccgggcaaatacaaacgcatcttgagatcttatgttgattcaaatgaaatgaagatagtgatcggttttcttactggtttaagtagtttcccttagacccttacccgtgtttttgtttttgtttaagttacttttgccagtagtaaatattgatgctcatcgtcacaagtattgactctgtcgtgtttacgtaaatgaaaagttaccctgaatggctgaatcatattatatagaaaaagtaatcgaaatcgataacaagagcagagcatgtaaagaagaataccgaggagatgacataaggtgttagttagggaaccggaatgagagtttggaagtaagaagaagcaacaacacgagcgtatgcagacttgtctatatcaccaaggctactggaggatgagtgtgacttaagatacgacaatgcaacttctagcatcacttccacttctttaaagaaagtgtcaaaaacaaatgcatcagacaaaccgaaaaatgacggccttttagtttatcgattgaactaagggcaccaaactaacctcgtcaattgcccctgctttaatcttcgattgcatcaaacaccatttcttgaaatgtacacctattgaggaagccaaagagatcattccacactatgtgctttgcaaaatttcacacggaaaagtagaaatcattactttggtttacttaccgactcttatatctataacagatgaaattatctgggaggagatcaaatatcgtttgcagaggccctggcttttgatgtacaatggttgggccttactgagccaatgacccctagatatcttttcagagacctacctcatgattccagctctgcgtcttcctttgaaagtcaaactacttttgtggtaatagcagccagtagtaaatgtaaaccaaggccaaatagacaaacttttttcgtaacttttttgtattgatattaaaaatattctgagatattacagactccagaaacatttcccgtatctcgagtccgacttaacacatatagtaacacctttacttaaactaactggtaaaatggatctttaaaagtgttccactggttttcccactgcagctttgcgaccatctgctcaaataaaaggatccattttaggatctacacaaattaaataattaactggtgtagatcctatatagtttgagcatatactttgaatcttaacaaattgtttcagatccaatttgtaaaagcttgcaagagcacatatccacttagaaatcgacaagcatctatgtatctacatcacataaagcatttgttggaaacatttacaccaccaaagagtgttccaacaaataatgtcctacgactaacctcaaacaacgttttttttgcttgaacaatgctgaattttctgcagtagattctggttttctcgcagatcttcacgcgaaaatcaaacatccttcgatactaaacttcaacatttgaaactagtagcatctcttctggtactctgacgagggagcagacactatgggaatgtaagggcagttccaacctcccagacatattttaataccaaatgaactaagattagaaagggtaagagatgcgtgtacataccagttattactataatagttagtttttataatttcaaaactaaagaatgtaaaaaataagttaaattttttaaaatataaaaatttaaattaaaaccagaaaaatcttattaagaacaattaagtaaaggaacttttttttgtcttatcaattaaaaaatattaacttcttattttcatagaaaaaaaattattacaattaaacccaatacacatgactatatgagttttataagaaagtaatatgaaaaacaattgagtatataactttttagtctaacttttgcacggtaatttttaaattcaaaatcaaaattttaataaatatttaatcaaataaaaattaatatttttaattgataatataagaaacaaactaactattgattaaaaatatttagtaaattaaaaaaattaacttcttaagaaactaactattaatattatgaatagttcatatcttaaaattgtttattctttgcacacaaaaaaaaatgtttattctcttaatttagttttgaaattgaaaaaagctaactattataataattatctagacgaaaaaattgtttaaaaacaatacagtttttagattttctatgcaatattattaattactattgataaactgtaaacttgaagaaaaaataattgactatcattggtttagaattgtagaaaaactgtaaatcacaaaagcatcatatacatttataattaacttttaatatattttttgtatatgtgtgaaaactctaaaagatcgattatttacacaaagagtaaatttaaacataaataaaactgaataattaatattaccccacatgtttataaaaacaataataataaaatactacatcacaagattgttttgtatgtagactctaaaacaaaataaaaattaatttaaaaatattcgggttacgccaggtatattttttaaattttatcaattaaaatataatttaataaatataaaatttatggtttaacataaaaattatttgaaataattaatatgaacttgaattagggttttattttttgagtgacgttaattattaaagaaagaaacaggaatatcataaaaatagtttctagtaacctttaaaaaacgttgtaattcagaaaaacgtgaaaccaaacgggctacaaaatatattaaaacacagagtacaacaggcttttggtttgagcccaaacaagcccatttaaatctatttagtctgtaacataagtcacgtgcacctatcacgtgatcatcttctttcttccttttttcttgtcatctgttacacatcggttagggttttagtttctcttaccgagattcaa

SEQ ID NO: 14476 - DNA, 3000 bp, Unknown
  misc_feature (1)..( 3000): cDNA_ID_2990644_gDNA_ID_2684121_Annot_ID_190980 3000 nt of promoter + ATG
ttgataattacagctaattggaaggctctgttgtttaacttacctcggggaagtttgcgagtttggccgggttaggccgtcccatggcaagaatgtaagattttttgccagctgcagatatgagtgcttgcatatggtgaatcatatgaaggtaaccagctgcatatattgccaggtgacattagacatttaatgaacttatcaatcttgacatcacaaaatcaatcttgacaacacaaatgcagaagaataggaacttaccaacaccaagagtccccaccaaaatacctataatattcgcatccttagctttttccaccaagtaatatctgcaacacataactctgaatgaggacttgaaatgtaattcaacagagataataaagaagatcgaaatgattgacaaagtttcatattgtgatgtataatgtctgcttgaaaaaagtgattataccgtcgcttaagtatccttctttgttgataaaattccgtcaccaaagaatcttcttcagcatcatatctgactaacatcaacaaacgaacataaacaagaagataagctactcatgccttagtcaacccattggatatttgtttaagaaaaatggatcaagaaatttccatggatagagccatatacctatgtcacaaccattgaaggtcagtactacattggcaaaagctgaactgtcagaacctatccagaaaagtaaatagtcctcgattttgcttccttctggcaagtcccaagttagccctcctagtctatagctcctagatgaggataagctatcactagaatcactttcgctatatggtctcggatgctccatggattctctaggatctttggatggactaatgaatgaacacaagacattggctacagataattgagaatcagtcttcgataatcctaattcttctcggatttgtggaattacatgcgcgtattctagaccataaagaatctgaaaacaaagcaaagattgagaaaacagaacatgttcatcaatacctataccataaagataaacttatgaaaacaaagcaaagatagagcgataagcctcacataccatgataggcttatcgctctttgacgcataatctatcaaatgcttaacacagctggagacgtttatcgaagctttcccaaaaacgaagaatgctggaagaactgatgtcctgtgaaaacatagaacctcacaataagacattgtttcaacaagggaatttaaagcaattacatagatgaagaaaagggtttatgactcacgggcttagacatgtttgaccgtaatgaacaacacattcagaatcaatatgcaaagctccaacttcatcaatacagcaactaccataagttgtgtcagccattacaaagaacctgacttctctgtcagtaagcaaacgagttttgctcttaagagcactcacgaccttagtcgaatcttttaacaactcatccgggaactatgaaagaaaaaaactaagctttatcatcaaatattcattgaagtaacaatttgaagctaagaaacaaaatcaaacttcttcattcagaaactggagaaaaggtttggtacctgtaaagcaattctggtgaagcttttgctaataatgaactccgccgtacggttaatctcgtactttgattcaaattccaactccatagattaatcacacgaaattatcaacctttccggccgaataactaaaatcgtcgtattcgtcgacttggatttgcggctgaagaaaaacaaaccagacgtagaagaatgatgcttgatgaaacggcgtcgtttctaagtatagttctcatcactggttttccttatttatcaaaccggtttaagatcctaccaaaaaaaatcaaaactcaaaccggtttttaagtatttattttagcggttatgatgaaacgacatcgtgttgattccttaaaagtgcctgaaacatgaagtgagctcagagtgattcaactgatggatttacagaagataacaaagacgagagaagctccaaaaaccctaagagccatttttcacagttacaacttacaacgcaatgaaagctgaatcaacgaagttactttcagaaaaaataacaacagtgtcccttttttttgaattgaatttaagggaagattcgagcttgagttaacgccagaaatccgatcagtggcaaactacaacagtttcatctaaatcaatcaaactataaccaagtcgaagctcaaaagaacaaacactatgagcgcttgtaagaagcagaggataaaccatagagaagagagatcagatgaaatccacatcgcaaagcttgcaattaacgatgacgttcgacaaagaaattttaaaaaaattaacctttttagtttccgattgcattcaaggatctgggttttgtcgcgacgtcgcacagagaacgatggacgtcgagcactatgtttccgtattgattaaaaccggttcaagtatatatttatcggtctatatttgcaaataaatcacacccacaccggccatcgctggtttccttatttattaaacctggttttcatcggataagacgaaacgacatcgttttaatccaccgccgtcaaaaacaatttcttcggtcaattatacctctaagcttcgaagctccgacttcttcggtctgtttcttattaaacacacaaacaagaaaacgcaaaactaatcctctctcgaattagggtttcgtcaaggtattacattatttcacacccttatcatcatcttctgatttctggtaatcttcttttgattagatcttcctatcgattggttcagtcctttcttattttcgaattcttgattggtttaccgtggttgctacgatttaaacctttaacatacctaaaagaacgtttttgtttttgctttttgttgttattgaagtttttttttttttttattgttgttgatgaagatcctggagttgatgtattgagagaagccattgagataagag

SEQ ID NO: 14477 - DNA, 3000 bp, Unknown
  misc_feature (1)..( 3000): cDNA_ID_3017338_gDNA_ID_2684121_Annot_ID_190979 3000 nt of promoter + ATG
cgtcatttttcggtttgtctgatgcatttgtttttgacactttctttaaagaagtggaagtgatgctagaagttgcattgtcgtatcttaagtcacactcatcctccagtagccttggtgatatagacaagtctgcatacgctcgtgttgttgcttcttcttacttccaaactctcattccggttccctaactaacaccttatgtcatctcctcggtattcttctttacatgctctgctcttgttatcgatttcgattactttttctatataatatgattcagccattcagggtaacttttcatttacgtaaacacgacagagtcaatacttgtgacgatgagcatcaatatttactactggcaaaagtaacttaaacaaaaacaaaaacacgggtaagggtctaagggaaactacttaaaccagtaagaaaaccgatcactatcttcatttcatttgaatcaacataagatctcaagatgcgtttgtatttgcccgggttaccagaccaggtagacttgttgatgatcgcttaatctttagccagtactcgttatacacttttttcctcgacatcttctcgaagaatctactccaaccttccataactcgggtcagcctaacactcttgggtcttcctataaggtacctaatgtaatctcttgcaagacggaacaactcctccccattgatgatgtagaagtactgcaaaaaaaagaaacaatgatcaaagctaaagatactataattcaaagataacttgtgcgggcttgtgatcttgtccttaccagaaagatgaagcctaaggttgctaataccacttgcagagtttcatccccaaaactagcaagaccaccatcttcccctgatgagcctccagacccattattcccaccatttctaccgccaccccctcctcctcgtcctcgtggaggaatgccgccagtgtctttcttttgtatctgctcacgcaacatatcttcaactgatttcttccccattgctttctcaatagcttcccatgttgatgatagctgatgataaaacatcatcactgagcgtattaatatcagacgcactaaagttctgtgccttaacttacaaacacagacaaaaagatcacttttgcaagatttaatattcaaatctcagcaagaacatctatagaatgaagagaaatcatctgatctcataactactatcagatttatcctttcgaccaagtaagtataaaacagaaaagaatcatatcaatactacttataatcagaaacataactcaactctgtgccgaacttcttacacgcacacacacacaaaaagatcaatttggaacatttaaagattaagcatcatctttatatgatctaataagcaaagacatcttagaatgaagacgaagcatctcacctcattactaccgttagacttatccttcccaccaagtaaacacacaacaggaccttgcctctgattccggcagcgatgattctgtagaggcgaaaactgagaagacatcgatgatgatgcagatgcccgaatagctaatttggggagtggtcgataatcaaagcgtaatgacgacataaaaggtgcactagagacatgtcttgtttgcgttgtccttgcacagaacaaggatggtctgcatagattagcctgcgtagagctcatctcttatctcaatggcttctctcaatacatcaactccaggatcttcatcaacaacaataaaaaaaaaaaaaaacttcaataacaacaaaaagcaaaaacaaaaacgttcttttaggtatgttaaaggtttaaatcgtagcaaccacggtaaaccaatcaagaattcgaaaataagaaaggactgaaccaatcgataggaagatctaatcaaaagaagattaccagaaatcagaagatgatgataagggtgtgaaataatgtaataccttgacgaaaccctaattcgagagaggattagttttgcgttttcttgtttgtgtgtttaataagaaacagaccgaagaagtcggagcttcgaagcttagaggtataattgaccgaagaaattgtttttgacggcggtggattaaaacgatgtcgtttcgtcttatccgatgaaaaccaggtttaataaataaggaaaccagcgatggccggtgtgggtgtgatttatttgcaaatatagaccgataaatatatacttgaaccggttttaatcaatacggaaacatagtgctcgacgtccatcgttctctgtgcgacgtcgcgacaaaacccagatccttgaatgcaatcggaaactaaaaaggttaatttttttaaaatttctttgtcgaacgtcatcgttaattgcaagctttgcgatgtggatttcatctgatctctcttctctatggtttatcctctgcttcttacaagcgctcatagtgtttgttcttttgagcttcgacttggttatagtttgattgatttagatgaaactgttgtagtttgccactgatcggatttctggcgttaactcaagctcgaatcttcccttaaattcaattcaaaaaaaagggacactgttgttattttttctgaaagtaacttcgttgattcagctttcattgcgttgtaagttgtaactgtgaaaaatggctcttagggtttttggagcttctctcgtctttgttatcttctgtaaatccatcagttgaatcactctgagctcacttcatgtttcaggcacttttaaggaatcaacacgatgtcgtttcatcataaccgctaaaataaatacttaaaaaccggtttgagttttgattttttttggtaggatcttaaaccggtttgataaataaggaaaaccagtgatgagaactatacttagaaacgacgccgtttcatcaagcatcattcttctacgtctggtttgtttttcttcagccgcaaatccaagtcgacgaatacgacgattttagttattcggccggaaaggttgataatttcgtgtgattaatctatg

SEQ ID NO: 14478 - DNA, 3000 bp, Unknown
  misc_feature (1)..( 3000): cDNA_ID_3017351_gDNA_ID_2684121_Annot_ID_190975 3000 nt of promoter + ATG
gagactatgtcggactctgaaaactgtttcagatgctgaatcaattgacggtacagaatttggatctcgtagtgtagaaatgacaaatctcccacaggctactgtatccgttggaagctttcatacgacatttcttgatactgacgtcaactctactcgaagtaccttttcgaacatctcctctaataaaagaaatgaaatggcaggttctcaaggcactcttcagcaggtatgatgatgcatctaatccattcatttactctaatatattttgatacatgctgctaggtatagagactgagtattgttgtatatcttacataggaaattagcggagcaagaagattagagaagaagaaaagcagtacagagaagaatgtgagcttaaatgttctccaacaatacttctctgggagcttaaaggatgctgcaaaaagccttggtggtgagaaactagtactagtagtgctctttgcttgtttcccttacaagattattcaattgctgatccttggatgtttttctttttgctttctttctgcagtttgtccgactacactaaaaaggatatgtagacaacacggaattatgagatggccatctcgaaagattaacaaagtgaataggtcactaaggaaaatacagacggtgcttgactctgtccagggtgtagaaggaggactgaagtttgactcggtgacaggggaatttgtagcagttggcccttttatacaagaatttgggacccaaaagagtctgtcttctcatgatgaagatgcacttgcaagaagccaaggtgatatggatgaagatgtgtcagtagagcctttggaagttaaatctcatgatggtggcggtgtcaagttggaggaggatgttgaaacaaaccaccaagcgggaccaggtaaaaaataataactacattttaagaccttttttggaggagctataagaatgtgaatatggtctaacaaaagatcattctcattgtgttcaggatccttgaagaagccatggacttggataagcaaacagtctggcttgatctatagtgatgataccgacataggaaaaagaagtgaagaggtaaacaaggataaagaagacctttgtgttcgaaggtgcttgagctctgtagcacttgcaggtgatggaatgaatacaagaatcgagcgaggtaatggaactgtagaaccaaaccactccatatcaagtagcatgtcggattcatcaaatagctcaggagcagttttgctgggaagttcatctgcttccttggaacaaaactggaaccaaataagaactcataacaatagcggtgaaagcggatcaagttcaacactaaccgtaaaagccacttacagagaggacactgtacgtttcaagcttgatccatacgttgttgggtgttctcagctctacagagaagtggctaagcgtttcaagctgcaagaaggtgcctttcagttgaaatacttggatgatgaagaagaatgggtgatgttggtcacagattctgatctccatgaatgcttcgagatattaaatggtatgagaaaacatacagtgaagtttctggtccgtgatataccgaacaccgcaatgggaagttccgcaggcagcaatggttacctcggaacaggcacctaagcatcaatgttattgtgcttaaatatgtacagataatctatgtttggtctgacattagttactcatgtagaaagacaaaaaaaaaaaaaaaaaaagggtgcagtggagttgaagaatgtatataaacatagaaagacacatcacacagatcctatatttttgtctcgaacaagtcgtagaagtaaatctgaatatatcagaaacgcaaggagatagaagctcaaatctgtggactgcagattagacatacatgttttttgttttgtttttgtcatcatcttcatgtttccaacttaatttcttttgaaatattctacttaaattaaagttgtttaaaatagggctattatattccagatttctttttaacagcttctagatttctttttattttataacttttggtataattattcattttggatctaaataagtttatttacgtacatccgatctaaaatagtttattgataaagctttctaattaactcatattttttttattttttttgtcgaaagtgaattttattgattaagagtgacaaaagtcatgatacaattgttcaagaatccaactagggggacaaacattatcagagtaatagttacaatggagacaaccctgtttagcaagtaaatgagctaccctattacactttcgttgagtgtatgaaaaactgatgttttggaatctaattaactcatatatattctttttttttaaacacccatttttttttaccataaatcaattgttccaatattttctttctattcaatttttacatctacagtaattattgtattatgagggggtgatttagttatctattttgaatgatttgagtttttttgtgagttatagatgattttgggtaaatatagtaaaattgataacttatgaattttcctaataacctagaacacttttttttttttttgaatacctagaacactttaaaatcattaaagaccaatcttggaaaaaaaaaatcaataaaagtggatttgaatatactctttcaaattcattagttcaatagcattggatttagcaattcttattataaccaataaccctagattttttattaaaaaaataatctatgataggataacatatgaattatcatcccaaacaaattaatttattgcttgccaaaaaaaaaaggtatattaatattgttactttttcattttattccacctattgttgttattattttgttatatctttatgtaatagtagtatactaacgtaagctataaaattctaatagaaaattcatctatatatatatattcttatgggggtgtaattgtgtaaactcgtccgtaacagataacata

SEQ ID NO: 14479 - DNA, 3000 bp, Unknown
  misc_feature (1)..( 3000): cDNA_ID_1694329_gDNA_ID_2684121_Annot_ID_190971 3000 nt of promoter + ATG
caaagacattgcgtaaatcatctgagaagcctgcaggttgacacatacaggcaataatctttcttcaaaaacaaagggaaaaagaaggcaaaactgtcgaaaataaaataataatcaaagaaagttaccagtaaacaagggctcattgaaattttgatccttccttgactggttattcattctccaaaactttaatttggatgaaggcatcttctttctcttacgtagagtatcactaggatccttaagcctttcacttatgttcctgttcaaactatttgatcagtacggaacagctaatgaaataatcaaagccacatgaagcaacggaaaagttattacttgttggttaatactgtgacaccatcaaagttcttcctcttccttgcccttctttgtggttggggaggaggagatggctgaagcaccagttgaggtgatggatgcacttaacataaagaaaaaagtgttttaaatagataataagagagagaatgtagtggttaagcttcaaattatcagactatgttgctagctcaccaaaatctgcacgttcttcctcagaaccagcagcagaacctggagatcctgagcgaagctcaaacgcagaatgccttccagaatttaacatttcttcatcaatactagggatagtgggttccttctcattcaaagtttcatccaatgactcagtgcgttcaactctgacatcctgttgttgtgcagcaaatgatggatgggacgtggggcttagatcatgtgcagcgtcacgcattctctcaatctcgggaacagttccaggagaagtggcatcgtttctctcggaattgggaatgcgctcttctgtcaagttactttgtctaggatcctggacttcagtgaattcctctgtgacgttacgaggactataggttccagtatcgaaagcaatattggagtctcttggctcattgtctggtcctgtctcatgagccgtttcaacatcaatttctccggtatgcctactcacaggttctgttgattggctgctcaaagcaaaaaaatatgtaacaacattattaaagaagatcaactaaacagataaggaagattaagagcaaggtgtagtaaaggaaatcaaaactctatgaagagcctcactcgacatccatcgggatagattctgagatgatgtcctgtaagaaaggcatacaaactttcattcaataacaagtgctcggagacatgggaaacaagaagtcagaatcaacttcaaagtcataagaagcaagcagtaatctcacctcgtcgaatgttacagcaacataaggatcaatgccagtaggaatttgatctgaaaaataagcatcaacatcataaacacctcaaaatcatggtatgctgcatctagaaccaaggaaaaaaaacacagacaaaaggtacctgtgagagtgatatcttcctcactccgagtatgattatcgaattccctagaattcacaagaaaagaatgttaaagatgagtcaggctttagaacagataaaaactcaaataaaagcaagaaagaagaatacatgtcgagagtgtcatcttccaagtcgaactcgtccagatttagtgcttgaggcaaagtaacagactcaggcggggcctgtctggcatcctcaggcaagttaacttgagtagaaacgaaagccttagctacccaagtattaaggagattccagtcattgtaaagataatccactttctttgaatatattcgcactaccccaactagaaggtgacttgacgttctcaatgccaatggtacttcaggaaacattatattatctgcaaagccaattgcaaaattctcgaaaagtcagaaactttattaaagcagagaatttcaattactacaatgggttatatataaaaaacaaaatcggaatttgatgaatgcccatgtaaaaattcgtattgcctttttgaaatttcgaattggatacaatcaaaggggattcaaaaaaaaaagaagcgaactttggatcaaaaagcgaaaattgaagataggaaagacgaaccaacagtgtcggggatgttgatggaggtgtactgagacttcttgaggcgttggtgcacatgagcggcgcaccacaccgtccccaatggaccctttcgagccaaaagcgtatgtgaataaaacattttaattccttcgaacaaggagccctaaagaagcagagatggagatactgaagttgatttgagagagaaggattatcgaatcgaaggtgttacattatttagagaaaccaatcaattttgaataggaaactgcagagcgaaagagagagagacgaagcggtagggttttgtgtgcttttggagagaggaagaagtgtttttttagtggagcgggaaaaaacattttgtggcgctaatgttgaaatcataggcaaatagacgcaatgacttaaatacccttttcttattggatccgagttttttgaaatttgccaaacaaaacaacttgggccactaaacccaatggccaacttttcggattaatgggcctaaggggtacatttggaaattcgcgtatatgagagtctagggttttcttcatatttaggtttctctatttctttcagacgctgggttcttgcttttgctgtttgttctcttgagtggaagaaagttgcagccactaaatcagatccgacaatggtaaagttttcttcgcctctcagttttattattctcaggaggattattgaagctaaatattatttgtttgattatctgttctcacgactaggattttagtaaagtttgcatgattgagctgaaagtaatcaatctcttattgtgggtttcttgtttggttactgataatctagtagattagagtcttcctcgtaattgacccattggtttaagtttcatcttgaaatgtatgaagtgttcatcatgcagtaacatttgggtcgaagtcttgttgtgtgttctgttttgttttgtattgattgaaaatg

SEQ ID NO: 14480 - DNA, 3000 bp, Unknown
  misc_feature (1)..( 3000): cDNA_ID_3017363_gDNA_ID_2684121_Annot_ID_190972 3000 nt of promoter + ATG
gatttcataaagagacaggaaatttgtatattgcagacgcttactatggtctacttgtggttggtcctgaaggagggattgctacgcctttagctactcatgtggaaggaaagcctatactctttgccaatgaccttgacatccatagaaatggctccatcttcttcactgacaccagcaaaagatatgacagagcgtaagacaactctcttattcttgctttgtatgtcaattcctaccgtaaattgtatgatatagaaattatacttgtattttgtaggaatcatttctttatattactggaaggagaatcaacaggaaggcttctaagatatgacccacctaccaaaacaacacacattgtgctggagggtttggcttttcccaatggaattcaactctctaaagaccaatctttcctcctcttcaccgaaacaaccaattgcaggtatgaccctcaactttgtgtttatatagctgtatctatcattcatttctcttcatcattatgtgtatgacagattggtgaagtactggctggagggtccaaagatgggtgaagtcgaggtggtggcagatctcccgggattcccagacaatgtaagaataaatgaagagggtcagttttgggttgcaattgattgttgcagaacaccggcacaagaggttcttacaaacaacccttggataagaagcatctactttcggttgccaataccgatgaagctgcttgcgaaaacgatggggatgagaatgtacactgtgatatcgagattcgacgaggaaggtaaagtcctggaggtgctcgaggatagacaagggaaggtaatgaagctttggattggaacagtggctcataaccacattgccactctaccttatcctttgacaatgaatcaatgaaggactttgttgtgtagttcctgaactaaatcatctctctgtaacttaattatcttcgttttgattcaagttcctttggaccggtttgtcttttgttgatattatgtgtgaccttagattcctcatgaaattctctttctttctttcttgagtctctttttttttttgtttggttcacgtcctatggaaggcttcataacttgagccatcgcccagtcttcttcgactcccgcgaaatagaaaacaagagtatgcaatgaagaattgccttggaaaacaagagtatgcaatagagaaagtctcgaaagtgttggaaggttgaagataaagagaatacagagaggtaacggaaaaataacgactgctttttctccaaaatgatgacgttacaatcatctccattacgacgttttactcttttttcagtaactttttctgtagtttgtttggcatcacatagcaatgaacattttatgaaatctgtggtgtctgctttcttctcaaagcacaactatccaaaactccaaactgttggggccatatatattactaaccaagttgatagcaaaaaaaaatacaaatccaactcataatttagtcttgaagttataagaaagaaactcaacggaagtctgaatcatagtcattcaaaagacagcagaaagggaaaaaacaaaatcatctaagacaagggtatataaaaccatgatagatcctgatttcataagatcttcaaaggtcttgcacactcaaacctgaaataaacaattggcaaattcaacttagatagagatagacgcatgcgttcatggaccaaccaaaaataacttgtgacctaaacatgccaattaaaagtgtctgaattaaagtagattaaccacaagactattcgaattcaaaaaccaaaatccaacaatattatgacactagaactttcaagtgatgaattactcaaagctaggaacatctatccaatctaacaaatgttatgagataagaggtttcaagtgtgtaatgtttgggctgagtcacagagagagagagagagagatagtgaacctggaggaagagactgcttcaacttatcggccttctcttggtcgaagacacatagtgtgtagaggtaccttgagcacctgaccttgaacttcacaatgtccttgcttctcttgatcttcacagaccttgcatccttccttctcgccgtcaaaaggaagtccttgatctcatggatttgcttcggctgcagattatccaaaccaacatccattttcaatcaatacaaaacaaaacagaacacacaacaagacttcgacccaaatgttactgcatgatgaacacttcatacatttcaagatgaaacttaaaccaatgggtcaattacgaggaagactctaatctactagattatcagtaaccaaacaagaaacccacaataagagattgattactttcagctcaatcatgcaaactttactaaaatcctagtcgtgagaacagataatcaaacaaataatatttagcttcaataatcctcctgagaataataaaactgagaggcgaagaaaactttaccattgtcggatctgatttagtggctgcaactttcttccactcaagagaacaaacagcaaaagcaagaacccagcgtctgaaagaaatagagaaacctaaatatgaagaaaaccctagactctcatatacgcgaatttccaaatgtaccccttaggcccattaatccgaaaagttggccattgggtttagtggcccaagttgttttgtttggcaaatttcaaaaaactcggatccaataagaaaagggtatttaagtcattgcgtctatttgcctatgatttcaacattagcgccacaaaatgttttttcccgctccactaaaaaaacacttcttcctctctccaaaagcacacaaaaccctaccgcttcgtctctctctctttcgctctgcagtttcctattcaaaattgattggtttctctaaataatgtaacaccttcgattcgataatccttctctctcaaatcaacttcagtatctccatctctgcttctttagggctccttgttcgaaggaattaaa

SEQ ID NO: 14481 - DNA, 3000 bp, Unknown
  misc_feature (1)..( 3000): cDNA_ID_3017419_gDNA_ID_2684122_Annot_ID_191006 3000 nt of promoter + ATG
tcaggatgcaaagttatcttgatttcatttttttttgttaattaaagttgggaacttttcctcttaagacatataataagtagataaatgtgagatcacttttagatcacatacacataccaattcatagaaaaaattgtgtctttttagactacaattgaaacagaacttgaactataaacgaaattccatattcctaaaccctaagctcagatcattcgatcttcctctttcttacgagtgctcacgttctctcacattcaggtatttttgagcttctaacgttctaagtatatacagtatagaacttcaagaagacaagaactttgtggaccgaacactggatttgcaatgtaattcttctatcaagaaattatctctgaaatgtcacattggagagaacaagaaaggggagatggcttgtctctgccgctggatatgtaacgcagtagaacgcggtgttttgtaagttggtcatagactcatagtaaagctacgcacacgaagaagaagaagaagaagaagaagaatagatatatatttagtggttgatcctttgcatacatcttcttgatttatgcttcttcagggtttgaatggtggttacacaggcgatgtcttcatgccgctcaaccatgtgaaggtgttgcatatacttggttttcaaggaactagtctagaattgaaacactttaaatggtgcaagtgaatgttgtcgaagcattggtggatgatgacataaaaaaggagctaatgatgcttcttggagcttcggtttcacccaagtgccagatcaaagtcacataaaatgtatcaagagctatagtagtttttattatttatcttttgacctttgtgatttttccccatatagacgatttgacttatctttactaatcatcatattcatatcattggatgaatctcttttggaatccaaaggaaaacgaccaattcttttgacgtttaagttaggaaagtagacagtaaaaaccctattttgacttacctacgggaagtattaatatttagtaagatagtatatatactaaataactgattggcggtgcctagcacattaaagaaccgtatatttgcatcttattgtgttatgttaacttttctttttcgtttttgttttcttcttctattctatgttaattttgattcccaagttgtagagataaggcaattaggacttatatatatactcatcttatgagatagatatacaaactaactttttgcaaagtaaccttttgtctagggttttgtcaaataagaaagggaaaaaacaacttttgtctagtaactttgttaaggagacacgaaaaaaacaaagttttggtggggtggagaaataagaaacaatatgcttcctttgggtgtaatatatagttgtgtgatatttggttctttcgcggccataattatctttcttgtgttctggaattactgtatcgccgccgaccgaatacgagtcacgcccgattctaatgagtagctattatcatgtatccgttgttttttttttatatgttcttcaacgatgaagattttagtatgttgaataatactctatagcatatcaatagttacgccatttagtgatcaatttttttttttagattaatgatattgtaactctattatatattattatttcatattctatcattatgttgtacgttgagatctcggatttttttgtcacatatataaaaattcccaaaattcttactttaatttggaatataactttgttttgtcataaagttaatatcagtgtgtttacacacgcaaaaccgatcgagaaataagtaaacagccaaagattttcatattttttttggtcacgtatcagtatactaaataatttctaaagggatacaaattcattatttctagattaattcaagtatacagtaaaattaattttgagtaagtggatctagaaatgggcctatcaaggttgttttgacttagttggacccacgtaatcctattatttcctaaacagtcaaagtcaaagcgatttcacaccgccgacacttttttgagtttttcttccttttggccttattgctttgtcagctaacgaatattgccacaacatccagttacagtagatactgcggttaacgtacatctcaccgtaggaaattctatctacgagcgcacaccagaacacaaatggtacgcgaagcacagtatcataacctacgaagattggggtaattttttcttatttaaaaaggcgaaatcgagtgagacacgaaatatggggaagtggtccccaccattatttccatttttttatttcttcttcttcttcttctctgtttctctttctgtgtcgaaatgaagatgctttaaatctaacttcttttttttgtttgggcactataaaaccatatccttaccgctaccaaacgcttctcctttaatcatcatcatcatcattttatctccgtcccttcatgttccgttaccgttaacggctgtttttttttaatctccggtgaccgttctttttctgattccaggtgttgccagctgtttttttttttgggagatattttttttaattccttttaaagttagttataagtcagttttgtctgcttggattttcatttataaaacaaggtggaattaggtttcttccgatagagaaaggggcttgattttggacaaaggcacgtgtcttagtcttttattcaagctccgatctataagttatgatttgggtttggttttgagttctccaattttagtctcatctctgtggttgttgtaactgggtttgtgatggaagctagaattgaaggtgaagtagaaggtcacagtttagaatacgggtttagtggtaaaaggagtgtagagtgggatttgaatgattggaaatggaatggtgatctcttcgttgctacacagctgaatcacggctcatccaacagctcttctacgtgctctgatgaaggaaatgttgaaatcatg

SEQ ID NO: 14482 - DNA, 3000 bp, Unknown
  misc_feature (1)..( 3000): cDNA_ID_3017409_gDNA_ID_2684122_Annot_ID_191009 3000 nt of promoter + ATG
ctgcaatgtcttcaactactggaagtaacttgctcttcaagaaagtatcatatgactttccatgcctttgcttcagaagcttgaatagatccgagcttatgatctgttgggaaaactagtgagggagatgtatacaagaattgaaggatggaattggaaatagagtctcttcttggctgcttcttgatcattggctttaattacaaggacgatcttccctcaacaacttctcaataaaacctgcacaactttcaagtcaaaagtcagttttgcaagacgtacgtaagataattggcttgcaaaaaggatggaggagaagaagactggttccttacctttggcaagaaatcatgttgcaccggtgacgaatagcctttcccttgcaagaaaacaaaaactgaaaagtctaacgctaccgagatcgacggtagccattgttagtaccaaacaaagcttttggtctgagaaacaaaaactgaaagtgtgaataatgttgagaaaacagacatgtttattcattggctggactaatctaagcaaaaagcataagcaaaccaaaccaagtcaatgtaattgttagaccaggctcagtaagttggcttgttaaactaatgccagagaaggttttaaatcaggcccatcaaatccacatcttttttttttttgtgtgggcttcgtatcatgtaagacataattgggttaggccgggtcgggtcggatctagtctaactaataatgtaatatgataatttaaaattatctgcaaaaaacaaatttattttttcttcagtagtgaattaagttcttcttcttctgctagaaaccctaatttttggggactgtgcaattagtcgcactctcagattcggccctggagccatcgtcatcgatgaatccgatgaggtcttcttctcgacgagcaagataagcatttttgtcttctgcggttttgactattatccaggtaataagaaacacagtctaaacattgatatcttgaaagtgaaattggaaattaaatatttgattattgcaggaaagatcgcagagaataatggggattgagatcagatatgaacttggcacttgttttaggcacaaatgtagttcgtaaagcttatcgctttctcttcatctccagaaaattctgcaatgggaactttggtggtaatgaaatcgataatggtttccctgatttggattgtggatttgacgaggactccaatatcagtgagctcagaagcatcgatcgagaagtgatctctgttcggagtaggtttttggagagtgccaatcatagtgcgtctcgtgttctcgtgacattgcagctagatgaatctggattcaattcaaagtcagttttagatgaattgaatgttagagtctcagggcttctagtgagggaggttcttgtagggatcttaaggaacttgagctatgataataaggcaagatgtgcgaaactagcttatagattcttcctgtggtctggagaacaagagtgttttaggcacacagtgaattcttatcatttgcttatgaagatatttgcagagtgtggagagtacaaggcaatgtggaggttagttgatgagatggttcaagacggattcccgacaacagcgaggacgtttaatctgttgatttgtagttgtggtgaagcaggtttagcgaaacaagctgttgtgcagttcatgaagtccaagacttttaattaccgacctttcaaacactcttataacgcgattttgaattctttgctaggtgtaaaacagtataaattgattgagtgggtttacaagcagatgttagaagacgggttttcgccagatgttctgacttataacattctcttgtggacaaactataggttagggaaaatggatagattcgacaggctgtttgatgagatggctcgagatgggttctctccggattcttacacatacaacattttgctgcacattttggggaaagggaataaacctctcgctgctcttactacgttgaaccatatgaaggaagtaggaatcgacccgagtgtcctccactacactactttgatagacggtctgagccgtgcagggaatctggaggcgtgcaagtactttctagatgaaatggtgaaagctgggtgcagaccggatgttgtttgttacacagtgatgataacagggtatgttgtatctggagagctcgacaaggcaaaggagatgtttagagagatgacagtgaaagggcaattaccgaatgtattcacatacaactcaatgattcgcgggttgtgtatggcgggagagttcagagaggcgtgttggttgttaaaggaaatggaatctagagggtgtaacccgaatttcgtagtgtatagtacattggtgagctatttaagaaaggcagggaagctttcagaagctcgcaaggtaataagagagatggtgaagaaaggacattatgttcatttagttccaaagatgatgaaatataggagatagacttttgttttgttaatttaggttgtttgttctcttctggaactttaattcttctcttttacaaaagaaaaaaaaagagagaatattagtaggggcttttgacagatgaagaatttctcttcgatatcacaacgactcgtatttagacttttgttctcagatgcagtgcgtataccaaattacaaaaatatagtccgtctgtttctaattagatgtagtttaaagtttttgcacaatatttttttaagtacataaaaattccaaaataatctcatcctccatcttgtattccaatttttgactaaaattgatttaaagcatgaaggggtaaaaatgaagtagtggcaaatcttatctagaagaaggagaataaatttttaaaaaagctcatataaattgccattccaatttccaaagtcgcacaagtcatctagtttattcatatcaaacttggtcagtttgttgttttgttgatgcctcatggagttcaccaactgagaatatg

SEQ ID NO: 14483 - DNA, 3000 bp, Unknown
  misc_feature (1)..( 3000): cDNA_ID_3017401_gDNA_ID_2684122_Annot_ID_191011 3000 nt of promoter + ATG
tagcccaagattctcagcccaattttgtctttgttggtgggccttgtattcacttttatttttattagagtcaaccagatcaacagactacagtcaccactcaccgtatcagaaagtcgagaaatgaaaaacgtagaacaaatcattacacttacgtttatttcatcaattattgtatcgaaagtagacaaaactcaaaagcaaagagatcatcaacatttgtctaaaaagtaaaaacaattgaacatgaagaaaaaaaaaaaactctcgttattgtaactataatcaataatcgattaaaacgccgatcggtaaaataaacagagagctgagaatttgaagcaaacaaaaaaaaaactcatatttgaatttcgaaatcgttcttacaaaggcgtcgttgtgacgttgcttctgtctgcttcaatctcttctcttcttctcataccaattccaagacctgaaacagtcctagccaaattcctctccatctctcccactcccaatctcatctgctcatgacgacgagccagtcttctcaacgcgtttctgattccaagccaatcatcttccacatcatcaccatctgcagcaatcgtagccagatccgataatctgattctcatctcagcctctgagccaccgattcccaccttcgccgtcgtagggagctcaaatctacaaagcggacacgagttatgatccgagagccaagggacgatgcaatcggagtggtatatatgactacacggtaatctccgagcagattctccgatgatgaaatcctctttgcaaacggcgcagagtaaaacggaatctggatctgaatcatcggtggaacagagcaaagaagacgagatctgaatcgtggggatcgaatcgatatctgaagatttcaataacgaagaagaagatgaagacgaggaagaagaagacgatcctgaattatcggaagcgagatgacgaagaagacggtgaaggtaaggactatcgaggaggaaattatcatcggaattaacagctggatcaacgaaacaccaatcttcttcgtcgtcttcatcatcgttttctccgtcttgttcttcaaaatcaccgatggtaacgtcaaagagattagaagaagaagaatcgtgatccatacgttcgaggaaatcgacacggcattggggacataacagaggagaggaatcggaatcggaatcggaggaggagaggagggataaactcatatcgcattcatgacaccagtaagttcgtcgttcaggctcgccgtggacggtggttgttgtggtggtggaagacgacattgagaagtggtggtggtggttgtgagagaaagaaagagaaaatgtgaaagaagaaaaaaaggaaaggagaaacaaaagttagtggttgtggttgagtactagtgataatgggtttatgattggtttcaaagcctttcaaggcccttttttaatatataaaagttaaaatggattaaagttggtttataaagggcctaccattttacttggctttattcggaaggtttggtagtgggtctctctattctttgaagtttattacaagtctttgcacttactaattggactttgctagtgataatattgtttgattataataagtatgcatatgtgtgaatgataactactttgctatacctctattagatcaaaaaaatcacagatttgttcgtttgacaactgcaacaagtaatcaaattatatacaacattttctattgttcgttttctagcggtcgctcttaattaccatattttaaaacgtaatctttttttctatcattgatcatcgtgatattcaaacgaacaacgttggatgtagtcaccaagtaattgccaaacatcgaatctgcgatactatataagttatatacggtacatttgtttattgtaatctcgtatgatgtattctaatctttgatatatgagggcagttgacaaacaaatgtatagcaaagtagtcacatttaaatatctaataacgtgtaaaaacatcaaaagtcgctttggccgagtggttaaggcgtgttcctgctaagtacatggggtttccccgcgagagttcgaatctgtcaggcgacgtatttatttttttagtggcattttaaatgttgatgctgcaacaacgtgccttctcgtgtaagcaagcaataaaataaggaaagtgagaaaatcacaatcataaagatttgagcttttaattgtttgttttcttatctaatgaaagtatgggcgttacaagcgtttagtagtagattccagttgcctgcaaaaaaattacaacttttttaaaagaatctctgacaaattgctatcaagattctatccattaactgatcccttgcaaacaaaattccaaaagtcacccataaaagccataaccaaatctggaaaatgaaaccgacatgaccgcatgatttctcagactatcctgcctctctcattcactctctgatcacttcaatttccaatattttataatactattttttcaaggtaaaagaaaaggtcttatgttcatagaatgactcacataatgacgttggaagaaaggtattagttagggttagtggagagagtgctcaatatgaaacaagtttttctctgtcttctttactccttctttttccctcctttgggggagaaattgttgcttttgaggtttcttatagatcaatctctcatcacaagggctttcatttgaagttgattctgggtatgtgaaagctccttcctttgatttttactccttcatgggtttgaaaatttccccttcctctgttttctaggtctgaaagttcctatttttttcctgatttagggtttgatagctcaattttcatctcttttgtttctgattagctcaattagatcttattgaggagtttgataatttattgctaggggtttcccaggtccagattgattaaaaatcctcactttattccggggaaaatttcgaagcggttgagaaaatg

SEQ ID NO: 14484 - DNA, 3000 bp, Unknown
  misc_feature (1)..( 3000): cDNA_ID_3017452_gDNA_ID_2684122_Annot_ID_191015 3000 nt of promoter + ATG
gtttttggctaatgatgtttcttcacttaggttgggagtgcactttcagatccatatctttcatttgctgctgcattgaatggtttagctgggccactccatggtttggctaatcaggtatttatatccttaatgagtcttatattgttcgaatctacaagtgtatataacttgaactctaagattgactcttaattataagcttaaacttggaatcttactctgttttttttcgttgtcttgttgtaggaagttttgctgtggatcaaattagttgttgaggaatgtggagaaagtatatcaaaggaacagctaaaagattatgtctggaaaacgttaaacagtggcaaggttgacaaaattatgctctgctttgccttttgaaactatccatatgtattgcatgctaatcatgacaggccataacttgaattattgtataaataatgaataaaagcttcggattatgttttgattatggggtttgcctgtgaatgttgtcaggaaacttaaataaacatttgtcttgcaggttgttccaggatatggccatggtgttttgcgtaaaacggatccaagatatatatgccaaagagagtttgccttgaagcatctacctgatgatcctctttttcagctggtaactttttttccccctcaaatctttggtcatgctttaaaattttactggctcacaaattatgcaagtctataggtctcaaaactttatgaagtggtgcctcctattctaaccgagctgggaaaggtactacttatactcattcatttcatgtgctaccagattttctgattttctctggttttatgaatcttgaaattgctgtatcaggtcaagaacccgtggcctaacgttgatgctcatagcggagtgcttctgaactactatggtctaaccgaagcaaggtaggaactacttgtgtatcgaggctttgaccttgttttgctgaatcttggttattatagagtgacattcctttcaaatatagatactacacggtgctttttggcgtctcaagaagtcttggaatctgctcgcaggtacatacatacattcatgccatcgacaattcgattttagtacgtatcgccatatccttcacaataaagtcagactaatcttttattccttttctgtttcagctgatatgggacagggcacttggactgccacttgagagaccaaagagtgtaaacatggactggctcgataacttcacgcgcttgaaccgctaagttaatccctgactgatgttggtcaaggttctctcttttatcacttcagccttctcttccatttgattgggtagcttttagagataaaaaaaaaacgatttttcgtcgaaattttgttctacagagttttcattttggttcttctgcaaaaacaataaagtcaaacaagtaaagaaacagtctttctcagattgagacaccatattattgttcctcaactttgatagacaaatgatgaccattgatatgtattgattagtctttggtgaattatcgcataataaacaatactcatgcaaccagtcccgctcaaacagagtgtttgaagtgaacagaagcagagtcaagaaattcaaagcctcgggatcaaacagaagcttcctcctatcttaagaagctccctacgaagctttatgatgattctacaaaacacatttgctatcttcagtgaacagtaagatgcaacgtgttctcttctaaaccttcagatatttggctaagtataagactcttcgtaatcacaaaaagccagaaatgcgaaattgattttgagtcttcttcctcacaagttttctctaactttcagaggagtcgctggatcctgttaccgagaattattagaaaccgagagcagaggtttctagctaggacaggaaatatattattagaacatatcctagtcttccttgtcatggccagtccagtggtgcaagagaaacatacaattccaactcaagtatgtgatggacttgacttgcttaagccgtacggcatcctcggaaaaccaaaaccatgtcggaaaaaggaacttgacttccttgaggcttacggtttcctgggctcgaacccaactacccaagtcaagtgacagagagtcttgacatagattaggcacctccttactaaagccagacaactatacaagattattggttcaaatattagtcaatcctttcgcgttttctggcttgacccgtctcgtcatgcaagggttggtcacgagtttcttattcttctaaagtttaccaaaattaatcccctttctttatctttgcgtgtgagtgtgaattaaagtattgatttatttaatgatgggtttaacttaaaaagtttaaaattgtgtcatcaaaacccatcaagacgtgtcttgtaactctgtatcacacaaacattcgtgtgtactaataaatgcaaatattttagtcacaccttttcgtaattatttatttatcatttaaataagtgacaaatctgggtccaatctccattagaggcccatttacaacgaattaaagcccatgtctttttgaagtggataaattccatgcccaagttactcacattaaccaacatcgatataaaaggaacattctatttctagtaacccatgagggtcattcctgtaaatagatctgccttccttcctcctctccgtagacggttgttgcacacaaagcgaggttggtttgacccgaacctacccgacccgttactatatatataaacacaaaatgggtaaagcaaaggtgaaaatcttatacgtaggtctatatcatttccatatgaagtggagatatatatatatagctaacgagaccctaaatatttttttctttcttataacatatagtttcatttcatatatttaaaggcttcataatacgaaacaaggtgataagaaaaaaaaaaagaaaaaaaaaaagcaaattaaaaattaaatccctaaaaacaaacgagcgtattgtt

SEQ ID NO: 14485 - DNA, 3000 bp, Unknown
  misc_feature (1)..( 3000): cDNA_ID_3017441_gDNA_ID_2684122_Annot_ID_191020 3000 nt of promoter + ATG
gccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcactttaaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaacaatgagaggtaaatttctaagtttactgttgctcattactttggcctgcattggagtttccgccaagaagcattccacaaggcctagattaagaagaaatgatttcccacaagatttcgtttttggatctgctacttctgcttatcaggtttagttcttattcttttgtccattggttcttttttgtatgtatgttaacatttttcgattttgcagtgtgaaggagctgcacatgaagatggtagaggtccaagtatctgggactccttctctgaaaaattcccaggtttttttcctaattagaaaccccaaaagctttagatctctataaagatttaagcctcaaaatgttggagtttggttcatatatgtgaatctggttttgtcttgtgttcataacaaaaatgggttgatgatgatgaaccttcttgatacttctttctttttcttggtattaaatttaaagataaatatttttgtcattttcattttcagaaaagataatggatggtagtaatgggtccattgcagatgattcttacaatctttacaaggtcttatttgctttcttcacccaaaaaagaaataaagtcaattatacatcaagcattacattttgcttcatgatttttttttggaaaatcaggaagatgtgaatttgctgcatcaaattggcttcgatgcttaccgattttcgatctcatggtcacggattttgcctcgtaagatatcgatattatcggattagatctttgtaacttgtaagcgttgttatatattcttgatgtaactcttctcaattgtttattaggtgggactctaaagggaggaatcaaccaggctggaattgaatattataacaacttgattaatcaacttatatctaaaggtaatgtttctctgtttctcagtctatttgattttaatgcacatagaggaaatcttggtgatgtttaggatattgccaaaacccttgtaatttttttttttttttcttgtaatgttgtaaatgtgtcaggagtgaagccatttgtcacactctttcactgggacttaccagatgcactcgaaaatgcttacggtggcctccttggagatgaatttgtgtaagttcattcataagatctctatatggtaagattacgacactgcgaagatttgttgttgatattttggtaatgaaacaggaacgatttccgagactatgcagaactttgtttccagaagtttggagatagagtgaagcagtggacgacactaaacgagccatatacaatggtacatgaaggttatataacaggtcaaaaggcacctggaagatgttccaatttctataaacctgattgcttaggtggcgatgcagccacggagccttacatcgtcggccataacctcctccttgctcatggagttgccgtaaaagtatatagagaaaagtaccaggtatgtttgttctatttttttatctagagtagaattgtttgtttgtgtttgaacttagatttgatgtgtactctttccaaatgatctcatagtaattttttatcatactaataaaatccttttgtttgtaaaataaaaatgtttacattgtcctttagagtcccttactctgtttttgctttaactctgttttactcttgtttccggtctgctctgttttcgctctgtttcttgtctgctctgtttttactctgcttaccatttgctctgttttactttatttccgctctactctagttctactatgctctgtttatgctctagtatgtttctttaccgtaacagtactgggattggcttgatcaatctcgtatcgaatcttaattttggttaccaaatcctcataaaaggtagactgttgtaaattgtgacaacattttcctcctaatatgatgtccataggcaactcagaaaggtgaaattggtattgccttaaacacagcatggcactacccttattcagattcatatgctgaccggttagctgcgactcgagcgactgccttcaccttcgactacttcatggagccaatcgtgtacggtagatatccaattgaaatggtcagccacgttaaagacggtcgtcttcctaccttcacaccagaagagtccgaaatgctcaaaggatcatatgatttcataggcgttaactattactcatctctttacgcaaaagacgtgccgtgtgcaactgaaaacatcacc

SEQ ID NO: 14486 - DNA, 3000 bp, Unknown
  misc_feature (1)..( 3000): cDNA_ID_3082861_gDNA_ID_2684122_Annot_ID_191024 3000 nt of promoter + ATG
ttcttagaattactttcttgttttgaagtatttaaacttttcaaaattaattttgtataatctgaaagtaaaaagaattatcaacaagacaacaacatgcatgatatatagtgagtgagtgacgatattcgcactaatacttaatttttaataattacgtactatgtattatcataacgaacgaacgagcataagaatattaatttaaacctgtgaaattgttttgagacaaatatatttgggatctagttagaaaatggagaaaatcacatgatgatgagctcaggtccaaatttattgaaacatgaagcaataaaagagacttgcagaagttaggacctgaataataatgatgacttgcagagtcactggtcactcttattattgatagtaataaacgtggacaatgtcaatgtaattactgttaatgatgtggtccttgaaaaacattaatattggaacgccgaaagctcttgatttccctgccttatgcaaaggaatgcaatgcaagtcgtatgttctttcacttcgtgattaaaaccttagatgatccggcttttcattaatagttaaatagtttatgtctagactaacttgatttttatggaaatgtgactaccgtacgtaatcgattaatcgctgactcggatttatttgtttagtaactcgttactcacggaagtaaaaacacacacacagtaattacaaatataacaagctcacgtgtaaataaccgtattgacgaagagtatatacgaaataatcaaaaataataaaatcgttgaactaaatacatatgtttcttcgtagaactttgattagacttggtagtactgagagttctgttgtttagcgtaattaaggatgaacgtgtgaggttcgtagaaaacgacttccttatatgaaagttaggctcgacacttttggaaaagagtgaatgggagagattccaatccgatttgattctattgtatcctgtccttttccactgaattgtagttggctgggaccatatatactcgactgcgatattattacatcgtatcttcgagtactgtataaaccaataaatagtatctgacaaagttgatctggccgtatggtctcaaatcatcatcaaagtcagtaagtcaccataaaacccagttagggttcgaactcctttgagaaagttgaaaggaaaagtggtacagaaccaccaaactagctagatgacccgaaagacaaaaacctatagtaatagtattgtttcttctacttattacgtgattagttctctttttttcattgattttttgttgttatagttctacttgccctaatttttccttgaattgctaatttcaatgccgacaaaaaaaaaaactgtagtatttttttaggtttgatcaaagtgataatattccaatagtcacggtctagtaattaaagcaaagttaattccttaataaaatagtttgactttctaagaatcgttcttttcttttctttttgtgctttaagggtcgttattccacaagataattaaattaaagtataagaatatacgtgtacggtgtgccacaacatcaaagtgaagaagcacgttgaaaattaaggtcgaaacaaaactgtagtatatgattatttaagtcgatgtcctttttttgcttttgtttttgtcttcttataacgagaaacagaggacaaaagggtatgggattatataagtcgatgtcttttggcccataattgagtcgagatgttgctgaccttaataaaaagggtatgggattattcatttcatctaagtaagtaccaacatagattttcttaataaaagcatctttaatctttattagtattaattattatacagaaaatcaatgtattttaccatattttgaatctaaatagatacatatttcttcacaatatccgaagaaaaaaactagactaaataactcaaaggatgagtggatgactaaaaaaccaagccggttcacagagtttagtcatcatcttaaaataaatatctgatatatatatgtgttaaattgacaaacaaaaatattataaaaagttgtatgaattatgtcttgtcatgtacgcatgtgttagtgatttccacgtgagtttcttggctgtttcggtcctttttcttcatatgtttagctgcgtcatcaacttgccttttcttaactttggaaaaatgcaaaaaaatagtacattagaaaaagaccccacctcaattcaaatgctaaagtctgtgaattgtcaacgttcattgcacagattacttatcctatgaatttaagaatatagtacatctgaatacactgtaatcttaaatgcatatatttagtagtctatgcatttaatgtggatagcagataaacatagggatcacacacactgattgttacgttacgtataagatcttgggcctgcctttgtataagtgaacaagtcagatatcacatgaaggcccattaactttagggagaattaagaaacagagagaattcgaagctagagagctacgcgtcgagattctttcttgctgaataaatcaatcacacccgccggaaaaaacagtaagagcataggacttgccggcggtaacggaggaatctgagctctacacaacggacacttggacatttcactgagccatgtatctatgttggtgtttgaaaaagtctttggttgttagtcgttggtttgcttctggagtcaattatgtccgagtcttatggaggagtctaagtagtggagttgtggaattgagtcagttcgtgtagtggagtcatggagtctgttcctattttttagttgttctgttgtttctttcgagtctttgtaaggctatttaaagccatcttttctcgttaatgaagtatcacttttagtcaaacaattcacatttggtatcagagcttgcaaacaagaaacaacctgtgtgagagagtgatcgagagagaaagataaaagagagagagaaaagtgagaaaaagagag

SEQ ID NO: 14487 - DNA, 3000 bp, Unknown
  misc_feature (1)..( 3000): cDNA_ID_3017437_gDNA_ID_2684122_Annot_ID_191021 3000 nt of promoter + ATG
ggatgttactatatatattggtaattcttggcgtttgttagtttccaaaccaaacattaataaataaataaataaaagagttgaggttagatttagtctgtaaatgttcgaaatattacgtaagagtttgactgtaacaaaatattatagtctatatgtatatactagttacgattaaaacataactattaaaaaattgcaaaagtttgtacttggtaatatgattacttatacggttataccattaaacatttctcttgaaaccgcttcaaaacagtgccatataaacttaagcagcacctattttagtatatcttaaaattaattcttaaaaacataattcgtgttggtaaatattaataactgaacaagtttctggatattctaaaaagtataagccattatgaacagttttgggcttgggccatgttagaaaagccactcaaaaatatcatatactaattcgtcagctaaaacaagaaatttcatacgcagaaatttgtgttgaaaataccatagttcaaatgtttaataaaaatatgtaaaattagtttgattgttttgactttttcgcgtctaattagtttgattgatttgattgcttctgttcccagtacatgcaatatagtgatatattagaggtaaaacatccgtgttgacaacagattaaaaaaaaaaaagtaagacagtgcatagttcaatttctagtagttgttctcatcttgtttttggcaactggacgtgtcataaaatttgtttcttaaacatgaattgtattttcgtagggaaattaattcaacgtttagtgaaaagaatcaaaatcaatccagaactagtataatacatttttctaaaactattatgatttttttataaaaaacatttttttaatagcataaagtttttggccaaagcccataatccttttagatctgaaatcatagcatgtaatattagttttgtcccaaacgttaaaccggtgacctttaaactttgcttaagatcttttaccaattgagctaataatactcgattaaaaagatattttttgactttctcacgaaggatatttttccttttcatataaatgataagttcttttgtattaatctttttgtttcctgcattatttttttcgttttcgttgttagacattgtttcgttcttgaaaatgatagtaggtaacaaatgaaaaaaataaaaaatacaccttttctcctaatttcttatatgttttattaaattttattattaaatcataaatatagaaatgtataatttactaaaagggagggacaagacaaaaaaaagaagaagaagaatatataagcccatctccttgtgttggaaaattagttgctcctttacaatatacaatttcttaataggaaaacatgtcactgccagttgattgttctcatctctttttttccttagtggaatccgataaggacaattgctcatatctgtttttttttttttaattgaagatgtacattttctcttctctgattatcttccatacaaaatctgcactcagtaaaaagaaattatgtattgctgttttaataccactagatgatcacccgtactacgccgcagtttttttggattattttatattatttaatttaaatttaatttttatttgtctaatcattcactcatacaataagcaattactttagtattaaaaatatttttttctaacaatattctcaacaatgcatcatacatataattcataaacaacatttatcttaaattaatttaacagagggtagtattggattctagaaacctaagaatatgatgataaagctccttacgtattcttcagcgtcagtgatttattctataaatatcataagagaatataaatatcaatttaagagaataacttactcaaatcattaagtaatctacgactattatacattcatactttgaatttggattacaaaaaaaaatcttcgagtatgagaaaactattaaaatagttttattgaaaaatcatataaaataaaaataaatttagtaatagtataattaaatatgtaaaataaaattaaataagaaatatatcattaacctataaattagaagttgaagagcttacattaattatttaatagacacatgtcaaatgctaaagtgatgatgtgtcaatcatatgaagagagttggccaactttcatatatatgattcttagtttcgtaccaattagtttctcaattcagtgcatgtgtagtcaaatgtccaaaagattgtttctaagcaattaaaatcttatcaaaacttcattgcccaaaatattacgaaagcttgtttctgtgtatgatatacccggtaaaattaaaatgatcattatacagaacaaatcagcatgattttcggataaagatgacacacatttgaaatcgtagccgtactacgcgaaatacatgcactcttcgttatgttaacactttaacagtgaacgtagccataatgttgaccacattcaacagtcaacacaaacattactttacacacaaatatatgattatatatacatatgtacatgtaagtgaatgtgagcaataatgacgggaatattcagagaagacgatggtgaatgttagcagtgatcacgggcacattcaaaactgactgtggacaaaaaaagctcctggccttaaatatgattgtgccaaaaatagtacaaaactaagaacccaaaatggaattcgagacctatataataatatatatgtatatagtctttccttggaaagaaatcttatgttattaagaaaaatactataagttatctctctatctagatatgatatatatgtccaaacatttccacgtagatgacgtatattaccgaggataatcctctatataaggaagagaagctcgagtaataaatctcatcactttgaaatctcaaaagacaccaagcaaaaaaacaaagacagacaaaaaaaaaagagagagagagagagagaaaa

SEQ ID NO: 14488 - DNA, 677 bp, Unknown
  misc_feature (1)..( 677): cDNA_ID_1017007_gDNA_ID_2684122_Annot_ID_191027 3000 nt of promoter + ATG
cttgcttggagaattccagagatagtagaggcttcaaagaagacaaagcttgcttcttcttctttcatgttgttctgcactgagagttgagcgagctgtataggattacatgtccaattccaaagctggatcctttgacctcttgcaaggagaaagattatcaaaggaagagagattggaccagatggaagtaaggaagtacctttttttatggtttacacataattttaatttttaacatttgtttttaaacttttttttttttatcactattaaagtttaaaggtttttttgaagtgttaaattctaaatttttgtctaaactaattgtacacaacatccaaattgtttttatttaaaaatgttttaaaacttctattttatttttttcaacaattttgtttttttctaagtgttaaaattttaaaatattttcttcaaaaccgtattaagagaactagctttcaaagatgagaagcaaaagtattcgggccaacatagttaggcccaaactaaatcaaacaaagcacacaaggaaggaagcatcaagagaagtctgtagaagaaaggtttgtccaacaacacagcaagcacgagcgaatctcctcaacttccccaacctaatagctcgccgtgtcgtgactactcaccgagtaggaacctaaccttatccaatg

SEQ ID NO: 14489 - DNA, 3000 bp, Unknown
  misc_feature (1)..( 3000): cDNA_ID_3082857_gDNA_ID_2684122_Annot_ID_191025 3000 nt of promoter + ATG
atcttaccgctatacgaacccatactgattttgtccaatttttttggaatttagatccggtttgatcaggttccacggttctaccaatcaatcgatccggttttatcttgatttcttgtcctaataatcggtaagtaattctcataagtaaaaaaacaagaacacactacattatttctcttaatctcctaagaacaatatatttggccattcaaactctacaattacaatcagaaaacattacaattttttataacaaaagtattgtttgagctatttcccatagagattattcaccacaagccatataaaaagcttgattttggcaaaatccatcttcagaaagccgtagtttactatccaatagtcaaacacgttgaccaaagactaatcccaccaaaataaaaaaactcaacggcggcgatcaactctacctaaatccacaagcttcttcgatctatttgcacaaaacgacgccgctgctgatatatgaggcttttccggcaccgccgttacctccccagaattaccaaactccgatggaaatctcattttccgtttaaacggacagttaggactagctctcaccaacggactcaaacaaaaagccatccccgacatgctcttccctatccccatcgcaatcttcctccttcccggagttttcgtcgccggagttctcctcaattcctcgattgattccgccgactgctccggttccgtatctcttacaggtgacattcctctacagtatatacgttgaggtctacgcgcagcgataacgtcttcgatgtaacacgcggtggttggttgctttttacgtcgaccggtggagagaatcgtcgagatccatgaacgtgaagaggaagaagaagatgaaatctcagacgcgtcgcatgaggagaatctaggattgttggatttgggattggtatcgaaatcttcagatctagctctgaatagattcgagaatctagatacttttttaccttgttttgatttatttgatcgattcgattcgaaatctttgcatgaatatccgacgagatctatctgtggcgtggtaatgaatctccgattagaagaaactaaaggatctcctccaccggctccggcgtcggattttctacgggtaacgtaaggagaaacagagcgagggaaaatcaaaagcggaggatgattattgttattagatttctttgattgattatcttctacggcggctgatacggcggcggaagcggcgagagagaggagacgttcacggaggcaagaagcgcaaacgccgttgctgctgctgagatcgacggtgtgtcttttacacctcatcggaggagaattgaagataaaagaaaaagctttgatttttttcgaaaggaagcttttttttttttgggttgggccgagagtttcggtggttatagtgatgtgacaacctgtaaagatgaaggaagaagaaaagatctggtggtaaagattttgtcttcttctcctaagatctctgttttgagataggcttagagagagagagatagcattctatgtcggaaaaccaaaaaaaaagatagatgagagagagaaactaatttatttatctaatggagatttgtaagcacaacattttgacagatcattttatcactaaccatttctttaatgcaaaatttaattatgcgatggttagtgattcaattgcaatttttggttcgtaattttgccaacttacaaaaaattgatctaacgcgccattatagtttcatagttgtagaagataaaatctagttatggttgacctttctttaattcaatatacggaccaataccattggatttgaatgggatgtgtagtgattacctcagccactgacttgaaacaatgatataactgtataaataaataaaaaacctaaaagagaagcatgtgacgttggatggtaaaagccgacaagtattaggtgaagacgagccatcgtcgttttccacatatctcacacgaatgttcgtccgtttcttctacatattgccacgtggttttcatatttcatcaataggccttaacttcattattgggcttttaaagccttcctaaagtctccttgtctattgggcctgtcatgtgataatcaatgatgtaataaataacgacaacctatacttagtttttgcttcttcttagtttgaatatgttatgttagtttggttatttcagtcatttagtttggtttggttgataactaaatcatgatgttgagagaaactcattgtttttgtgtttatgtctatgtttattgtgaagaatgattcattatttaccaagtactaagaaattcaaaattttctagaaatattattttatgtttgtgatttctaaaataaaatctaaaataattcagactggataacacaaaacccataaaaactagagaaccgcttgtatacatatagcctcctaccctcttcctggacctaactttattattgggtccttttaaaagtcttctatatctattgggccttctaaacaatgttgattgttgtttctagacttattattttgtatttgtgtgaggggtccatgtggaatttcaaaattcgaaaattcaaacaggttacaaatatctcaaattaaagggacacaaatcttatcttcattattttagatttgaccgtctagaaaagtaagaaccagaccgtaccgaaccaaaacgaaccagagccagacgactccttaacggcggctaagctatctgtaaaccgaccgaaccacacagccacaggcacacaaatcaaaccttctagaaatcaaagagagacatttattctctaaattcattttcctattttgcccctacgaatatttttcttcttcgtctctctctctcagctcttgaagtctttggtctgttggcgaattttcaagcagctttctaattctgaactgaaaatttcgtctttggaactttatattctctcatctgaaactgaaggagaaggaagatg

SEQ ID NO: 14490 - DNA, 3000 bp, Unknown
  misc_feature (1)..( 3000): cDNA_ID_3017444_gDNA_ID_2684122_Annot_ID_191018 3000 nt of promoter + ATG
gggtcacactaaacgaaccatgggtgtacagtattggtggctatgacacgggaagaaaagcccccggacgtgcctccaaatacatgaacgaagcagccgtggcaggagaatctggtctcgaggtttacactgttagtcacaatctacttctggctcacgccgaagctgttgaggtcttcaggaacaatcccaaagtacggaaaaggataattaatttcactttaacgagcatttttgtctttaaaaacatacttattgagatatacgacgtttattgtttggattacagtgtaaagatggcaagatcggtatcgctcattgtcccgtatggttcgagccttatgactcgaactgccctaaagacatagaagcatgcgaacgagctatggagtttatgtttggatggtgagtggttttatatcttaattaaaggttacatatttcaaaataaaactagtacatatgttttgttaagtttctaattatttttgtttgggtgctttctttaattaacaggcacatggatcctacggtgtatggagattaccctgcagtcatgaaaaaatcgatcggaaaaagattaccatcatttaccgcagcacaatccaagaagcttagaggatcttttgatttcgttggggtgaattattacagtgctttctacgtcaaaaatattgatgaagtgaatcatgacaagcccaattggagatcagacgcacgcatcgaatggagaagtaagtggagttgtatataatatttatatcattttagggtttcttggctccaagctttttgttactgttttcttgtctcacaagttttcaatttctattggtacagaagaaaacaacgcagggcaaacattaggtgtaagaggtggttcggaatgggactttctatatccacaaggccttagaaagtttctaaattatgccaagaataaatatgaaagcccgaaatttatgattaccgaaaacggtaataattttataagaagttctttaattagtcttactcaatttaatccgggatatagtttactaactcttgttttgttaaaattgttcaggacactgtgatatagattatgagaaaaagcctaaactttctaacttgatggatctccaaaggacagagtaccacaagaaacatctccaaagcatccaacaagccatccagtaagtgtctcttctaaacatctccattataagtttcttgtgggacaagaaactttactgtgttgaaaccatatactttgtttcatactgacgatgaaaattgttttggtcagggaggatggggttgtagttgaaggatactttgcgtggtcattactagacaattgtgaatggaacgccggttatggagttcgatatggactattctacgtcgattataacaatggactaaaacgtttcccgaaaatgtcggcgatgtggttcaaagaattcttgaagagagaagaagaaattgaagattcagaagaagaagagtacgtgttgaagtcaacaatgaacaagaagagattcttattagcaactggttcatcagcttcatgctttattcctaagatgtctgaatcttctaaagccctcgaactattattctaggtttaattttgttttccttattaaaatttgatttgtcaaaaaaaatttgatttgtcaaaaagcaaagcaaagtacttcaataaagaaggcttaatgcagggtgctttgcggctttaaactttcttccttttttggtctcctttgtacactatcagttgttgatttcaaaatttcaaatcaatcattaaaataagataatcgttcgttggtttataaaaagcatcacgcgccggagttagcacacacgatctacgcgcgattgatgcgcgtgggttaaaaagtagaagagtgtcccgatgataacgtgtgggctcaaaatcatttatttggactttgacggacccaatcccatagcccataaacccgtgatggagtattgtcattcaattaaaaacattaatatgtagtaactatgggcgtatgctttactttttaaaatgggcctatgctataattgaatgacaaggattaaacaactaataaaagtgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcactttaaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 14491 - DNA, 3000 bp, Unknown
  misc_feature (1)..( 3000): cDNA_ID_3017460_gDNA_ID_2684122_Annot_ID_191014 3000 nt of
gattagtggccgctttttttttggataattaattaatctttttttttgggtcaaacaattttggatttttgatccaaggaatcaaaacatcaaaacaaaaagctttgcacgtgtacagatgagtcacatatcacgtccgacgagtatctgtcgtgtttattaagttattagtatagggcacacggaatttgtttttctttttgtcggtttatctaatctcttaattccgaaacaaatgtaatttttttactattaacgatgtttaccatagacaataaataattacatttcacatatgctccgtgaaaattactaagacgaatttcacatatgtagtgaaagattgttttaaaatatatgtacaactccaagaaaccctatctccataagccatgtaacaaattattattattattattttggtaaaggacattttaacaaattcgtaaataaaacaaagtcaaattcacctccaaaggttaagtcgacgacctatattatatagtcaaccacatatattaaataaaacatcgctcacgccatctactcatatgtatgtttttacttaattatatagctaattgattatatgatatatcatcagttggaaaattaaaaaccattttattccgatagcgtaaaagaaacagatcattctttttgtttaaattacaatttatttaactcaagttgttgaaaagtgtgtaatggaaggcaggtccatagctatttcgtcttatatttttaactattttcattttgtttgtctttaagaaatagtattttattaatgtttttttacaaaccaacaataaaactgtatattcacattttgttttttttgtgtatatatatagagacatataatccacaacatatgcatatcatttcccaaaacaatacaagaaacctgaaatccaaaaaagaaaaacccaaaatcttcgcttcttcatcttctttttacgtttatatggtgagaaattctatgaaggctgagtacgatatagatcatcttcctcatcaaaccttttatggtgattattcaaaaactttggttcccatgaacaagaactcccaaataataaccaagatcaagcctaagatccgtatcatccatatatttgctcccgagatcatcaacaccgatgtcaagaacttccgcacactcgtccaaagtctaaccgggaaaccggagatcaccaaaaccggttctaagaaaaagataaccaacacaaattttcctgcgccaccgggtttgcctcaagattccggccaagaacatacggctgaactggacaacagaataatagggagccacgtggtgaaggaagaatggggatcaagttcaaacacaaatacttactttgattttgacggtttgatcgatcttgatgaagacgacaacatattctcaagtcgatggtttgatcttcaacaacaataattagtttggtcacaccttaccctaatatgtagggtttctactaatcgtaagtcctgttggttttgatgatgatttgatcatttattcgatatggagcataacaagacatgggtcaagacaagaccaaggttgagacgatgatcatctatataggtaggaacatacataacttgtatatatgtacaaatgtttggattttttgggcttgggtgccctttgatttaatttgttagactgacttaatttaccaagaaagagtgtagtgatgagtttgtagactgattttgccaagaaaaagtaagtttgtgttttgatctccgatcatgtgaaaactctacttaaaaatggtgtaacgttgtactcacgcgtgcgtgtgcaagttttatatatagaaaagcgagaatgatattgtgattgaattttttagattgttcattttttttcgtcaaattattttgtttgttaattcatatataagtcatgttacttacaacaaattgtttgataaaacaaaaatgaattccattaaactgaattaacgaaatactataatgataaatgattcttacatgactctaaaagagtttcgatttgaatatataaatgaataaagttctgttttattggcgatgttcttgatatataccttcaaaactttatggctaaattacattttaacttctcaaaacgttagattatgaaaggtggactcacatttcataaacattaaaatgatatggtaatatgattataatgagttgtaatggatatatgtcatatttttccaatctcattcattgaaatatcagtttattttttggatgacataacgatcaatagtgtcatataatatgatatccaatgttttaatattaactagctatagctatatccatcattgttaatagttgtgttacatcattaaatagtatttcaaaagaatataaaaatttctgataactaatggagaatgaagaatatcaaaccgcccattcgaccaagaaattataataacgaagtttataactttttttttcaattgtgaaatgtcatttttactttatttatttccaacaaaataaaattatgttttatctaaacccttggactttaccaagaagctacttttttatttagcaacagcaaaagctacataccatttgttctttatttattaatgaccgtttttttaggcattagaatcgttacggctgcttcgaatcttgcgtctcacggaccgacggaactaaccaatctcaaccgaacccgaacataacctgttcgtttggttttctaaatggtaatcaattggttcattataccggtttggtaagaagaatccgtgtgtttggtttacatatgttgtaatttgacgcttgttcatcacgttgcagatatatctcaacatctctcaatttttctctctacgttgaagaaactttcgaatttcccgttagttcttctccacgctttctctttccctttatctcttatctggttaagccaatcttgattgtttggattcgtaaccgatcagtgttgtgaggtttgaaaga

SEQ ID NO: 14492 - DNA, 3000 bp, Unknown
  misc_feature (1)..( 3000): cDNA_ID_3017517_gDNA_ID_2684124_Annot_ID_191034 3000 nt of promoter + ATG
aagaatgggaagtgaatttaccagctgaagaagtgcctcctgagttaccagagccagctcttggtattaactttgctagggatgggctctctgaaaaggaatggctttcgcttgttgctattcacagtgacgcttggttactgtctgtctcgttttactttggctcaaggttttctttccacaaggaagagaggtaatggatggtttctcttttggtctcctactcttcacaggtatatatgtacatgctaacttgtgtaattttttcaggaagcgtttgttcaacatgatcaatgatgttcctactatatttgaagtagtgactggaatggctaaagcaaaggacaagtcatctgctgcaaatcaaaacggaaacaaatccaagtctaactctaaagttgtaagactcttgctatatcctttttaactctttgcttttgcagttttcggaaacttgtatcactaaagatgttcatggttcaacacttaatcatgtactagctgacggaaacacgattaattcataatcttgaataccacatccagactattgtagtttcttagtagggtggataaaacaaagagacaatgcttcaccgaaaacgctgctttggttggattggttttgagtatatctgtagtttttttcatctgtgtagtttaatatttcctttgctttgttttgggaatgcagagaacttcagagggaaaaagctcaaagaccaagcagccaaaagaggaggacgaagaaatagatgaagatgatgaggatgaccacggggaaaccctttgtggagcctgtggagacagtgatggtgctgatgaattctggatctgctgtgacctttgtgagaagtggttccatggcaagtgtgtgaagatcactccagctagagctgagcatatcaaacaatacaagtgcccttcatgcagcaacaaaagagctcgagcttaaaaatgttgtattgtagagaatagcctgtagtgacaactctcactaccctcgatctgtctttatttggctagtcttttagctcgttattggccataacagcttgggcctatttctctgtataattggtttgattttgcaactgagaaaaaaaaggaaactctttaactgaatttgtggttagcttcaaaccaagaggaaacataacaattcttaattcggatacagcaatatactctagaagtctcgaaatcatcactaaccctatctggaacaattatgttagggttctcagaacctgaggtaacttgtgatgcttctctagcaatctagcaatagtctcaactctcaattgggagtgtaacgaaactgaagatcacatcaacaaaatcttgacacattttatagtaaattcaaaataaaacataaacatttcggacacatgaaaacaaacaaaaaacaataacaagaagtcttgaagcaaacaaatttagaaaggaaagccaacacttgagagcacaaaatagaaagagaagagatgaacacggatcactaattcactatgcccggtctctcacgacttgactctgcgtaagttttcaatatcgatacctttattccttaaccaaatcagtacacactaacacaccatacacgagagagactagcacatcactaggtcagctcccaatacaccatacgagagagactagcacataactagcttagctctcaagtctctcatgcgagactcatacaccacagatttataacgaacaacaaacattcagaggcagtatttatactagaacagagttttttaaagatatttttagatcctaaaaatatcttattcttccttctcacgtgcctcctcacttgcacgtttcttcttctgctttatctctcattctcattcttcttgatacaccagtcgtatcactctgcttcgccttgtaagcacagtaatcaaggaaaagctctgtccccgttaagtagcagccaaagtggctcttcttgagtgccatgagcgagtagaccttctttaggttcttcgcaccatcaaactggtcacctttctccaccataaccatgtagaagccgaaatacaaagctatattgcatgcgttacgcatacaatactctttgatcgaggccacgaccttctccctagtatctaagctcctaagatgagtaggcgcgttgttgacagtgactatctcttttgacatccaaattgggaagttctctagataggccatcatctcgaaaagagtctcccatttgtatctacctcctcctactttgttaatcattggagaaacagtttccaaatgggatatgtaggttttagccttccttacttctggctcaaggtacgggagcattgccgcggcgctcccaagacctgacttgacaagaagctgcttaacagtgttgctgcaggcagtctccttcttaaaggatatcttcaccggatgtccagcgttaaaccacatggcgtcccttagagcgttcaggtcttccttccaccaccgggacaattgatcacaaccagtccatactcgttcctccatagccatgaatacctcctcggactggaaattgtactggtataaagacgtgatcagagagtatccttgtaaaggaatcattccagtggcaagaaggtggagctttggaatcaccttcttttcagtttcagataggttcaaaggtttggacaggtggttgcaacactggagaagatggagatccgtgaagctaagcgggtcgagcatggtgaacactcttatcaatcaccacgtcactcgttttcttcatcggctcctcctagaggttctggtgagtctcagatcttattggataatcgatctagcttactaagacgtatagagatgcctatgtttgatagatctggagtttatgaatggttttcaagggtggaacgcttcttttgcgttggtcgttattaggatccagataagttggatctggtagcgttgagtcttgagggagatgtgttgaaatggtttaattgggagatg

SEQ ID NO: 14493 - DNA, 3000 bp, Unknown
  misc_feature (1)..( 3000): cDNA_ID_3017483_gDNA_ID_2684124_Annot_ID_191044 3000 nt of promoter + ATG
acatttcattgtcacatgcacatttgtggacgaaattgcccttgatagtgacagactgatgtgtcagataaaggacaattggtgatagacttttttttgtctccagatcttatccccgattagaaattctctgttgtgtctacgtcttttcctcgatttcatcatcttgctctattattatgaatcccacatcttgtccaccaattgttctcatttaaggattttaaattttctttagattttttgccatctattttggtccacagattagttaaacattattgtcttcacctacacgtttacaattgcatataattttattttaataatatgttatatcggggacaagttcatatcgaatgagtgatagaattatatcgataacaaattcagatcgaatgatagaaaagataatatgttataacatgatcttttttgttattttgcaatagaaggaaaaaaattaataatctcggtcgatgaagacaataatgttcaactaatctatggaccaaaatagatggtgaaaaatctaaataaaattcgaaacccttaaatgtaacaattagtggataagatgtgggattcatgataatattgaaagatgatgaaatcgaggacaagatctattcacaacagagaatttccaatcggggacaagatctggaggcaaaaacgaaagttatttgttcagatataatgtttattggttaaagtgcacgtgtttcgagagaatagagataaatagaaggggttgtgttatgatggggcactttacaagtttgtaagcctatttagagcactttggaggcagtaggccctttttggaggttatctactgttcgaaaaaaatcaatacaattctacccctgatgacgtcagctgttgcgctaacatggtaaacaaatttgaatcacagccgttcgtttgttttggagagagaatcgatctaacggttattattaagagaagagttaaagttttcacggaatgatctcctccgtcggattgaaatgtctcttttaattttgaccatcaaattaaaattaataaactatatctaataattattttctctctcttcctttttgttatttaatttctttttaatttgtcacattctctattttattaaaaatctttaaccatttttttgtaaaatatataataataacattttttccttcattttgaaatctatattactatatttatttatattattattaattatattcacttaaacataaatagattcagaaaaaaacaaatccatatgatctaatccatatggataacaatgaaatatataatttttaatcagaaccatgtaactataaactctaaaatcattgtaaacaatcatagttccttaacactaaatcgtaaaccctaaacattagatactaaactctaaacattaaaccctaactcctaaatttaaaccttaaatattagatactaaactctaaaacattaaaccctaattcctaaatttaaaccctaaaccctaaactttaacacatagacactaagccgttaaccatatacatataccctacaccatctaccataaacactaagccattggccataaatgttaagcataaatcccttaaccctaaactctaaatcttaaaccctaaaccctgaaccctaaactttaactcgtagacattaaccctaaactatatacatataccctaaaccctaaacccatatgacaataaacccaaaaataattatagaacttgtttcatcatattttatcaacatcttctacataacgtaacacttgttttatggatagtattatcaaactacaatcatttagaattatcgaccatcaacacacatccaccaaactatgaccatgtggtcatttcaatcatttcaaattatcgaccattcatgcacattcaccaaacttcgatcgcgtggtttgtaggacaaaatagtaatttgtatacatatcattctttccttgaaaccctagccacctatcactctgctatcatctttttcctccgacctattcaaccaccatgtcttctttgattcatcaagaccatcaccattattattgttgcccataaatgtaaacccttccctaaaccctaagccctaaaatttaaaccttcttattgttgcccataaatgttaagcataaattccttaaccctaaaccctaaaccctaaatccctaaactcctaaaccctaaatccctaaactcctaaaccctaaactttaacccatagacactaagcctttaaccatatacatataccctaaaccctaaactttaacccatagacacttaatactttaacctcgagggtaaattggtaatttcaataataaatgtggtaggagttgtaaagaaattagaaatatggtagattttataaaaaattagaaaaatggtaattgttataattttctctatgtgtaaagtgcccttttgttttgggctatattaattggtatgctcagacgatgagaaattaagaaagtatgcatgacaacatactaattagtctctctcttcagcgacatatttatttcccgaaaatacccctattaaccgaaataaacgataattgtttctagtgtagctgcagaagcatttaatgttgaggatacactcgaagatacacccgctggcattagaaacataacaaggatattgataatcattgctgatatttttgaggttgcggatatatcgtttgtatacactgggctatttattagcaatgtattatcttccctttaacaacgaaaaaactacaagactaaagaccttagcttccgacaactttaatgcaagagggagctaaagaaacagagaaatcaaagcagaaaggtaaaagtaaaagatttgagtatttcgttacttagagttaaatttttggaatttcttttttaacttagggtttgggaaactaaacttcatatcggtaacgaatttgttatttctaaaaattctgcagttacgc

SEQ ID NO: 14494 - DNA, 2909 bp, Unknown
  misc_feature (1)..( 2909): cDNA_ID_3016263_gDNA_ID_2684124_Annot_ID_191050 3000 nt of promoter + ATG
cttcttaagcactgaaacaaacccaaaaaaaaaaaaaaaactcttcaaagcgaaaccaaatttcacaaaacacgtaagcgtagatcggagcaaaacaactatgaagaaaatcacgattccggtagaatctcttgacgaagaagacgatttcctactacaactcgccgcaattgaagctgaagcagcagcgaaacgccctagggtttcttctataccggaaggaccatacatggcggctctaaaaggaagcaaaagtgatcaatggcagcaaagtccattaaatcccgcctctaaatctcgcagcgtcgctgttaccaccggcggttttcaaagatcagacggaggaggaggcgtcgccggtgaacaagattttccggaaaagagttgtccctgtggagttggtatctgtttgattcttacttcaaatacaccgaagaatccaggtcgcaaattctacaagtgtcccaatagagaggttcttaatatgtttatttttgcattctaagtgttcgataaaatgcctatgagaatataatgattttaagctacgtgttctattaggaaaacggtggttgtggatttttccagtggtgtgatgcggttcagtcttctggaactagtactactactagtaatagctatggaaacggtaatgatactaagttcccggatcatcagtgtccgtgtggtgcgggtttgtgccgtgtgttgactgcgaaaacaggcgaaaacgttggccgtcagttttatcgatgtcctgtttttgaggtgtgtgtatatcaatttgtttatatggttggttgtgttggtatctataatcaacatagcaatggcattgcaatctcttgttcattttgtggtttgtgcttctggattctggtttagtgagccctttggctgtgtttcggatagaactatggttatcgttctatatggttaagtgctgagtcttgtctttcattgtatgctatctctgattgttgtaaccaagtatactcagcttagattaggagatttttcatggtttaaatgacggaaatagagtgataactgtggcatacacagtttgtagactttgtgcatcactggaataagtgaaaaattgaattccgagtcaatattgtgcacgatggttaagtggttaatgtagtattgcttacctttgagtgtatgtgtgataacatggctttttattaatttcagggctcttgtggtttcttcaaatggtgcaatgacaatgtagtcagctctcctacgtcgtatagtgttaccaaaaacagcaactttggtgactcagataccagaggatatcaaaatgcgaaaacgggcacgccctgttataaatgtgggaaagaagggcactgggcaagagattgcactgttcagtctgatacgggaccagtaaagtctacatctgcagctggagattgttttaaatgcggaaagccagggcactggtcgagagattgcactgctcaatctggtaatcccaagtatgaaccagggcaaatgaagtcgtcatcttcaagtggagaatgttacaaatgcgggaagcaaggacattggtcgagagactgcaccggtcaatctagtaatcaacaatttcaatcagggcaagcaaaatccacatcctcaactggagattgctacaaatgcggaaaagcaggacattggtcaagagattgcacttcccctgctcaaactacaaacactccaggcaaaagacagaggcagtactaggtcaggctttctagttttgatctgtcttatacaaaatcttagggtctctcttaatatagttaaccacttcattgccatggccaatgggtgtgcctaacttcgaaacctagctttatcttccatcttatgaatctttcttttgttaccttttttttagaaagcttgtgaatcaaagaagactgatctgtttaaagttactgcatgaaattaccttacatttgatttgttttctgacgttttgatataacatatcataatgggttgttctattattttgttgggttgaaatgtgtccattattccaattgtgacaaacgttttgttaatagattttaccgtgctttgactaagaaaaccctgtcaacattgtatatacatagcaaaacaaatcttaaaaatatcaataaaaataagccttgaaattctctaacatttctctccgataacttctgcaataatatatgaaatttattttcacatttaccctacgccatatttcttttcgatcattcctaaagaattcacaagtttttctttatctttaatttttactagtgcaaatgtcaaagcggatattttggtgcgtaaaattcgtgtccaaccgcatcatatcacttatgtaaaacaacattccttagaaatgactcttttgagctctaatttatttcggatgacaaaaaaaaacacaatattcctcataaatggttcttttgagttccaattaatttcggataaagtaaaataaaataaaaaggaattacatatggtccatatggcgaaaataatatatatcatcacctgaagaaattgcaggtaaaaagttaaagaggcacaaagaaaaaaaatggttagaaacgaatttggaagctagtgcttttttagtttgttgaagaaccaaaaaaaatatgacaactttcctctgcaacaacaacgtaagaaaagggacagagaagatttaagttgttagaaaaaatcggtagactccatatttagcttatgtaacgctttactcatatctatattcgcttttatcttatcatcttctgatttctcccatttatggctaaccaacaaaacaaaacccatttttttttctctttagaatcaaaagtaaagattggttgatttaacattgtgtaatgcccactctgcttcaaacagctccaatg

SEQ ID NO: 14495 - DNA, 3000 bp, Unknown
  misc_feature (1)..( 3000): cDNA_ID_3017511_gDNA_ID_2684124_Annot_ID_191036 3000 nt of promoter + ATG
ttccgatctgtattataaatcagccgtaaagtgatgtaactcagctgtaacgtgatgtaatttagcagtaacatatatttttcacaacctttcatcttccctgaatgataactcagccgtaccgaactttttgtcttccctgaagcatataatttacacccatctttcgtcttcccttgagcatataactcagtcgagacatgtaaatttaccaaacctttcgtctgtccttaagcatataactcagctgtaatgtaattttaccgaacctttcgtcttccctggaacatataactcagccgtgacatgtaaattgaccaaacctttcgttttcccttaagcatataactcagccgtaatataattttaccgaactttttgtcttccctagaatatttaactcagccgtaacatgtaaattaaccaaacttttcgtcttctcttaagcatataactcagtcatgacatgtaaatttgccgcaaaacaataagagacgcaacatttcgtctaactttatcatcgagcaccaacttcacaagcttgtcgtgcattatttctgcatctatctgcacaactgtacaccctcttaatcagtgtaaatacgtatttgtgtttcgatactcaattaccggacacaacaacaaccggaaccggatcaaccatatcggaagaaggatgaaagaaattgaagaagaatgaagaagacaatgaggaattgtaagttccggtgatgtgaaaaactcaggtgaagaagacgagttgaaaaattttggctctatttacatggaatattgcagccgacgtcgttttgaattgatgaggtggcaagtaagccaccaaacgaacatgtaaatttgcctaaataacttagccatcaaacaaagctataagccagtcgcaacatgaatactattatagtaattaaaaaatgaaaaaacgccaagttaattcagccgtgtaatatcgtaacttaaccgacaataaataactcaaccataacgtttgataactcggccgtaactgcatgctattatagtaattaatcttttgcaactaagtcagccgtaactaggctgagttatccggtaatccagctctttatggttgatttataacacttgatcataactcagccgtaacaacatcccataactaacccgtccttcataacccagccagccgaaaaagataactcagtcgtgtcgaggaaataagtctgatattttctaataacttagccataacgttgtctgggttatgctcgaaattcttataactcagacaaaattccttaactcaactgtcatgtaggctggattatcgcataactcagacataatttttaaatcagtcgtaacgtatgccaagttatactcataattccaccgttttctcatgactcaaatacttttgtcgtaagtcagccgcaacataccgtaactcagtcgtaacggccgctatatcgccttacggctgagttcattaatccacgttagcgatttctgacgtggcagtggtattccttgtattacgttttttcttgtaacgtttggtatagacacactgagtatacaaaaagacgaaaatatgatagtaataaaaaaatattttgtttggttctggtgaataaacctaatttatataacatcttagtaaatctctctaaaaataatttatatattataagaaaaatataaacataaattaaaacaatctttttaggaggtataaccttccatatgattgtagaataggcataacctttcataggatcaaggagatagagcttaccatttgatccaaaatatagatctgaacatatgatcgagcaggcagagcctaccgttatgatcaaggatgtagatcttattatacgattaagaggcaaatcctactattatgattgggaagagggcatagcctattactctatatataaatttctaattttaaataaattaagttttttaatataatttaaatattacctcaaagcgatgatatatttagagtcgctcagagagtcactcgtgctagcgaatcaagagtcgttcgtgctgataacgtattaaatattatatattatattattttagaataataaaaaagaatctcttactcatatttttttcttcacaaatgaaacatatatataggaaaggtgaactctttggatgtaccaaaaacttagacaacaagtcacgtgggtttccagaaataaatagataaacacaacaattaataattatctaactttttcttgtattaatcatttttattcaatatatatatatatagttgtttattttttaatgatatttatatattgaatacttcattttgtatctcacagtttttatataaaatttatattaatcaccaaaatatttgttttctttatttgttaacaagttttatactgatttgaatttggataataacacaacaacgaaaataacacaagttactatatcacatgttaaaaaacatgtgattattcatatgttaaacaatttttgtatccaatttattatagattattcataatttcatatgttaaacaaaaaatttcccgtctacggtcttaaaatttctagccacaaaattgatattgactgaaagaatgtcgaatatatacaacaattaagaatatttgaccaaatctatactttcctaagctggagatgaaaaattgatatcgaaagaaatcaaattgatacttgatattaaagattaccaaaaaaaagtagagtaaatcctaattctaattgatttgggcttttgggcttcatattggattatatttatgacccgacccgaaccaaaaacacccaattctctttgaccaaaaaataatccaaagacttagaagaaaaacaagatcgggtctcgtcacggtccacggcgcagctttttcttcgtcttcttcaattattctattccctctgagagattctctctgcgtttcttagatcgagcgagcgaagcgagagatcatg

SEQ ID NO: 14496 - DNA, 2291 bp, Unknown
  misc_feature (1)..( 2291): cDNA_ID_3017636_gDNA_ID_2684125_Annot_ID_191054 3000 nt of promoter + ATG
aagcttaacgcggtctacaatcaacttgtggaggttgtcgattatgttagtagcagaggttttccgaatcagagatttgatcaccaacaaggctacagaggttcctatgggaatggtccaactagctacactcagaattctcagttccagcaaccgcttcagaatagcaatagtttcagcttcagaaggaactatgatcttgcttcttaccaagccccccccccctccacccacacctaaaagcaagatagaatcactgctggaacagattctggaaggtcaacagaggatcttagagagacctatccctagatggaatgagagcagcctcactacttctcggcattctacttcaatggaaagtgagtatgagttagtgaagattgaggagagtgacgattttgcagttgcagaggcagtgtcgatcgacaccatcgcatatatacgagacatcaggctgtgacgaagtagaatcgaccaggctggacattaatctccagaatcgctcgacacacattgatagtgtcgaccgacaccacctgggtcaaaatgtgtcatgtaaacctataaatacagtttatatatctaataaaagtgtgtggttttcgttttacaaaaacagagaaatatacagtaaaacaaaacagagtaaaatatatgttgtccgatccttaataaatttgagagttcaaagttctacatatcttagattaaggcgaggtcaagttctccaaaaagatgactctgtgggcgatctgttgatatattattccatacgagattctcaggaaatcgtccctgaggcgagctggactattccaacggattgtagtcttaacaaactatttatgatacagaaaaccagagataactctttgtagaggtaactgatcgaggagtggttcagttctctagaaagctaatatccggggcaatccgtgaacatattactggttgcgagattcattgagacttgtcggaatgtcaatcccgaggcagagtgatctattcagacggatctgtaaagaaacagacagtaacgacttcagcaaaacagtgataactctgagcggagatatcggattgaactatggttagattccatggaaagctgatctccgtggcaatccgtgaacatgttcgtcgtcacctggttcattggactttgacggaaggtcgccccaaaagtagtcggattcgattgtctttgcttgttgagcgtacatcgaatacttggatgaatgatatgcgaagagaattttttgtcgttccccacagacggtgccaattgttgaaccaaggattcacacaatagatttgtttaaaagggaaaacaaattaagtaagttctcttcattaggtattccatccaagacttgattacaaagactattctaatatcttgtgaaaaacgttagagttttcctcaagaacaaagaaagaattagggtttttagaaggtgttgcatctatggtggattgcctacgtaccatgtgaagggatgaagccatcgtagttctcattaggtataaagttatgtgttctttttgagtattgaattatctcctttgctaagttgttgataataggtttttagtcaattatcgtaaaacaccaatcctgtcgttgtagtattttaggttgtcaatccaaatgggtgtgatgctaacaatcaagatgtgatcagaagtcactaagtcaagccaagcaataacaggttttggggtgttctaacagtcctaagtgaacatgcaggaaacagaaatttaagcagaaaaaataaaacactcgaccaacacagctcgttgcagagcatagggtgtggtcgagtgcctggtcgagtaacaagcagtaaaccaaataaagatactcgactgcacaatctgttgccaaacaactgggtggtcgagtatcaggtcgagtaacaagaaagaattgtagaaactaaacaacatgtaacaagatgcagtaagcaacaatagagtaaacaaagaaatcaattagataataggtttctaaggatgggttagagtagtttagaattctctgtatgctaggtggttgagtttgattgatagatcccttctggattaattgtttttaatgtgtattgctttttgatcaactggaatttgagcacagacatttccgcgcccaaaaggtgttcgatgaaatgtctgaaccactaattccagagatttgtggctttgtaccaaggtattggttgcagagagcgttttggctttaacttgttgattcgtaatgcctgttaggtaaactctcgtcaatg

SEQ ID NO: 14497 - DNA, 3000 bp, Unknown
  misc_feature (1)..( 3000): cDNA_ID_3017619_gDNA_ID_2684125_Annot_ID_191059 3000 nt of promoter + ATG
attgcttccttgatggatactccggattctttcagatcccgttcatccatatgaccaggagaaaatgactttcacctgcccctatggtacatttgcttatcggagaatgcccttcggtctttgtaatgctcctgcgacatttcagagaggtatgatgtctatcttcacggatatgatcgagaatatcatggaggttttcatggatgactttttagtttatagatcatcatttgaggattgtttagagaatctctacaaagtgttagcaagatgtgaggagaaacatctagttttgaattgggagaaatgtcacttcatggtacatgatggaataggtctaggacacaggatttctgagcatggtatagaagttgatagagctaagattgaggtcatgacgagtcttcaagcgctggataatgtcaaagcagttaggagtttccttggacatgctggtttttataggagattcatcaaagacttcagcagaatcgcaagaccattgactgctttactctgtaaagaagtcaaattcgagtttacacaggagtgtcattatgcatttcagcagataaataggccttgatcagcgcaccaattgttcagccaccagattgggatttaccttttgaggtaatgtgtgatgcaagtgattttgcagttggagttgtctaggacagaagaaggataagaaacttcatgcaatctactatgcaagtagaactcttgatgatgctcaaaggaattatgcaactaaagagaaagagttgttagctatggtttttgctttcaaaaatttagatcttatctcgttggatccaaggttattgttcacacagatcatgctgccttgaagtatttgatgcaaaagaaggatgctaagccaagacttttgagatggattttgcttcttccacaatttgacatagaagttagagataagaaaggagttgagaatggtgtagctgatcatttgtcacgcgttaggatcgatgatgatgtccctataaatgattttttgcctgaatagaacatttacatgattgatacagctgaagacaatgactacaaacgtgacaggttgcaggatcgtgcttcagtgtcgatcgacactcccattatgtcgatcgacactcacatttcagaggaagttgatattcgtagttgcgcgatagtgtcgatcgacacccttgcatctgtcgatcgacacccttgcacctgttgatcgacactcttctgaatcgacaagaaattggtcaccaaccgagaattgcgccatcacagcggtcgagaaagattatccattgtatgctgacattgttaattacctagttgcagatgtggagcctgataatttcacagattacaacaagaagagattcctaagagagatcaggcgatatcattgggatgagccttatctctataagcattgttctgatggaatttacaggagatgcattgttgcaacagaggttcctgatatactattacattgtcacagctctagctatggtggtcattttgcaactttcaaaacagtttcaaaagttcttcaagcacgcttttggtggcctacaatgtttcgggatactcagaagttcatatcacaatgtgacccttgtcagagaaggggaaagatcagcaagcgtaatgagatgcctcagaaatttatactcgaagtcgaagtcttcgattgttgggctatagatttcatgggaccattcccaccttccaacaagaatttgtacatcctagtagctgtggattatgtttccaaatgggtagaagctatagctagtctgaagaacgattcagcggttgtcatgaaactcttcaaatctatcatcttccctcgttttggagtaccacgcatagtcattagtgatggaggtaagcatttcattaacaagattcttgcgaaatttcttttacagtatggagtccagcatcgggttgctaccccctaccatccacaaacaagcggccaagttgaagtttctaacaggcaaatcaaagagattcttgagaaatcagtgggtaaagcgaaaaaagagtggtcctacaagttagatgatgcactgtgggcctccaggacaactttcaaaactccgcttggtaccacaccttttcatcttctatatggtaaagcttgtcatcttccagtggaattagagcacaaagcagcttgggcattcaagatgataaatctcgacatcaaatcagctggagaaaggagacttattcagttgaatgagcttgatgaaatacgaatccacgcttatgacaactcgaagctctacaaggaacgaacaaaagcctaccatgacaagaagatccttactcggacctttgagcctaatgaccaggtacttctttatgattctagattgacattatttcctgacaaattgtcttctcgttggacaggtccctacacagtccactcagttaggccatatggaacaatcattctcgaaaacaacaatggcaaaccatttgttgtgaatcgactcagagtcaaacactactgggctgaagctgagattccagtagaaaagcctttggatcttcaggacccacctgttgattaagcaactccaaagtcaagctattgactataaacaagcgcttagtgggaggcaacccactggtaagtatttctccttttatttatttcattcatttgatttctaacttagaatttttgattttataggaatatccagatttaaaaaaaaaaaaaaaaaaaaaaaaaaaaaaaaaaaaaaacgtgttgaccaataacgcgatggtgtcgatcgacaccctcattttccaggtaagtcgttttaacctaaaacttcatcttcttcatttcatatttttctcaaaccgccgaattcactaaaacctccatagatccttcgattcttcaccatttctcgtgatttcaggctttaaactcaatagaatctcaccctctatcttcccaaagtgtcaattccatcgatttgcaag

SEQ ID NO: 14498 - DNA, 3000 bp, Unknown
  misc_feature (1)..( 3000): cDNA_ID_3017615_gDNA_ID_2684125_Annot_ID_191060 3000 nt of promoter + ATG
cagtcttctcactcccatattcgagcatttccgcatcagctttgagggcgaagaagtcaacaccacgcgtgtcactatggatgagacttacctgaagaactctcactggcttaagggcaacctactgtggtgcttcagggatgatacaggtcagcacatgattcagttacctcaccttgcacttacagagattataggagagcatgaggagataggctttcatcaggatccctcccttctgcatgccgcaccacgcaccaggcgacagagaggttctgctttaggatctgcgcctacacagaccgaggaagagttcattgaccctactgggggtccgagagttggatcttcctcatctgctcttccatatcagctgccttctcctccccccatcccgatggagccacaggtctttcagcagtacgtcgtcgacagtttcaagagcgtctagaacgccatagctacactttctcgctgcggttgtgttgcccccagtcgtcgtcgtcgtcgctctcccgcacccacctccggctttactttctgactttggttctgctttatttcagactcttggttatttgttttgaaacttgttgcacttattttcttatgctttgttgggactattgatatgtcttttagtgatttaacagtctaactggaggatccatgtgaaaacactaaccaaggctctacaccaacgagcagaattcacaaagcaatgcggaacgaccaaagtgtcgatcgacaccatcatggtatcgatcgacaccactctcaggtggcaactcacgttttctaactttttaacttttgactatttctctttcaattcctctagcttaataactttggggacagtgttatctaactctgggggagtcagttactaacttcatcttttcttttcttatgagtcagttgtgtcatttttaacttagatagtcattttattgagttaaaacttttgtctgaaattatgatctatctctcgagtttattgcctggattgtttaagtactgcacattcaaatcaatccgactaatgaaaaaatctagaaggccaatcaacaaaattaaggacatccattcccaaaataatccacaaaggctggagctaatctcactgctcttccttttacctcatcaaaacggttagtgctcataggacttgactccttgttcatacccgatagatcgactaatgtgttaaaaagaaaagtgttcctctcccaaaaaatttttttttgataaataatgagagattgagaagactttcagatagtgtataggggtaggaatatttctataaccccattattatacattatttggaacgatcaattacaaaggttggaaaatgccgaaggtgtcgatccagtatgcgagttcccctttgtttactctctaaaaagaataagtctgggggagagaaagaacaccaaagaaaaaaaaagaaatataataaaagaatggtcgatttatcatggtatagttcaggaatgagtctagaaggttcttaagcattcacttgattgatgagacccagcgatgatagcctagtggatatagttgagtgctttggcatagaatctaggatgttgtgtgggctagcggagaattacatggtggtcaggatttgattagaactgtttagttcatggatttggtttgtatgatcaaggtaataaaccagagagattgggagtttctatgtttttcaaacctctttcacagattcaaccttttgttttgcttgagggcaagcaaaagctaagtctgggggagttgatatctcccggtttttactgatttctaacacagtttcagaatgatttttagagtctttctagtctttttcgtacgttttaagtcattctaggtacacgcacacatctgggaactatggagtacaataaggaattttggaagcttttcagcaataaagatcttgaaggacgtctttcagaagctggtgtcgatcgacaccacacctgtgtcgatcgacactcttgtcgctgcgaggagaatattcgttttacaccaagtctttgagaagccctgaagttttccttatttgcaagatagtccctgcacgtttttagagttaaatacctaattgtttggtcattgttagacctagtttttgttcttgagcttttgttacactttagagaaaagaatccaatccctaaaaagagaggattctgaactcctttgctactattctcaattcatcaataaaaactattcagattatgatttgtgtttctattgtcatgtctgagtaatcaccttgttgggtctagagaatctcaatagggatttagatgtattagtagatcgaaaaccccttaggattattcttagagttcttcatcttgataattcttaatgctagttttagattgatcacctagaacttgatattggataatgggtattcccgctatatgtatttgttatttgaaccatcatagatgagcctaggcatttaagaaagaacatgtaggctcatagaagggctttggtttagatactaggtgaactaatcaagcttattaacaatgcatgctttagcataggatttctcggcttctccggttatcttagttgtaagtatagagagtttcgcggaacgccaccggttactctagaattatagttttagtttgagaacggtgcgataacaatcctgatattagctagatctacaatttatctatgtcccgagacaattccttagacgtgacgctttaatcacttgaatctacaactcatttacttgcttatttgtctatattattcaattacttcattttgcttattaaacagcatgacaagtctattgtgtgaacatcgagagctcagtagaatttgacccttaagtgttttggagagagaatcaatctgacgttattattaagagttaaagaagagttattgttgtgtggatagcgtcgacaatcttgttttcgtttttgctccccagaaggaaac

SEQ ID NO: 14499 - DNA, 3000 bp, Unknown
  misc_feature (1)..( 3000): cDNA_ID_3017623_gDNA_ID_2684125_Annot_ID_191058 3000 nt of promoter + ATG
gattttccctatgataatattaaatctctcaaacgaatgtgatatagctaattacgttattaccttccatatattttacgttattatcttccatatatttcagaaaattagactttttttttataagttaattatattttcaagttttatattaatacatttaaatgttaattgatgatgtagttttgcttttattgttttatttttaacttcggtttagatattatacaattatgataaatacaaatcttaatattctattatagagtcggtttgttcgagcctatatcatccattatcgacatactcacatattcttaaaacctttcatacttattattatattgatcatggggtctattcttcgaattactttgtttatctgagggaaattaatcctgctctagaccgatacaagattaaaatacgtgtggttaggcttcggcgagcatttaaatctataggtattgttgtatttaaatctttggcgagcatttaaatctatagttgttgtggatggagaggtattgttgtattttttgttcttaactatttgttgttataatgtatatgttgtcttttatttgttattttttccaatctttgtattattaggaacgagaattcatgcgtccatcgaagagggtttcgttaagaggtttcagcactagtttattagtggtgaagccagaataatcgacactttcaattttgttgatcatgatggtaactataggacgagtcctttctgtttcaaaatagtcttctattgaattactacggtgataccctgtgacgattttccatctcaagttcccgagaaatattttaattaaggagtttgctgaaattttgtctgggaaattagacaggcagatattgtttggtttgtattaatattttaattggtatgtttttttatttctactttttactagcattatgccccctgctatgcagagagaaaattacacattagttacagtaaataagtgatttataccattaataatagcaaaagaacaaaggtagattttggactataggtgaagtcgaaacaaagactgtcaatccaaactaaattcatatatttcaattaaccaagaatctaaaacctctaaagaatcacagaatgtcaaaatatttaggttagcctaaattctcaaagtgagatgacattttcgtgatccaaaaaatacatgagattaaatttttcagttaaatatttttttacagaggaatgaaagaaatttaaaagaaaatcaatcattgtctccagttcatgtgattagcagtaatgaaatgaccaaagatctgtacttaagattgatgaatcaaatttgaatacaataagataaaagagattgtggtcatttttagtcaacatggagtactatgaagtagtggagcaaataaaggaggataaaaatcgtatgttaagtaattcaaatcatagagatattacgtattagggaagtagattatgcatattaattagggaagtagatgtcccttgtaatattttctgaaaatttatgaagttgtcgagaaaaacatggagtcgaaaatttatgaagttgtcgagaaaaacatggagtccgattggtgacctataaaggaatacatggaataaagagtaacatgactaaaaagaacaaacaggaaaagaaaaaaatgataaaataggaatgaagaggaataggtgcagaggaaaaaaagaacaaatgttactgtaaatgataaccaaaacatagaacaaatagtaacaaaaattaaaaaataaataaattattttttaaataaaatattaaacaaaatagccaagttatcatagactcaaacaatttcattgccaagttatcacgtaacttgtatggcttggttttctttcttactataagttcacaaaatcagagagttaattgtcgagtacttgatttgcgtttgaaaatatgagatcaactatttataaaagcaaatgatgtaattgagaactgataaccttggcatgtctttgggttagtcacgatggtataagatttttctttttctgaaaatgtttcacagggaaccctaaaaatgaaatccatgtcttgttacagtcagtttctcaaaaatatgtgattagatgagaattgtaataattcacaaagtataaagcaaaataatgttaaaactgaaaccagaataataattgcaaaacgaagagacatatgaatctcgagaatatgaacaaattgataccttaattacaattacacttgttttgttcttcagccataattgacatggaaggggaaaggagagtgaaaatgaattatggttcgagagatgaaagtggacaaaaatactgtaaaattgtaaatctgccatgacgtggagatggaggaagagaaagtaattgatctgaaagcgagaaatttgggaatcgtaattagaaaatccgcgaagaaaattaaacaatataattagcaagaacagttgcaagagaagatcgtgaggaagatgccgagaaagaaggaaagattttgggattaattttctgtaaaatttttattaatgagtaactaattattgttttacgcttcaaaacacaataaattgttactttgcttacgtgtcagatggagagagtatcagttattgtaaaagtgactgttgatttagtataattagatttgtttggttccactaaaacaatgggatagctaataaatcgaatactttaaagggtttcttctatgttggggcactttccaagtatttaagcccatttagagcactttgaagggagtaggcactttttggagattttctattgtttaataaaaatcaatacaattctacccctgatgacgtcaactgttgcgctagctatggttaatgatatgtcccggtttttactgatttctaacacagtttcagaataatttttagagtctttctagtttttttcgtacgttttgagtcattctaggtacactcagacatctgggaact

SEQ ID NO: 14500 - DNA, 3000 bp, Unknown
  misc_feature (1)..( 3000): cDNA_ID_3017611_gDNA_ID_2684125_Annot_ID_191061 3000 nt of promoter + ATG
ggggcaacgtgtttatgtggaacctcaacgtttcacaaaatccctcttcttcttcgtaattgtatctctttttaaattttgagtaaacttcgcggtcctctcttccagcacaactcttcaacataatgtataataattcggtcactgggtagacttctttagtatatgtggcgatctcaattgcctcttctatgtcaaaaaataggaaagccgaaactaggcttcgaacatacaatgcataaggattttttgctttacacatttccaaaaaaaaggattgtagacactatcaaggctggactagtatacaaaatttctagatttgtccaaccttaccgatttctggctatctggtgaagatacagctaccattccctcccttccggagataatccaattctttaactcaccaatctcaccttcagctatatagctaacaatttttgcaagaatgcctgcaggcatgtggaagtttgttgaaggcccctacatgtgaaaaacggattttaatttttttataaatgtatgttttactcttttataaagattgcctcaactcttaccttttttttaaacccgacgattgattccagattttgactacaagtttgttcggccatccgtcgaggagtttgttgtcttctactacagatgtaacgattgggattattggttgaaacagaacgatgcatgaagtgcctttctcacaaactattttggggaccatagtatagatctttaaggtatttggagcatatgatccctaatcgcacctttacttatttataatttgattttaaaatttttggggggaaatatcccgccaaaatatatgaccacgttgatatttatagttcaacaatatatgccctataggtattttttgggttctcaaaccacgtggttttgttatgatggataacataaagctaatgctgtgtgttaaggttaattgtttaggttaaagttttaggatatagggttgctaattatgtgtaattggttaagtgataggtattaatagtttatttatttatttgggtttagggtttagggaaatactgtttaggaattatattttagggtttagggttttgggttttgggtttagggtttaggtcttggtgtttagggtataattattattgtctggattttagtgtttagcgttagagtttatagtttaggacattagtggtttagggtttagagattaggtttaggttttagggtaatgttatagggttttggggttaaggtttagggtttagggtttactgttagggttaagtgcataatgtttagggtatagtgtttatgatatatggcttagagtctaggtttaggattatgtttaaggtaatgttatagggttttgggttatggttttagctttagggtttagggtttagtgtttagggtttaccattagggtttagtgcatagtgtgtatggtatatggcttagagtctaggtttagggctatgtttatatgaatttgacaatatagcctttactatttagaaacactagtgaattaaagagataattatgtattgtcttaatgtggttatgttgtgatggatagtttatttaataacttatgatttagatgactgattactatattctttattttataatttagatataattttatgattaatacggacataaatatcatgaaattgtttttgttataacgaatttaattaaaatatgtcattcacaaatatctaacaacatattaagaatagggtttaggatttgggttttagggtttagtgtttagggttttgagtatagttattaggatataaggtttatgatttagagtttagtgatgagatattttagcttagggtttcccaatagtgtgttgtgcatacggattttacaatatagtctatactatttaggaaaactattgaatttaataggtttatatatgttcttaatgtgaatgtgttgtgatggacattttatttaataacttataattttgagaaatgattattatcttaccaatttaggtatatgtattatatgattttttaatgtatatataagtttatgatttatacggatattaatatcttgaatgtagattgatataacgaattggtaatcaaaacattaagaatataaaattaaaaatatttaaaataaactaaatttttgtgataatcaaaataaaaataagaatataatataagttattaaaatctcaagctaaacattaaacgagaaattattacataaaaaaaaaaaaaatcatgaattaaccaaaaattattacataaaatatttaaaaaaaacaattcctgaatcaaccatcaatctataaccaacttcaacttcacgaatctctgcattagaaaacacttttgatatagatccatggctcacaatcttcactccatttgccctccaatttgacttcaaaaccttccaccaccctagtgcaacaatcatatttggctttccatacaatcgattttttttttcaaagtcagtagctgtctgcccaaaagcctcacacgacaatacttctttgctatagcaataagtatgatcaaaatcttgtatacaaatttatgcagactattttatataaacaatataaaaataatttactctctagcgatccatgatcttgaacagaagggtgtaaccattaacgtcttcaacgttgccagtatcatttctcaaactcccaatgataagtgggcattttgcctgttttgagcatacatttatcatcactttagcatcatatcatcacttttttatatcatttgtcatcatttgtcatcactttgcatgtttatgatagttttacatgcatgttgcatatttgtgttgttttcaagtgatttggagctgttggcgagctaatttgaagaaggggacctgatcactgcaaaacactcgaccccctggtcgagtagatgattccacgacttcaacaaaccactcgaccccctggtcgagtagatg

SEQ ID NO: 14501 - DNA, 3000 bp, Unknown
  misc_feature (1)..( 3000): cDNA_ID_3017532_gDNA_ID_2684125_Annot_ID_191083 3000 nt of promoter + ATG
atataaagacaaaaccataccaactaaaacccaaaatcttattaacatgctttctttcacgtattcttttctctgcatttgttattcttacagatccataataatgtgttcatttcaaatgtgttcatacggaatcttgtttactaagcatatccatcaccccaagtccatacaaccatgtctacaccgttgtagaatcacaatacacaatttctataaaaaagcataagtaataaccaccaatttcaaaaactatgtccactacgatgctttgcgtttatattctaaccctttacaagtagccatccactagcgaccattcaatgttgaccatatagttgtagggatcaattacaattttcttgtaaatggttagagttatgaccatatgatgtatcattgtagaatgcgcaaacaaaagaaagtgctaatttaccgagctataaacacattcacagcaaatcaaagacatagttgttgtccattgatgacagtccaaaaaatgtagtccatatggttatctaatgattcacatggtagttttatttcaataaacaagtctatacatgaccaataaacgccaatccaaagtacattatccatttttctttgaccatttattcacttgtgtataaacaatcccatcagtaggacaatgtcagttatatagcttttataaagaatttaacgaagatcttatcactctcaatgaagaccattagttcacttggataaacccgtctatactaatcatttgtaataggtataagatagaaggatgtgtccattgccataaactacagatttttattcaatagaaattcaacaaatatacatctattgtataacgtcataactcacaaaagttactttgattttcatcgtgtctcaacctctcgtttatttcttcatcttgactttgaattagaagtgattactctcaggaaatcaaatcaatcagaaacaatactttcaaatttatagatctgatgtggaataagattaagaactttctaattttgtatatcagagataccagagtaattaggagcagagaggcaccaaacgaagcgacgaataaggcataaagctccctccgccaccgccaccaccaactacgtacgccatcatgtcttgattagcttttcaaaaacaatcatagcaaggaatcaaagcaaatatgtcggagattagaagataaagccctcatttttgaactttgatttttcgtaaaagatttgatattggttttggaaatagaaaaataaaaacgatgaagaagcgctgagaagatatgacaaagagaatgagtttgcagttaaaaagggtaaattggacaatttggtttggcaaagtgccttatcttttcaaagtgtctaaatccgtacatagttttttaaaagtgccctagaatgtaatattttcataaataaatctatggtagtataaaaactataaatcttagaaacaaaaatatataatggtataatatgaggcaagcccactttaattggttgtatatctaacttttatctaaaagtttttcaaaaataaataaataaatagatatattaatatccatttctctctagagtttgtaacatctaatacctaaatattttagaaaatttagtttgatattaactacccaactaaaccaacaattaaatttgttcacacatatgtaaagtcaataatacaaagtaaatgacaattaattgaaaaccaaatctcatatcatttatttgttttccaagcaaccaaatatatttgaaaaaaaaaatattatataatatatcatgcaattaagtaacaaattaaataaagctatggttgaatacaaactatgaatcttagaaacaaaaagcaaaaaaaaaaaagagattattctagggggtgaacccaattatttttctatatattcaacgtttttcttcttgacacactcaaatctcattctgtttatttggttttcaaacacccaatatcttctcatactaaacaatcttgagtaaattagtgtttcctaatttgttctcaccacaagtctcaagccacacaaggaagacaatgatgataaaagagagaaaaaaaaatcagattattggaggtgataagagtaacaatgaagaatatggcaatgtagaatatctctttttttttttcctttagcaataaagaagatataaacaagagtatgagttttgcaatcagattatttttttgctcttgttggtctgcgtaattatcttcaatagttccatttctttaagtttccatagtcactagatgtctagatttatatttcgtttctgatttgcttgggctcttcttaattttgctgatatgtttgaaaaatagggacatgagtatgagacttgatatttcattcaaatttttgttctaagatgtcctgtttataaatcacattcaaaagcttttttccctccctggcacttttacctaggcgaaacaaaagcagaatagagctttcttttaaccggatctcaccaacttccccaacccatttttagaagtttgtaacggtcccttcgtggctttggcttttgtccaacggtcggatgaagttttccgttgaagtttcgcttcttgttaaagcttcaaagttttccaatagcaagttccacaacctgtgaagcttagatccatatctggtaccttacaaccccttaaccaaaaccaaccactaccctctgtttccatggcaaaccgaatcccctatcacctcaaaggaaaagttgtggatattgactttcccccccccccccaccaaagagaatccgagcccctgaccttgatacctttgacctaattgaagccaactccctaacccttatggatcgtctcaccaaccctgctggctaaagattatggtctttgttttctttcctctctaaccggtggaacctaaagggtaaagccgcaggttcagatctgggaagaggttgtttccagttcagctttgaatttgaggaagat

SEQ ID NO: 14502 - DNA, 3000 bp, Unknown
  misc_feature (1)..( 3000): cDNA_ID_3017557_gDNA_ID_2684125_Annot_ID_191076 3000 nt of promoter + ATG
caggtgtcaaaaaggtagtgcagcgtatcataagctatagttttatacgtttgacatccaacataaacaaaaaaccaattgtttcctacctttttttttttttacgcaggttgctattatccctgaaattcacataccggcaccagtacttgctaaaattgttagctacgttgttgaagaagacgtgtatgctctgaaaccctttgtgaaagctggaccactatttaaatcggctttgtattcaaaggaaactctaagttgtgtacgcgttgacaaatctcgttattacatgtggtggtccatgacgcactccatctattatcatttcttcacaaaatgtcttgaagccaaaaattcacatgctttgaatgctgtattgtacaaaccaatagcatatgagaattttgcagccgaatgctatagagctaccttatgggtggagctttacggagagtatgaagcatagaaatcaatatgttcataatgtgtccattgttatcttgtcatgtacatttctatacttgatatatcttatatcttttgaagtttaatcctaggtaaattcatccattcctccaactaacttttttggttgacatgaatctgttgagcacgtttgattaagttaatttcccagaaaagattctcaaatgctaacccgtttgggtcataaaactcagatccaatatttatattacatccaaacggacggttatcggtggacatgttattttggacagaaaaaaagattatgaacaaatataaattgatgatatccgcaacctgcttcaagacgaatttccgaggtcaaaccgaattaatgcttagtacaagacaaattaaatccccataccgtatttcaaactctattttactttattgaactttcatagaaccaacgtttttttaattaaaagttacaatgtttaattccttcgacgaatcaacacgtcgttatgacagtttacatcgtttcagtttgtatagattcaactgctactcacgatttcatcaagacaaccacatcacaaacgcaaaacaaaactaaagcttaccatatttctcagttttcgttactctttacttctcctgttcacgatggttcaacatcataatctttacgagttgtctccgatggttactggctggatcatctgtgtcatggtattgagaatttaaattgctcaacccgaacgatttcaaactacgtcttgtcttggccgatgaatgggtaaacaattttcttcaatttattttgcaatttgcggaatttttatttacccgtctatccctcacccctaaaatgttgtttgtaacagggcacccaaatagaagcaaccatcggacctcgtttctctgccttctactttgacaggatccaagagaattaatggaaaacgataagtacgtttctcgttcgacctaactgcgaaccaataagaacaactcctcatgagtttcgcattctattcatggatcacaccattatcacttcttccacacctttagcaactagtttactcaacaagttcactccatttgactacattgtggatgatgttgttggcaaacataccttggttggtaagtaatggcttcttcataaatttcattcacatttttcaaaaaaaatatttttttaaacacatatctccgacatatttcttatagatgttattggtgcactcgtgaagattgggattctcactaataccgcaagtaacgggaaagatacggtcggattcaaactgccgttcatgatcatggataaaaaaacacatttcttcaacatcaattttcagtttttttccaaacatatcatgtttatacatttttgtagtaaggttactatataatctcatatttttactgattttcagcaaagatacattggaatgcgaggcttatggacaaattgcagtggacttggagaaaaggtttcgagcatttcgcaagaacaatgttgttattgcacttgcttggtggaaggttgttagatattatccaggttgtaactggtttaagattgttagccatgcgccaatatcaaccatgtatcccgaacctgatgttgaggaagttgaagaaatcaaaatggttgtcgactaatggaagatgcttagaactatcaaagtgcttgttgcttacaattgttatctcatcttcttttctgtttttttcaaatcttatgtttacctccaacaatgttttaatatttttataaatgatattatatattaataaaaaagttatttatttattcaaaatttctcctttttatttattgcaacaaaaacttagattaagcattacaatagtaatcaagtgtctgaattaagtttacctatggaacattgttgaactgttttaaaactgaagaattacccacatacaggatcacaactgtttgtaaaacgtcaaaccataataacttactcaaactgtttaaaattctatttctgatgttttgttgttatgttaattcttgtttgcattccatctacatttctatataagcgaagttttatcgttttaacaatattttttttgtctttaatgacttcagtctatggatataaaatctaatctcttctcaaatttacgaaaaaaatgaagaaaaaaaatttcgaacctaaatccccataaataagttccggctaaattggctgtaacaaatcactgtagcacgtctatgtaatatattatagaccatgcgtatatatattcatggacgtgagaatatggacatatctaatttactatcacgaacaattttttggaatatttataggatccactaattatattcggtaacccatcgctccaccacaccactccctactcatttgtccagagaattagggttcccatttcatcacgatctcaaatccgtttcccttcagcctagttcggtcctctttaattatcggtgtttcttcaaattccttagatcgttatttgttcactttcagtactatactaatttgataattcaaaatg

SEQ ID NO: 14503 - DNA, 669 bp, Unknown
  misc_feature (1)..( 669): cDNA_ID_2730160_gDNA_ID_2684126_Annot_ID_137181 3000 nt of promoter + ATG
aagcttcctgaaaccgcgacgccatcaaaaagtgaagatcaacttagaattttggagggaaaataaaacttgctctgctttgcttttgacaacgaaacgaactgatgaagttgattcagtacggaaaccctagttcgaatcgcagtgacgcagatcagatcctcaattatttatttcttcccgagtttaacaaaaagtcaacgtgctcgttttttaaaacggtgtcggttagatgatgggctaagcccaaatccttttgagtccaaatacggagaccagagttcgaagcgcaagtgacggctttataatctctttatttaataaaacgatgtcgtttttgcttaagcaataggcccaaataagtaaaaagttcaaattaagggttttgaaaatattcgccgtcgccgatgtcgggaaaccgaagaatttgaggcaaaaaaaattcgtatttccggtgagtctgaagttcctgaattataaatttccgatctttgttaaattcaccattcgttttcctaactctccgtcggcaaaaggcgacacaatgaagcacatataaaactgaaaatctataggaatatatatacacattataattctctaattgcattggcattggatttatctctttgttttacagaagagagtaatctctggaaagaatcaatg

SEQ ID NO: 14504 - DNA, 3000 bp, Unknown
  misc_feature (1)..( 3000): cDNA_ID_3017649_gDNA_ID_2684126_Annot_ID_137187 3000 nt of promoter + ATG
ttaaaacccactcattgctagtacacatcaatccacaaacaggaacacaaactccaaacgagtaatctttagggacatccatatgattatcaacaactacaagatttgagttctggtctgaaatcagatactcgggggatgagaagaaagaccacttaccctcagcttgaaaagtgattaggagatgtggccgagccgaggacctcttcaggaacaggttggtgagatatggactgcggagaagagaattccaatcatttgacacgcaacggaacctcgcggccgatttcgcaggcaccctggagagtatttcgaccatgagatcagttggcaacgtacccgagttctctccatattcacccactgaagaagatatggttagggcaacattttccttggagactttcctcttccgttttttcatcatggcggacattgcacatgaaaaagaaatgaaacccttagagttctgagtaccgatagacaaacacaagacgaccttataaatgaaacccttacagatccactagacagacacgattttgccacctttcggattatgtctacctaccacattttttttttttatctttctccctttttctaaccttatctttttttctttaatttcctttttgtagcatccttattagataccattacatatatagataattttatctataatttttcttcttttccttctaaattcattgataccaatcgagattacaaagttattatacaaattatttatctataattaggtagtactttttaatgtatatatacatacatacactatactaattacccaatcataccgttgctttcacgcctttttgtatatttttaaaatgacttactaaaatattgagtgtgattatcttgaaaagatatcaaatttctatttaatcaaattgaataaattttgagttcaatttattatatgcataaaaaatatgaaaaggatatgactatgaggggatcatatagttttatgaaagtagatgaaagagaataacatacagtaaaagtaggttttagattagagaaagaaaagcaatggattaggtcgatgaaccgcgaccaccacggccaaatcgtagtacattgattctcttgatatttttgcgtaggcttgattggccttcctccttgggcttttagagaggagtcacccatctcaaaacaagtatcaccaaatcctgagtttaaggaagcaaaaatattgctttcaaaaacattaactagattttcatttgccaatgaacctcgttgggtaggaataaatagggtgtccacagatgaaggagtatcaaccatagaaagaagcctcagttggtgcagcatttgaaaaggctagtaaatttggcgtttattgacgccagtagagagagagaagctaagtatagtggcagatggcgttgctgggggggcatactcgtttgtccgtgatataacgtgcttaacaatttcattatggtctctacatttttgacgaatgaatgcctatcacctagggttttcttgtgttttaggaaacattcttcctcaaaataattctccgcatatcagatatatatcaacttaactgagaatagcgattagtgcaatagtttcaaattaaagaatgatgtcctacaagtaaacagcctattaatttctcagggacaaatctgtcagtaaacctcggaaacaggcgtttcggtatctaaatacaatccaaacttagtcatatgtagggtttactgtttaggtaagcgagcgaaattaaccgaaaaagtgttatagcccaacattgttgcattgattatagctcaaaactcatgataaaacctgtcccaagtgtttgccaaaaaaagacatgttccaagtaaaattactaggctttcctaagaataaaataaatctcaaaaaattgagtcgactaaacatcaattgccttcaaaagataggttaaatctattagtcaacaatccggatacaaaatcatcgtcactctctcccttcacgtcctcctaaagatgattcatcacaagaacaaattaaaccaagaaattagatatttatattgaatatcaacagtaattacaattatgaatttatgagtatagtatattaattagtaaaagggttcaaggagagaagaatacgataccttatttttctcttcagctactggggcagcttgagtggcacttccagatgaaagtgcagaagaaaaaacggccatgggagaagcagcagatccaccggcaccagcattcatgatgagatcatccatgtttttgttctggcggaagactaggccagtatgattcaatgttcaaattggctgttttcaccaatgttgacatctttctcagcctagtttacaagtaaacaaaatagtttgagtacatgttaattaaaacaaacaacctacaagttaattaaggctccagtaggattgatgtcaagattgagcctagaaagtacatacggtgacatggtcatggaggaggagagctgcgtaagtgcaagctagctcaccggtggccattgtaggctagctcgcgtcccacgaaagatctacaaaaccatcaatagagctcatcgattcataatctgaacttcaagtgaaacataaaaacaaaacgtgtagagtctctgaatcgaacctgtaaccaaacagaagattaggggttaacgtacgaggtcactatttatttcgatagagttattagggtttctagaggattattaatgtttcgaaatgggcacgtgaatatcatgtgcggcccagagaaaatttaggactggaatttcatggcctatatagataaccaaaattgttcttattaagcctcagaagcccaataaaaggcccaattggacaacgacaaagcagaacccgagtcgttaccacacacacagtcgtcactcaccacctcaccgttccttatccatttggctgacgcaaaatcgaatcggaaccctaaaatctctccgaaagcc

SEQ ID NO: 14505 - DNA, 3000 bp, Unknown
  misc_feature (1)..( 3000): cDNA_ID_2730148_gDNA_ID_2684126_Annot_ID_137189 3000 nt of promoter + ATG
ttctttgctgaagacgggaaaacacgtgtgtcagatataaaaacatggatggggaagttcaaagacaagaatgtggcaaaatgtgctgctaggatgggcctgtgcttctcctccacatatgccactgtagatgtcatgcctcacgaggttgacactgaggttccagatattgagagaaatgggtatgttttctctgacggaattggtacaatcacacctgacctcgctgacgaagtaatggagaaacttaagttggatgtgcactacagcccttgtgcttatcagatacgttacgcaggtttcaaaggggttgttgctcgttggccatcaaaaagtgatggaatcaggctagcccttcgagacagtatgaagaagttcttttccaaacatacgatcttggagatctgttcctggacgaggtttcaacctgggttcttaaatcggcagataattacccttctatccgtactaggtgttccggatgaaatattctgggatatgcaggaatccatgctctataaactgaaccgcatccttgatgatacagatgtggcatttgaagttctcacggcatcatgtgctgaacagggaaacactgcagctatcatgcttagtgcaggtttcaaaccaaaaaccgagccgcatctacgcgggatgttgtcttcagtcagaattgcacaactctggggtctcagagaaaaatctcgtatttttgttacttcaggaaggtggctaatgggttgcctagacgaagcagggatacttgaacatggccaatgctttattcaagtctctaaaccgtctatagaaaattgtttctccaaacatgggtctcgttttaaggagacaaagacagatctggaagtagttaaaggctatgtagccattgctaagaatccttgtcttcacccaggggatgtaaggattttagaagctgttgatgtaccccagctgcatcacatgtatgactgccttattttccctcagaaaggtgataggccgcatacaaacgaagcttctggcagtgaccttgacggggacctgtactttgtggcttgggatcagaaactcatccctcccaacaggaaaagctatccggccatgcattatgatgcagctgaagagaagagtttaggccgtgctgtcaaccaccaggtcaatatctacttccccactttttttctgttagctgagatgatgacgcttaagataaaatggacaagtgattccagtataactctctgatatttctggaagtggtggaaactttgtttttggatgcttgtagtgattacttttgcttgcttctgagttcatagattgcgtggcataggttgttaacagcatactgtgttcatcctgtaggagctaagatgatgacatttaagaaaactttgtcatatattgttgattctgatttgtatttttcgcatgccttactgtgactgtgactgtttagttactatcaagggcagtatcatgatgctagtagcttctgccaatgtagttatgaattctttgttattttttcttgctgtgcttgccaagtcttgggtaattgattgcttttgttacaggacataatcgatttctttgcaagaaacttggcgaatgagcagttgggcacaatttgcaatgcacacgtcgttcatgctgatagaagtgagtatggagccatggacgaagaatgtttgctactggcagaactagctgccactgcagttgatttcccaaagacagggaaaattgtgtcaatgcccttccacctaaaaccaaaactctacccagatttcatgggaaaagaagactaccaaacttacaagtcgaacaaaatcttgggtcggctttacagacgggtaaaagaggtttatgatgaagatgcagaagcttcctcagaagaaagcacagacccaagtgccatcccttatgacgctgttcttgaaataccgggatttgaagatttgatccctgaggcatggggtcacaaatgtttgtacgacgggcaactcattggtcttcttgggcaatacaaggtgcagaaagaggaagagattgtgacgggtcacatctggtccatgcccaaatacacaagcaagaaacaaggcgaactgaaagaaagactgaagcattcttataattcccttaaaaaggagttcaggaaagtatttgaggaaacaatccctgaccatgaaaatctcagcgaggaggaaaaaaacatcttgtatgagaagaaggcttcagcttggtatcatgtaacttaccatcccgagtgggtgaagaagtctttagagctgcaagatccagatgagtccagtcatgcggcgatgctgagttttgcttggattgcagctgattatcttgcaagaatcaaaatccggtcacgggaaatgggaagtatcgactcagccaagcctgttgattctttggctaagtttcttgctcagcgtctctaaaaggttatgtttaatgccgtaaggccactctgccatgtatctgtggatttttttgtgtgacgaaacatcttgtctttgcaaaaactgcttgctgttcaggatttgtatagctcaactgcttgccattgtttgtgtaatgtattctactatattatcgtcaaatatgctcttattattttcaaaacaaatttgatttgctcttattatacttgatgttggttaactggtttgattaagatgaatcaaatgagagtcttgagacttttataatcaaaatgtgaaatacataaaatgtacttattatatgattaggaaaatatctgaattggtaaatttttattgactcctgtatttatctgtgattataattaaacagttaaatgacttataaattcattttttagtgacattatagggctttccttataaggccttaaaggcccattgagaagctaattccgataaacattgacattctgaaacacttgagctgcaacaacactttttccttcaccagtctcttcctcgttttggtgagaaaacgatg

SEQ ID NO: 14506 - DNA, 3000 bp, Unknown
  misc_feature (1)..( 3000): cDNA_ID_2730144_gDNA_ID_2684126_Annot_ID_137190 3000 nt of promoter + ATG
cttagtcgaaatccaaatctctataatctcacgtgtgttgtagtggttatataacacagccagcttctcatctctagcccatgatagagtcaaatagtcaaaattaggagagggagggttaaacggcagagacaaacgcggtccaaatctctcggttgtaaaatcaaaacatagtaaataatctctcggttgtgatatcacttcttcttcttcttcctctattgttacctcttgaccgaaaaagtatgaatttcccttcaaggacacgccactgtaataaaacagttcacccctgtggggattaacatcaaaaaccctcctccatgaatcagagctaaaatcgtagacatcattgtcgcgtccgcgaccggttctgtacttcttggcatcataaagaaacctcaagattttgtggttacggttgttgtcgtgtccaagagcaaacacgtcatatctgtggaatgtgtttctaagtcgaatccatttggtttgacacaaatacggattccataccacaagtcccgagttgtcttcggcgatgcataaaagagaggttttcatttgagaaccgtttctttctctatctcctactttttcctttttttaatagtatctcatatcgagacaatggatggaggttctttagaacaaataatggcagatggtttcagctatggcagtttctccctaatggcctactaactttatattctctccggcctctgcattgcttctatgactgagagtatattgagataaagaacataatagaggtagatgagagagtacatattcatcagatgactagcattttctacgaaatggtgttttgacaattcaaaatctaaaagaaatcaagagagatcaaatcccaagtttaagctcatgtgtaaactatggaccttaagtactctattgcatagaacggcaggccaatgaagtcttcctctataagacaaatcgatgatattttcatcttcagtctgaaaccaagatttcaaaatgaacttcaaacactatacttgaaaaagtgagattttgtcatatatacactcatacttgtatcaactatttcttcaaactaaaatcagttttgttcaaaagaaaacctgatgcaagaaacaaacaaaagtattgaaaagtgactaatcttgcagttgaactaaacttggaacataagaagagcacacaagtctgcctggtttccgctgggaattcggacttactccaatgttgacagatttgaagtatccatcatctccaacgatgtaagccatttggtagcgacaggtcttgatctctttactatcaaaaagcacaacaactttcttctcctcgtcaatgaagaagctcttagcttcaaagtacatcgaaaaatgatccggtaaaccattgactagtgacatatccacagtcaaaaaagagctccaggataccgcattgggttcaatcttagtcgaaatcctaatctctataatctcagctgtgacgtagtggttgtataacacagcgagcttctcatctctaacccaagatagagtcacagtttcaaaactaggacagggagggtaaaacagcagaggcaaacacggtccaaatctctctgttgtaaaatcaaaacagagtaaacaagtttcaatctctgttactttcgtcgcttgtgtcacttcttgaccgaagaagtaagtatttcccttcaaagacactccggtctgataaaacggtatatcacagtcaggattgacatcaagaaccctccatgaatcagagctaaaatcgtatacatcaatgtgagttcttcgactgctttcgttgctctcttcatcatagagaaacctcaagattttgtggttacggttgttgtcgtatccaagagcaaacctgtcatatctgtggaatgtgtttcttggtcgaatccatttcgtttgccccaaatacggattccacacaaagacattcgagttctctttggcgatgcataacaataagccatcgcaatgatagacttgagatatctcgacttgatcatcattactaggtatacttattagcttcatagatggatcaacgaagtcttctttgtcttcgttacggattccttgaagatctaatctcaaagaacaaactctagaatctagaatcatgaactctagaaattgattccttgctgctgtttttctaccaaagatctgatttttcgataaagcattccactttttacaagtagatcgcactgagattagagatgtaaatggaaccctagaaagaatatcacctaccaaatcatctgatagatcggaaattgtcgtcattcttcaaaactttctccagaaatttgtgtattgttcttctccttcagtctgttctctgttgctacctttactgtgtcaatgtcggatctctcgattgtattttcttgataacggtttggtttggcccaggttgtttaaatgggcctatgtacaataatggaaacaaataggaatatattttaaaagcccattaattagacaaatagcacgtgagcagcacaagcacttcttctccagtctattttccccctcatcagtctcagactctctttcgtttactcgccgaagtcaaataaaaacgagagatggtttcagctatggcgggttctccctttttcgcatactcactaatcctctctccagtctccgcattgcttctatttctacctcgtatccagtattagattgaaaaagatctcactgtgtaagtctccagaacctcactgtgtaagtgcttttgtatttattcccgcttgattccaaaattattcaatcaacaatgtattaggtgatcgatttcaatagtatttgtagttggaatcatcgatattgtctcttaatttgatatttatggtcttagatcttccaacggagtagcgaattagggcttttcttcaatattttctcttatcagccttatcatgtgggggttatttctgtttagtatgtttctttttcaggagaaatg

SEQ ID NO: 14507 - DNA, 3000 bp, Unknown
  misc_feature (1)..( 3000): cDNA_ID_2730133_gDNA_ID_2684126_Annot_ID_137193 3000 nt of promoter + ATG
tgtctattaatttatggttagagatactactaaaatatctactcgtatatttgcatattaaatggcctatttaataggcgtgggcaggaaatggtatttgataatgtaattaattagttatttggatatttatttatagagtaagacggcagaaaaaagtccgtgaagtaacggtaagaggaactgaatcaaaccattctcacatttctcaagactctaaccattgaaattgaatttttttctcttttggccaaacaagaactaagaagaagaaaaaacgactataaatagatggcacaagtcattcatcacaaaagagtagctagacctagagaaagctagctaaacaaggataaaacaaaatacgtaaacaccttgttttgtattataccaatagaaagagttaaatcagaatttggaggaaggtgtacggaatccatccaccgtgagaccacaaattgaggtaacatgatgatagaagttttgttgtagcgacgagaacaatgttccgtatacttcatatactgcttaaaaccagaagtgtttatgcgacaacaaccttcatcactagtccaatcctccgaatcctgatgaatgatgaactgtcaactcttgtgtccgcaagttaccagatacaaaacaagagtgtttttgactccatagatagataatatcagaatcaaagggattcattgccacttgaaaacattcgaatatactccaacagatgcaatgttgatttccggtgtcaacaactgccaacattcatcctctaagtgttaatattcagtctccaaatcctcaatattcgatgtagtatttcaatgcagatcccatctcctcgtgaagtagtcaaacatctcttaacattctaacattaaattgaaatcatttagtaatatttgatattttttcttcttttctttgacactgccaattacgatttatgagcaggacttaagattgcatatacaatcaaatgaaagatggagtcacatcacaagaataaaaagatcaatgatcaaatgaaagattttagttttcaggggattttgcatctttcaatgttttcgattgtatcttccggagaaaaaagaatcagagatcgtaattcacacacgaacacgttcgacttaagaaatgttgattacaaattttcacgatgcaaaactgatttatatttaattgaatcaaagaagaatcattttgagatacaaagaacaacaaaagccaaaccaatctggtagtagcaaatcaaaccaaggtgacatacaacaacattcaaaatactttcacaaatttaattaatcatcaaacggtgacaacagcttctttctcttcttgtttactctcctcctttactggttcagcctcagcttttactggttcagcctcagcctttactggttcagcttcagcctttttctccgcttccactgcaacctcaaccttttcgggtgcagctacggcaaccgcctccacctttgcttcagcgttttctgttgcagcgttctccactttctcaggtgcaactactgcagcctcaccagcatcagcagaagaagactcttcgacggctgcaacctctggttgaacagcaggagttgtttccttggtcggctcgaccggaaatgtctccttagcttcgacagaagttgtttcagtggtctcagccactgtctggttctgtttctcaccgctttctgtgttgttctcctgtattaattaatcataccaaaagatcataaccggttaagcccggttcggtaacaaaacctaattaaattttcatatttaaaacctagagattaattgttaccttggctactacgttttcagagacaggcttgttaggaacagagccttcttcgttttgcatgtctgattccttgggtctactcgcacagccacccattattatatatttttttggtttttgtgattttgggttgggtttaggctgtggagtgtgcaaaaaaaatttacacaaacttttttatttttctcttcttttttattaatgttgacccgaggattgagcaaatgaagagaacataatcatggttatatagatgaagatgattccgatttttatggagagcctttggtattttttcttgtgtgtgttgaagtattcaaattggggatggctaagaatagagtttagcagagaggtaagagtaaatttagatagatgtttctctgtatttgaaaagcttcattgatatcgtcaaacttttggaagttttgtggacctctctcgtctcttgttgctagctctatttttagccggtcctagctccagaattttaattcgattttttgaattttgtaacttgcaaagataagaggattacgccgtgtaaacgatgatgaatatcctaatgattatgcagctttttactaatacataatttcatgaaagaagttttgattaggtttccaaaagtcaaagaaagcgaaaaaatctaaataaattaaaaaagacaagtttccaaaagtcaagaaaagcgtaacaccatcccaaaaacaaagtgacatgcaccgaaacttccattcctttccacgtgtcattacatcattcgttctatgacatttctcatcaccttcttttacaacagtcattcacttctcgcttttacccctgcatctagttaatatcccaaagtcgctcaagggcaaaaccatactttaacaatttccaaaccgcgtaacgtacttggtttgccgcgtgtacacaccacgcgctgccatcaccatatagaactcacaaaaggaaagaaaaaaccaaatcaaagctcacatctgccttcttcttcactttaccaaaatcatcgaatccatttttagggtttttgttttctctctaaatttttattgttatcttcttcgcgataccttggaatcgcatctctgagatagataaataattctgattcgtatctttaaatcttgggttcttcttcttctcgcgattcgtttaaaagagcagcatcaatg

SEQ ID NO: 14508 - DNA, 3000 bp, Unknown; identical to SEQ ID NO: 9678
  misc_feature (1)..( 3000): cDNA_ID_3017665_gDNA_ID_2684126_Annot_ID_191116 3000 nt of promoter + ATG

SEQ ID NO: 14509 - DNA, 3000 bp, Unknown; identical to SEQ ID NO: 9668
  misc_feature (1)..( 3000): cDNA_ID_3042953_gDNA_ID_2684126_Annot_ID_191115 3000 nt of promoter + ATG

SEQ ID NO: 14510 - DNA, 3000 bp, Unknown
  misc_feature (1)..( 3000): cDNA_ID_3017681_gDNA_ID_2684126_Annot_ID_191109 3000 nt of promoter + ATG
gacattgaacaaaattgcaacgatcgttgatatagcaggttacccactttggttcatattttgatatatatggaaacaaacctgtatccagcagttggagtaatcttgatcttaagtttctcctcgtaaggaagctcgaagaactgatgcgtcatctctttcaccttatttataagatcatccgatattccatgaccaatctgatccacactcaccaaccataatcagacatctttattataaaacccctaaaaaagaaactcaaatttcgaaaatttgttaccacgtagaagaatccgacgtcccgacatgccctgtccagttttccgactacttccacaacccccgcatcctcagccatgtcgaaatcatcacatttggccagtaaaggactgatgtctgcaacaacattatcacattaactagtttagttagtgaagatttttgctgaaaataatgaatatacggtttcttacgtaccgataactggtagtagggatttgaagtctgtcaccatttcaatattaaggaaatgatagaaacgctttgctcttacgtacgtaaagactactttgcgatgatatattaccataaatggttatctcatttgtataaatacacattaaaaattgtcccttaggatttctaaaggccaaacggagcagcccacgtgggaaatcatagagtgatctgttatcagacatatatttttgtcactcaaataaactgtagtgatcgttattattcggttttataactttttaaaataaaattagtaatttcttagtagctttaatgctttgtgattggtttgttgaatacatttttaaaagtttattcgcattttagataaaaagtaattaccaaagattatacaaatgtttatcatcacgtgtaagttagtttggaggataatgataaataaattaaaaagtgagtgatccaaatcccttgataagagtttgagcattatctagttatgtttgtggcattgtttattcttatcagatcattgcggaaaaaagaaaacgcataaactcaattcactaaataagttcgttagttaattagtcaacaaacatcaaaagcaacaaaagtagacggcacctagctccaacaacagtaagaatgacacgctggtagctaagacaaattccaacaagacggccgccggcgttagtttgccactacatagcccggcccaccctaaggtctcggatccaattcacttgtcagcagggccggctcaatgatatttgagtcttgtactaaaatatttttttgacccacaaattaatcaaaattattttttggccctctaatttaatcaaatttatttgttaggccttaaatctaataactttttcattttagcccttaatttcagttaaaaaaaaattggaccctgagcaaatgctccacttgcacaccccatcagccggccctgatcttgatatttgagtccacgtactaaaatatttttttggcccacaaattaagcaaaattttttttggccctctaatttaatcaaatttattttttgggaccttaaatctaatcaattttttcaaattggcccttaatttcagtctaaaaaattttggaccctgagcaaatactccacttacacaccccttgagccggccctgcttgtcagatatatatcagatttttttttagtaaataataaatcgtcttgctaaggaaattctaattgtaattcacggggaagttaaggactatatagtgcatgctcgcgaatcataccagtttgattttgtttcaagtttgatgttgttgtggatgcatgtttgagggctttacgggtttaaaaagaatagtttttgtcacgttaacaaaaaaaaagtttttgttaaaattggataaaaataaagatgatttgtctcattaagtttgatttgcattacctttttgatacttaaaaaatcaattaaaaggctaaaagcaattgaagatagaataaggaaaattcttcttgattcgagttcaggctaattagttagcagagttccacttgaatttttcaatggcttcaaaataagaagatattttgattgaagtagtcaaagtaaaacaacatgagagaattttcttgtatacacttggaaaagggtcaaagttcatctcttatttttattaatatatactgattattatttgattgaactaaattcaatattcaagtttcttctccatatatattttggcaaccagtatacattatttcagtagatgaaagtcaacattggtgcttgttgttgcatcttgcaagtatggtattggtatggtccagtgcttgttctacgaggtcgagtgatccaacacacttaacacaaagaaaaagaaaaagagagtaaagtcaatactgaaacccatatggcccaaaatttgttcgaagcccaatacataatttggaacctaatttgagaagtccattacagaacatttagtggataaaattacccaactattaatccaccattcataattgtctcgtgcgtttatcagaaccacaattgttacttgttagcttggatataattgactttgttcttctgatattaactcgatactggtcgtactgtctaaggttaaaatcaaatttgatggccctgaaataatttaaaagatctttaactgtattgggcctaagctcattgacgattctcacacttggttttaaatctgagatatgttcttgtttcgtttttttttgtttggttttatcatttatgttgggatcagtttcgtttagggtttctgttgaagtaacggtgtataaataagtttatttggatagatattatgagattatatatctatgattatcttcaaaagttattaactttacacaaattaagttagttataagaaaaacaaaaaaccataatgtaaatggagctcctaactacatttatgagctctttcgtttaattactttttcctctccctcttgagttttctgttcgatcacaatg

SEQ ID NO: 14511 - DNA, 3000 bp, Unknown
  misc_feature (1)..( 3000): cDNA_ID_2730122_gDNA_ID_2684126_Annot_ID_191108 3000 nt of promoter + ATG
tccattgaccacaaaaaaaaaatcctgaagttgtggaaaatttccatgaaactcatgtacccaaaaaccctttatttttttctacactcaagtttcaattaactcttctacgattcctttgaaaattatggtaatgtaggatttcatggaatttaaacttcaaagttcttcgatccccttcgagtctccaatacctactagttccataaaattattttgatagttaagattgacattagatctcactcatatattattacttcattacttaaacatggtatcattccaaaatattatttgcttccataagaacttttgtaattaaaagtcaagacaaaatatgcaactagtaccagaaatactaattcattagaaatggagttcaacaatttgtatgattatcagaaattctaatttattcactagaaatggattcaaacatttaatttatgttgaaaacataacatattaccatcgatctatatacatgtatagtgattgtcacatacacaactatacataacttatgagaaatatcttattctacgaggaagagacgacagaagaagaagagagacgagagatttgatccatgaggaagagcatgcgatcgtgatagtcacgtgcctgttctaaagactcgacctccagctccgccagctgcgagcagagttgctcttccgcctcctccgccacaaccgttcgctgccacaacttaatcatttctgtcttcatctccgccacttctctcgagagctctatgttcctcctccttagctcatccatctcttccgccgccaccgtcacgcatcctcctcggttcgccattaagattctttgtgtaaaaggatttgattgtggttctaactttgtttcttgatttgttgagtgttagggtttgattatgtttctttaataggcgctttgtgtagcttttgcatgtccaggttcaatgtatctgcttcttgatttttatttctcctcacttttgatttcggtcaatattttctccttacttgaaacttaaacatactcatggcttatgtatgcatagaccaccccaaaagagaaaatttactatttttttcgaatgttcaatttttttttttcgtttttttatcacagtttcgctaggttcgatttaaatattttttatatgaaacttaaaccaaattaatttcgaaatttccggtttatccatgttattaactagttttaactttaaaattaataaacaaattgccgtctatacaactataaattgataaatggataaatatatgttaacgtgtaaatagaatagtaattaataattctaatgccgtggtttacacaaattcaatttaattatttataaatctctggtccgtcaaatttgtaataaaaatgtgttggtctgatctctgatgtatgtatgtggtatatattgattacattattgagttagtagggcttgaaataggtgacgtctgaagccaatcactatagtgtttctcactttcttgtgatattgtgagtttgtgacaaggatttattctttagattattaactaacaagttaataatttgggaaaacgctgccgcttaatattgcgttacttatattatgattgaagaactattatgggatatttcacgacatcatacatctacaaccactataaaatagaaaattagtgtactatcaccaaaaatatatttctcctgttccatgaaatttgatgttttagatttttttttgttccataaaaattgatttcttaggttaatattattattatttttattaatgactaatagagagaggaaagaagtagaaattatattattaaattaacaaaaaaataatataaataacataaaagttaattttcttaatttgggtgaaaaacccaaaacatcattcttttaggaacatagagaatatataatagacatttacaacttatacatttgttgataacatgcagtatgttagtttgaatacatatttttcacaacagtaataataacagttgttagaagactaaactacattgtaagaatcgctttctcttgtaatgatacaatataacatataacatttaaaataaaataaaaatctgtaggttttaaaatgttagctacgtagtccataacttcaaaaaaccaatggttttgaactcattccatagtgatgattgcaaatacatattatctggtttacaaaaaaaaaaaaaaagtgttccaattatctagaaatgttgggcctaatgcttaaacagtaagcccatatacttaaacatccgacttggcgcatttgcttcaccttctctaccaaaaaagcgcgtgagattcaggttcactgtatacattaagagcctattgtcttgtctcctgtaaaaccagaagaaaacaaaaattcaacaaaggataacaaggacgtggctattcttcattggctgcattcacaagagtcgaatattaattagtaatttcacagtatagtacattaagattaacgagacctattgtctcctgtaattgaggcaacaagataagggtaaaacgagaaaaacaaaagagaacaaagacgtggctatttatcattggttgaattcaatattaatttaattagtaatttcacagtgttctcaaatcgtgatcgtgtgtgtttcttctacctctgaaactctttttgtttatgttgatcatcatcatcgtcatctgcgtgtaaaacacactcacgccatcgttgacgtctcagatcttcacataaaagcttctattatcaaactctcttcctcacggtaaccctaactatctgtaatttatctctctacactttcttcatctcttaatcaccttaatcatcttaagctttgtatttctagatccttctcccaaaacaacgattcgtgatctccgttctcatagatcagtttcggatttggatatttcttagggatttgtgtgagatatttttagaattgtttcgatttagggatttgtgtgaagaag

SEQ ID NO: 14512 - DNA, 3000 bp, Unknown
  misc_feature (1)..( 3000): cDNA_ID_1029469_gDNA_ID_2684126_Annot_ID_191105 3000 nt of promoter + ATG
aataggccatttaatatgcaaatatacgagtagatattttagtagtatctctaaccataaattaatagacacgtgaatttccccattaaccgccaagaaaagacaaaagaaattgtagaaaatcaataaattagctcaagaaatctgtaatcatttttaaaattgacaataaaaataaataaatataccgtttatttttcaagtaacggagttagattgatttctataaatagttaaaaatgaccaattcatcttcttcttcttcacaaactttctttctccaacaaatattattcagtgccgagtcaaaattagtgttgagaatttgctgcttctgatcaggtctgttttatttaatctctgtgaattttattacttcttcttgttggatctcataatgcgatttatcagctgcgattaaatctgtttgattgaaatttatgcctgattaggaaaaattatctctaatagtggatcaatttcgtttttttaattcgggttttcttgggttatgcagtgagtgaagaaagtttgaagctttgagtaactttgaaacaatggaggtatttggaaaatctcatgtggttgttggctctgctaatgttatttacttatctgctatattgggtcacgaaggacccaatcacaaatgtgattggaaatgcgagaatgagaatgtgtgtgggaatatgtaccgttgcaaactaactgggttgactcatgtttgtgacaagaactgcaaccaaaggattttgtatgataatcataactctttgtgtcgagctagtggtcggattttcccgctttctttggttgaggaacaggcggttaaaggagtgaggaggaagcttgatgatgagagtcaacaacaaccttctgaaagttgtgttaagcgtcgtcgacgtgatgctcagtttcattcttctccttttgagaggtcttttgctgctgtgagtcctttttgcagccaagctggtggagatggaatggagattaactagttcttttctatctcacctagaataacttgcttttctttttcgttttggacaagtatgcaataagagatatttactcatgtgctcttacagagagtctaggcttagctctctgtctgaagaagcacttttatcttagtattgttgaactctatgtagtatttaacgtaggagagactttatgattctgctactttgttctggacgttcttgttttcgctattattaggtgaagtagaataacacccttgtttcagctttctttctagtgctgtctgatattctcctctcgcaccttttcttagctttgtatcttgtttttgcttgcctcttgtaccattggtcattcttttaagtttattgcgacaggtttttgtcacattgctgaaaattgcagtgtaggtttccaccaagtttttcaagaccaatttctttctggtttgtcatcttgtagaatattcctcttcatcctctcaatggagacattgttgtatcctatactttgttcaaatttaacttacttccttgcagtgattgatgagcactagaagttctgaaagttttttctgtttgtgcaggtttcacaatcttgccatgcaagagagtttagttaccattatttgactgttatgtttcttaattctcagtgtttgaggagtaagtctaacaattggaagcttgaatttttctttgtaggtaggtctatgtttgtgctcagcaggcagcagaggaaggacggttgtcgaaagaaatgatacccgacgtaagattgcggatgaagacacaagtaatctaatatcttacatcaatggaactgcgtgaaagaaaggaaagggttggtgctcttctttgcattcaaaaatggatgattctggtacgtagtagcttatttacaactacttgttctttacttaatatatccagacagtgtaataggggctaaaagaaacatcaaataatatatgcatttcccatgtaatggtaattgttggaatggaaaatgttattttgtcagtgaggaaaattctgaggtggatttatattgaactatatcatataagacagaaaggcgaaggtgtggtggttgatgtgacaactatcttactgggacacagagaattttgcccaaaaaagttggcaaagtatcaattgttggctcgtcctctgctataaggtacaatgctggaacatttctccttagctattgattattatgatggaggttatattcaacttagagcaaaatatgtgaagtagatcttttgttgtttgaagaaatcaatgtaatatctaaattatgacatattcttacagtcttctgtgcctttcaatctgctacaatgctttcttcaactttgcagaaatctgtacacattctgattaatctttgacgttttcttaatcgaatatgaattaagtgttgtttcttctgtatcaaatccaggttagaggatgaaccgagcagccaaatcttcagaagttcagaaccacctagtccgaatcataatcagaatcaaaacagcaaggtgtggcagtggctccctaaggttagcatcaagatccaaacctaataccttgagcatcatcaatctacagagttctccctccacattcagcggcattttcgtttgtttttatagtaaccactaagctcaatctactgaaacaaaatatctcgttgttgatgatattatacaaacaagtaaaatgtctatttgagcttctttcatgcttcaaacatcatctaaattcagacacaaaacaagcttctctatacacacccaacttttttacctaaaaagaatggagaaattgagcaattttcagaaatcagaactgagtaaaatgtggcaaagacgataaatgggcttttttcaggcccagcatatcatatataacccaatgggagatgagaaggagggagagataagactgagaagcagagaaccgaaagaagaaaacaaaactctcgaagtcgcaacagaaaagaaacgagagagat

SEQ ID NO: 14513 - DNA, 3000 bp, Unknown
  misc_feature (1)..( 3000): cDNA_ID_2730133_gDNA_ID_2684126_Annot_ID_191101 3000 nt of promoter + ATG
tactaaaatatctactcgtatatttgcatattaaatggcctatttaataggcgtgggcaggaaatggtatttgataatgtaattaattagttatttggatatttatttatagagtaagacggcagaaaaaagtccgtgaagtaacggtaagaggaactgaatcaaaccattctcacatttctcaagactctaaccattgaaattgaatttttttctcttttggccaaacaagaactaagaagaagaaaaaacgactataaatagatggcacaagtcattcatcacaaaagagtagctagacctagagaaagctagctaaacaaggataaaacaaaatacgtaaacaccttgttttgtattataccaatagaaagagttaaatcagaatttggaggaaggtgtacggaatccatccaccgtgagaccacaaattgaggtaacatgatgatagaagttttgttgtagcgacgagaacaatgttccgtatacttcatatactgcttaaaaccagaagtgtttatgcgacaacaaccttcatcactagtccaatcctccgaatcctgatgaatgatgaactgtcaactcttgtgtccgcaagttaccagatacaaaacaagagtgtttttgactccatagatagataatatcagaatcaaagggattcattgccacttgaaaacattcgaatatactccaacagatgcaatgttgatttccggtgtcaacaactgccaacattcatcctctaagtgttaatattcagtctccaaatcctcaatattcgatgtagtatttcaatgcagatcccatctcctcgtgaagtagtcaaacatctcttaacattctaacattaaattgaaatcatttagtaatatttgatattttttcttcttttctttgacactgccaattacgatttatgagcaggacttaagattgcatatacaatcaaatgaaagatggagtcacatcacaagaataaaaagatcaatgatcaaatgaaagattttagttttcaggggattttgcatctttcaatgttttcgattgtatcttccggagaaaaaagaatcagagatcgtaattcacacacgaacacgttcgacttaagaaatgttgattacaaattttcacgatgcaaaactgatttatatttaattgaatcaaagaagaatcattttgagatacaaagaacaacaaaagccaaaccaatctggtagtagcaaatcaaaccaaggtgacatacaacaacattcaaaatactttcacaaatttaattaatcatcaaacggtgacaacagcttctttctcttcttgtttactctcctcctttactggttcagcctcagcttttactggttcagcctcagcctttactggttcagcttcagcctttttctccgcttccactgcaacctcaaccttttcgggtgcagctacggcaaccgcctccacctttgcttcagcgttttctgttgcagcgttctccactttctcaggtgcaactactgcagcctcaccagcatcagcagaagaagactcttcgacggctgcaacctctggttgaacagcaggagttgtttccttggtcggctcgaccggaaatgtctccttagcttcgacagaagttgtttcagtggtctcagccactgtctggttctgtttctcaccgctttctgtgttgttctcctgtattaattaatcataccaaaagatcataaccggttaagcccggttcggtaacaaaacctaattaaattttcatatttaaaacctagagattaattgttaccttggctactacgttttcagagacaggcttgttaggaacagagccttcttcgttttgcatgtctgattccttgggtctactcgcacagccacccattattatatatttttttggtttttgtgattttgggttgggtttaggctgtggagtgtgcaaaaaaaatttacacaaacttttttatttttctcttcttttttattaatgttgacccgaggattgagcaaatgaagagaacataatcatggttatatagatgaagatgattccgatttttatggagagcctttggtattttttcttgtgtgtgttgaagtattcaaattggggatggctaagaatagagtttagcagagaggtaagagtaaatttagatagatgtttctctgtatttgaaaagcttcattgatatcgtcaaacttttggaagttttgtggacctctctcgtctcttgttgctagctctatttttagccggtcctagctccagaattttaattcgattttttgaattttgtaacttgcaaagataagaggattacgccgtgtaaacgatgatgaatatcctaatgattatgcagctttttactaatacataatttcatgaaagaagttttgattaggtttccaaaagtcaaagaaagcgaaaaaatctaaataaattaaaaaagacaagtttccaaaagtcaagaaaagcgtaacaccatcccaaaaacaaagtgacatgcaccgaaacttccattcctttccacgtgtcattacatcattcgttctatgacatttctcatcaccttcttttacaacagtcattcacttctcgcttttacccctgcatctagttaatatcccaaagtcgctcaagggcaaaaccatactttaacaatttccaaaccgcgtaacgtacttggtttgccgcgtgtacacaccacgcgctgccatcaccatatagaactcacaaaaggaaagaaaaaaccaaatcaaagctcacatctgccttcttcttcactttaccaaaatcatcgaatccatttttagggtttttgttttctctctaaatttttattgttatcttcttcgcgataccttggaatcgcatctctgagatagataaataattctgattcgtatctttaaatcttgggttcttcttcttctcgcgattcgtttaaaagagcagcatcaatgaatcagaatcttcatgtattatcaatg

SEQ ID NO: 14514 - DNA, 3000 bp, Unknown; identical to SEQ ID NO: 14506
  misc_feature (1)..( 3000): cDNA_ID_2730144_gDNA_ID_2684126_Annot_ID_191097 3000 nt of promoter + ATG

SEQ ID NO: 14515 - DNA, 3000 bp, Unknown; identical to SEQ ID NO: 14505
  misc_feature (1)..( 3000): cDNA_ID_2730148_gDNA_ID_2684126_Annot_ID_191096 3000 nt of promoter + ATG

SEQ ID NO: 14516 - DNA, 3000 bp, Unknown; identical to SEQ ID NO: 14504
  misc_feature (1)..( 3000): cDNA_ID_3017649_gDNA_ID_2684126_Annot_ID_191094 3000 nt of promoter + ATG

SEQ ID NO: 14517 - DNA, 669 bp, Unknown; identical to SEQ ID NO: 14503
  misc_feature (1)..( 669): cDNA_ID_3019126_gDNA_ID_2684126_Annot_ID_191088 3000 nt of promoter + ATG

SEQ ID NO: 14518 - DNA, 3000 bp, Unknown; identical to SEQ ID NO: 14512
  misc_feature (1)..( 3000): cDNA_ID_1029469_gDNA_ID_2684126_Annot_ID_137196 3000 nt of promoter + ATG

SEQ ID NO: 14519 - DNA, 3000 bp, Unknown; identical to SEQ ID NO: 14511
  misc_feature (1)..( 3000): cDNA_ID_2730122_gDNA_ID_2684126_Annot_ID_137199 3000 nt of promoter + ATG

SEQ ID NO: 14520 - DNA, 3000 bp, Unknown
  misc_feature (1)..( 3000): cDNA_ID_2032898_gDNA_ID_2684126_Annot_ID_137200 3000 nt of promoter + ATG
aagttcatctcttatttttattaatatatactgattattatttgattgaactaaattcaatattcaagtttcttctccatatatattttggcaaccagtatacattatttcagtagatgaaagtcaacattggtgcttgttgttgcatcttgcaagtatggtattggtatggtccagtgcttgttctacgaggtcgagtgatccaacacacttaacacaaagaaaaagaaaaagagagtaaagtcaatactgaaacccatatggcccaaaatttgttcgaagcccaatacataatttggaacctaatttgagaagtccattacagaacatttagtggataaaattacccaactattaatccaccattcataattgtctcgtgcgtttatcagaaccacaattgttacttgttagcttggatataattgactttgttcttctgatattaactcgatactggtcgtactgtctaaggttaaaatcaaatttgatggccctgaaataatttaaaagatctttaactgtattgggcctaagctcattgacgattctcacacttggttttaaatctgagatatgttcttgtttcgtttttttttgtttggttttatcatttatgttgggatcagtttcgtttagggtttctgttgaagtaacggtgtataaataagtttatttggatagatattatgagattatatatctatgattatcttcaaaagttattaactttacacaaattaagttagttataagaaaaacaaaaaaccataatgtaaatggagctcctaactacatttatgagctctttcgtttaattactttttcctctccctcttgagttttctgttcgatcacaatgaatagaaatcatcatgatcatctcgatgctgcggggaaggatatgtggtcacgtttaagtgatttggcggataaagctgatatgctatatgaaagagaaggaatatccaaagaccgcaagagtgtctcagaagaagaagaagaaaagaagacgagattcagtattttggtggatctcgtgggtaggttatgtgatcaagaggaacgtcgtactcttggatcatctcctacaaaaaccaacactctttttgagggtagtgaaaagagccacttggatcatcacttggatcatctcccacaaaaaccaaggtcttcccttgagtgtttttttactagagtatacacgcgacgaaaccataataacgtttctacttcttcatcgctcttcaacacggatgagtttgagaggacggagactaaaagccctacaatccgtaattcccaatcttcaccgtcttcgtgtctaatggagaacacaaaacgcaagaggtatcaaagtagtggtaaatccaagaaaccaaagtttgatcctttctcactgactgcggcgagagagacgccagagtggcttttagatgtgatgagaaagatgaagggagccgaaggaccgatcaaactgatctacgagaagactttgaccgcaactgacgtcaagccaagcgagagtcgtctcttaatacctttcaataagttactcagaaacgacttcttgactcctgaggagtctcgagccatagccatagataaagaagaagaagaagaagacaccaagaaaattggtgtgaaaacgattatcgtgaatcaattctctaaagaatggagtttacgttttctgatatgggtgatgaagaagaaaaaatctggaaatggaaccttgtactacactttgaatcgggggtggaatggtgtcgtctcgggtaacaagctcaaagccaacgacaatattagtctttggactttcaggtgtggtggagtcctctgttttgcccttgagaaagagtagctctttccttttaactctgaatctgatatgtttcatttctacttggaacatttaaacttgattttatcaagttttccattggcagagtagaggtttttggtctatagactatagtagtatagtaacttcttcttttcttttggttttagtagtagtaatttcttgcaagtaaacttaaggttttcctacgattgcatgtgatcttacactttattattggtagttaacttgctctttctctcttgtttactctactttagttactacatatgatttcttctttaatctagtacaaagtttaatctggtgtgatggaattgatccaattgtgcaagtgtttttggtgaattcctcaaaatgtgcttataaaatcaaaatcaggacaaaatttgttgccaagacatgtttttgtttgtttggcatgtaatataatctttagttctagactttgatgttaacacgtgtttagattcagtatgggacttgaaacattttcatttgttacacacaccactgtgatgaaacagatatggagataactatcaagtgctgcaaaatttactgagattccctacttcacctaatttgcctcagtatagaacatcttgatgagataactaacactcgagattgttctttgtgcagagaagaagaacattgttctgttcaaaaaccaagagaacatcagagttttaatagtaccaaaccctttttgttgccaacaagttctcaagaataaaattaaatagccgcttaaccatattgggcctttgaccaacataaaaccatattgggcctaagcccatataatacttatagacagacattgttgtggggaaaaaattgttactcctcttccgttggttctatcttccgcatcgtcgtctcctctgagagtccgtacgcatcgacgattctctcatcttctctcaaacacgacgacactggtaattttggttttccttgttttccacttcaatctaagatctgttgcttttagtttctgtttggtttcatactgtgatttggtttcgtttagggtttctttgtatcgacagatctttcgatttgaatctgaaacccaatctcttcgcttttttttcgattcagggttggtaaattagagttgaaagatg

SEQ ID NO: 14521 - DNA, 3000 bp, Unknown
  misc_feature (1)..( 3000): cDNA_ID_2730114_gDNA_ID_2684126_Annot_ID_137203 3000 nt of promoter + ATG
gccattggtgtgagtgatgcatgcattcgatcgaagtagtaattctaatttctaactagctgatatggttgtaatctctctcttatggaccgcgacgaatacagtgttacagagagttcaagcaagggaaacatggggacatcggaaaggtcttggaagggccaaaccagtggtaagagtttgattgattgttttcttttgcatctaagtttgtgttaaaaaaatattataacgaaagggcgacaagataaataaagtgtgtagatgcacatatatgaataagaatagtgaaacgatcgatagtagaatgatatatattaactgaatagaggctaaccaaagtaatcataaaacatttaaaactaattttaatagattaatgacgttttaatttttgtaaatatatatatatatatatatatatatatatatctttgaataacccataataaatgacgaaatcatttatctctttgactatttatctctttgtgtattttttgctacctcttttttgaaggccaggaaatcctcaagagtacaaagatttaatggagaagtatattaagctgtgcacaggtgtgtttttaccccttttttgtttatcagtaaaatttataagtttctaatttcatttcattgtctttctttcttttagatctttctagaaatatcttaaggggaatctcattagcccttggtggatcaccttatgagtttgagggaaagatgcttagagaccctttttgggtaatgcgtatcattggttatccaggtgtaaaccaagaaaatgttattggatggtaatcttttactaccaccacttttcatttcaactttattatcaagattcatttgtagtgacttactctgcgtcttctctttttcacttgcagtggagctcacactgactatggtacgtaagcctgaactcgaatcaagttcactctcttcatagttgttgtttttttttggtctcaaacgggttatttcacaggcttgttgacgcttataaatcaagatgatgataaaactgctcttcaggtatctatcattgggcttatttgctatagccaaattttgttattcttttcaaaattggtaaaaaaggctaaatcgtaaataagatgtgatatgacatgaaatatgatgttgtgaaaaataacactatgtttggtaacatcatgatgtgtaatatatatatccaccttgtaataaaaaaataaaagcgatcgataaattaatcagtttatttcgattttgtcatcatgttgtaattgcaaataaaagatataatttgcctgtttagttcacatcctctacactcttattataaaccatatatcattttgtgtttgaaaaatggttataaagttttctttttgtttgcaacttctaaaaggtgaaaaacgtggacggtgattggataccagctattccgatccctggatcatttatctgcaacatcggtgacatgttaacggtttgtttcttcttctatctccctctccctctttgatctctctttcttttgttttgacaattcttgaaaacattggggaaacatatatgcagatactatcaaacggagtttaccaatccacactacataaagtaatcaataactctcctaaataccgtgtatgtgttgcatttttctacgaggtactaaaaacttgtaatactctttgtattctcctcttttggatttggattcatgtttatctttaatatatatcttgaatgaacagactaacttcgaggcggaggtagagccacttgatatctttaaagagaagcatccacgaaaagaaacatctcaagttgccaaaagagtcgtctatggacagcatctgattaacaaagtcctgacaacctttgcaaatttagtggaaaacagttaatatggttgatgggctttggatggtaattgttttacctaagcatggatttcgagttttagtaaaataaaagaagttctaggcgacaataaaaataaatgaagaagaaattgtaatttggtttctaatattaataaaactacaggtttgtttaccaatcggctagttttagtaatttgagtaaaaaacgatgagattcctctaggtagcttcctctctcacctagctagtgtttcgtcgctggttttggagttaaataatcattgacattgatgttctttaattaagagtaccattttgaagttcgaggtttaagaaaccacattctatctcaagaaataaatcagtgaaaacatataagttaccatgcatatcatatttaagatgtaatctagtaaccataaattagaattttaaactttgaaaaaataacacatattctagttatttgttaaatgccgttttgtatgatgatgagttgaattttaaccgtattcttctcacgtaatgaagaaaacaaccaacggatatatttttaccttacatgcactcatcaatctcaaacaaatgcttgagtgatgtttggatacaaaacaattcctaccgtacccaatggattggattaccaattaagttgcacgtgataaaagatgatacaagatgattcgtccaatatatcttaagtaattgtttttatctaaaaatgtattgacttaaaacattattcatcaaactaattataaagcaactaaaaagtttcaagaaaatatctacataacacaatgacacgctatttctacattatccctgctaaaatcatctactattatttacattttttgccactatattttctttctaattttgagtttggatttgactagctacctaattagtcctagaaaagaaataaaaatcacacatgcgatcacacatgggccggtccgtttggcatttatgggtattgaaaactagttgcacacttgcactataggaaattatataaccattttatgataaaatatttcattccaaagagtttttgactttatatatttgttagagcaaatcgtttcccgtcattgtccaagtatctgaa

SEQ ID NO: 14522 - DNA, 3000 bp, Unknown
  misc_feature (1)..( 3000): cDNA_ID_2730110_gDNA_ID_2684126_Annot_ID_137204 3000 nt of promoter + ATG
cgtgtcgatatgtgatctttcttatcttaagatggtcattatttttggcttacacacatgtataatttcagcaaacttacgcggattctcaaagatggtctgagtgggaactcccagacagtgatggttgcaactatatcacctgctgatagtcagtatcatcatactgtaaacacattgaaatatgctgaccgagcaaaagagattaagacacacatccaggtgacaataattttcgttgaataattctatttcatgagacttttaattggtccagaagtacttactattcacttttcatgcaatttagaaaaatattggtaccatcgatactcatatgtcagactaccaacgaatgatcgacaatcttcaagtaagttaattacttttatctacttctgttacaaaatgaatatagtaacagtatataactcagagctttgctttcatagagtgaggtttctcagctgaagacacaactagctgaaaaagagtcgcagctaagcatcaaaccttttgaaagaggtgttgaacgtgaactttcttggttggatggtttaagccaccagatcagtgaaaatgttcaagaccgtataaacttacagaaggcgttatttgagcttgaggaaactaacctcagaaatcgcactgaacttcagcatcttgatgatgcaattgcgaaacaggttagctgctaaagcttctcctaattcagaggtcaatatgttgcattactgtaacctcttctttgttttataggcgacagagaaagatgttgtcgaagctctaagtagcagacgacaagtaatacttgataatatccgcgacaatgatgaagccggtgttaactaccagagggtaaacctttttctttatcatatatttcaactttgcacttcatcatggtcattgcttattatccttattatttttgttttacaggatattgaagaaaatgaaaaacatcgttgcgaactacaggatatgctcaatgaagcaataaataacaatggaaacaaaacgtatctgcatattcttaatcagtataagctcctggtaagtagaataaacagaacagtgccttattttcttgaccatgaagttcttacattacgattcacatttattgttgttttcaacaaatctaggggatgggtaatacggaactacagtttgaaatggcaatgagggaccaaattatttacaaccaaagggaagcccagagaaacctatggaatttgctcatgggtttaggagttgaagagaaacaagtgttcgatctcgctgcaaaacaaggaatcacaatcgaagactggagtagtatagcgttgtttccaggacttccttaccggaaacagacaccgagtttcataccagcaaacatccctttcgtgggccactcatattctaaatcctcctgcactttccagagctatcaagacccttcttcgaaaggacaacaatgggctccaactcctactttatgcagagaagaacaccacagctcttactacttcatgagacaggagccaccagcatttgtcaatcttaggaaaagccacgatggttgggttggtggcagcagaccagcttcacggattgacacaggaggcaatcatcgccgagtctcatatccacaaactgtgaacaattcttctcctcggatggcctcaggtcctactttttaccagactcctcaaagggtacgtatcaaaacagctccattgcttctttcaagttaaacgtacctaagatgttgtttcagttactctcaacctcacttgtttggctagtaaaacaacatttttttgttctgattgcaaaatctgattaaccaggaaatgttgctcaacacaacgagtccttatagtagtccgcgagtgggactcatcaacggggccaccaccccgtccgtgcaacctttctatggaagtcctcgtgccgtgactgtgagaaacggttcatacaacactccactcgcccccgctgcagtttcaactaaaggtgcgagaaaccaacaacgagtgtttggaacgagcccactctcaggaaccaaaggcgtcaagaactcttcatatggacagaacagtcacacaaagttgtacagaggaggaggcactaaaggtcacagtaaaggaaacaatactcaacgccaacaccaatgacatgagaccaaaacatgggttcgaattttcgagtcagttgaggcacagttttttaaacgcctcacactcagtctcactctcacatgactcgattttttgtttgtgtttgtacagctatttccactgtattgatttctttctgatacgattgatgtgtgtatatatatgggaaagaggttggtaaaaagtaagaagacaattgttccgtggtgaaccaaaaaaaaagctcaacaaatcttcagctttgttttcaccgaaccatttttgtttcaataacgtcacagcagaggccagaggggaaataaaaagagtagtttctgaaaaaacaaaaaagaagaagtagagtttcgcaaaacgtcaaaaacttaaaaatctccaaattgagtttgaagctaaagccctaagacgatctttgcccaaaaaaaaaaaaaaaaaaagccctaagacgatatctctcgaccttctgttctctccgccgtctgcaccgccgtgatcgaccttctccggcgcccactcagctttctccgtgcttagccgacgtaatttttcaccactacgtacgtctctcgtgatctccttgaaaaatcgaaccctggtttttgatttctctctctctctctcccttctcttatcatggtcgactggttctcaaaagtctgatgattggttgtgattagttccgattacttattagtataagtagatcgttgccttattggatcatcgaagctcctgttttgatttcccactgaaaaatcgatacttgggcatgcaaatacttgtttacttgaaacaatgttacttgtgttcttttagactgaaagacgaggacatg

SEQ ID NO: 14523 - DNA, 3000 bp, Unknown
  misc_feature (1)..( 3000): cDNA_ID_3017791_gDNA_ID_2684127_Annot_ID_191128 3000 nt of promoter + ATG
ttgtccccatataacatattatttaaatttattatatgcaattgaaaacgtgtaggtgaagacaacaacactcaactaatctgtggaccaaaatagatggtgaaaaatctaaataaaattcgaaacccttaaatgagaacaattggtggacaaaatttgggattcatgataatagcgcaagatgatgaaatcgaggacatcataactacattgaaaggatatattgcgggtgacttttgatttcgtggtattgacatgcctttatttgatttggaggtttgacttgcaaaaaataaaaattactttgagtggttttttgcataaaaccttttgatatattatatgagatttaaagacattgaaatatgtctttgaaatcaataatagaaagatgtttagcggaagtgactgcagccttcatgataagatgataaactcaagaggaacaattgctattatgccaccttctcgcaaaacttattctattttgccatcccttctattttagaaattaaatttaaagaaatttaatcaataattatgaaaagactaaaaccccttaacctaatctagtttttacgtattcttatcctttcttttgccaatccaataacatatctacacttctttcttttttttcatgcctccttcttcttctcttcttcttcttcttctttttttttgattattttagatttctcgtcttctccatcatcttcacaatgaaactctagatctcttattttccatagatattttattttccatcaatctctctttgcgtttcttcatatatctctcttcatgtttcttttccattgatttctaagattcacaaagcatagatctctattcatgcttcttctctatgaatatctcttcatgattttctcctttgtaatgcgaaatcgtttggtgaaacaaagaacacagtctacaaacttctaggaagaaaggtgacgggagaaacaataaacaagttaagaagaggcgaattaaagagggtggcggtgttagggttttgaattaaaatttcttttttttcagtaaaaccatttgtaccagttgttcttatttatatgtaaattatatcagttgtactattatcgtttagtaatactgtaataccatttgttccacttgtcccataatctatcgtttgaaccagttgtactatcatctcttagttgtaccaatcgtaagtaatttcattaagagtatttttggtatatcacatttacagtagcactttgaataactagtggcacgctgtttgtaccgaggttgtaacaatgaataagtaagggattttcgggaagacgaagtatcttttattagctgacgaacgagaagggtaaacaacaggccggttgaatagttacaagtgatttctatcgatcggcaacgtaacacgacttgaattgagaaaaaaacgaaccgtgaactaaaacgaaccgagaacaaaacgaactgagaacaaaacgaaccgaagacaaaacgaaccgagaacaaaaacgaaccgaaagacaaagagttttagtccgaatattgctctgattctctgggtattatcttctgtgtcactatttcgccaatagtgcattatttataggacaagcctcttaacctaaagattcttctgctcctcctgtaaattaccgttttgccccttgcgtttaataggctaaattgttggagacaacaagcccattaaacacttaagtctctgtttgggccaaatgatatgttgagggtgaagctcatgtccaacaataagccccccccccttagttcatcaggcgagaattttgtagagtctggtgagcggatttcttgaatcggaatatgtcgatttggcctaaacgaaaattacaccgtagatgtaaaatattatatattttttatttctacgctttgcgcgcgttttcctaggagtgcggaactccggtgattttacgccgtggatacgcttttagcagagtgcagaactctttccggtggataatattccaaggattttactgtgcataatttttccctatatatatgtctcctcttttttactctttaccttctcaccgcatcatttcaccaaaacggtaaataaattctctctcccttatctctttattttctcttgttcacgcttccttggttgtggttcgtcgagaacgtcttggttcggcgaagagagaagcttgaatcgaactggttcggtgagaagagaagaaagagctggttcgtgagttgaggaggaagagacggttcgtaagaagaggaagaagagctggttcggcaattgaggaggaagagctcgttcggcatttgagaggagatagagctggttcggtttgaggaagagatccggttcggtgaagaggaagaaaagatccggttcggtttggaagaagagatccggttcggtgaagaggaagaaaagattcatttcggtttggaaggagagatccggtttagcaagagaaagagatcttcggttcggtagaggaagaggagctccggttcgacgagagaaagagatcttcggttcggtagaggaagaagaaattcggttcagcaagagaaagagatcttcggttcggtagaggaagaagagctttggttcggcgagagaaagagatcttcggttcggtagaggaagaagaaattcggttcagcaagagaggagactacggttcggtgaggaaccggtttggtttagaggttggagcttgccggttcagccaaagaatccggtttgggacgatggactgtggttggtgtgacttgaatggttatgggaccaaccaggatgcttatcgtggaataaatgacgggttgccggttgatgattttggaggacgtgatttagtctagtattctggcgaagtcgacgatggaaatttgggagacattgagcgttttctagaggcaaatcttgtggttaccactcatggtatctgaaaaactttgagtcagcttgaaaattaccgtagagagatg

SEQ ID NO: 14524 - DNA, 3000 bp, Unknown
  misc_feature (1)..( 3000): cDNA_ID_3017756_gDNA_ID_2684127_Annot_ID_191138 3000 nt of promoter + ATG
tcttgggatgatttacttcagatagtcaccacaaaataacccaaagtaggtcaaaagtagaagagaaattaatgtttaaaactgaacaaaggctgtaggagaggttttgaaaaggtttgtatggagagaaaacaagaaattatggctaagtttctgggaattctagagagaagtgagagtaaaatcttgaaatgtttggagagaagaagtaaaatttgaaatttttgagcaaagagagagtgtaagtgacttagcttgttgagtgtggttttatagacaagaagatttgatcctagccctccaaacaccttagatcttcacccttcatttggtcaaggggacatgctttcactatttgcagaagaatctctgatgggctttggggagcaagatttgattggtggggccgagtaaatttgaattcaaattcgaatttgaattgtgttgacctcgcacgtgtgaactcggccgacatactcgacgcgcgtgtcgagtacagttttgggcctgatgggctctttttcttactcggcttcagctcttccatcttgaggtccagcttttcaatggtttccccttgagatccatactgtttcctgagctccataagctctctagcaataggaccaacatcaaaatggttcctcttagtctcaacctctgagctaggttctccttctatcataagaggctcctcgggctctcctaggtggtgagtcgtaatggagtacgaaataaaattttcccacccactcaacaactcagcatctaaatttctttcttcaatgaagaaaagatgcccttctatggtgggcttcttcatcttcttaggaatatcaaagctcatatggagattcttaccaaggttcaagtcgatcttacccatttgcacgtcgataagagcgcccgcagttggtagaaatggtctcccaagaatgagagggtctttcggttcctcatccatctctagaaccacaaagtcggttggaattttgactgatccaatctttaccggtaagtcttctagcatcccatgaggcactctcactgatctatcagctagaataagatgaatgctgctaggcttgaacttatcaaatcccaatctctttgcaacagacaaaggcatcaaactaaccgaagctcccaaatcacaaagactattgttgaacactaaggatcctagtgaacaaggtagactgaaggaacctggatcacctagcttctttggtatcaccttcctttgaatgatagcactacactcaaaactcaattcaactatttacttagcttcttgggatctttccataatcacttccttgggagtatcaaccaagggtatcttctcttccaactctttgatacacttgatgaacatcatcttatgtttctggaagatcttttcattaatctgtgcaatactttctggaaatgccgaaggttcatagggaggtggaatagggattgggttgctcgggtcatgtgctcgttcgacaagccgagcaaagaagtcgagtttaatttcctgtcttgatcttggtcgcaaaacctccccttcttgaatcccactgtcctcagtggcagaattactaactgtggagatagcatgggcatactcctttggattttgaacagcttttccaggaagttgtccagggtgcttaggagctgaagtataagcaatgtagccctccatgctcttgactctattgttaagtgcatcaatctttatattcaagtcgttataagagcaatcaatcctagtggtaagctcagctagcttcttatccatggtcatggaacatgaagcctatccttgcacaagttgttgaagtagagtcttcatctctgagtcttgtgctgaagtgtgctgttgttgctgggtgaagcctggaggtccaaagttgccacattgttacttctgtaagagagattatgatgagggggcttgtagttgttgaatcccttgttgtagccaccttgattctgtaggtagctaacctcctcaatagtaaggttctccccatcttggagttgtgtaagctcttcttctgtaatgtagtggacatttctctgttgagcaagcaccaaataacaacggcgccaaattgatacaagggttttctgtgtcaattccctaaatgcatcttatgtcattgcagcatttaaggtgtcaatccaaatgggtgtaattgctatcaatcatgatatgattagagaatactaagtcaagcgaagtgtgaataggtttggtgtgtttctactaaacctaagcaacagattaacatgtaaatcaaatttagaaattgaactatactaagcagaagataaagaacatgagtgataaaaccaagaagtaaatgcaagaaccagagagtaaaccaagcacaaagagaagcactcagtcgagtaaactaccaacaggtcgagtacaatactaaaaacaccaattttgcacgagacgaacagagtactaaaaacacgagttttgcacaataaaacaaaacagagctcttaagaatgaggtaattggtcttagtggactcctcaatccattagctaactaacaaaatcaatcaagctatccctagacaatagattcaagaccaaatcaatccactttcgtgacaatgattctcataactttataacttcctaatctcaattttcattgatgaaacataataaagcaggctttaaacaccaatctattaaagtcaataagcagtctaaacatccaaggtcttgggctagaatctacaaatctctgaaattagttggtttagacatttcataaaacacttgttaggtggagaaagtctgaaatcaattttcaattgatcagaaagaaaatagcattaagaactcctaaaacagaagggaatcatgcatataaacacttagttagctaaagaaaagaggaatccacctaaacctaacccatcctcaagaactctgaagaagactactcaagaacaatgaagaacatcatagaaccac

SEQ ID NO: 14525 - DNA, 3000 bp, Unknown
  misc_feature (1)..( 3000): cDNA_ID_3017734_gDNA_ID_2684127_Annot_ID_191144 3000 nt of promoter + ATG
gaccaaaactcacagggtacaatatataccatatactagcaattcctaatatcaaacttgttctctcatcttaccagtccgatatttgtaaaacaaaaaaatcaacctctttgagtttctttatgtgaaattgtctaaatctaaagtgacaacaagaattgattagtaaaaaactaagagagaagagagaatgaaggcatatcctcaattctgaaaacatcatccatcatcagctctctctcaagctgccccttgtacatctatagaaatacgtgtatcgaaagaagaagaaaagatttttttttcttttcttttcttttgcaggtttatgaatcaaggctgtgataccatatagatgttggaagaactgatgatttattatgttctcgacattacaatatatatacaagagagagaccagctagggtatacaaattgtaataaagaagagtatatacgacattacatatatgaacatttaacctttgcaatcaagtatatgattgatcctcttaataaatgtaggatatgattgatatccttaatacatcttagcacatcctacacaaatacaatttatcatcacatcgccatcaccataaccaagcaatataaaccgaaagatgatcgactcacgttgaattccatgtaggtggcgttcttgtccagccattgcttgtccattaccacaaaggcaacacagtaaagcaaaccaaaggcccattcgctttctagatattccaaaaacttagttaaaaatcaagtaaaccagagagccatgatcatcataaccaaatatttccatatttcacctgacaacatttgtaagaataccaaccgtataaaactcctaggttttgctgcaaatgtagtaagtattaaaacaaggtttcttgcttcacaaacaaagagcaagatattagggacactcacatgcttctaggtcaagcatttgcatgatcatgaaggttatgttgacgcccgctacagcgaatggatattcccaagctgctcttttgcctccctgtttcttcaagagacgctgaaacgaagtctacaccaatgccacccgaaaaacatcaaaaaggttatgaatctctcaagtagaaagttatgagagttaagtttaccgagaaagtctttgcaaagaatcgaagattctccaatgaaatgaatccatctcctctgataacaacagtcacaagaaaaccaaattaagcactatctgacatgtatggttactcaagcaagagagaggttaacctgaaatcagtggatggatcttttctttgccatcccatatttttccactggtctgagatcaaatcttgaagcttttcatcagcatacgtagctgatcacagtgctctcaatgcatcctgatgatcgggccgtgatgcatcatagtaattcttcattcttttcctcaacctcttcagtctttcttcgtatgaaaaaaaaaaatcagacttagaaaattgaatgttgtcatacaaaaacgagttaatggagctgttgtttctatttgtgttaacctgcaatggtgtcaagttagagcaaatgcgttcataagctctcttgcggttaaagcaaacacatgttagacttttcttgattctccaactaggcgtgctactacaactcgcatcctctgcatccgcgttaattagttctgtataaacaaacaagaacatgttaagattctcaagatttaaatccctacaagaacacgatgccaagtccctaagaaaggctccattatctgctccgttgttcataagctttcctagagaattacacgaaagcatttcgtacttaagtactaacaaactatagaactatagtagcttccattgttggtttacaaaaaaaaataaagtagcttccaatgttattcaagaatcaagcttcaaaacacacttggtcaagtcataagaaaatgaagacacaaatgacatgtagctagacagcaagtaaagtataccatattttggtccggtttggtatggcttcggttattgagaaaatacattagaggtttacttctacagtttgtgttgggttatcgtaagctcagctcagagatggaaaaatctagatcggtattattttttctttcatttgcggatcaatttttaatggttttagttcggtttaaattggttaaactggactggacactcctatgacaggttaccccaataatagaccaaatatgtgaccccattgccatatagaaacatatgtgattattattggaagtgagtgcaacttgcctactccaattcataaactttttgttttagattcaatttcatacatctgtcaaaatttgctcttgaagctgatctagacaatatatgggaccaaacataaattcggttctacaactaaattatagtagtatagtttactaatttacctaaaacagttacgaatcatagatctactgaagtttgtttgagtcacgtggcagaccgattgaatcaaaagaaattttcacagaagtggacgaaaaaagatttgctctcaccgtttgtcaaagtgagaactggttttcacgttttgtgttttcattcaatttcggaccaaattaccctgggaaaacttaataatggcacaaaccaaaccgtgcagcagttcgtatcggttgagttgatggcgtaaaccagaccctacagcagttggtttcggtttagttgatgcgttcagttttgaaaacgacaaaaaaaaaaaaactgaaacgaagaaacccgagaaaacgaaaaagagaagagagtaacggagagatttgcgagagaatcagaaagcgaaacgaaattcagtatccattgcttcaaaattcgacataacttcaaattgttgggtagttgaattgagccactgaactcccacatccggggaagtgaaagttactgtttttcccggcgaagccaagagaaagttactgtttattccggcaaaatttgaacctccagcgagatagcatctttagctatg

SEQ ID NO: 14526 - DNA, 3000 bp, Unknown
  misc_feature (1)..( 3000): cDNA_ID_3017874_gDNA_ID_2684129_Annot_ID_191155 3000 nt of promoter + ATG
gataaacgagtcgaacaaaagctttacgacctctctgttccttgtcacgatcatcaaaagcgtagataagatccttaagctgagaaccacgaagttgaccggtacgaacgccgaggacgaagctaatagcgtccattaggttagatttgccagaaccgttgggaccaataatagcagtgaaatccttgaaaggaccaaccaattgatgacccttgtaagatttgaaattctccatctcaagctgcaagatcttccccgatggggattgtatcgcaggcatgattgggggagagatctcgagtttggtttcagagaaagtagtggagaatgaaattaaaccaaattagggtttctagaaggttgggggtattctcggagaagaaaattggcgggaattgaaaatgttttgagaggcgaaacaaatctttctctcaagggatttcagaatttcatctcttccccttaatccggaagttgaagccgaggagatttcacagactcacagtgcgtttaattttttaatcaaagggctgggccgaatgatacggcgtagtttcgtatgggctcgactaaattgttctatcttatgtttttaaaaaaaataatcaagtttttatgatattttgcaagaaaaactatatatactcatgtttatagattagtagtgtcaagttttcattcggttttaactttgtaaagaagatttttgtattgtaacctgtttgtgtgttttctaaatgatttgttaaattggtaaagtttaggttttgttcatctttttatgggtttctagattctgatccagaaaatattgatggatgtttgtgtagtatgtttgttcatttttcccctttgtttaccttgcttggtttttgtctgcataatgtttttgtactcgccgactaatgttttcggaagtgttcatatacttatcggctttttgtaattcaccttaaatctttttatcaatgaaatcctattaagaaaaaaaaaatagtcgtgttaaagatttaggaaaaatattgtttcatagtgtgcttagaatccattgaactaaaaaaggaatgtcaaagggttattaaatcattgctattgctaaccattctttagttctatgatcattttgtagcttaaacttgaaggtagtcaaatatagccggaaaaagaccacgaatgacatccaatctcgtccatgcacggatcaaactataaacttgcaagtttttttttaatagtgtgaaaaaaactattatgcagccaattacattattttcacgattttctagtttaatcactcaagtcggtatcccatgagttataggaatcaagggaagttgagctagttatttctggttcttccatgaagattctccatagccaaatggtctttgtacaacgattcatggagtttaaaagtcgtggtggatgctccacaaaagtgtggttaaaaagtcttgctaatttatagtttgggaaaaatgtcatttaatcctccaacttttaaaaaatagccattttatacatcaacttcgtatatggccgtttaaaacatgaactaaacgttgattaaattttaaaacatgatctttcgttgaccaggccaaaatagacatgccgttatcagtcattaacggaatttctaacgtccgttatcatccgttaactttattagtcaagttttaaattgtggccattttaaacatcaactttttatgtggccatttaaaacatgaactaaacgttgactaccatttaagacataaaaatatcgttgaccagaccaaaatagacatgtctttatcagtagaacctagaaacccgttaataactgttaatctgtccaaaacaacgtcgtttgagaataatcgaaagaacataaagatttttcccatatgaaatctccatatcaaaaagttttaagtagaacccaagaacatagtttgataaagagataatcgcagtgtcagtaattggaagcaaataaaggtattttcgtttatatatttgttttaaatttgaaattgaatcatggaagcaaattgaagactcattataagattgttcgtcttgtttgagcggttgtagaaatagatttggggaactggggtttcatttagaaaacaatcctgattttcttttgattattctcaaaacaaagtcgttttagggatactaatagagtcgttaacaagtgataatgaatgttataagttcttttaatgaatgatgacaacatgtttattttggcttggtcaacgaatttctcatgttttaaatggtagtcaacgcttagttcatgtttaaaattgccacatataaagtcgatgtttaaattgaccacaatttaaaacttgactaataaagtcgttaacggatgataacggacgttagaagttccgttaatgactgataacgacatgtctattttggcatgatcaacgaataatcatgttttaaaagttagtcaacatttaattcatgttttaaacagccgcatacgaaattgatgtataaaatgaccattttttgaaagttaggagattaattgatatttttccctttatagtttacaggtacatacgttgataacacaaatcgtataactttctaacggtacagaaaatagtaaaccgtacaaaaataataaaaaagggtaagatgtagaagtataaaactaatagtacaaattaaaagattttggttccacttgtatgtataagtgattacatcaaaatggtattactaagtcatcatttagatttgatgaagtttgtattcgtgtcataaaccgggcgtaggtggagttattgtcagtttggtagcgttttacgaccacacataaaaacatgtttataaattgttaaaaaacaataagacatgtcataaatctaaatgccacaagtagaattatcgaaataaagcttttacataaatacacacacccaaactaaaaaagaaaaaaaaaagaaagagagagagagaagaagaatcgtggagatg

SEQ ID NO: 14527 - DNA, 3000 bp, Unknown
  misc_feature (1)..( 3000): cDNA_ID_3017870_gDNA_ID_2684129_Annot_ID_191156 3000 nt of promoter + ATG
caccgatagtgaagagatcaaaatcgtagtggcggtctgattcagctccattatcggtactggcacaaacagaaaaccggcgagagtggtaatagcggtggtttgagagtagggcgatacggggacggagagaatagagagaggttagggttttaggaagcgagagaaagctagaggaagaagatgatggtagatgaattgcgattgggagttttttgcagaggaattgaagagatggagaagatgatgaaattgtactggtaagcttcggggtcgaagccatctccacgattcttcttctctctctctctttcttttttttttcttttttagtttgggtgtgtgtatttatgtaaaagctttatttcgataattctacttgtggcatttagatttatgacatgtcttattgttttttaacaatttataaacatgtttttatgtgtggtcgtaaaacgctaccaaactgacaataactccacctacgcccggtttatgacacgaatacaaacttcatcaaatctaaatgatgacttagtaataccattttgatgtaatcacttatacatacaagtggaaccaaaatcttttaatttgtactattagttttatacttctacatcttacccttttttattatttttgtacggtttactattttctgtaccgttagaaagttatacgatttgtgttatcaacgtatgtacctgtaaactataaagggaaaaatatcaattaatctcctaactttcaaaaaatggtcattttatacatcaatttcgtatgcggctgtttaaaacatgaattaaatgttgactaacttttaaaacatgattattcgttgatcatgccaaaatagacatgtcgttatcagtcattaacggaacttctaacgtccgttatcatccgttaacgactttattagtcaagttttaaattgtggtcaatttaaacatcgactttatatgtggcaattttaaacatgaactaagcgttgactaccatttaaaacatgagaaattcgttgaccaagccaaaataaacatgttgtcatcattcattaaaagaacttataacattcattatcacttgttaacgactctattagtatccctaaaacgactttgttttgagaataatcaaaagaaaatcaggattgttttctaaatgaaaccccagttccccaaatctatttctacaaccgctcaaacaagacgaacaatcttataatgagtcttcaatttgcttccatgattcaatttcaaatttaaaacaaatatataaacgaaaatacctttatttgcttccaattactgacactgcgattatctctttatcaaactatgttcttgggttctacttaaaactttttgatatggagatttcatatgggaaaaatctttatgttctttcgattattctcaaacgacgttgttttggacagattaacagttattaacgggtttctaggttctactgataaagacatgtctattttggtctggtcaacgatatttttatgtcttaaatggtagtcaacgtttagttcatgttttaaatggccacataaaaagttgatgtttaaaatggccacaatttaaaacttgactaataaagttaacggatgataacggacgttagaaattccgttaatgactgataacggcatgtctattttggcctggtcaacgaaagatcatgttttaaaatttaatcaacgtttagttcatgttttaaacggccatatacgaagttgatgtataaaatggctattttttaaaagttggaggattaaatgacatttttcccaaactataaattagcaagactttttaaccacacttttgtggagcatccaccacgacttttaaactccatgaatcgttgtacaaagaccatttggctatggagaatcttcatggaagaaccagaaataactagctcaacttcccttgattcctataactcatgggataccgacttgagtgattaaactagaaaatcgtgaaaataatgtaattggctgcataatagtttttttcacactattaaaaaaaaacttgcaagtttatagtttgatccgtgcatggacgagattggatgtcattcgtggtctttttccggctatatttgactaccttcaagtttaagctacaaaatgatcatagaactaaagaatggttagcaatagcaatgatttaataaccctttgacattccttttttagttcaatggattctaagcacactatgaaacaatatttttcctaaatctttaacacgactattttttttttcttaataggatttcattgataaaaagatttaaggtgaattacaaaaagccgataagtatatgaacacttccgaaaacattagtcggcgagtacaaaaacattatgcagacaaaaaccaagcaaggtaaacaaaggggaaaaatgaacaaacatactacacaaacatccatcaatattttctggatcagaatctagaaacccataaaaagatgaacaaaacctaaactttaccaatttaacaaatcatttagaaaacacacaaacaggttacaatacaaaaatcttctttacaaagttaaaaccgaatgaaaacttgacactactaatctataaacatgagtatatatagtttttcttgcaaaatatcataaaaacttgattattttttttaaaaacataagatagaacaatttagtcgagcccatacgaaactacgccgtatcattcggcccagccctttgattaaaaaattaaacgcactgtgagtctgtgaaatctcctcggcttcaacttccggattaaggggaagagatgaaattctgaaatcccttgagagaaagatttgtttcgcctctcaaaacattttcaattcccgccaattttcttctccgagaatacccccaaccttctagaaaccctaatttggtttaatttcattctccactactttctctgaaaccaaactcgagatctctcccccaatc

SEQ ID NO: 14528 - DNA, 3000 bp, Unknown
  misc_feature (1)..( 3000): cDNA_ID_3017863_gDNA_ID_2684129_Annot_ID_191158 3000 nt of promoter + ATG
ttgtacatgcgtctattttattggcataatatctgagaactcgttggagatgtatttttggctgcagttgctcaagtacaatgtcatttgaccttaggaactaccaagaatcgtgattggttcaacaaccctcgggggattagggtttaggtaagtataagaaccctaactttgtaagtatagcaagtactgaatgatgtttgattgttaggtttgtaatttttgtgtcacaatgttaaaaggtatttcacagtggtaaggtgctttatttgcgatttgatttggcataggaccttataagttctgacactgtagagaacctatggaaccttttcttatgtgatactataagaaactcgtgattttagctgcatctgattgacgttttatgttttgataatagtttttggagacatgttgtcaaagtagaagtaaagacaaatgtttctttaattcgtcggactagaaatcaaatcttcaaaagccatttttgtcgtcccaatcgactttcaaaaaagctttaaattagaacgacacaacaatgaatgatttaacccacaaaaagcttgaatccaaaaggtttgacttttcagaatttagtcttaaaattccgtaatcctatatattaacggataagatccaacagagcttcagaatttgtccttaactcatattcttcttattttctatattataattcgagggttacgtgtcatatgcctactactgacatcacttgcgtcttccttttctcttgtcctctttcgtaatcattaaagtaagtaccttttaaaaaaaataaagaaaccaacggtgggagaggaagcagagagagagaaaataaaaaaaacagaaaacgagaaaaccagagattcatcaattcattgattctttagttcttcttcgtccgtctaaccttagaaacttatagctacagcgagagaagacgaagaagaataagaataagaagaaagaaaattgaatggcggcaagagccaacaacaaatacacctctatcaacttcaaccacatccttcacaaagatcctccttcatcttcttcatcttcctcctctgcttcttattcctccgtcgctcgttccaatggccgtatgctcgtcctcaccaaatcttcccccaaacctctaagatctccctccgctgctcccaccaccactacgaccgcacctcctatctctacagctccgaggattccttcaaatcaagccatctctgatccagatccgagtcagatctctcttcgtcccttaggtcatacaggatctagttcctcgctttcttttccaattcggactcctgaaatcaacaaggctccggaggtaaatgctccaactccggtttcattgtccccgaaacctgatcggttcgtgccgccgcatcttaggccaggttttgttcggaaagacgagaaacctggactcaactcttctcgagttagagatccgaatccgaatctgaatcagagattgcctaaccaggaacagccacggcaggaatatttcggttatggacagcccggacggcccaaatcgggcgggtatgagaggatccgtacggatccgagaataaccggaaaccgacccggcacctccggatggtatgttcatccctctcgtaataatcgttgttctagcattactagagagtgtctaggcttcttagctctgcctcaacggaattatcttgagatttattctacgttattgatagtttttgcctttcatgctgataattaagtaaaattggaaatgagattattctggttgtttggatttttgctgaagaagtagtcatgggagccgaatccaccatgtgtctgaacattaggattcgtttgaccatagagaatgtcatcttcacgtggattcgattttgagatgagaaagtaatatgaaggtgttttttgtgtggagaagctactcttgtttgtcctttactctttttttgtgtgtttgatccaaggttgtgtacttaaagctatatatattatatgatggaatcatatctgttcattgctcatctcaactctattctgtataattttctgggggaagttgtaactaaagttcatttgtctgtgcagatgagcttgctgggatgatgcctagttaactcactcgatgatggaggtggaactttacttacttctgaacgttgaaaacagtgacttgtcatttctcacttcttttgatcaaaccagagattatcaaagaccaacccccaagattcagtagatttgtagaagaatgttgttttgggatcaggctgggtgatactatgacacaaataacacttgttctcttacttgtctcactcatgtttcaaaaactttgtttatgtaactataattctgttatagcacgtgttgtttaggtattaatctatagattctattaccatttggtttataagaaaaacatttgtttctggatgtatgtttcagcaaaagaaatttccacttttgtttatttcaccatttgcaattgcaagaaaatctaactaacaatagcaaaaatatagacaaaataagcaaaatggaaaatatgtacatacttttttgggagagatccacttgtaaaagacaaaaggtgactataattgactaattgaggactgagaacatattgggaaggattttgtggccattggtttgaagaccaatacgttatttttttttatgtcattttttcgaacgtatttgaaaacccaatttaaaatgtattttttcgtgtaaaaaatgatgctaacatacttgtttgattttcatctaaacaaattgcaaagcagttttcataagcatcacgctaataataccattgatgcaattaatgaccaccgatcgctgaatcaccgcgaaaacgaaataacccgttaaattacccatttgcccctccgtctccattaatacacactctctgctttttttgagatctctctcagcacaaagcaatcacaaatcaaagctttcagagatccaaaa

SEQ ID NO: 14529 - DNA, 3000 bp, Unknown
  misc_feature (1)..( 3000): cDNA_ID_3017839_gDNA_ID_2684129_Annot_ID_191164 3000 nt of promoter + ATG
gagtctaccaaattgagcaaagaggaaacagacgaagaaaatcagaaagaggaaaacggagttgccatggaaattgatggtgtggcaggggaacatgtggaaaaggttgttaaagtaggcagtggttcggataatgcttgcaatgaatctgctggtgcaagtatggttcaaacacaagatgttccaatagctgaagctgacaacaatgaatccaatgtagtaaagaaaatggaaattgatgaacgcaaagataatgctgatatgacaagtgatcttacgggaacaattgaatctgctgattcagcaatcccaaatagtcccactgaagatgctgctccaggtgaagttgaaccgttggatcataatgctctttttgatccaacttctgatattaccaactttattgatttcagtggtgtatcatcttggtcaggaaatatacaagaccttaaaaccgaaaccgggaatgtatctttgaaagaggataagaaagttactgacatggcagaggacgttgtcacagcagatatagaaactgaatcgaatgaagcccgtgttggtgttggggcagaatctccagctgctgcaactgattgttcaaaagagacttctgatgcaactttgggatctgaagaaaaccaacaagataaggatcatcaatgcctcgacaagaaaacagcagatgtacaagatacaatgatagaggaagatgacattactcatgaagctccaagtttcgacccaaaccaaaaggaaaatgcagaaatggaagaaaatcacaacaattttgtttatgctgatgatgaagctggttctgatgttaagaccaatggtgtgaaacgaaaggctgatgtcctgagtgaggattcaccaggagaaggtaggaagactgtttcattcgccaaggtgtcttttgccgaaaggccgtcctttaaaattggtgcatgcatagccagggctgcaagtcagatggcaggatctccttcagttttgaagggtagtaactttggtgatgaaactctttctgttgagagttttgtatcccagcttcattgcgcagccacagaccctgttaaagagaacgttgtatctgacattgctactggctttttcttggatttccgaaactcatcagcatcgcagcaagttaccacggaaaaggtaagcaagaaaagaggtagaccatccaattctaatgtagcaggaactgaagcatttgagtttgaggaaatgggcgacacatactggactgacagagtgatccataatggtggtgaagggcaaacaccggctactgaaaagggaaattatcaagtcgtgccggttgagttgaaacctgctcaggttcaaaggactcggcgaccatacagaagacgacagtctcagatcagtattcctcattcagccactaagaaaccggcagacattgatgagaatgcaccagctgagattataatgaacttttttgaaactgatacaatacctcctgagaagagtctgagtaaaatgttcagacattttggccctatacaggagttgcggactgaagttgacagggagaaaaaccgggctagggtagtttttaggaagggtgctgatgcggaggttgcttacaatagcgcaggaaggttcaacatatttgggacgaaggttgtgaagtacgagctcagccgtaatgttactgaaacattcaaagttcagccttatgttgtgtctttagctgaggaggatgcagcggtatgtccttcctcttagatggagttttggttcaggtaaatctgcttcattgcctcttctctgttttaatatcttttgtactgcttctgatatttactggtgtgaaagctgatgtgttgtttcctttggatgcatagttgttcctttgtttttcttatggtattaatagcaaagatgttttagtaccccctggtagattcaatctaggaagtaaagacccattaacacatagatgacgactaaaattgatgaagccatgtctttgcttttgttgtgtttgtaaactgagtttgatttaaacagaattgttgatcttgtggttcaggtgaaaagaaacggcaggcatcaagagaagtaaacaaagaagtggctcaatggattggaggaggctcttgcttgtgtgttttattaccttttaggcagagagatcatttaggattgtgtaatatgaaaagacatgtatttttctagagacaagagttgttggttatgtataatttgtctgtcgaggctactagagacaggttaatcttcttcttctttctttttttggtcgcaaaacatttgatttgttgttattaaaccaagttatattaggagcctgtttgttggttgaagtgattttgatcattattatatttggtgcttgctggttcagcttggttattacatgtataaaccggaaagaaccgaaacaaatcaatggctgatttaagaaattagtcaacgttatgaaagtaacggcggcgttagattgactgttacaaaaacagtaacaggagggaatcccaaattatttcgaccaaattttttgaaaagcagctttccgatttcacgctctttcctcttccctccaatctcactctccactattttttgtttgtttcccctaaattttacaaaatagagagaataatgaaaaaaccctagcctgccccgccgtggaggagaattacaccacgacgagctcgtaatcgccgctgggtttctatgtttacatcgctaagagattaaccatcgagcgtggtgagtatgtcctatctctcatttatgtttgtgattttgttttttttcgcttgtaagttcttcgctggtactattcaccagtttctagggttcatattgtgaggatttttgaaccgaattgatattttatgttgacaaagatcttgctggtaaaatggaataataacattgtgcgtcagatttggtattggggttaggtaaatttggggatcaagcgaacagtatcatttggaaatg

SEQ ID NO: 14530 - DNA, 3000 bp, Unknown
  misc_feature (1)..( 3000): cDNA_ID_3017827_gDNA_ID_2684129_Annot_ID_191167 3000 nt of promoter + ATG
cactacacccttcaatatgtctctattcatttctcttatgcattttctcttgatacgatcgcgactaccaatcccgcaaatgaaaaacttataataacatcaccacaattttttttgcactgtcatggcccatgcatgggtttcagcaatgttgttgattgacttgtcctacagtcctagccgagccaattggtgctttagacgtcaaaatctattacaactacatggacttcattttcttagaaaaatgttttgtggagcagtaatgagatcagcttgattaatgacttcatgagatcttaacccaaattttgaaatttttttttactgttttatacatatgtttataattgatccccaaaactgtatttttgctttaggacccaacaacaccaaatactgtataaactaaaatttagataaatttcagttattctttaacctagctccaattttggtaaattaaattgtcaaaccagataaaacaaatgtctggagtgtaaatagcaaacgaacaaaagaaacgtatggagttggacagttgttgttgaacctggggtctgatttagtaaagagcttaggctgggccaagtttgggcctaacagcaacactaaaaaaagatagattcacttgtttacgtcaactatgtttcgcaaattcacagagcgtattaaatttaaagaacgggataaaaaaaaaaaagagagagaaagaaataaaaaaaaattatatggagcttttgaagttgacttagacccaaaaagtttaagaaatttagcgacactataaaggcctaaaggaatcctatcctccaccttcataaagataaaagattagctaaaagcttcttcttttccatgatgcatgatcaaaagataatttaactagttcatgcaaaaatacggaaatacccattgttgatagaaacttatgtttcataaactaataaaacatttttaaaaataactgaccaaaatgaacattttgaatgctattatccataaagttgatgtcaaaaagatttggggaaaaaggtactccatctgttcctttttgtttgattgtttagaaaaaaaaattgtttcaaaaagattgattttttagattttcaatacaatagttattagttataattgataaattgtaaacttcaatacaaattagtaaatatcattaatttagtataagataagcttaataatgtcaaaaagatttaagaaagtaacaaactttttcctctcttttcctttcttttgattgcctttagtttgtgtcttgactcttgatttttccaagttggataataatgcaggcttcatgataacattcaatattcattgccgtttacattgtacacataaacataacataacacacacaaaagatgtctccatcacatgatagatcaaattgtacgtcacacagtgttgtttactttaattttgtaccaataattataaaagctgatatatactgtatttgattattttaactaattacattttgaaaataaaatttttagaaacgtacgtataagttaagagtatgattaaaaaacaatttttgttaaaatccttttttgtgtgttaaaatatttagaactttttttttaacacatatttagaactttcttaataatgaaatggatgtataaaacgatatatcgaatctagtattaatgtgtacataatataataacacaaatatacccgaatagagggttgaaaattgaagaacacgtcaaaatatagaagccatccgagattatcgagaataatgttgggaagatgttgctaatgacaaagtttgaccgttcgagctcgtcgagcccttcggttacgtcttccaagactttgtctagttgcatggcattttccgacattcctaaaaagtaaaaactcaaacactttgaaaaactccccaacggccgatgcttgtcttatcactttcgagccaatatttgaccattctttgttttgttttgcttagtttacaagattgattgaacacagtatacaaatgataatagcgtagaagtaacaaattgtaaagaaaaatactcaaatagcatgccatcaacgaaacaaacaaaagatcatctttaagaaagaaagaaaataaaaggaaaggaaagaagattgactttttaaattttaaacttctgagggttatgacatatgccggaagaaggtgataaagtgcaccgtgcatatcatcatctcaatgtagaaatcaaagtttacatatcaatttttttctccaagaaaatataaaatgtaatccattaatttggactcatgatgccactttctcataactagcagagctcatcattccttttcatcatttacttcccttcccaacttttcttcaccaaactatgattttgcagaagaaaactcgaaagtcattgttaattaataccatttttattttactgtagacaatatttcccttataactatttatagaaatactccaaaatactactagtgtattaaaaacagataaaattcaaaagcaaaattttaccaaaaaaaagaacttaaaaagcaaatagtatcattattgtttaacaataaagtttacatttccatagaaatttcaaaaaatcggatacccataattttcgaggtggactatcataatcaactctaattattttatttttctagcattgattagtgttcacaataatggcataaagcagacgcattaacttttgtaattggggttttacctttcgttttcactttaattattttaactaatcctttttacaagacccataaagaacaaaagtcaaaataatcgatagtctcaaaaagtcaagaatctctcacacactcattatgaacacgcaccaccaaacaacacttccattgatcctcataataatctccaccaatactcatttccctcttggattcttcaaactcctctctgaaagttctcatttttggtttacatttcctttgagtccactgttacttactaaa

SEQ ID NO: 14531 - DNA, 3000 bp, Unknown
  misc_feature (1)..( 3000): cDNA_ID_3017819_gDNA_ID_2684129_Annot_ID_191169 3000 nt of promoter + ATG
ctaacccgttatcaagccatttcttaatggatgttctgtcaaatgtctgtcctgaagctactattaccggatccagcatgagttctgttgacaaaggacaccggaaatacgggggtatcgagatacctttagccacttcaagaaactcagttttaagcatgtgttcacggatgcacaagacgagttctatcaactgttcggtttgttccatatcttcttctgacttactggcctgggatcttatcctctctttctccacagtaatgctttcctttaagagatcttggtttgatatcaatccaagcatttgaattatgctttccagatgattgttatccaaagaggtaatatcatctttctgattccgtaaagcattctccatgagttccattaatgtcccctcttgcttaaaactctcagtctcctgcacgcagcgctgaaaccgttccaagagattagtacaagtggctgcatataagacacagagggctaaagaaatgaagaaattctagtttacctcaacactttgtacgcttgaagtaaccggacttgactgtgataactgaagaagtatgcgactaatctccaacgaacaagtctggacctttcccaacaaaacctcgcattgaaacacctgcacaacaacgatgtagtgaataatgctgaaagctgcagaaaaactgaaatggtagcttatatcatcaacttacaccaaacaacttgctcaactttggtgaccagtcctctaagaactcccgagcctggttaacaacagaatcaaggtcttcacatcctttatataaacagtcatcagaaggtatcttgcaatcaacaacttcatcgagcaacggtttcaagagcttcaacaagagaaccatatttccaatacatgtttgaataggattaaatcttatagtctggcacgcaaccagatgaagataccgagatatactgttaagaagacatcgaacaggaacaggatccatttaactatcaagctgaagaacacaaaaaacaaaacacacacatatcaacattataatctttcatgacttttaaaaagagtgttggttccttgatagtgttatcaattggattagtaaaaatattcagacttttctgtgtattatatggaaaaaaagaaaggaacacaaagttttctgatagaacagacatagaaaagcattgactttttgacttattagtctgagaagacagacatgactagattcagtcaattcttgtggaaaactgaagaaaaggaagtaaatttaaacagagacttgacttgagcacattctctcaacagatgtttctgctttctagtttcctttttcccttatatttgattaaactaatttatccagtctaataaagtgtggagaaaacaacagagttactctgaatctgataaacctatcaaatcgaaaaagaatctcaacaaagaaataagacagaacagtgaaaacccacaagtaaggaaccctaacttagtacaaagctaatgtcgaatttggaaaaagattgtaacaaaggaatgtaagaaggtggaggtacccgagaagattgaagtgatactgaggctggaagaagaaaaggattcgaggtatcaagggaacaaggcggcgatcattcgagcttgcaagaggaataatgaagagtttcctaaattatctaaagattggttctttgcttacacaaagagaagagagaagagagagagaaagagactgatgcaagaattcaggcaacgaaacagagcagaaaaaagggaaaaataataaaatagtaatggcgaggggccccaagttggtttttttgcagatatctctactgtttctgtaatgttggagttggtacatcttaaagctgtctcttttttctttctttttatgtttctgatgatatataatattaacacttaagtaattttactcatattgttgccttgacaaaggaataagttaagggttgaaatttgtgaattttaaaaatcattacttttgagattaggaattatgtcaaaggagaagaagattcattggtccttggagattataaggtacaatgattaactttgttatgttctagttttgggtaatatatatgggtttctatctacatcaatatttcagatttgcttttttctttttgtcaacatacagaattcagatttttgggatttccctatttttcctacggcaaataaagtcaaagaaatattaggccgtatgaaacaaattgatgggttaagcccaattgataggctaggcccgttattgttttgtaaagaactgaaatctaatctgtctatggtctttctcagtttagaacaacaaattcttgtttggagatatatgctaacttgtgttaatgtgttgttctcgttggggttacttgtttctccaatagacaatgattactcggtaatgattccactaattggtcagttattcaccgtacgatttaacaacttagcttttgaacctttggaaagcagagtttaaattctataattcgtataaacaataaaaatattgaaggacataacgaatagcagagtttaaaagttctaattatagaatttaaatccggaagacagaagcgccaatcatttaacctttcacaattagcaagcaatttttaaccaacaatgttaaaaatttataaccaaaacgaaacgtaacaacaatcgaaaaaataacaggacaaaataattatttgtttttctctcttgattgagagaaaaacaaaaaaaaaatttgaaaaataattttttctttgtaactgatctttccatacttttgattctctgtttcgcttcggcggaatcagagaatcgtttcaagttacaaattcgcaacaaaaacgtgttgtgatatcgagtatttattcgtttacggggaagaaacatttcaagtggtataagcatttcctgattgtttgaaactttgaatcgtttaataaatttaaaaataagaaaaaaggatttgtagagaa

SEQ ID NO: 14532 - DNA, 3000 bp, Unknown
  misc_feature (1)..( 3000): cDNA_ID_2175403_gDNA_ID_2684129_Annot_ID_191174 3000 nt of promoter + ATG
tcaagatttggttgcatctaagattgctttgtggactacagtaagtttttttttttcacccttcctctgcttattacatgaaagttgggatgattttcactaaatttggtagctagccaggtgaggtcatctaagagtttttttccttgccttttttgcaggttgttaatccatttaccaaatatcctttatcaagaaatattcagagacttttcatttatctctgtaattttgtcataagcttattcataatataaactgaaaattgtgtggccttaatagaaagaaagcacatatgctttgacattatctccagttgcaatgagtcttgaggagttaataccatcaaactatgggaagtcacgtttctacgcaatcgccattagaagtgcattagccatctctactctgctcgttggtcttgcgattcccttcttcggtaaggacaaacgaaaaatatacatgtaaagaaaataagtgtcacttcttttgacactcagaattcttgcaggccttgtcatgtcactgattggatcattcttgacaatgctcattgtaagttacacatttgtttcatccttttctggttatgtaaagcaaattctcatattgcagtttcatagtgaatttgcttagcctgacaaagtttctggacacagacgctgatactaccgccagcttgtttcttgagcatcttaaggaaaaaagtaacccctactcaggtatggcctgctcacttactgataaccaaaccgaatatcgaaattcctcaaactgaaatcgatataacaatctgtggtttgtttgcaggtgacaatctgtatcttaattatgacagtaggagcagtatgttcagtcattggcacatattcagcccttgcaaagatcattgagaagttgaacacctaaaactgatcaatcttgagattcttattttgtttctcttgagattttgtttctgtcttaaatcaatggaacatctcaacctatatggaacattccaaacacataattgtattaaacatcttctgcatttaaatgttaccaaacagtgaactacaagaaacaattataatactggaacataaggtgaagttctgttccataatggttaagtagcaaaagcaaagaagatcactccttattcagtagaaatctttcctccagctaaatcttcaggagttaggttaagagaatccatggatcctttcttgaattcttccccttgagaagcaaggaagtcctccacgcttcctggttctccaaaccaaccacgacggtctgcaatcaaatgtagattatcacaccctccacatcgtaccaccacaacgccgttttcatatgattctcggctcgccatcttcatagatcttgtatcacagaccttgcaagtgaagaccatcatgaagtcatgcctcgggtttatttttaactgggacttgtacttcaccatcatttcctcagagggcgtcgcaggggagggaactttggccgattcagtagcagagtttgacgagttgcagacattggttacagaagcttcatttgcctcacggattacagataactgtctctgaaataatcttccataaacatgacttctgctgaagagtgagtttgatagcgacaactgctctgttgagactattttcaaaaaaaaaaagataatcaagaaagatcaatttaacagtagttgtagttgcacgaagctaaaacagtctgtaccataacaggacatcataggaacctcctaggataatgtttgcatcaaaccgtagactaatgctaacacatcttagtcaggaaatatataaccaaacttgaaaacttaaccagcgtctagctgaaatgccaatgttcacagctactgcttaatgcatagagatatgttgaagacaaagcacttatgtgagcattcataacttcaggtttcgtagaagcacttctctaactccaaaatgtaacagagcaaagacgatattagatgatatacacatgagaatacgagtactcatcatcactaatgccccaaatctctaaaagctacaaaaacaaccctaaaaccaaaatctccccaaaatcctcttctagtgtaaattcaaacataaaaaccacaaatttacatgaatctcaaccaaattcatcaaaagaaacatcaaggcaagtataaattacacagattaagagaccagtttaactctagtgcccgattttcaataactctttaatttttcttaaagatgacaaagttgagaaggagagagatgaaaccttgagacaaaggaaaacgatgttgttggttgctgaaaagagacaaagcgcgtctcaaagcaagtaacctagcggccattgacaacctgagggagaggaggaactcgacgcttctattttccgtgaaattttggaatcggagcacaataaaagaagcctttttaatcattagagttagttttcgttatggtcaagtcaaaatctaaacccaggttcgaaccactgagtgagccacaagtagaccgacctttttcttcttttttttacgtgaggaaaaagaaatttgtgaattgaaatcttatctagaaaagaaaaaagaaaaaaaaaatcagaacaagcaggagaataatgtgtgtgatacaggatattgagtaaggccacgtggacggctgtgattagaagatcaatggacggctgtgattcaaattaagtgtgcgtagagctgaagctaataaatatcaagtgtcatcgtattttcatgttatcgttgaagttgttgttattcctttctctctgaaaacattccgagattcatcctctgcatagaacgtcgattcttgcgaggtgaatccagaaatcccttgttttatgaacattggatttcatttgttatttacatcgtaataataagtaatcggagttgttgatgattgctttggttgattgattgtgttgtggtgtggttttactgtattaaaggtatcagagcaaagacgtttctcggagatg

SEQ ID NO: 14533 - DNA, 3000 bp, Unknown
  misc_feature (1)..( 3000): cDNA_ID_2106795_gDNA_ID_2684129_Annot_ID_191175 3000 nt of promoter + ATG
cacagttactccgtttggcaaataatttatgctccctcattacttccaataccagttttaagtgctgcaaatgctccttctttgatttgctatagataaggatatcatcaaaaaacaccaagacaaacttccttagaaacttttgaaacactgaattcatcaacccttgaaaagtagctagtgcattggtcaatccaaagggcatcaccaaatactcgaaatgaccactatgagtcttgaaagcagtcttgggaatatccttctccaccattctcacttgatgataacccgctcttagatcaaacttcgagaagatcactgccccacccaactcatccataagatcttcaataagaggaatagggaaacaattcttcactgtaattccattcacctttcggtagtccacacacaatctccaagagccgtctttcttcttcactaaaaccacaggggaggcaaatgaacttgaactaggctggatgataccgctctctaacatatctttgacaatcttatcaatctcatctttttgatgattagcataacgatatggtcgcatgttcaccggattagtgccctcaatcaaaggaattggatgatcatgatgtgtccgagaaggaggcagccctttaggttcagcaaacacatccttatactcatcaagtaattgagaaatagcagaagtagtacttggtggtgacacctctgttgttaaagaagacaactgcaacacctctccctcatcctcatcagcgtctgcaacacacaacatagacagctgaacttcggagtctctcagtttgttcaatttgtcagccttgatagcacgcaccgacgaaggctgaataccatgtatcatcacccgtttcttatcccatttaaactgcattgtcaacaatgtgaaatcccatgtaataggacctagaggtttcaaccaatgtacacccaaaactgcatcaattcctttcaaaggaattaccataaagtcagctacaaaagtcgtgttatgaatctcccacttaaaattctgtattctcgctatcaccttcagattgtaaccatcagccacccgtactcttgcattatcactaggtaggagtgagcaacccaacttctttgccatttgaggatccataaaattgtgagtggaacccgaatcaaccaacataaaaatggatctcttctgacttgtacccttaactcgcatagtgttgtaagttgagataccctccatagcatgagttgagatatgagctacttccccaactaactccttatgctcttcttctgcatccaagaacacttcctcagcatcttccatttccaaaacaaacaattgtgttttcttgtgaatcttataatgttcagatgtgtattgttcatcacaaaaataacacaatcctttagctctcctagcactcatctcttcagtagataagaaccgccttggctgattttgttgtgtgtctcttggtttttcctgaaacgctggtttattgccctgctgctccatgtctttcttaaaggagaactggccctttgaagtagccttattgttcttccaagaagtcgcattgttctgcacaggatgagcagtttcatagagacgtcccaacatcaaacactgccgcaccgtttggggttgaaacattcggatatgcatctgtgtctcaatccttaacccaaccaaatacgcactcactaaataatcctccgtcatccttactcgagtccggatcgcctcaaactttgcgtgatagtcatcaatgctagcagctgtttcctgcaacttcttcagctcagcaataggatcctctccaaccatctcaaacctctccctgatcctagctttgtacacaccccactcaggaacctgcacttcatcctcaatcatattctggtgccaagtagcagccagaccatccaaatgaatagaaactacagacactcgcatctcttcaggtataggatccaccgcaaaaaattgatcaaccttaaacaaccattccttaaccttctcaccactgaatctgggaaaatccaacttccctaaccttgttactcccgaatgattgttagcgtgaccttgccttctcatgtaatccacgtctgttgctgaagcggatgaagcacgagctgtttgatgagtctcacccagatttgactgcttagatggagacagcatgtggatcgcctcaaacatctccgagatatggcgctcgatcttcagattttgagcatcgatcttgctctcgatcttctccatctgtgactccatcgattcctctgcttctaacgccttctctcgacgagcttgagctaactcctgagctcgagtctcgatcaccatctccgagaaacgtctttgctctgatacctttaatacagtaaaaccacaccacaacacaatcaatcaaccaaagcaatcatcaacaactccgattacttattattacgatgtaaataacaaatgaaatccaatgttcataaaacaagggatttctggattcacctcgcaagaatcgacgttctatgcagaggatgaatctcggaatgttttcagagagaaaggaataacaacaacttcaacgataacatgaaaatacgatgacacttgatatttattagcttcagctctacgcacacttaatttgaatcacagccgtccattgatcttctaatcacagccgtccacgtggccttactcaatatcctgtatcacacacattattctcctgcttgttctgattttttttttcttttttcttttctagataagatttcaattcacaaatttctttttcctcacgtaaaaaaaagaagaaaaaggtcggtctacttgtggctcactcagtggttcgaacctgggtttagattttgacttgaccataacgaaaactaactctaatgattaaaaaggcttcttttattgtgctccgattccaaaatttcacggaaaatagaagcgtcgagttcctcctctccctcaggttgtca

SEQ ID NO: 14534 - DNA, 3000 bp, Unknown
  misc_feature (1)..( 3000): cDNA_ID_2105807_gDNA_ID_2684129_Annot_ID_191173 3000 nt of promoter + ATG
aaaacaatatgaacgaatgattttagtatttaactttcgtcctcatgtagccatgttgttattttcaaaccataaagaggacttaagagtcgtcagataaaacaatgatattttcgtattcgtcgatgcactaataaccaactcgattggacaacatatcttacttcattcacgattttgatgatttcaccgaacaattttttctttctttctcttttgtcttttaattatgtcattttcttactggatatgttcactggtcgagttgggtcttggcctaacacataagatatatttatgatagacatatcttttttttttatctttttttgagttcaaagtagacttacatatgtcaaaatccgagactcccctaactcatgaaaaaagtgagacgaattcaactactttgccgaatttacctgtcttagaaaatcaatcaaacccttgagttgtttgcttgatcataccttctcttctccttgtcactttcactcaatacaattgacacaaatcatcactcgggaatcaagacccaacacttttgtcttggttgtcaggggctgggttaaatactactaggcccagtatcagcccacgtaatgttcttctttactgttttgtctatgctctagtttttgtttatacattttctttgtattcctcattctcctaacaaccctattgcctgcctattggtatcagaatagaccaccactgcacgagaaaaaacctaaacttgatcgcgaggaaaaaattgtgtaactaaagtggtcgtggagcggtggaggtaaaacattactacatagtactgttacaaaacaatatcttgtaataattaaaataaaagataaagtagtaaaaatattatttttttgtcacatcattacaattttcctaatttatgtttagaccattgctgtttggcatactaaaggtataagaaagacacgccacagagatccagtggtatacaatttttatgctttggaatcaacttatttgctacaatgacaaactaccaaagtttatttaattactttacaaaaagaattatttggataatccaaaatcaaagaggggaaagttggatttacatttccgattaacattttaacgtaaaaaggaaaaatgtgaaacataaagtgggcaactggacattcacggcaacagatcaaaaacccttttttaaatcaactacttagtaaaagaggaataaattaacagattatcacacacactgattgataaattaggagcaaattggttttaacaattcaaaagaaataaacaaagcactaagttagttttggtgctgacgagagtggacggcaaaaaaaacagaagatcactattaagaaagttaaagttaatagtgcaaaatattaatgtagggaaaaaaatgactacaataatgttcaaagttaaaataaaggacattttgttggcaagaagaaaaacattagaaacaaaaacagaacaaggcaaagctgcaaagtcaagttgagtcggtgaaagagaacaacaaccaacctttaccccactgccatcctccctagttttgaacatgtgcactttcttcgttatttaccatcacttttgtgttgtcatattcatcttcttctattcagagaagacatttagccaaaatttatgtaatttccgagattaagaactggttttcctttgtttgtcacttcaaaccagtgatcaacaatgaaaacagtaaatgttacagtggtctataccaagattctaaaagttgaaaagtggaagagggcatgctaatttgaatgaatacccaatatttaagattctagaagctcctttttatctatatatatcaactaaatagtcggcatgaagctctcaaatacttggtccacctatttatagagtacacaacttttttggaaacagctaattggaaaactctgtattatttagggtttggtactagttccttttgttgtgcaactatcaataaataacatataccttctattgataaatccaaatccaaactctaaagtgagtcgctgaaaatgaaagtagtaaaattttgtggcctctcatctcactgtattcatatttcgtttgttgagtgccgactctactatccacctattatgagattcttatgttaaaacttacaaaatatatttacctagattttgtctttgtccatactcttccatgtctcgggatcagaacaaaacaactagtttacgtgcttttttggaaggtcttatagtagtaataccaacagagctacagataatggattaaatacatgtaaccaacaaatgttatattacttttataaaataattataaatcaatgaaaaaaattccttatgaatcgctaaattttcaagaactcaaaaccttattcggttttcataatgagcaatgatgaatacatgttatacgtcgaattattattttggattctcaagccggccctttgctatcttattttctcctttacaacattttttaaccccattgtcaaagagtcggctttgagcccatgattgtaatgaatggatagcttgaatattgcgaccacactaataattcccgtcaaatatttgtttaacttaatgtatgacacatgtattttacgagcaaataaattcaaaaaatttaagcattagcgaaaacattgtttctccgctccacaagacactaaaacataaataatgaattaaatcagtcattctacagaaaattaatcaccgtagtcggttgccatcattccaaaaccttaaaaaaaacccatgtaaaatgatcattaacaacaacaacaacaacaaccaaaccaacaaaaattaaagtaaaaacagagtccaaagcctcgtcacatctgcccataaatacccttcaccgactcaccatcttaccacatcaattctctcatatctctctctcactttcgaatatatcttaagataacagagacacatactcttaagtttggtgaagaataagaagaca

SEQ ID NO: 14535 - DNA, 3000 bp, Unknown
  misc_feature (1)..( 3000): cDNA_ID_3017823_gDNA_ID_2684129_Annot_ID_191168 3000 nt of promoter + ATG
taccattttggcatccgaagattttccatggagaaggtgcaatgacatcaggcgctacgtttgtttcgacattcaatgatgttgatgagtaatttgtcgatgaataatttgtccagtccacagagtttttgcgacggttcctctttgatacatcaagcttcacaagtcccttctcagcatgagatacaaaaaattcgcaatccggaatcggaaacccctaatgaaaacatgagtcccatgaagaaaagtctctaaaatctttcattgtaaagaaaatgttaaaactgttaaaaaaaaccttttgtgaagcatcctgcaatgatcggatccatttggcagcttcttcaggactacttgctcccaactgttgaaagtcagaaacataactgattattaagagtttaagacaaatagaagtctgagaagtaaagacaaaagctttgaaacaaacctttagttgatccaaatggttcgaagtgttgtaaagcgtgaatatgaaaagaatctgaaacaacacatgaaaatatagtaatacttaaactttctgtgaaatatagaaattgtaggcttattagtatcttaaagttggtacctttctatggaaactctctctaccattgtcggtaacgcgaatacaacaatctagagatgctcttctctcaggttcctacacataaaacataattttttgctattcaaatggctcattcgtttatatatcacaatatacttaatacatgttgttttgcatctatacgtaattcataacacatgaacaaaaaagaatcccacaaaacaaatgaaagtgtgaaaaaagtcaaaagacaaacctcattgtgatcagatggtacagatttaaaacttgtaaggttgttctcgtgaagaacgaagtatcgtttacgggaaaattgaaggccaaatcggttgtgtcggatggtataaagccaaccttccattcttccgtcggtttgagacactcccatttctctacaaatccttttttcttatttttaaatttattaaacgattcaaagtttcaaacaatcaggaaatgcttataccacttgaaatgtttcttccccgtaaacgaataaatactcgatatcacaacacgtttttgttgcgaatttgtaacttgaaacgattctctgattccgccgaagcgaaacagagaatcaaaagtatggaaagatcagttacaaagaaaaaattatttttcaaattttttttttgtttttctctcaatcaagagagaaaaacaaataattattttgtcctgttattttttcgattgttgttacgtttcgttttggttataaatttttaacattgttggttaaaaattgcttgctaattgtgaaaggttaaatgattggcgcttctgtcttccggatttaaattctataattagaacttttaaactctgctattcgttatgtccttcaatatttttattgtttatacgaattatagaatttaaactctgctttccaaaggttcaaaagctaagttgttaaatcgtacggtgaataactgaccaattagtggaatcattaccgagtaatcattgtctattggagaaacaagtaaccccaacgagaacaacacattaacacaagttagcatatatctccaaacaagaatttgttgttctaaactgagaaagaccatagacagattagatttcagttctttacaaaacaataacgggcctagcctatcaattgggcttaacccatcaatttgtttcatacggcctaatatttctttgactttatttgccgtaggaaaaatagggaaatcccaaaaatctgaattctgtatgttgacaaaaagaaaaaagcaaatctgaaatattgatgtagatagaaacccatatatattacccaaaactagaacataacaaagttaatcattgtaccttataatctccaaggaccaatgaatcttcttctcctttgacataattcctaatctcaaaagtaatgatttttaaaattcacaaatttcaacccttaacttattcctttgtcaaggcaacaatatgagtaaaattacttaagtgttaatattatatatcatcagaaacataaaaagaaagaaaaaagagacagctttaagatgtaccaactccaacattacagaaacagtagagatatctgcaaaaaaaccaacttggggcccctcgccattactattttattatttttcccttttttctgctctgtttcgttgcctgaattcttgcatcagtctctttctctctctcttctctcttctctttgtgtaagcaaagaaccaatctttagataatttaggaaactcttcattattcctcttgcaagctcgaatgatcgccgccttgttcccttgatacctcgaatccttttcttcttccagcctcagtatcacttcaatcttctcgggtacctccaccttcttacattcctttgttacaatctttttccaaattcgacattagctttgtactaagttagggttccttacttgtgggttttcactgttctgtcttatttctttgttgagattctttttcgatttgataggtttatcagattcagagtaactctgttgttttctccacactttattagactggataaattagtttaatcaaatataagggaaaaaggaaactagaaagcagaaacatctgttgagagaatgtgctcaagtcaagtctctgtttaaatttacttccttttcttcagttttccacaagaattgactgaatctagtcatgtctgtcttctcagactaataagtcaaaaagtcaatgcttttctatgtctgttctatcagaaaactttgtgttcctttctttttttccatataatacacagaaaagtctgaatatttttactaatccaattgataacactatcaaggaaccaacactctttttaaaagtcatgaaagattataatgttgatatgtgtgtgttttgttttttgtgttcttcagcttgatagttaaatg

SEQ ID NO: 14536 - DNA, 3000 bp, Unknown
  misc_feature (1)..( 3000): cDNA_ID_3017835_gDNA_ID_2684129_Annot_ID_191165 3000 nt of promoter + ATG
gggtaaattattgtctaaggtttaatcttcttgaatatgtacgtatgataatttgattagtcccgtcttgatattgaattaaggtacccttccgcctacgttgccccgaacatgaccttcaatcaagtaagtctcatgaattctaattcattaaaaaataatcgatattcttctatgattttccacttaattatgaatttcttatgtggttgtttaatgaacagaaagttggatatgtcggaggaacctatatgaacggatactatgcacaaatgcaaccacaaccgcaatcgcagccacaaccgcaatattaccaccatcacatgtatggtggaggacgagttatggttggggcagcaagtccaatggtgcctttctacactgtctatccttatcatcaatctcaagccatcgggtttccacaaccttcattttcgaaacctctttctttttccactcctcctatatcaggtatttgtcattctatttctaaaccttataacggaagctagtcactaaaaagatatcgaaaattacatatctggataattaagtactatagcaataatcatttgagaaaaaaaatatacatatcagaatcaacatttggtttcacatacgtacttagttaatataaatttgctgcttttttttttttctttttttatctctctttacgacgactacaatttacaaattagtaatattatacattcacgtaacgtgtcttcttcacatatagtgttgttctttaatcttaaccatctagcttctgtctatccatcatttttttgtttactctatatatatgcaccaaataaaactgatgagacatacgcacacatgcatacacaagttgatcacgttattaagttgatgtcagtcatggcctcatgtgcccatgatgtaattatcacatggatccaccctcagctagctaggccctgctttggcacgtgatccctcgctgtagcacgtgtgtctgtaataatttagttggatcttggtgcttataggttaataaaaaacggaaaggtctcttacatgcaagatgttgtgatcttcgtgtgtcggaaaatctattaaactgattttataaagatttgcgtttttgactctgttgaataggcacagttggaggagagagcatacagaagaaggccatacattgataggctagaagctgttaatcaaacgattgactcagcccaaaattattcattttatccatctcactaagctttatttttttctagagacttgtatttgtaataatttaatttcgttacatttaataatttattcattgaagctaagctgacaagttttttttttatataaaatcgctttataatgaagtgttctacttaaatacgaaggacatgatgagatacaccaatctcttcggttagcctagcaataacgtgaaaccaaactcgagtcataggacatgaatgtatgtgcttctttcttgccggtgacagtggtggatacaaacgaatcctccatagatagtttggattcggcccaacaaactcgtgcaatcatcatattaacatctaagaaaagagtagctatgattgtaaaacgaaagaaagttataagtatttaggatagttaattatatatcaacatataaagttaattataattatagccattttatgtattaattagtttttaatataatgaaaagagttcttttagcacattttaactcgacgtgaacaaatacgaaataaaaaggttcttttagatatctttgaaagttttgatcttaaaaagtgaaaacaacaagctattgggttaaaagtgaaaaattcagggatcataagttggttttctcttcgagtattgcgttttcttcttcaccacactggtctctgatgaggtgaagccggtagatgagggagagcatgtgctgagagtcagtgagacagttgttgacttagttgaggttgaaacgaatggtgagacagccaactctggagttgagagtgaacatagtgaaagtcatgaaagtgcaggagaataggagagtgtagtatctggtgggaatgaggtgactgatgagaaggaaaactgtgaagttgaagataacggtggtgattttgatgctaaccaaaatgttcaaactgaaaagtcccggtaaagttcagtggatggtgtcatggtgaaatggtttctgttgtagaaattgaagcataccttctatcccaaaccagaaaaagtcacaaagacatagatgagtctttttcatcacgttaatctagcaacgacactaacataaaccacgaatctacgtatcatggtttatattagtaaactgatcttaagctaattttagatgcatcatgtttggatttttggcatgaacaaaaatatttggaaaaacaaaaaatatccaaaaggaaaagaagaacaaaaaaatgtccatatatgtattgaattattttaatttagaaaaaatcggaagtttacctcaaaaaagagccacgtggataaatcaagacggtcgattaaatggatcatagggatgcaatatatcataaaaccaaccctccccgaaaatcgtgaacaggcaaaagagttattcggtagctctcctctccgaatctaaaagttttccgaagaacttaaaacaaatatgactgatacgctcgagctcgactgacgaattcggcgtagtgttcacttttcttcttctttcttggaaacccacactcgtctgagtcgtctctgttactgacacccattaaagccctagcctttggtttcttttctccaaatcttgcaagatctcttgaggtaatttcgccaatttcattattctcgttgttaatttcacttactgtatcactgaaatctggaatctttcatgctttttgtgaataccctttgctctgatttctgtttcttgtttaaagttttcgacttttttttttataataattacggacgtcttgagtaattttgagctggaatcagataattcacatg

SEQ ID NO: 14537 - DNA, 3000 bp, Unknown
  misc_feature (1)..( 3000): cDNA_ID_3017851_gDNA_ID_2684129_Annot_ID_191161 3000 nt of promoter + ATG
ttgttcactgaaaatagtttgtaagagttgtaagacatttatacttgagaaaatctgctaataattttaaaagttttgtatggattttgattgaacaaagaaacaaatttaaggtagtctttttttgttgcctaccagatttttatgattaacttttgtctaccagatttatagaagtctattgtctaaacccaacacttccaatgtccctagaatattttgtccgaatgatgactcggattatatttatgaaggtgcacactacaaagatacgttcaaggacccacttagatttgtcctccctatctctcacgatagtgctgtcagatttctaatttataattacctcaattttttttttttggtcaaactagctttttataaatgattctactctccaacaatggagaaatggttcaacaagtacatcaaagatgctacaaaggccaaagaaaccactgctacaaatggcatacggaaagcacgaaagaaaaagataaaaacatacataacagttaagcaactaaagttggagacaccaatagtgctgaaacatgagatgagctttcggaaataagagagcacacttggtgatctgctgtccggagatgcaacatcctctagtggataaaacgcatcatgaaatacggctacgatagcataggcgacaaagcaccaacttcttgagcctacgagatgtgagaaaaacctcaacttcggagaggtgtggggttgcgaaaaccaccacttctcgatgaacaaatctggagtccaagacccaagatcatttcttgttaagacgtcatatgtcttttcctttatcctgcgtgaaatttcaagaaaccaaaccaaagaaacaataacatgaattgctcttaaccaaagtttttgaataacatcctcataatgaggtaagagaagcctaagcttatacagaatcaaaccaacctcatactgaggtaaaagaagctgaattcgaagtccaatcgaaaacaacacatcctcataatgaggtaagaacaacttgagcttaagcaagatcataacagcctcatactgaggtaaaaccagcctaaaactagtagaaatcatcacatcctcatggtgagggaactgaagtataaacgaaggcatgttccaaaagaaggtaaaaaattcaaagaaattactacctttcagagagacaaaaccttttgatagagtgactagaggatgagagaggtgtggaatagagaaccaaagctccaaacaagcgagaggaaatacttggtaccacgaactgcacacagcagtaatagatcgtaaagcaaaacccagatctagagggctcaaagcctgaacaagatctgatcctagatctgaagacctcaacaacaaaatcgagagaaaggagttggaagctccaacgagatagtctggtgggtctggagggtcgggaggttcagaaggagagaccaaactggtcaaatcttgcggtagagcacacggcggcggattcggagaagggaggagcaaaggtggagcaggagcccgagcaagcatcactaaagccatagaagaaaggaagaggagggagaaagaggaagattctcgccggtgggcgagaggccacaccaacggcggcaaggagaagaagaaaccctagtcgtcaagttgagagagaaaaaggatttttttataattacctcaatcattccatgaaattcccactcttttgagaagaagtacatttaaaaaatttaagatcttattttcatagtgaaaatatatggagcataggcgacgactagatgtaaattatcttatggatggggttatacttagatactcctgctaaagtttatctgtgtccctaaaacatagaaggaaccaaaactgacaaaccaaaatttttatttgggtcatttgaacaaattatagtctgtattgaattaggcgacaacaaaaaatctatagtgaataataaaaatagataagagataattccatttttttataaagcattttttttctttctagtcaattctgagtggattataatgtactattatgtaagtatgcatacagacaataggtccgaccaaatgaatcaaatgcataaagacaaaagcttttcatggttatcatttttattgcgtgctcatcatttgttcaaatagttggtagtttctaatgtaaatccaattctattttcttcaaaaaaactggatatgtgtacatcatgcaaaacgaaacgtaacaagttctggacttgaagttcatcaatgcatgcatatatatatatagctttggacgaaaaataattaaattcatgtttggaggatacctccacgagattgataaaattatcgatctcgatgtcccaagtcccaacaccgttctcagtctcgtgtctcctcttgtccttcaacgctgccttcactttaaataattaatgacaatgagggaaaacatatgataatcacaatggagaatatatatcacgatcgagtgatatgctaatgtttaattatgataaatctaaaatggaatatgtcaaatacgacccaatacatcatcgagtgatataaaaacgaattaaaacaaactgaaaatgatactcaaacgaagaaaaatagtattttggccacccactactactcaatcaaacaatacacattttcatttttggttcgtcaatatcgcagcttttcatcattccactaagctcagtaatttagtgggggaaaaaggttttcaaattctagtttcttagattgctgactctgttgaaattctagtttctcgtaattacacaaagaattagtctttgttattatttctcggaggttgatgaaaaagagattaataaacagagttttgaccaagacaaaaatactcataaagacaaagaagacaaaaacgtaaaaatgagactgaagattatttcataataaatactttggctcatcagccactatacttactaaaacaatttactctctctctctctctgcaatg

SEQ ID NO: 14538 - DNA, 3000 bp, Unknown
  misc_feature (1)..( 3000): cDNA_ID_3018002_gDNA_ID_2684130_Annot_ID_191188 3000 nt of promoter + ATG
aagagagagaatttagagagatcaataggaagtcaaagtgaccttgagcggtggtttgggattaattttcgttcgtgctcttaactgatgtttacatcacttcccatataatttcatatcaaagttatcactaaaccggccaaaatatatgttccgtttgaacgcttccgcataaaaaaaaataacatatgataattttaccattgtttatgatttttttaattacaaatgtttgattttcttttttttatatagaaaaaaagtgtaataaaatttagggtgaattgcaaaaatgacgtttttaggagatgaaataaagaatatagcactacaaatctataatgtagtgaataacatttaggtgtggtaaaaagatcacaaactccttctaacgaaagagatagtaagcgcgtggaataggcgaagaattgaatacgagtgggtaacgtgacgttgttttcatccaagcaattttcagtagcatcatcaaagaaaagtcctgcaaacaaaacaaaaaaatatagatgagggtgaaaatagtttagcagttaatacgacaattcaaaatgtaaagatacatatatttcgctttcaagctttactttgtttgaaaaaatatcaaattgtttataagtacagaaaactaaaccctaagaatggtagggaacccaaacaacaaaatctgaaacccccaatttagattttgtaaaatttgaagttttgcctctgtaaatcaaaaccccaattcaatttaatcaaaaaccctataagtcacttcaggaaattaattgcattgcttccatcgtcaatatacctctgctgattgttggcaaaattagaagtttcagaaaaggtggactgcaacttattagagctaaaactctgtttgaaagttaacagttggtgaaagagaagaattgggttcctgcgaaaagaagaagatgatgagcgtgtttctcaaacaaggataatgttgccattattacaaaaaatacaaacaatatacgttacttttttgtggagtgttagtttcttaaatataatatttttgtagattataagcccaaatttctctaaaatttacatacttctatctaataatagagttacatacttctatctaaaaagtataatagagtcacatacttctatctaatatgtaacaatataacataacacgtaatttgttttattatgaaataaaaatcatgtaattataaaataaaaatacatgtgataaaattgtctagtgattaatcaatggttcctacacaatgttctaaatattttagtaaattttactagctaatagatggaaacttatcgcatgttacaggagtagttcatcgtggccttagtaagttattgataaagttgtccattttatgtgttgttgtcaaattgtttttgttttttgtatttttttttgaataagttgttatcaaattataatgtctaatactactatagaaatttatcacttttatcctctctttttgttatgtctttttcctttcaaaattgcataccattttgtattcttttctcaccaaacttattcaaactaaatttccaaacatattatagagaactatcaaaatacaaatagttacataaacaacataagtacaaacaaaatcacgagaaaaagtgaaattatattacaaaatgctatatttttttctcacactctatattaatgtcaaatatgagtaatttcaatcaaaagccatttttcttttgcataattcatgtttatttttttatttttttcatcttgcataattcatgtttaaaaggatatatacatgggtctactacattcacctgacattacgttttatgtgtttgtcttctgaaaataatcatcaaaatatttcaggacttgtttacgttttcaggagaaaaaaaataactgtacccttttcaatatagaaataacatttgtagaaatcgtggattttccttaataaacaatccaaaacacgaccaccgttgtctcctcgactcggtaacacccgatcgccgacttgaaaattagaagaaaaatgaaaagaataataaaaaaaaaaaaggaatgattattgaagctgtcatatatgtcgaccctatcacagtcaatccaatagcctatattcgccaactgatatatccaacggctcacaaattttcacaaacttttcaaaaaagtataaataaaagaggctgtctgacagccatgtcacgttatactttttccgtatgatcgaaatgattcgtctttgtcgaatttaattatttccaaaattgatgactctaaagaaaaaaaaatagtttttcagataaacccgcctatataaatagttcaacactcggtttatttcttctcccctctttgaattgcctcgtcgtcttcagcttcatcggccgttgcatttcccggcgataagagagagaaagaggagaaagagtgagccagatcttcatcgtcgtggttcttgtttcttcctcgatctctcgatcttctgcttttgcttttccgattaaggtaattaaaacctccgatctacttgttcttgtgttggatctcgattacgatttctaagttacttcaaaagttgtttccgatttgattttgattggaatttagatcggtcaaactattggaaatttttgatcctggctccgattagctcaacgattcatgtttgacttgatcttgcgttgtatttgaaatcgatccggatcctttcgcttcttctgtcaataggaatctgaaatttgaaatgttagttgaagtttgacttcagattctgttgatttattgactgtaacattttgtcttccgatgagtatggattcgttgaaatctgctttcattatgattctattgatagatacatcatacattgaattgaatctactcatgaatgaaaagcctggtttgattaagcaagtgttttcggttttctcgatcaagattcagatctttatgtttttgattgcagatcgtagaccatg

SEQ ID NO: 14539 - DNA, 3000 bp, Unknown
  misc_feature (1)..( 3000): cDNA_ID_3017958_gDNA_ID_2684130_Annot_ID_191201 3000 nt of promoter + ATG
aaaaaaaatagaaagtattttctaatggtaattgggatttacattatataaagcactaattgctgagataaaaccattcatcaggtatatatgtaaaactattctcgagataaaacaagaaagtgaatacacaattttcttgcctctattcataagaaataaacctgttttcattgtgtttatttaacaccaaaagcactcaaaattgaggcttaacattcagacaaaccgtaactatagaacataagaaaaacctaactattgaagaggttgcattatatcacaagtttaaaacaccaaagctcaagctgagtagcaaaaataggtctcttcttccgccaccaaaacctcaacaggaacgtctacaaaagccttgaccgccacaacgaccaccggaaaaacgaccaccgacgaaaagaccacgaccaccaccaggaccaaagacaggagtaccaaaacggctataaggttcctcatcagaagatgatccatccacagacatgctctctgcctgggctttacagagccaattttaacttcattatttgacctaaacaatgagatcaacagatccatcttctcttccattttatgaagacgaataccaaatccttccaacatctccatcgcatcagatattttcatctcagtcgtcatgtctttcttatctttctccaaattgtctgtaggcgtcgtgtccttaatcacagaaggagatgcttcagctttggttgcggatttattgtccatggagaagatgattagtagaacaacgcactagagctaggttaaaagagagaaattggagatcggcaaaaacccctaatcagctgcttaggaagaaaggtatttataagagtcttttatattctggcttggggcacaagagtcctttccttttattttatttacttttcccgttgttcattttttcaactaagcaagctttatctgggccgaggtgaggcccattaattgaattaaaagcccaaaataacaacaaaacattacctgattgtcggaaaatcagacggaaacaaaagaaatcaaaaatccgatggggaggaagaagggattgccggagttcgaagagtcggcgccggatggattcgatcctgagaatccgtacaaggatccggttgcgatggtggagatgagagaacacattgttcgtgagaaatggatccatatcgagaaggctaagatcttacgtgagaaggtcaaatggtgttaccgcgtcgaaggcgttaaccattaccagaagtgtcgtcatcttgttcagcagtatctcgatgccactcgcggcgttggttggggcaaagaccaccgtcctatctctcttcacggtgagtttttttcccggcgttctctctcacactggtgaaaatgcttagattgaaattcttagggtttcgtgtttttttccttagcctttgaattttgaattcagttactctttagtgtgtttgattgaatttgatttgaatttgatgtagagtggtctcaaaattcttcatgaatacctttgtgaaattgattcttcctttagatatatgtattgaattttttttgtttgtattgattttgtcaaaccaggtcctaagccagtagctgttgaagaagctgaatgatgttgtgtgcgtgattgatctttggtaagtaactggtgttgattagttatatagtgtgtattgcttagaagaggagaaaggttagactttctagcatgctttgtgtagacactatcttataactggacatgttatgtgaatctgtttgtggtaggagaaaattggaatatggatgtttggatagttatatgtatgaactgatcaggtcttagagtgacttagttttgcggaagttgtggatacactggttaattattgatatcaatctgactgcaatcacaaaggttaaagcttagtcatggactttcttcggtggttttagaaacaggacatgttttggaatgtatagaaatgaaattgatagatcttggagtgactcaattttggagacatatgggccgatattatagataccaatccgcttgcaattgcgtccatctttaatctgcaacagagctaaacctagtcacagaatttcattgatgaattaattatttgagatatgagatgttgtggactgtatgaagaaggatagagctccaacatttaggttttgattggtttaaacaatagttccaatagggttaaggcatatagtcaaaatctcaagttcaaattggattgatgatttttgtatttggttcaaagattttaaaggttttttcttgctccaatgacacaggtgagtgagagctttgattaccatacatgaatggagtctctgttgcaagttaatgctccacatcaaggttgttacttgatttatgcttttctgtttcgtaaaacatatattactaattggacttgggagttccaattggttaagctcagcttcgtttttcaaatgatttatatatatttttggcttgttgtacattgcgtccctgtttgtcgaaataatgaaattcccaagtacctttttgcatgcttgcaacttagtatatgtttttaagactttatctgataaaactaagaaagagttaactctaaaaacatcatactttccctttatttcaaaactgtaggaacatctttacttctttagtgttgtctaaatggattcatttctgaaatagttcatgaaatttttattaacctttaagtagtagttcaaacatctacggagtctattaccatatgttaaatggtgacaaagacaggtaaggaccacagacaaaatgagtcagaaaacaaaagactaacaaacaaaaagataaaacttagagatgggtaaggaaaagaagccataaaagacccaaaaacataatccaagtctaaccaataagatcgcaaagatatggatcaacttcggtacatgatgccaaatcatcactacagtgtcttttttccttgtacaacccaaccaaaa

SEQ ID NO: 14540 - DNA, 3000 bp, Unknown
  misc_feature (1)..( 3000): cDNA_ID_3017950_gDNA_ID_2684130_Annot_ID_191203 3000 nt of promoter + ATG
taaatattaacgaggatatcggtaactaccatatctaaatttaccatttttttttttttgtgatagaaaaagaaagttaatattttagtaggaaaaaatggaaaattgggaattctctgatgatatattatagttctttttttctttggtcctaaaacttcaattgatatcacactctaatttttatttttttgtatttctcggagaataatttgtagactacacattaatgattaaataaaaagttttttattttcgatggagaaatcaaccatctaagtacggagaacacgtaaaattgggactatccagaatctcataggttaatctcaaccctcaacttatgattttgagaaaataacacacttttttttttttaacggcaaatcgattttattatatagttaaagtttacatgatacataagaaacattcaaaagcaacctgagaaaataatacacttattctatcaaaactagtagtgatttttttttttgttatattaacgagtttaattttcaaatcattagattattttttaagtcactacatcatagtatatatatttatcatcttatatgtataaaatgaaatttcaaaacttgataaacatgatccgattaagttgagaccttccagtttgagtgtgtcgataaacataaaatttttgttttaaacagtagattaaacttttaaaaagaccgtacaacaaaaagaaaaaacaaaacgcaaaaacgttacaaaaagaaagactaaagaaacaaaacaaaataaaaagcataatgagtagtattaatgagttatacattttcccattaacattttcacatttccccattaacgagttaatgagtcaaatctacttcttacgagtaagacgtctcttcttcttagatgatgtttctccaccatgaccaagaacagatccaatatctttcctcttattatcaacaagacaatttccatccatagacgaaaccggaacttcaaacctttccatttccttgagaacagcccgaagattatcggcttcgcgtaaagcaaaactcaccgtcttgcgttcaatcagtccttcaacatacttgtacaaaccgcatttcactccctctttcctacaaaaatcaagaactgcctcttcgtgcaaaacattgatggctacaccgaatgcagaaactggccagtacttgtctcggagacgaacaccagtatcactttctttcttcatgaccgcacgagctatctttagttcagagctatactcagcaaattgagcgttaaacgctcttatcatagccgattcagcagccgtcctaccttttgatgtcgctcgcctctttagcttctcgctgcgttgcacttccacaacggcttcaataccggcttttgttttcatccattaaacttcgtagatttgacggagattcatctcgtggcttagaggacaaatccctagtgagtttgccttggctaacacgctatcgcgtatatgggaagatactaaattatataatgacactgaattgaggcgagtgtgtgaaaaaagtagactattcagttgctgccttaataagtacgctgcttcattttcccaagagggataagaagcacgctgtttcattttcccataaagaaaacgaaagaaccgagtagtttagacttaagttatttatggattaaatataattctgtagtatattttaaaaataaaatgttactaaattgtattaaaaaaaatatagctttttgtatatatataagctgtttttataatttagcatagcatttgaaataaaaacagatttttgagtgtagctgacttctgaaagagattcattagccacacgatgcaaacctggcttgtagggctttgtcatagtgtcgttaatatgttacataatatattagagattaattaatagtatgttgtttttgttttaaaacttcctagacgaaaaccaaatcatgaaataaaatattgtatattgcaagtaaaagatacatttaattgttatcatataggaattttaaactgcatgtgtgaaaattcctctgtttttatagaactaaatcaaatgttagcattaattcaattatttttttaaacgttgttcaaggattgcatattttctaatacgtctgaccagtgtggttagagtctaaatggagtattcttgccgtgtaaccaaacaccgcatccatagatcttgatctccatttgggagattgcctctctagttggaacaagtgaactatcatcatcttttttctaacttctcttttttaaaatttttttttgaaaattgggtggttttcaaccttctttttcataaaaaaaatcagaatcattagagttggatacacgtctcaaaataacattctatatctctcgttgacatgttctccatatgctttaaaactaattataatcactcgcagtattaacttaccttatccgcatatatatatgttcatcgaatgaaaactatgaaggtaagggtcagctatatatgaagagatggagttgatcacttaacttaatgtccccaaacacaaatgaataattttctataccaacttgttagaagcatctattagggagtactattctttttgcttttggcacagagaacaacaaactttatacgatttttagagttaagctctttgaaataaaaccagtcggataacagaactttgaaatgacgcttacttatagccaaagtttcccatagggaaaaaccctaattaggctaaaggaaaaataattttgtattgaaatgttagaaaacggcgccttaatgttttgagttaatgttgtgaaattgcaaatgttagaaagttcagggttttctagacatattagtattttattttggccgttgacaatatatgggtttcgtttctttaactagtatccacttgatcagaacgtgatataaaataatattttggaacttaaaaagatgtcaagggtcgtgttatcctccagaaataggaaaa

SEQ ID NO: 14541 - DNA, 3000 bp, Unknown
  misc_feature (1)..( 3000): cDNA_ID_3437565_gDNA_ID_2684130_Annot_ID_191206 3000 nt of promoter + ATG
caaaaatctcttcgagagaattacgaagaacacggaaattgggggcatgagacacaagacagatacacttgtctgcgtatgtattcggcggtaagcgataagcttcaataatatcctcacagactcgatcccgaaatgcaatgcaactgacaaatatttttgatccatcaccctctgtgcaaaaattattaagataaaatcagtaagagatcacccaccacagttaaagcaggtgtattcaaaacaaaccaacttaaatccaacatggcagagaaacaagactagataaatgagtgcaagacgacttctacgctaaaataattccactgcaaccgaaacaacatcgcacatagagcagctacaatgcaaagcatacaaaactccgagtatgcaatatacggataatcacatacccgtcaagactatgggatagctccgtgggaaacttgcagggtcactggaaacaaaaccagaagaatggaactccaccccagcaggaagaacacactgtccaaaagaaaatgaagcgtaatcataaaaatccgcttgtttaatatatctagtcttatctaacgaaagaaaacaaactcttaaaaggcttaacctaatcaagcaagttaaactcttaaacagatgactcatttcaccatggagcatcaaaagcaaactacaagcacaagaccaaaagcaaagaaatataaccacactttgagagaaatttcaaaagctccttattggtagaaggcaattcaacttcaatattccaacttaactaatctagagacctaattagaggtacctagaaaacatcaatccaattcagcacgtttatctccagttaataacttcgaaatgcttcgtttagcaaatacagaagaaacctaacaactagacaacgctgattccacatttcatcgccgtttaacaacaaagaaattaccagcatggacctaaacccaatcaaaatcctaatctcgacgagaattacaaaagatgttgtgaaaaacttaacagtaggaagctgaggaggaggggcagggtaaggagattgatcagtaggagggaactggtcaagaagagcaggcaagtagaatgtttgcattccatggaatccaagatctccatccacggttcgcatctctggaccaagtccgcacacgacgaagtactcgaagatccgtcccattgtcttccttcgagatctaaactagggctctagagcatgatctggatttccaaatggagatcaatttttggcggatttcgccgatggtgatgatgatggagaaaagtagttgcttcaattcggcctcctttgtttttttggccaagtcgttcgtgggaaaataatcctacgggtcgaacgcaatttgttttccatttcacacaaattacaacaatcaaatttttgtagattttattttattttaaagtttgcaaagtagcaaactaataatattaattttagagttaaaaaataataatactattaactttattttttaggttacatttttttaaatgtgttcatatgtttaattttatttaagcttttaatatataacaaaaattaaaactgaaaaaatagtaaaaccaataaccaaactctaaaactaactaaaattgcacccatttcggtcttttatactttatcttcttaatttcttgtttttacagttattttttggaactttacgaactaattaatatatatatatatatatatatatatattattttcgtcaattaatatgtttttcttaacttttgaattctgatattcaattttatttgttactaagatgaccaaattataaagcaaaactcaacaaatatttgaaactacaagggtggtgcttctttgctcttgccactgatccatctctttattagcattaaccccatagtataaatactacatctcagatattcttcaaactagtaaatagtaatgcaggttgttgtttatattatatgacaagaaagaaagtccaagattttttcggggtcctcatactttttcagttcatatatcgaagagaaaaaaacgagaggattagaacatctccatcaaacctcaaacttttaaattttgaagttttttaactccaacaaaccttaaaacctttatttttgagggtgcataacacccttaaaatctttcacatattttcattgagtccttatagcttgcatatatctcacaataattctattaaattcaattatttcaattatattcatataaatttaaatacattaacatcaaaattgaaattattaaaataaaaaaacattacatttaaaaacaattttatacagcaataatattatatttagaaatttaacacacataaaattaacattacaatagttaataaatacatgaacacacaagttttattttatgtttcttttctaatttatatatatttttgtatagcatgtaaaaaattttgtttttcctaacatatcttgtttgacataatgtttttgaaatgtatgttgtatagttattttatgattacatatttatttatttctaaatttttatcatgtaaattaaagttgtatcatatatttttattgagttaaataaaagaaatcaaattgacaggaaaaaggaaaaataaatgtaaagcaagaaattataaaatttgttaaaactattaaagttttttactaaaagctatttttattgtcctccatatatacttttttttttaaaaagaacatttatagggagggtttaataaaaatgaattttatgtgtaagtaaaattcatttttttttttttttttttttggtaagtgtaattcatatttttcaaacatttacttcaaataaaataaccctctccttcctcgcagcttccgtctcgtataacgaaagcctcttgactcttgaccactcctagtctgccatttttctttctcgtcctgtttccattctctctccgatcaaaaccagcccaattcgatcggagacatcacagaatg

SEQ ID NO: 14542 - DNA, 3000 bp, Unknown
  misc_feature (1)..( 3000): cDNA_ID_3017946_gDNA_ID_2684130_Annot_ID_191204 3000 nt of promoter + ATG
tccatattggaaggatctgaatctccgacattgtatcgatgtgatgcatacagagaagaattttttggataacataatgaatactcttatgagcgtgaagggtaaatcaaaggacaacataatggcaagaatggatatagaacgattttgttctcggcctgacttacatattgatagtaagagaaaagctccatttccagcttatacattgacaaatgaagccaaaatgagtttattgcaatgtgttaaacatgcaatcaaattccctgatggttattcgtctgatttgagtagttgtgttgatatggagaatgggaagttatcaggtatgaagagtcatgattgccatgtttttatggagcgattacttccatttatctttgcagaactcctcgaccggaacgttcaccttgcattatcaggtaaaataagaatataatttactctttatatcatatatgcacttgagatgatgattttttttttccaggggttggcgcattttttagggacttatgttcgagaactttgcagaaaagtcacgttcaaattcttaagcagaacattgttttgatcatatgcaacttagagaagatcttcccaccatcattttttgatgttatggagcacctgcctatacatctcccctacgaagcagaattgggcggtcctgtccaatataggtggatgtatccttttgagaggtttttcaaaaagttgaaaggaaaagcaaaaaataaaagatatgcagccggatcaattgttgagtcatatatcaatgacgagatttcttatttctcagagcactactttgccgatgatatacaaacaaaatcaaggtaaccatgaattatcgatgtgatgcaagttttcaatgcgcaaaaataaccatgaattacctcttttggatcaggttaacaagattcaatgagggtgaagttcctgtatatcatgttcctggagtacctactatatttagttctgttggtcgtccaagtggagaaatacgtgaagtatggctatcagaggaagactatcaatgcgcacatggatatgttatacggaattgtgattattttcaagtaattgagaggtatataacaaagtcatactcccattttaagttaattatataaatgtttgtttactaacccttatatgttgtttttgtctttatatagtatgttcgaagattttctttctattaaatatccaggattgaacgaaaaagaactcttcgtgaaaagaaacgaggaatatcatgtgtgggtgaaagattatatatgtctaaatagtttataatatatatgatttgcatttatttattgttattcttatctctataatgatgtttatttctaaatttgcatacaggttacatattggaactctagtaatccttttccaacttgggttcaagagatagtcaatggacctttgcacaaagtcaaaacatggccaatgtattttacaagaggctattttttttcatacgcagagtcatggagcaggacgtaagacttgtaactatggtgtatgtgtgaaaggtgaaaattatacggatgcatctgacgcagcagatttttacggcaacttaactgatatcatagaacttgagtatgagggggtggtcagtttgaaaatcacactttttaaatgttcgtggtatgaccctaagctcggaagaggtactcggaggagcaatagtggtgttgtcgacgttctttcatcgaggaaatataacaaatacgaaccctttattttaggtacgtatggtatatatatatggtcatttagtttttctagttcatatacaaatatctaattctctaaatatggtgcatttacaaacagcatctcaagcggaacaagtgtgctttattcctatccatacacgaaaaaaccaaagcgggagtggctcaatgttttaaaagtaaatctaaggggaaacatattagaagaatatgaaaataaagacccgagtttattgcaaacagaaaatgatgatgctgttttaataacaacaatagaagatcttatactcgacaatttgacaatcaatcgcaaccccataaacctcgatttagatgctggagatgctgatccagaagatgaatttcgatgtaatttatcgtcttctgatgatgaagaacaacaagacgaagaacaatattagttttgtgtttatgatatgtacttaagttatttctagtaattatgatatgtacttaagttattttgaaatactatgcaaacatttttaaattattttgaaaaactatatttgattaagtatgttatgtttatttatatttttattatagataattactatttttgaatatctatggcccaaaaaaacacaaggcccaaacccaattattaaaaattaaataaagcgactaatttgtgacaatttagcgactaaccattgtattgggccaaaataactcgaggcccaaatagggtgactaatttgtgacaatttagcgactataaccattctattgggccaaaataactcgaggcccaaatatggcgactaatttgtgacaatttagcgactacataaaaattattgggccaaaaatttcgaggcccaaaattggtgactaatatgtgacaatatagcgactaatgtttaaatttcgagaactttttaggcccaaacccattaggcccaatccctttcaatgtcaaaaccctaagttccatctctttctcttcgaaacatccgcagccttcttcttcgatttctctcttcctcttcgatttcctctgcgaaaccctagcaaatttctctcttcctcttcgattttcctcttaatctctctaccaaacatctgcagtcttcttcttcttcaatctctctcttcgatttcctctttgaaaccctaccaaatcaatctttcctcttcgtttttctcttaaatctcttcttcttcttcgatttcatcgatttgaacctctgtctcatctagatctctccttaatatcatg

SEQ ID NO: 14543 - DNA, 3000 bp, Unknown
  misc_feature (1)..( 3000): cDNA_ID_3017899_gDNA_ID_2684130_Annot_ID_191219 3000 nt of promoter + ATG
caagcctcctcataagatctcctctatcccacggcctgcaaagaccagaaggcgatgttccagcaggaaccttcaaagctgaagacctatcaatggtagctaatacaatctttggctcaaccaatgctaacgcagatgaaggattttgacgcttcttgcctcttgattgttgctctacagaagaactacacaaaccaaaggatatatacataagctgacgcagaatcataacatgaacacaagctctgatgcaaatatcacaaaatcaactaacatctgaaatcaatccaaagagcaatgtatatgaacacaaatacaaaatcatctctgagattaagcaatttatccacacttcaatcagcgaaacaatggaactcagataatggagatgaatcgatgcacagtgtaaaacagtaaccagcaagaagagactgacctggtggaggaagaaggaagctgagatttcgatggggtaaagagtttatccatgatttggtggaatctcttctctgaatcttgtgccattgtttatcttccagaaaaatcgcagcttcctctagctcgtctttctgatttcgtcctcctataatcgtataaaccctaatctaatagattcgcttccaccttcttcgccgcggctcaggtgaaggagtggtgtttagatggcggtgacggaacaacacgaaaacgacgggatctgctgtcgtttagtcctcttcatatttattccgcaaatcggaagtctcgaatattttatctattttacgaatagatccctttattctcacttcatcccatgtatcacccaaacatttcaaatatgtaaaaagaatccaaaaacacaaaaaaaaatcatcaaattatttaacgctttatgatattagtcaaaattaatacgaaaaatactcacaaaaacagattttcctcaactagtcgtatttctttgaaaacaaaaattcaaatttcaaagtagcaaataataagtcaaaacaatatctattagatatccctcaagttgtggacaagcaaagccaaactagtaacaaacctagctgcactctcacactacttaaattcaaaccttaagcaccacaaagcagaaaaactaaacattttcttcgagaacaatccctcgatatcagaaattaaacaaaagaggattcaaatgggtggacaaaagattgttctgctttcgatcttcgtatgtttttacgtgttttcacttgtgtcatgtactgaatttgaagctggaggagaaaatggttggatcattccacaatctagtaaccaaagtgacatctttaaccaatgggcttccaagaaccggtttaaagttggcgacactatccgtaagtttttcttttgcttctattatgaatttatgatcatcgtaatgcatatattgagttttgttttgatttggtggaaaggtttcaagtacaagaaagactctgttttggtggtaacagaagacgaatacaagaaatgtcagacgaccaaaccggaactttactccaaccacgatgatacggttttcaaattggaccgtcccggtttgttttatttcattagtggtgtctcaggccactgtgaacaaggtcagaaaatgattattaaagtcatggaggtggaatctacgccgcaatctcctccaccttcctcgtctctacccgcttcagctcacaagaaaaaccacgccgtgaggaaaacgagtcggttcttaggtgccggtttagttacaatttcgattctggttattacggtttttagtcttgtgtagtatggaaaacaataccactcggttatggcggttcagccgtcgagttttattccggtttaggttttgttgcttagtttatttaaggtttttttattcatttgataggttgatttgattttggtttttggtcacttcagagctttaaaataattgaactcatgtcttattttataagtttagtatccattttaattctattaaattctaggtttattgaaatacaatgttttttacctttatctaattataaacaaacaactttcaattttctataacaaaacaaaatcaaatattttgacaaattttctaaatatacactttttagaaacatctaatattttttttagaaattcaataaccctactcaaagaatcaaatccaataatggaacacgaaattattttgttatataaatttttataacaaattatgaaatttataactcattcaaccgagattgggtcaaccctataaccttataaaatttccaattagcattttgctctagctataaaaacattgtcaaaacatgatcaagtgatgcatcaaaatacatagtttgtagtccggtctaatcgcccgaacctagtttacctatacatggactttctgttaaaataaaccgacaaaagaaaactataagttatggtcttatggacatatcagaacacaaatcaatcgagcgacaaatgaattttttttgcaagaagtggataccacgaatggattacttgtccgttcacaccttatcaaaaatcaaccaaatattattctttgtaccatttttaaaattttaaaacaagatacattcatctgtttctatcaaatgcattagtcaataacgcttccatccaacggcgaataagaggtatacacgtggtgaggcatagttgattcagcttttatacacaaaagtctcgaggaacaacgtgagaagctctaacaaaacgtgaaggccacaactattatcaaaggcacataaaacacacgaacacaaaaaaagacaaagacaatgattattcagacaagtttcgtacctatttgattctctacattcctctctctcacacaccaaactcacatacacaatctctctctctttctcaacatgtctatataaatacacccacgtctatactaactcacatcatagattcacaattttgaacaaagaaaatttctttggagagaaaacttagaacttagattgacatagagaa

SEQ ID NO: 14544 - DNA, 3000 bp, Unknown
  misc_feature (1)..( 3000): cDNA_ID_3017905_gDNA_ID_2684130_Annot_ID_191217 3000 nt of promoter + ATG
atctttgtactgatgacaagtgacaacaataccttgtagatttaaggttttaaaaaaatattgtatgccagtaagtgttattttttccaaacaacaagttttctgtttgaacctatagatggtgatacaagaacagaaccaatacaaaccacactagccaacatgttctagttgaagaagtggtaattttggtactagttttgcaattcatacgatggtatttatcaggaagtatcaattttggaatgtattaagagatccattgtattaaccaactatactgcaagcattgtgtgtatatggacttactccttgagcaagaccatccttgagaccagaagggccacgccatttgacacgttgagcagctggcaacttccctgatcgttgagcctcaaagaacaagaaggtcttatcaagagcacttccgtagttatagtactccgctgccgcggttgctgccgctagaagaacggacagcaataggcttacgccgaacaatgatccaccaaacttcctcatttctctatgtcaatctaagttctaagttttctctccaaagaaattttctttgttcaaaattgtgaatctatgatgtgagttagtatagacgtgggtgtatttatatagacatgttgagaaagagagagagattgtgtatgtgagtttggtgtgtgagagagaggaatgtagagaatcaaataggtacgaaacttgtctgaataatcattgtctttgtctttttttgtgttcgtgtgttttatgtgcctttgataatagttgtggccttcacgttttgttagagcttctcacgttgttcctcgagacttttgtgtataaaagctgaatcaactatgcctcaccacgtgtatacctcttattcgccgttggatggaagcgttattgactaatgcatttgatagaaacagatgaatgtatcttgttttaaaattttaaaaatggtacaaagaataatatttggttgatttttgataaggtgtgaacggacaagtaatccattcgtggtatccacttcttgcaaaaaaaattcatttgtcgctcgattgatttgtgttctgatatgtccataagaccataacttatagttttcttttgtcggtttattttaacagaaagtccatgtataggtaaactaggttcgggcgattagaccggactacaaactatgtattttgatgcatcacttgatcatgttttgacaatgtttttatagctagagcaaaatgctaattggaaattttataaggttatagggttgacccaatctcggttgaatgagttataaatttcataatttgttataaaaatttatataacaaaataatttcgtgttccattattggatttgattctttgagtagggttattgaatttctaaaaaaaatattagatgtttctaaaaagtgtatatttagaaaatttgtcaaaatatttgattttgttttgttatagaaaattgaaagttgtttgtttataattagataaaggtaaaaaacattgtatttcaataaacctagaatttaatagaattaaaatggatactaaacttataaaataagacatgagttcaattattttaaagctctgaagtgaccaaaaaccaaaatcaaatcaacctatcaaatgaataaaaaaaccttaaataaactaagcaacaaaacctaaaccggaataaaactcgacggctgaaccgccataaccgagtggtattgttttccatactacacaagactaaaaaccgtaataaccagaatcgaaattgtaactaaaccggcacctaagaaccgactcgttttcctcacggcgtggtttttcttgtgagctgaagcgggtagagacgaggaaggtggaggagattgcggcgtagattccacctccatgactttaataatcattttctgaccttgttcacagtggcctgagacaccactaatgaaataaaacaaaccgggacggtccaatttgaaaaccgtatcatcgtggttggagtaaagttccggtttggtcgtctgacatttcttgtattcgtcttctgttaccaccaaaacagagtctttcttgtacttgaaacctttccaccaaatcaaaacaaaactcaatatatgcattacgatgatcataaattcataatagaagcaaaagaaaaacttacggatagtgtcgccaactttaaaccggttcttggaagcccattggttaaagatgtcactttggttactagattgtggaatgatccaaccattttctcctccagcttcaaattcagtacatgacacaagtgaaaacacgtaaaaacatacgaagatcgaaagcagaacaatcttttgtccacccatttgaatcctcttttgtttaatttctgatatcgagggattgttctcgaagaaaatgtttagtttttctgctttgtggtgcttaaggtttgaatttaagtagtgtgagagtgcagctaggtttgttactagtttggctttgcttgtccacaacttgagggatatctaatagatattgttttgacttattatttgctactttgaaatttgaatttttgttttcaaagaaatacgactagttgaggaaaatctgtttttgtgagtatttttcgtattaattttgactaatatcataaagcgttaaataatttgatgatttttttttgtgtttttggattctttttacatatttgaaatgtttgggtgatacatgggatgaagtgagaataaagggatctattcgtaaaatagataaaatattcgagacttccgatttgcggaataaatatgaagaggactaaacgacagcagatcccgtcgttttcgtgttgttccgtcaccgccatctaaacaccactccttcacctgagccgcggcgaagaaggtggaagcgaatctattagattagggtttatacgattataggaggacgaaatcagaaagacgagctagaggaagctgcgatttttctggaagataaacaatg

SEQ ID NO: 14545 - DNA, 3000 bp, Unknown
  misc_feature (1)..( 3000): cDNA_ID_1021383_gDNA_ID_2684130_Annot_ID_191210 3000 nt of promoter + ATG
ttcctttctttttgttagttaatgactttgatattcggtttatattatttaagatttcatttcatcaaatattaattgaatgatgtttaagaaattagagagttaaatatctattgcatatatgtcagtagaatactacttgttttattttctttgtccttttttggttgttggcaaaaatggtttttctttgttcgtttgtaataatctcaatagtaacaatatatatactagtaattatcaaatccatatagtgatatacgcgaagcaaatgaatcagcggtagatgaaatctctcgtttgaatatttgatatttgactaagattgcggggatacatatagtacgcatgcatggatgtgaaaaacacgcaaatgtcgcgttgcaccggacattttcttaaattgcactctaacattctcatatcctaaactttaggccttattttcttattagagtatgtatttacaatatttacttgattattctcataattgacatattgaaatttgaagcccacaaaaaacaaagcttctatagttcttcttccgtacattacgttaatttgattcattcccagctgtaacacaatgatatatattcggaactatatagtataatcatccgtacaatattggattataatttaacacatactgtctatgggcctataaaggcggataggcctggacacgaagcaaatatccggaaaaattgtgatatttgttatttgattcgttttaatcgaatacttgattttatgatttgctttgattcgaaactttccggatatccggaattttgaatatccgaatttttttgtgatatttgcggatatctactttgatacgtataaatattaaaaaaatatgtaaactatataagcatatcagatattcaaaatttttatttaacatactttcaaaataagttataaataccaaatataacctttgttgttattaccggtcaacaaaaatgttatcaaactaattccaaaaactaaaatccgatagtttaattttgatgtcattgatcaaaacacaacataaaaaaaatgataaaacaaacatcttaacataaaaacataaggtagcaacaatacacaaactatttatgatatctacatatagatataactatatattctaatatatatcaaaagatacggatcaaagcggatattcgattttaaaaaagacaatatttgctatttgattcggtttttacgaatactacattttcatatttgctttggtccaaaatcttacggatattcggattttttgaatcaaatcaaatcgaataccgaatcgaagcggatcgaacgaatattttacccagccccaataaaggctataacacaccttgagaaagttcaaattcctcaagacatagaaagtagctaaaatattcaagaaacgtctccaacaaaagcccaaatattaacaactggaaatataaaaggttgtctacaaaaagctagccagcaatttttcaatgaattaagtacccgttaagttgattttttcacatattttgattcatttacacttttttgttgttgtcttatagaaagtaaagtatccgattcatttagacttttaagtgtccatatatatatggtgtgagatctcacaattcaaaaaaaacttattattgaagtgaaagatggtaagaactttaacaaaaaaaaaaagaaaaaaaaaaaaagatcgtaccttagtgacttgggtggggtgacatacgcagggaagcctaacagtcaagctccttatcgcgaaaggcccattaccttccaaagacaaattctggatcagatgaccattatatatacgagcttatttggaagaaaatcttcattcaacaacccatctattaatttccacctattatttaaaagagagatgagaaatgacgtaaaaaaaaaaaaaaaaacgtttttctagctctagaaatttatagatgggttgttgaatgaagatttatcattttatgtattcgatactatgttaaataaatttctttaatcgagtttgttttcatgcatgttctattaacaagtatgtagatcttggaaaaagaaaatattttgatcttgataaaattctttttcaaatctcgattagtttattgtttttccgaattttgcatttatactatttatgtgatgttcgtttgttagtcgttggcgaccgcgaccaaatgttgttcgtatggaagtcgctggatatagcgacctgcgattataatttttggtcgctatttatctttacgactgattataaaacgcgatgtctgaattcagtaaactcggcgacggtattgttttacattcttttacattttaaaactctattatttacattctctattaattataatgatgctcactaatataaagttttaaaatgtgatcaattgtttcaaactgcatttgtcttaacaaaattcaaaaaaaaaatataaattttttgaaataaatgttttataaatatcaaaaggtaaagctacactaatcttttgcattgtattcgagtaatataaatcgaaatgaccaaagtctctaaagaatgaataaggatcaaatttcaaagaaaagtgaagagtaatcgtcaactacaagaatcttatcctatgcgtactctttccttatgagtgacacaatagaaaacaaacccaactgattgatccttgtgaataagataaagtcccaatcaacctcttacttatcctgcgcatatgcactgtcctctatactatcatgcgcatatacaaatgtccattcttatcatgcgcatatacaaatgtccattcttatcatgcgcacctcaacttaataccaaacaaaaaaaaaagtttcacaaaactccaaaaggtaaagaatctgacccattcacatatgcgtttcaaaaacactatcatgtccaccacacgattaaaccaaagagaagagagagagagagagaaacagagaagaaaagattgaagcaatcgaatg

SEQ ID NO: 14546 - DNA, 3000 bp, Unknown
  misc_feature (1)..( 3000): cDNA_ID_3017938_gDNA_ID_2684130_Annot_ID_191207 3000 nt of promoter + ATG
agatattccgtaacagaatcacaaattgttaacggagaatgatatttacccgaaaactatatctgactcggctagtgatccgttatggagtttgagatgaaacttatctttggtgagaactcccatggagtagctatgatcagcatattcaatctcgtagtcacattgatgacaattttcacaatgttctgtcagttgattcctttggacttctacacaaaaggcctctgaagatctcactaagttatcttttctaggcttatatagttgatttgctccctaaaaccaaaatccagaaagttcatcactaaattcacagagagattctcctaaaatctaaaaaaacttgatctttattctttaccttagcacaactagtacaaggagcatcacattggatccaagtcaattcacttcccgtatcaatatcaagatgatagtattgtccatcttcaggctttccaacaagaatgcgtgtataatacagcctgcaacaaaagcaaaaaaagacaatctttgtttacttgtgctttaagaaacaaaccacacattcagattacagagtattagatacaatgcatacatacccatctggatacacattaccaccgacgggaaaaatcgtagtggaggagtcaatagaaccggcacttgtagataaaacatcgttgacttttacagggttgaccagctctaaatccattgattccacaaagttttcattctctaaacctaaatcttcctctaagatccgctcgtggaactctcgagctctcaatttgtgatatacagggaaaacaaacgacgccgtttcacggagattatcgtcgtcgtcacggttcctctcatcaggagaaaccctaaacatttgaacagagttgggaaaaacagaggcgtagaaagcaaccgcgagaagcgagattccgagaagacccagaactaatctcggcgaattcattgagagatccgagaacaagaggcgagattgttggtttcggtgaagtgggtcgggttgaaaactcgggtttgggttatcctcgggtgggatttcgagtgggtaatcgtggtcagtgagagtgaaagcagagattgttttgccttgtgaaggatcatcagatggtgggagagtgattatgactacgctgtggactcgttgttgttgttgctggtcatgaagatctggttccattctgtgatgtctccgatcgaattgggctggttttgatcggagagagaatggaaacaggacgagaaagaaaaatggcagactaggagtggtcaagagtcaagaggctttcgttatacgagacggaagctgcgaggaaggagagggttattttatttgaagtaaatgtttgaaaaatatgaattacacttaccaaaaaaaaaaaaaaaaaaaaatgaattttacttacacataaaattcatttttattaaaccctccctataaatgttctttttaaaaaaaaaagtatatatggaggacaataaaaatagcttttagtaaaaaactttaatagttttaacaaattttataatttcttgctttacatttatttttcctttttcctgtcaatttgatttcttttatttaactcaataaaaatatatgatacaactttaatttacatgataaaaatttagaaataaataaatatgtaatcataaaataactatacaacatacatttcaaaaacattatgtcaaacaagatatgttaggaaaaacaaaattttttacatgctatacaaaaatatatataaattagaaaagaaacataaaataaaacttgtgtgttcatgtatttattaactattgtaatgttaattttatgtgtgttaaatttctaaatataatattattgctgtataaaattgtttttaaatgtaatgtttttttattttaataatttcaattttgatgttaatgtatttaaatttatatgaatataattgaaataattgaatttaatagaattattgtgagatatatgcaagctataaggactcaatgaaaatatgtgaaagattttaagggtgttatgcaccctcaaaaataaaggttttaaggtttgttggagttaaaaaacttcaaaatttaaaagtttgaggtttgatggagatgttctaatcctctcgtttttttctcttcgatatatgaactgaaaaagtatgaggaccccgaaaaaatcttggactttctttcttgtcatataatataaacaacaacctgcattactatttactagtttgaagaatatctgagatgtagtatttatactatggggttaatgctaataaagagatggatcagtggcaagagcaaagaagcaccacccttgtagtttcaaatatttgttgagttttgctttataatttggtcatcttagtaacaaataaaattgaatatcagaattcaaaagttaagaaaaacatattaattgacgaaaataatatatatatatatatatatatatatattaattagttcgtaaagttccaaaaaataactgtaaaaacaagaaattaagaagataaagtataaaagaccgaaatgggtgcaattttagttagttttagagtttggttattggttttactattttttcagttttaatttttgttatatattaaaagcttaaataaaattaaacatatgaacacatttaaaaaaatgtaacctaaaaaataaagttaatagtattattattttttaactctaaaattaatattattagtttgctactttgcaaactttaaaataaaataaaatctacaaaaatttgattgttgtaatttgtgtgaaatggaaaacaaattgcgttcgacccgtaggattattttcccacgaacgacttggccaaaaaaacaaaggaggccgaattgaagcaactacttttctccatcatcatcaccatcggcgaaatccgccaaaaattgatctccatttggaaatccagatcatgctctagagccctagtttagatctcgaaggaagaca

SEQ ID NO: 14547 - DNA, 3000 bp, Unknown
  misc_feature (1)..( 3000): cDNA_ID_3017954_gDNA_ID_2684130_Annot_ID_191202 3000 nt of promoter + ATG
ttcatcttggtttgtttctgattgaggaaactcaacaacagtaaaaagttcaatagcattgatgagaggaggaagagttgactttgttgtcttcactagctgcaagaggcaacttcctcctttacatgtcaatgtcgaatcgggttgggggctcatagtatctatacttaacattttaggactataaggtccataataaacttttccattcagcaaaacattgaattctctagtctcgttggctaacaaagtttgaagctctgcgaagtgaaggtaaatgtgaaaccgtgtggtagaatcctctaagctccatggaaattcccatgtcccattatcattaacacgggttgcagccgatgccattgcaccttgtggtagatcaaaaccatttgaagtgtttacattgagagttgtggttacaattttccactccttatatgagaatgggaaccatctacggtcgttgacatcatcggggtacctatacgtatcttgtattagacatagctagacaaaacctcaaagatgtttggcatcaaagaaagattaaaaatatttttatatttactcattatcttttataccaagatccaagaaaaagattcatttcacaaattaaagtttacgtaccgtaaaacgacacctgaatcattaagataacctctaaaatagaggagcaaggagctcccaatggcactaatgtaagtatcacttctcaaaggtcgtagctccaaggttgatatcatcggtgtagttgttcctgtcttaacaagacaaatatccaaaggggttgaccttgacatgtgaattatctccacgaacacaccacctccggttgcattaaaattcactgttgtcaccttattagggccaataaatagatcaaagtttgggacagtattaagaccatcgtaatttccatataagaaagctgctctaatcaagtaatttgttccttgtgtgacattcaggttataacagttccgctctccatctggaaagtatcttagagttacaaaagctttttcgaagtttcgctcagagtccttactgactcggccattctttccactctcgatgaaactagaatccgaagtgaatgttaatccagtagatggattggtatatggagatccatcaggtaacagaccacaatccaaagtgatgaatcctaataaaacattaaaccaaaacaaaaatcctaataaggggatcaatgtaaaggaattatcagaaaaggaaaaaacaaattaagaaaaagaacatgaagagtgtttcttaatttcaaaggtttaaagataataccgtttggatcttgagcctgaacaacatgtataaaagcaactgtgatgatgaacacacataaaactccatgaaaatacttctccatttttcctatttctggaggataacacgacccttgacatctttttaagttccaaaatattattttatatcacgttctgatcaagtggatactagttaaagaaacgaaacccatatattgtcaacggccaaaataaaatactaatatgtctagaaaaccctgaactttctaacatttgcaatttcacaacattaactcaaaacattaaggcgccgttttctaacatttcaatacaaaattatttttcctttagcctaattagggtttttccctatgggaaactttggctataagtaagcgtcatttcaaagttctgttatccgactggttttatttcaaagagcttaactctaaaaatcgtataaagtttgttgttctctgtgccaaaagcaaaaagaatagtactccctaatagatgcttctaacaagttggtatagaaaattattcatttgtgtttggggacattaagttaagtgatcaactccatctcttcatatatagctgacccttaccttcatagttttcattcgatgaacatatatatatgcggataaggtaagttaatactgcgagtgattataattagttttaaagcatatggagaacatgtcaacgagagatatagaatgttattttgagacgtgtatccaactctaatgattctgattttttttatgaaaaagaaggttgaaaaccacccaattttcaaaaaaaaattttaaaaaagagaagttagaaaaaagatgatgatagttcacttgttccaactagagaggcaatctcccaaatggagatcaagatctatggatgcggtgtttggttacacggcaagaatactccatttagactctaaccacactggtcagacgtattagaaaatatgcaatccttgaacaacgtttaaaaaaataattgaattaatgctaacatttgatttagttctataaaaacagaggaattttcacacatgcagtttaaaattcctatatgataacaattaaatgtatcttttacttgcaatatacaatattttatttcatgatttggttttcgtctaggaagttttaaaacaaaaacaacatactattaattaatctctaatatattatgtaacatattaacgacactatgacaaagccctacaagccaggtttgcatcgtgtggctaatgaatctctttcagaagtcagctacactcaaaaatctgtttttatttcaaatgctatgctaaattataaaaacagcttatatatatacaaaaagctatattttttttaatacaatttagtaacattttatttttaaaatatactacagaattatatttaatccataaataacttaagtctaaactactcggttctttcgttttctttatgggaaaatgaaacagcgtgcttcttatccctcttgggaaaatgaagcagcgtacttattaaggcagcaactgaatagtctacttttttcacacactcgcctcaattcagtgtcattatataatttagtatcttcccatatacgcgatagcgtgttagccaaggcaaactcactagggatttgtcctctaagccacgagatgaatctccgtcaaatctacgaagtttaatggatg

SEQ ID NO: 14548 - DNA, 3000 bp, Unknown
  misc_feature (1)..( 3000): cDNA_ID_3434291_gDNA_ID_2684130_Annot_ID_191200 3000 nt of promoter + ATG
ttgttcacttcaggaagtctccggcagtatgtattttgctcatttttatactatcttgttatgtcgccgcgaaaatagcggttttggagttgtgtttaaagcagcgaaatcttggttttcttgaaggtaccgtaagaaacatagaaaggtgaatatgaaggctgtcaagtgttgggcgagacagattttaacgggattgaaatatctacatagtcaagatccgccgataatacaccgagatatcaaatgtgacaacatttttatcaacggtaatcatggagaagtgaaaataggagatcttggtttagctactgtcatggaacaagctaatgccaaaagtgtgattggtatgagcaatgctttttcttttatatagtttacaaattcgtttttctttgttttttttaggatctaaattgatagtgttatgttataaccaacaggaacaccggagtttatggcgcctgagctttacgatgagaactacaacgagctcgctgatatatattcgttcgggatgtgtatgttggaaatggtgacttttgaatatccttattgtgagtgtagaaactctgctcaaatctacaagaaagtttcatcggtaagttcgatattttcaaattgtttctaccattggttttatgatatcgaacaatatatgataatatgaatggataacttacttggtgagtcttttttttgtattctttacttaggggatcaaaccagcttcactatcaaaggttaaagatccagaggtaatgaaatttatcgagaaatgtttattgccagcttccgaaaggttatcggcagaggagcttttattggattcttttctcaatgtgaacggtttagttatgaacaatccattaccgcttcccgacattgtaatgccgaaagaaggatcattcggtgaacgttgtcttatgtctgaaggaccacctaatgctcggaatagaacgatgtcaatgaatcttgacgaagacaataaccttcctattgttatttcaagcaacaattcaggaacaaactgtattgaggttagacgggcaaagcgaggaaacttttttgtccttaaaggtgaagagaatgatgagaactctgtctcattaattcttcgtatagtcgatgaaaatggtaagagtcttttgcgtttatattttacaaaacatttcaccgaaaatgttagatgcatatacaatcagccaaaaattgcgtttggaaaattgcatattataccaaacttgattagttttgtcttctttttggcgtgtagggcgtgtgaggaacattcattttctattctttcaagaaggtgacactgcttctaatgtatctagtgagatggttgaacagcttgaattgacggataaaaacgtaaagtttatagcggaattgattgacgtgttactcgtcaatttgataccgaattggaaaaccgatgtagctgtcgatcatctaattcatccgcaacagaaccagagctccaaggataatcatcaaaacggtgcaagttctcaagctggtgaatccattagccactctttgtcctctgattattgcccacgatccgatgatgaggcaaacccgaccgtagctgcaacaacagaagatcaagaagcagagaaaccaggaagcttggaggaagaagaagaagatgagaggttaaaagaggagttagaaaagatagaagaacggttcagagaagagatgaaagagataacgaggaaaagagaagaagcaacaatggagaccaaaaatagatttttcgagaagaagatgcaacaagttgagtaaagtaaacaacagagcaacactctggttttggattcctctgttttgcttttctgtttttccatgttttattattttagttttggtcaaagagaaaaaagcttttgttgtttacttgtttcattgcaagtgtagaaagtttcctccataaaaaaaatagaaagtattttctaatggtaattgggatttacattatataaagcactaattgctgagataaaaccattcatcaggtatatatgtaaaactattctcgagataaaacaagaaagtgaatacacaattttcttgcctctattcataagaaataaacctgttttcattgtgtttatttaacaccaaaagcactcaaaattgaggcttaacattcagacaaaccgtaactatagaacataagaaaaacctaactattgaagaggttgcattatatcacaagtttaaaacaccaaagctcaagctgagtagcaaaaataggtctcttcttccgccaccaaaacctcaacaggaacgtctacaaaagccttgaccgccacaacgaccaccggaaaaacgaccaccgacgaaaagaccacgaccaccaccaggaccaaagacaggagtaccaaaacggctataaggttcctcatcagaagatgatccatccacagacatgctctctgcctgggctttacagagccaattttaacttcattatttgacctaaacaatgagatcaacagatccatcttctcttccattttatgaagacgaataccaaatccttccaacatctccatcgcatcagatattttcatctcagtcgtcatgtctttcttatctttctccaaattgtctgtaggcgtcgtgtccttaatcacagaaggagatgcttcagctttggttgcggatttattgtccatggagaagatgattagtagaacaacgcactagagctaggttaaaagagagaaattggagatcggcaaaaacccctaatcagctgcttaggaagaaaggtatttataagagtcttttatattctggcttggggcacaagagtcctttccttttattttatttacttttcccgttgttcattttttcaactaagcaagctttatctgggccgaggtgaggcccattaattgaattaaaagcccaaaataacaacaaaacattacctgattgtcggaaaatcagacggaaacaaaagaaatcaaaaatccg

SEQ ID NO: 14549 - DNA, 3000 bp, Unknown
  misc_feature (1)..( 3000): cDNA_ID_3017970_gDNA_ID_2684130_Annot_ID_191197 3000 nt of promoter + ATG
ttgatgattacatagcgaaatcgaagctcagtgagagtttaacctctacggtttggttagcgaagcacaagttaaccggcgaagaagcagtgatgaagtgtttcgacctctcgaagctcaatcgcaatctccgagactgtttaaacaacgaactggagtttctatcttctgttgatcatcccaatatcattcgtctcctccatgtttctcaagtactaacccaaaactgagtttttcaatatttcttgagtctatgaagaatatgattgatttgttttcttcaattttgcaggatgatgattttctcgttatggttttggaatattgtgatggaggaactttatcatcgtatattcaacgttatggtagagttgaagaagatatcgccaagagatttatgaagcaaattggtatctattgttatataggagaatgatttcactgcatttgcttcttcttgacttaatagtgtcatcaatgttttgatgaaggagctggtttggaaattattcatgataatcacattatccatagagacttgaaacctgaggtacttctagaattatagatactctggattcaagtttggttgtgaattgtgacaatagtatttgattggaacagaatattttaattgacggatctggtgatgatttggtgttgaagattgccgattttagtcttgcaaggtaaagttttttgaggaggaaagacatgcttatagtataaagatctttatatgtttcatgttcgtaagcagaaaactacatccgggcaagtatcttgaaacagtgtgtggttctccgttttacatggctcctgaagttcttcagtttcagagatacaatgaaaaggtgtgatattgtttttatgcagctccattgaatgataaggttttccagttttaaattcactgagaaacattgcaggctgatatgtggagtgtaggagcaatccttttcgagctacttcacgggtatccaccattccgtggtaataacaatgttcaggtgagatcttgaattagttagtagtattcttttatcaaaaagctccaatgcctttaacttaaaaaccttttaccactaaccataggttctaaggaacatcaaatctagtacagctcttccattctctcggcttattcttcaacagatgcatcctgattgcatcgacgtctgctcaagattgctttctattaacccaggtacagaaaaatctcatctgtttgcggctacactatgtacacatatcgctatatatattcagttcttggttaccattttctgcagttactcgtctctctttcgatgaattctacaaacacaagttcttgaggctatgattgatttgtccttgaggtaaaaagatgaagtcgtcttaaaacttctgttgaatccttgtatagattctcgtgcctgtatccatgtatataatttagttgaagcatgcattatatttgtatttcagctgagctagactgacatttaacctagcaaatatgtttttgattctcagagagctgccacactgggcatagaagattttccttttcttggccgtataaagaacagtagggtttgggtcaaggacacaacattttcttcaaggtatcttgaaatttatgtttccattatatccatagaagtggtggctcatatctaaattatactgcctttttttttttttttttctttcagatttgcggatctagttaattgattgtattattcatcagtattgggatacatccaataatattgagtcgtcttgtttcagacaacatggaacaagggaaagaaaagtggctacaattaacggaagacttcaatttgacctttcacaggttttttttgtccctaaccagtttaaatattgttggagtcatcattatattagatgctttattttcaaattaattgcaaaaccatcagccttcttcttcttttatatttttaggcaatgctaagagatcaatagttaagttcatactattgagtgtagaagattatagtttacaccattatgtttccatggtttctcagaattttgattttgttctattggtcacttctttcttgcagtaattgttctgtttctatttggtttcaactgttctttttctctgtttctagtccagtattagaatcttataaaaagataaaaacttaaattgcattcgtatttgctgttacaggatgcatacctcccacagaggcttcttgaaaacctgatgtatatttacaatactattgaaatggctcgtgtaactggagtccctacctcctaccttatttcaagaggagagagcatcaaggtaggtttcactaaattctgtcgcagcacactttctttgactaaggctgtctgagaagttatatatcttgggtctaggttctatctcaactacttaggaaagctaaacagaaaacctggttcttccaaatgctgagaagttggaacctgaacaaggaacttatgaaggtgcaactgtacgttggtggttttatatcccctacttacagttttacttattcttcgatcacttctaatattttgataaacatctccaatgatatatattcacactgttaacttcaaaatggtaaatcaggttttagaagcaagaactggtttctacgagccaattgctactctggattttgcttcgttgtactcgtaaatcatgatagcatataatctatggtactgcagcttagtattccatcaaacgcttttttttcttcttatatttattttccaacgtttgttgatgttatccatctattgttcaaagagcttattactgccatcttctcgtctttgaaggtgaaacctgaggatgcaaaaaaataaattcgacttacaccaaaattatgctaatcttaagaattattcactttttcattccaaagcccaaaccaaacccaaaagggccttttatcaaaagcctatttacaacatataaacccaaaaaggcctttcgtcgagaaaactaaa

SEQ ID NO: 14550 - DNA, 3000 bp, Unknown
  misc_feature (1)..( 3000): cDNA_ID_3017966_gDNA_ID_2684130_Annot_ID_191198 3000 nt of promoter + ATG
ctccaatgatatatattcacactgttaacttcaaaatggtaaatcaggttttagaagcaagaactggtttctacgagccaattgctactctggattttgcttcgttgtactcgtaaatcatgatagcatataatctatggtactgcagcttagtattccatcaaacgcttttttttcttcttatatttattttccaacgtttgttgatgttatccatctattgttcaaagagcttattactgccatcttctcgtctttgaaggtgaaacctgaggatgcaaaaaaataaattcgacttacaccaaaattatgctaatcttaagaattattcactttttcattccaaagcccaaaccaaacccaaaagggccttttatcaaaagcctatttacaacatataaacccaaaaaggcctttcgtcgagaaaactaaaatggctccgacgaagaaaggaaagaagaccaaatcggcggcggaatcaacgacggtcacagaatcttcaagctttccgacgtgtttgcgtctccttacaccttcctccgtcgctatcaccatccatgcgaagccaggttccaaagccgcctccatcaccggtatatctcctcttccattcatcggttttgattttgtgtaaagtctcggattttattgattttggtttcctctctatgatctggagatgtgagcgacgaagcggtaggcgttcaaatcgacgcgccggctagagatggtgaagctaacgcagctcttctcgagtacatgagctctgtaaagtttctctttcttcgcagataaattttcacttttcaagttctttgaaattgtttatactctgttttgctctcatatctggatttggttctcagatagtttgataatgtcatgtagaattgtgtctctgtaatctttgatgaatttgattagctcttgttgagccactagtcataaaaaatatgcacttgtgagcttccgtggactaaaggaatcaaaccttaacttggaggatctttgttaagatatatgtaacatagttgttgctctgatttggattgctatggtttatatgctgctttaagtagtgagaattgtttgctgctgattttgagagataagattaagagatgaattctatcatcatattcatatcctgacttctaaaatgttatctttgataggtattgggggtgaaaagaagacaagtctctctcggttcgggatcgaagtctcgagataaagttgtgattgttgaggatatgacccaacagagtgtttttcaagctttgtcccaagcatcaaaacctacctaaagatctccaagcctgtaactaactatatggagaaactaaatcatcaaaagctaaatggttcatgttcacttaaggtacgaatggtttgaagagtttcaggatttgtgatagagatcattggtctgatattactatgagtccatgattaatgtcatgtaaatctatagactattgcttattatataacaaagctgtgtttagtctagtccccaattgatctgaagtcatggatggttttttgatgtgtttgttaatccttattttcatgtaaagtatttaggatggttttcttttctctcttgatccttatttgtctttgtatatttcaaccgtttttgacttttgaaccaatcaaaagagaagaaacaataatgggccaaaagaagataaaaatgggctatggagaatcacaagtccaatttctctgctcacaacttgaacaacaatattttttttttcctaaaaaacttgtacaacaaacttaaaaaacaataatatgagaattggaacaaaatccttttaagtttgtaagtctaatttcaagaaccaaaatacaaaagtaatatcaatttctcaatacagttataaaactacttgatttgtggattttatacgttttaaataataatggttggatattccttacgatttttttaattgattagttatgcgacgacccgtgccatgcaggttgaagtcactttcaatgatcgttgtctcataaattacaaagaacacagctattttgtttctatttcataatgaaaagcgaatatttgtctgttcagataccgatcaggtaagcgatgcttaaagccaccaaaagggattctaaagtaatcaatgatttgattaagaaaaaagtcagaaaacaatatccatttgagtatttccatgtcaccaattggtttataacttccaatgatcacatgccgcttgtaatatacatcacctaaccaagcgatcgactccaaaaacgaaaccgtatttattattatcttaagactatagtctatacaatatacattacataatcaagatgcccaattagatgttttaaaacaacaaaaagatcaataggcccaattatatcttatcttaataaaatgaaaaagcaattgcatgaggaattatggatatatataaattacatgggctaggttttttttatatacatataaatagtttggagagataaatcaggtggaaccaagtttgttgtttgtgtttcgattgaacaacactttaattatttaatctttccattgtctttgcgtcttcttcgatcaatttatcaaattagggttccaaccttttttcttttttttccccgttgtgtgttaagtcggcggaaaaacttagaacagaacaaaccatcatttttccaggtaaattatattctaatctcatgttcttgttaatatctgatttttgatgatcttcctatgcatgtttgtcattgcgtctttctcttacgtgatagatgttcgttgacgcgatttgaggtttatttaggttccttaatagatttaacaaaaagaaattctcggtcaataatatttatttgagctgatcaatcatttgctggagttagtttgtgttgtcgtcttcatatgaatctaaagggtatatatatgttttgcattctttgttatagaaatttgaagaatagataaaaaaagattaataagat

SEQ ID NO: 14551 - DNA, 1458 bp, Unknown
  misc_feature (1)..( 1458): cDNA_ID_2730213_gDNA_ID_2684202_Annot_ID_137207 3000 nt of promoter + ATG
gaattccgctgtgatggaaaatgttggcaagtttgatggcacggaggatggtttgcaagtgactctattggaagtgcatcatgtgggtcgggttaggtatatattggcgacagatcttagcggaaagcttacggttttcactgagaacagaacggtttatggctctgttagcccaacgagtagaccgcttgtgttcttgaagcagaggcttttgtttctcactgagactggtgctggttcattggacttaagaagcatgaagatcagggaatctgagtgtgaaggtcttaaccattctctagcaagaagttatgtttttgatgcgtccgaacgggctaaagcttatggattcacatccgaaggcgaaatcattcacgtgttgcttctcggagacattatgaacttcaaatgtagagtgagatcaaagaagaaggtacaaatggaggagcctgtagcgttacaagccatcaaaggctatctacttatagtcaaccaagagaaagtctttgtatacaatgtatcgactcaacactacgtccgaaccacgggtcctcggcttctttttccggctgcattagaagatatcaggtcaacgttcttgagccatcgagaatcaactaaaaccacagatcaccagaagctagaaaaggtaactcctttaatagcaagcgaccgcgaaaagctgcttgtgatgggtttaggagacggatacgtagctacatacaaatcaaagcttccaatctccaaagcagaattcaacacaatgctttggagcagtcctgtcttcttcttcatacttttcttattcggcgcttggcattttttctctaagaagaaagaatctctcacagcttggggacctgacgatcctttctcctccacgacaatgtcttcttcttctacaacaactgcacaaaatagttccgcattctctgaatcaactaggagaaacgacgaccacatggatcttcggagaagatacgtttcgccatctcggtatcctcctggagcagcaacaggtgcttaccgttcagtagggtctaacgacccgagctcaagagctccagtggaaactactaactacagaacaaccgcacaggagatgaagtatcgtggtgggtcaggtcttgattctggcggatttggtaaaagaagagagagtttgtttggtaataacaaagctttagacgacgaaagttagttcctttttttttcatagttcgttatgttctttttttaccggtcaacgcttgaaaattttctaatgtgtaaaactccggcgaagaaataaaatttttaccggttgctttgtttcttctccggtcacttattgttagtttaatgcttcttaactgtaattttcacaatctcaagattaagaacagattaaaaaaaattcaagatcaaataaatgaaactgaaccagagagagacttgaggttaacacgtcaagatatg

SEQ ID NO: 14552 - DNA, 3000 bp, Unknown
  misc_feature (1)..( 3000): cDNA_ID_1695701_gDNA_ID_2684202_Annot_ID_137208 3000 nt of promoter + ATG
tcacgtgtctacgggaagacgttcctctactggttcgggtcgaaacctgtggtggctacgtcggatccaagactaatccgggaagctttgacgacgggtgggtcgtttgaccgaattgggcataaccctttgtctaagctgctttatgctcaaggtcttcctggtcttagaggtgatcaatgggctttccatagaagaatcgccaaacaagcttttacaatggagaaactcaaggtaacactaacacacatcaatgtagaagctaagatctgtaattcagacaacattgtgctatttggaatctcagtctagtttagtttaaaaattaccaaatccggagtgctttataggattgtggctaaagctaagatctttttttcttttatagaggtgggtgccacaaatggtaacaagtactatgatgttgatggagaagtgggaagatatgagaaacggaggagaagagattgagttagaggtacacaaagagatgcacaatttgtctgcagaaatgttatcaagaacagcttttgggaacagcgtggaagaagggaaaggaatctttgaattgcaggagcgtatgatgcgtcttttttatctggttcgatggagcgtttatatcccaggattcaggtaagtcttatgggaaattttcctagttttgagaacaagtttggaactagaaccttattgctcactttttgagttttgaatggtggttttagattctttccttcgaagacgaatagagagatatggagaattgagaagcaaatccgtgtttctatcttgaaactgatcgaaaacaataaaacagctgttgagaaatcaggaactctgcttcaggcttttatgtctccttacacaaatcagaatggtcaagaagagaagcttgggatagaagaagttacagatgaatgcaaaacgttctactttgcagctaaggaaacaactgctaaccttatgacgtttgttttagtcctcttagctatgaaccaagaatggcaaaacattgctcgggaagaagtcatatgcgttctcggacaaaccgggcttcctactctagacatcttacaagacctcaagactgtaagtcctcaagccccactcaaaaatggtttcaggaaacactgtttcttagcaatttcttgtttttgttaacagctaagtatgataatcaatgagactctccggctctaccctccagcaatgacattaaaccgtgacactcttaaaagagctaagctaggagaccttgacatccctgcaggaactcaactctatttatcagtagtcgcgatgcaccacgataaagaaacatggggagacgacgcagaggagtttaatccgcgtaggtttgaagatcctaagaaacaatcagctctgcttgtaccgtttgggttagggcctaggacttgtgtgggacagaatcttgctgtgaatgaggctaaaactgttctggctacgatcttgaagtattacagtttcaggttgtctccaagttatgctcatgctcctgttttatttgtgacgttgcagcctcaaaatggtgctcatcttctctttactaggatatcaagttaaaaaataccaagattggctggtattatggtttccggttttctccggttttaatgtaattcggttcggtatttgaatgaaaaggctaaaatggtcaaagcaaacaattatttttatattatcaaaccctgttatcttcttcctccactctctcagctctcatgagtctgcaactcctaaatcactgattttgtgttcatatattgggcgggaaacaaactgattcatttccccctttaattcccttttcttgttcttgtaatctgagatatactgtaattggaaaaagtcggataggaaagataagcatcaacggaaatacgcgctcaaggtgttcgacgaaattccgcacagagacaataactctataagagatgccactagaaccgattcgattcttgagaaccaccgcaggcgttgctgttggtgggtttgtgataataaccgcggtttcttcagcagctttaggagcatttcgatatacaattgaagagaaacggaagaaaagcggaatggcttgtagagtgtgtcgtggaaaagggttttacatatgcaaattatgcaaaggaaacgcaacgattaaatggtcaccattgtatgatcccgtttgtatcaatccatgtctttgccctacttgcgatggtcacaggttttttttcctccttttaactcttaatcagagaacaaaactctgagaagacatttggatatggtatctaataattttcttttagactaaaatttggaaactttgttttaacattgcagggtacaaaaatgtctcaactgcttaggaaaggagtactggtagactccttaggtttatgatttgatcatctttatgcttctgagaactcgaaaacggtttggtttttgtatacagcttttactaatattaaaccctagaataagctcttttattcctttataaatttcctatttttataaaggggacacctaaaatatctcataaatgtttgggaaacgttctccatcacgttttttgcttgccgtccctctgtttcatgaaacgtttagaggatgtttccctgttgtccccgtgaagtaccagcccccatcacgtttcaggtacgtgagacgcgtgcatcataggttaatagtgttgaatggtgtggatttgaggggaatataataaataatcggtcctgctttgtaataaatatggttgtgctgagttcggtaattctgcctaaacctctctacctagttagatgttattgttaatatggcctttgaccaagaacaacttcagccgtgttaaaaaacattgaaaccaaaatcaatggttatataagattaacttgcactactaggatttgatcacagaagaaagaaaggggtttattaatttggttactgtatcttactctttttactttcggataacttcaattggca

SEQ ID NO: 14553 - DNA, 3000 bp, Unknown
  misc_feature (1)..( 3000): cDNA_ID_2730206_gDNA_ID_2684202_Annot_ID_137210 3000 nt of promoter + ATG
atagccgaatctagaaatacttggcgggagatggaattgattggggcgaacaagcacattatatttttaagggtttccttcgacttctcttttatattttagggctaaacgaaagctctgattccttaaggccgtcagccaccgccgaagaggagcttcgttggtctcttaagaaagaaaagaaggggagaatatggcttatcaagaagcaatgaagcccaatcccacgaaggctggtttggaagaagtgatggcatctctgacatcagttcgatacttgtaaaaagtgtgaagctatccaaatccattacaaaactgtttcattacggcgatttttggagatagcttttctcgttttttgcatgttgatctgactgatctcagatatctcatcggaaccgtagtaaatacatcatcatctacttgcaagaagtgcatttatcctgtttgtatgaatccatgtctttcccctacttgtgatggtgtctagctcaacttaattactctttagccttaataatgaacagtcttatcgatcctgcttaattaaatattgaatggaagtttggtttgtggtaggttcggcaaattttgcctaactagtacataaatgattgatcaagtccactctttatagactgtagtatataaattattataattttgttaaccttgtaacatgattttaaaaattagaacccacttatttatttctctatcaggatggtatgttaatagaatgaactatagaacagatcaacagacagtaaatgaaacttaaagaaaaaaatacaaatggctcatataaaatgaacttgcagaaatacagtttgatcacagaataagagagggtttatcaatttggcttctgcgtcatttcggcaatggcgggtcgcagagacaggatccaacagctccgtggatctcgaattgcgattgccatctttgtcggaattcttatcggctgtgtctgttccgtcttgttcccgaacggcttctttaactcgggatcatccttgattgctaacgaagaacgcatttcgaaatcaacctctacggtactgagagagatcttatgctttaaacatctacaaattcctttttttagaaatttttctgtaatctcgagctctcgatttgtgattagaattagtgtttgttggaatttgagaatttgagtctcttgcgtttgttatgaagattcaaaatcttcatggatttttgagtagaactacaaattgcatgtcttgaacatttgagtttaactggtgaagtttcattttttttctctgttttttgaattgttcaggatggattggcttcatgtgaatcatctgaacgagtcaaaatgctcaaatcagacttttcaattatctcggtaaagaacgcagagttaaggaagcaggtaagagaactaacggagaaggtacggttggcggaacaggaaacagagaatgcaaggaaacaagtcttagttttgggatcagagataaaggcagggccttttggtactgtcaagagtctgagaactaatccaactgttgttcctgatgagtctgttaacccgagattagctaagcttttagagaaagtagctgtcaataaagagatcattgtggttcttgcaaattcaaatgtgaaaccaatgttggagttgcagattgctagtgtaaagagagttggtattcaaaactacctcattgtcgcgttggatgattccatggaaagtttctgcgaatcgaaggaggttgtgttttacaagcgagatccagataaagcagtggacatggttggaaaaagcggaggtaatcacgctgtttccggactgaagttccgcgtcttaagagagttcttgcagcttggttacagtgttcttctatcggatgtggacattgtcttcttgcagaatccttttagtcatttacacagagactctgatgttgagtcaatgagtgatggtcacgacaataacacggcttatggcttcaacgatgtgtttgatgaaccatcaatgggatgggctaggtatgcacacacaatgaggatatgggttttcaattcagggtttttctatctaagaccaactattccttcaatagacctactcgatcgtgtggcagatacactctctaagtcagaggcatgggaccaagcggttttcaacgagcaactcttttacccttcgcatccagggtacactggcttacacgcttccaagagagtcatggatatgtacgagttcatgaacagtaaggtactcttcaaaacagtgagaaagaatcaagaactgaagaagttgaagccagtgattgtgcatctcaattaccatccagataaactcgaacgaatgcacgctgtggtagagttctacgttaatggcaaacaagatgcgttggatagctttcccgatggttcagattgataaaagagatggatgcttgttaagcaagatatcgaaaaacccaatcatcttcttcttcctcgagttaagaaaaaaggtaggctaagtttcatcttcccacatctgttgttataatcagttatccttttaggttcctagttcttcttctctactaagaatcttgtgtagcctatagctgaaaaactcaagagtcttattaacaatactgtattgttgaccacagtttcttatttagtcagaaaagtctctctttttttaactatgcattatttcctgaccacaaaaaaaaattatgagagagacaacaaacgagagattaggcaagaaagagagatatggaagaacaaggaagacaaagagagtgtaagagttttggatgtatgtgggttttatccacaaacaagactctttaagattcttctctctgtaatgaccggaaaatcccatttttttgtggtttcaaatcaaatggaaccccactcttacctctgtctttgtctttttcttaaagccttttgtttcagcctctgtatgtatctccctctccggagcaattgcaaattctgtgtctttgtgct

SEQ ID NO: 14554 - DNA, 1458 bp, Unknown; identical to SEQ ID NO: 14551
  misc_feature (1)..( 1458): cDNA_ID_2730213_gDNA_ID_2684202_Annot_ID_191230 3000 nt of promoter + ATG

SEQ ID NO: 14555 - DNA, 3000 bp, Unknown
  misc_feature (1)..( 3000): cDNA_ID_4262308_gDNA_ID_2684202_Annot_ID_137215 3000 nt of promoter + ATG
tgacgcctccggtcacggtacctgcgtcaccggagactgcggcggcgttttaaaatgtaccggcggcggagttcctccagcgactctagcggaattcaccgtgggatcaagcaatgccggcatggatttctacgacgtgagcctcgtcgacggttacaatgtaaagatggggataaaaccacagggaggattcggaaattgcaaatacgcaggctgcgtctcggacatcaacgagatttgccctagcgagcttaggatcatggatccgaattcgggaagtgtcgcggcgtgtaagagcgcttgcgcggcgtttagttcgccggaattttgctgtactggtgctcacgcgacgccgcaaacttgttctccgacgtattactcgtccatgtttaagaacgcttgtcctagcgcttatagttacgcttacgacgacgcatcgagcactttcacttgtaccggatctaactacttgatcactttctgccctacccagtcttaaaaccggagctccggtttagatttgggttgggtttctctctctcacgtttcttttgcttgttatgtacggaaagagaaataaagaaagatatgataaggaaaagcgactatgatccatttttaaagattttttccagtgttctgttgttacacacacacacacccatctcatttgcaaatttgcaatgttgctttgattagcacaatagtatattgagactaacatatcaatatctggattactaaagacagatgaatgcttcattagggggttaataattgtgtgtttcaggtcattggttctcttcttcttgatatacttactaacatgagagagcaataaaaacttttagttcacccaaaagagacagagctaaatacattttcagccacggaatggttaaaatatgtgacccgcgcacagattcgataaagtctacaagacagcttgttaatttcttaaggagatcgtactaatgcagttaatatatcactagtgtttattgcttattttggtttccacttgtaagctttctttattcctgtggcagcctaaacgaatcctacaatagcctgaagctcatccattttctgtaaaccagagaatgtctcataattcacaccactgggcattgtcttgcaaatatggatagaccagtaaccctcattttgctaattagcaatgcatggatgtatgaaatgtttattgaatcaggttagatggttcaaagtaggttgtattgtcggtcttagtggaacttggttcgagatagacataagaaccattatatatttatctcggaggtgtattatattagaattagaatctcactctaaaagttcttggacggagctaaaataacatataagagacatgtgcaaatccattcaaaaccaataaactcttcaactgtattataaatcttacaactattaatgtctaattttagctattgccactacggtctaaaatcttcgaaaccgtgtggaccatataaccctgatgagtgggactaataagatttttaacattaccccttagaatagaaaggtcctatgctatgtattagtacaaggaaatttcagcagccacgtttttttaccacaccactgcttatactaattaggaggattacttagcttggtttaagggtttagtaagaaaagtccatcttcttcctctctgtacgccctttgaatctcatctcataaagagacaattctttctagctcccatcacccttttgctgattgctgattagttttcccttttcatatcagatattatatttcgagatttgacatatataatacaatgttttcgataaactacaaaaccaatttcgaaaaacatataagttttgctggaaaaagccgtcgttgatcaaagccacacgacaggttttatgcctaacaacgttgacccattaatgaaaggactcaaaagcaaccctcatagtcacggcaagattcaattacttttcctcggacccaaagttggttcaatttatgaaccagtttctacgtctaagtcagtcgtctcaccttataatctttaaagtctcccgctgcactaatcactccgtttcatcgttttatatatcacttgattttattttatttcataaaatatttttttttaaatacagatttttcttcaactatgttctagacttctagaagccataaaagattacaatattattaaaatgcgggacaaaactacataacgataccatttaacgtacgaaatatttctaatttacctattcgtttataaccagattttatacctgtttagatgtttactgttttaaaaactacacattcatggtcatggaggatatgatatctaaaaccttaggattcaagctttcgcgttcaagtagcaaatcaggcctcttatgtatgcatctgttccggtcttataatcgaggattcacaccaaattaaaaagcatcgatctattcgggtttcatacaatcatactcatgggttacaacagtcaacaaacacatctatctggtcatctggatctcaaactcgcacctcacaacacaatatctaaccgatccggatctcatattcaattcgtggatcacaattagacacatctaattggatctcatagtcgcggatcacaattaaattcatctatacagatatcatactcgcggaccacacatcacatgacataaaacatcacactgaaccctaaggtttagtgtagtgtgcatcagccatggccgagtcaaaatgttaagattttttttttaccatttatagtaaactaatggaagtaaaaaccagtaatgcaaagaaaattcagagaaccaaaggaaatatctatcaagacaccaaaaattctaattgattaatcatgacaacattacgtcgctacccctcgaaccaacatctataaatagaggatcggtgccattaacattcatcatcatcacccacagcacagagacacacacaaaaaacccataaaaaaatatg

SEQ ID NO: 14556 - DNA, 3000 bp, Unknown; identical to SEQ ID NO: 8771
  misc_feature (1)..( 3000): cDNA_ID_2730189_gDNA_ID_2684202_Annot_ID_137216 3000 nt of promoter + ATG

SEQ ID NO: 14557 - DNA, 3000 bp, Unknown; identical to SEQ ID NO: 8773
  misc_feature (1)..( 3000): cDNA_ID_2730172_gDNA_ID_2684202_Annot_ID_137223 3000 nt of promoter + ATG

SEQ ID NO: 14558 - DNA, 3000 bp, Unknown; identical to SEQ ID NO: 8775
  misc_feature (1)..( 3000): cDNA_ID_4266404_gDNA_ID_2684202_Annot_ID_137225 3000 nt of promoter + ATG

SEQ ID NO: 14559 - DNA, 3000 bp, Unknown; identical to SEQ ID NO: 8776
  misc_feature (1)..( 3000): cDNA_ID_1394832_gDNA_ID_2684202_Annot_ID_137227 3000 nt of promoter + ATG

SEQ ID NO: 14560 - DNA, 3000 bp, Unknown; identical to SEQ ID NO: 8791
  misc_feature (1)..( 3000): cDNA_ID_2037321_gDNA_ID_2684202_Annot_ID_137228 3000 nt of promoter + ATG

SEQ ID NO: 14561 - DNA, 3000 bp, Unknown; identical to SEQ ID NO: 8778
  misc_feature (1)..( 3000): cDNA_ID_1989792_gDNA_ID_2684202_Annot_ID_137231 3000 nt of promoter + ATG

SEQ ID NO: 14562 - DNA, 3000 bp, Unknown; identical to SEQ ID NO: 8791
  misc_feature (1)..( 3000): cDNA_ID_2037321_gDNA_ID_2684202_Annot_ID_191253 3000 nt of promoter + ATG

SEQ ID NO: 14563 - DNA, 3000 bp, Unknown; identical to SEQ ID NO: 8776
  misc_feature (1)..( 3000): cDNA_ID_1394832_gDNA_ID_2684202_Annot_ID_191252 3000 nt of promoter + ATG

SEQ ID NO: 14564 - DNA, 3000 bp, Unknown; identical to SEQ ID NO: 8793
  misc_feature (1)..( 3000): cDNA_ID_4266404_gDNA_ID_2684202_Annot_ID_191250 3000 nt of promoter + ATG

SEQ ID NO: 14565 - DNA, 3000 bp, Unknown; identical to SEQ ID NO: 8773
  misc_feature (1)..( 3000): cDNA_ID_2730172_gDNA_ID_2684202_Annot_ID_191248 3000 nt of promoter + ATG

SEQ ID NO: 14566 - DNA, 3000 bp, Unknown; identical to SEQ ID NO: 8772
  misc_feature (1)..( 3000): cDNA_ID_4266408_gDNA_ID_2684202_Annot_ID_191247 3000 nt of promoter + ATG

SEQ ID NO: 14567 - DNA, 3000 bp, Unknown; identical to SEQ ID NO: 8771
  misc_feature (1)..( 3000): cDNA_ID_2730189_gDNA_ID_2684202_Annot_ID_191242 3000 nt of promoter + ATG

SEQ ID NO: 14568 - DNA, 3000 bp, Unknown; identical to SEQ ID NO: 14555
  misc_feature (1)..( 3000): cDNA_ID_4262308_gDNA_ID_2684202_Annot_ID_191240 3000 nt of promoter + ATG

SEQ ID NO: 14569 - DNA, 3000 bp, Unknown; identical to SEQ ID NO: 14552
  misc_feature (1)..( 3000): cDNA_ID_1695701_gDNA_ID_2684202_Annot_ID_191232 3000 nt of promoter + ATG

SEQ ID NO: 14570 - DNA, 3000 bp, Unknown; identical to SEQ ID NO: 8781
  misc_feature (1)..( 3000): cDNA_ID_1989217_gDNA_ID_2684202_Annot_ID_191261 3000 nt of promoter + ATG

SEQ ID NO: 14571 - DNA, 3000 bp, Unknown; identical to SEQ ID NO: 8780
  misc_feature (1)..( 3000): cDNA_ID_2995025_gDNA_ID_2684202_Annot_ID_191260 3000 nt of promoter + ATG

SEQ ID NO: 14572 - DNA, 3000 bp, Unknown; identical to SEQ ID NO: 8778
  misc_feature (1)..( 3000): cDNA_ID_1989792_gDNA_ID_2684202_Annot_ID_191256 3000 nt of promoter + ATG

SEQ ID NO: 14573 - DNA, 3000 bp, Unknown; identical to SEQ ID NO: 8779
  misc_feature (1)..( 3000): cDNA_ID_1989218_gDNA_ID_2684202_Annot_ID_137234 3000 nt of promoter + ATG

SEQ ID NO: 14574 - DNA, 3000 bp, Unknown; identical to SEQ ID NO: 8780
  misc_feature (1)..( 3000): cDNA_ID_2995025_gDNA_ID_2684202_Annot_ID_137235 3000 nt of promoter + ATG

SEQ ID NO: 14575 - DNA, 3000 bp, Unknown; identical to SEQ ID NO: 8781
  misc_feature (1)..( 3000): cDNA_ID_1989217_gDNA_ID_2684202_Annot_ID_137236 3000 nt of promoter + ATG

SEQ ID NO: 14576 - DNA, 3000 bp, Unknown
  misc_feature (1)..( 3000): cDNA_ID_2730291_gDNA_ID_2684203_Annot_ID_137241 3000 nt of promoter + ATG
gtccggattgtcctgatgaaaatgtcctcctgtgtctcctactgcaaaacatactcctaattagggtggctctttgacgttttggtttcaatgatgaagagaagagcgagagatgcttacgttgaacgtggataaggacacattgtggagcatcagcaacaatattttcaacggcccatttcaaggcgtgttggctgttcttgtccttatcaatggcgatcgccgtgatactgccatagtcctccgaggtccttctaactcttcttgcagacatgttagaatcttgcttcccaagaaacatgaataacctgcttcacaaggaaactataatactcataaatgatctcatgtcttctttgtcacaaaacacccacaaccaagatcgattgtgttgtttttcttttgtctggctttgcaacctcagagaagaaacaatgaacaatgaaaagaaacagaaaattgtattgtgagatgatgaagcttttagtggttttacaatttttctaattttggagggtttatttctcaaacaactcaacagtcttgtgaaacaaacaaacaagaatggaaatttccacaagtctcaacttatctttaattagagagtgatttttgggaagttgctggtgagatctagtttgtactataatgtacgcgtttcgattaaaataaaattcgattatacattatcaaaatattaaatcgattattttatcttaatcagtaaaacaaagtttttagataaaaatattagtaaaactagtcaaacatatggtttagtcttttaggtttatatagactagaggttgaaccaaaaaagagagtaaaatagactagagaatagaatgttatgtttaaacatgatcacacatctcaatttacacacatttacttaatttgagtttcgataataatgcaacagcaatatatgtatctacgaatttgaaatttatgagtacaaaatctagaggtgtaacaaaatatttattattttcgtccctgatcaatcagagtagccacgtgggcgggtggtagaaatcgaaattattgcgattattgacttggaaaaaaacaaacacacgttgcattttttgatttacgtatccaaaaagaacaaagaaaaaaaggtaaacgaccaaataatataattttctggggctgtcgtcttccatctttatttcttcttggcgatatcaccatatcttatacgtctctcgaaagattattactcttaagacgattccattaaacactgattgtgagaacttgtactttaacgttatcgaaaagtatacataaatatttttatttttttaggctgattcattcttactgataacaataattttgtgttattctttcttacctagagagttctatagacaagttcgtaactataaaaccaatctttatttcttactcatagctttcaaaactaaaacttgatcagtttaaataaaatatatgggaaatttttgctgaaccaatatattacgtgtcaagatttcattgatcctattaatacaatttattcattttacagttatatcaaatacaaattacaactaagatactcacttatctacacgtcagattgtacaactaagatactcacttatctatatctaattttcgtggttaatattacatgtcaaaattttatggaaataattagtgtttttctactttatataaatttttatgatatattttttttttaaaaaaaggaaagagaaagaaatcaatttccatttgtaaacatatttttggttctgaaaataaataaatgggaaaaaaaggaattaaataacatctgttgttgttagctgatcgacaggtgttgcctgaagcgaccttaaaaaaagaaaaaggacaaaaagttgaagaaaaaaagaggacaaagttcacaaaatgatacaaagactaatacgtgtccttttattaatcctcttttgtaataaatactcttttttcctataaattatattacaaaaccaaagaaaaaaaggaataaaaaaaaacagagagaaaaagcaaaccacacaatattctcttctctctctctttgtttcgctgatagagagagcctctctctaagcaatttagctcgagcgagaaataatcctgagggaagaaaataaaaagaagaagaagaagaagaacatctttacttttgttctctctctctcttctgttcgattttaatttttttgcagatgcgaatatcttctaaagattcatcaactggttagttctttctctcttcttttttctttcctgatttttttatgttgtttttctgtgtagttagcttttcaatcggaagatttttgctattatgtgtcgaatctctcttgttgttttgagctttgtgtttagttttgcttaagaacaaagtttaaattcatctttctatttctgggtaaagctaaagcttcttttttaatttagatccaaggaaacccatgttctactatatgattatggacgttaatggttcgaattttttagggctttcttgtgattgatttcgctgattttccctcctttttctggtttttgtgtgaattttctttgacatgaccgtttggataatgattcgtgagtttttgattagtgctttgtgatctctcaatagggttgaaatcaagataaggatttgagaaaagatcgacgaagttgttgcgattttgggatcaagagagtgatataatcgagtgaggagaattcgtcgtatagattcgtcagatctggttatctccggtacttaattctccttgattcgtcgttttaactatgctaagttagtgtatgaataaagcggcatttgggtcgctgacaaaaacttatttggagcaaggattcttcaacatcatgaaaccattgcttagagtattcgaagaagaagatgaaaacaattgatttctcctaagtccatctttgaaatttaaagctttgttgtggtgtggtgtggaaatctctgattttggagagctcatg

SEQ ID NO: 14577 - DNA, 3000 bp, Unknown
  misc_feature (1)..( 3000): cDNA_ID_2730287_gDNA_ID_2684203_Annot_ID_137242 3000 nt of promoter + ATG
acaatacatcgtcttcatcaaaaacattggaagacccgcttctcgtatcggataaagttttcaacaaatcctgttcacctacctcttccagttcagaaacatcttccatagtgcattcagtccctccgttgcaaaagctttgattttcagaatcagataacaagtcagctgcatcagtaacgttctttagctgagtgatctcgacaggtgatgattcacacatggtgttggctgctaagctaagagtcattgcaactgcgggagtcatctcctccatgagctctccaaaatcagagatttccacaccacaccacaacaaagctttaaatttcaaagatggacttaggagaaatcaattgttttcatcttcttcttcgaatactctaagcaatggtttcatgatgttgaagaatccttgctccaaataagtttttgtcagcgacccaaatgccgctttattcatacactaacttagcatagttaaaacgacgaatcaaggagaattaagtaccggagataaccagatctgacgaatctatacgacgaattctcctcactcgattatatcactctcttgatcccaaaatcgcaacaacttcgtcgatcttttctcaaatccttatcttgatttcaaccctattgagagatcacaaagcactaatcaaaaactcacgaatcattatccaaacggtcatgtcaaagaaaattcacacaaaaaccagaaaaaggagggaaaatcagcgaaatcaatcacaagaaagccctaaaaaattcgaaccattaacgtccataatcatatagtagaacatgggtttccttggatctaaattaaaaaagaagctttagctttacccagaaatagaaagatgaatttaaactttgttcttaagcaaaactaaacacaaagctcaaaacaacaagagagattcgacacataatagcaaaaatcttccgattgaaaagctaactacacagaaaaacaacataaaaaaatcaggaaagaaaaaagaagagagaaagaactaaccagttgatgaatctttagaagatattcgcatctgcaaaaaaattaaaatcgaacagaagagagagagagaacaaaagtaaagatgttcttcttcttcttcttctttttattttcttccctcaggattatttctcgctcgagctaaattgcttagagagaggctctctctatcagcgaaacaaagagagagagaagagaatattgtgtggtttgctttttctctctgtttttttttattcctttttttctttggttttgtaatataatttataggaaaaaagagtatttattacaaaagaggattaataaaaggacacgtattagtctttgtatcattttgtgaactttgtcctctttttttcttcaactttttgtcctttttctttttttaaggtcgcttcaggcaacacctgtcgatcagctaacaacaacagatgttatttaattcctttttttcccatttatttattttcagaaccaaaaatatgtttacaaatggaaattgatttctttctctttcctttttttaaaaaaaaaatatatcataaaaatttatataaagtagaaaaacactaattatttccataaaattttgacatgtaatattaaccacgaaaattagatatagataagtgagtatcttagttgtacaatctgacgtgtagataagtgagtatcttagttgtaatttgtatttgatataactgtaaaatgaataaattgtattaataggatcaatgaaatcttgacacgtaatatattggttcagcaaaaatttcccatatattttatttaaactgatcaagttttagttttgaaagctatgagtaagaaataaagattggttttatagttacgaacttgtctatagaactctctaggtaagaaagaataacacaaaattattgttatcagtaagaatgaatcagcctaaaaaaataaaaatatttatgtatacttttcgataacgttaaagtacaagttctcacaatcagtgtttaatggaatcgtcttaagagtaataatctttcgagagacgtataagatatggtgatatcgccaagaagaaataaagatggaagacgacagccccagaaaattatattatttggtcgtttacctttttttctttgttctttttggatacgtaaatcaaaaaatgcaacgtgtgtttgtttttttccaagtcaataatcgcaataatttcgatttctaccacccgcccacgtggctactctgattgatcagggacgaaaataataaatattttgttacacctctagattttgtactcataaatttcaaattcgtagatacatatattgctgttgcattattatcgaaactcaaattaagtaaatgtgtgtaaattgagatgtgtgatcatgtttaaacataacattctattctctagtctattttactctcttttttggttcaacctctagtctatataaacctaaaagactaaaccatatgtttgactagttttactaatatttttatctaaaaactttgttttactgattaagataaaataatcgatttaatattttgataatgtataatcgaattttattttaatcgaaacgcgtacattatagtacaaactagatctcaccagcaacttcccaaaaatcactctctaattaaagataagttgagacttgtggaaatttccattcttgtttgtttgtttcacaagactgttgagttgtttgagaaataaaccctccaaaattagaaaaattgtaaaaccactaaaagcttcatcatctcacaatacaattttctgtttcttttcattgttcattgtttcttctctgaggttgcaaagccagacaaaagaaaaacaacacaatcgatcttggttgtgggtgttttgtgacaaagaagacatgagatcatttatgagtattatagtttccttgtgaagcaggttattcatgtttcttgggaagcaagattctaac

SEQ ID NO: 14578 - DNA, 3000 bp, Unknown
  misc_feature (1)..( 3000): cDNA_ID_2730285_gDNA_ID_2684203_Annot_ID_137244 3000 nt of promoter + ATG
gaatggcctgaagaagagactctggagttggctaaattggctttacaatgttgtgaactgaggaaaaaggacagacctgatcttgccttagttctgttaccagctctgaacaggcttaaagagtttgcaacagaggatcatgaacgtattcaggatagaacatctcatgtgtcacatgaacacaattcagttccgctttccccgattccttcctctcaggttagtttcttagaaccattctttttaagggatattagctgcaaatagaaatttagggttttagatcaagcagaatcatgttttattaagtaggtgaaaaatgtttactgcagaactttctcagttcatgaataatttctgtgccatgtagatagaggatgaattgagaaaatcatattgagtattgataaaaacatggaaattcgacgtagatcaaccagaagctgaaaatggcagtacctgagatccacgactatcttgatccttctaagacccgtaaccatcctatacctagaaggagtcgacctccaagatcacatacaagcaagtacaaaggcaacggttggtcttttatgagttgtgctccttccagagttcagtggggtgatctcccatagcgtgtggggagttcccttatctttgtatatgaaacattcttttagttttgttcatgtaaaattctacactttaaagaagacttgtttattgatgtaaagaccctcattcgaatgaagaaatcagacgaaatgtcattttgcaggtacatgatcttctgaaacaaaacaaaaattctaagcaagctgcaaaactgaaagtttaaggctttaataaaaagattagaggacactatttgttcttcatttagagcagctgataaggtctagagacggtaagagtttagagaaggtttgctacacaatatgcctgagacttgagaaccaaaaaccacaaaaccaaaagtgactgatccatcatcataagcttgtgaaatcttggagacaaaattaatagctaagagcagagaacagtccagagaaatagaaccagggggatataataggtaacaaaataacaccatcaaatatcaggttagtactcaatgagataaacagaggtatacaattatgtgaacacactacaccatcccaattaacaaaatgataagaaaaaacttgagagaagagcttcattttcaaatgtaatacaacacatcagtttctcaacgaatcaagaaagagttaacattgatcaaaaacagaaacataaaacactaactagaacaaacacactcatgacaaattaaattaccaatcggcaaaacatttaatcagtatgaatataagaaaaaggtttgcaggttattcttcaaagtgaaactgcattatgacttgacatacagacttgttgtacctctagaaaccaaataaagttttcatttttatgattccaagacataccaaacctatcaaattctcaccatttcccctatcaaaaatttcaacaacgacccgaaaaagagtctgccaattagactcttgcagtcttcaaatgggcacataccgcttcacaatttgcttcccagctacaacagctccagccgcaagtccaccaagagcaccagctacagctgcagatctcactcctctcgccgctctacaaacagctccggttccaagaccagccaccacactggtccaaacatcatctctatccgtggcagccacaataccactctcgatccctgcgtaaaccaatccaatgataccaatccgattaccccaagttcgaccagtttgaccagaagagttcaagatcctgttgattttgagcttagtagtgtcgccagattcgaagcttttgactccagtgatgactccaacagaagctccggcaacggagccaccgaggtaagctgttccggtgtagaaagtgagattctcaccccaagatctacgttgccttaaagcctcctccgtgaagagaaactcaggggaggtaggaagcttgtaaaggtactgagatttgttgattgggacttcgtagttttggtaaggattgtaaagtcttgtgttttcgtctgacccatgatcggatctgttattagccgccatcgatggaagagaaaagtctaggttttaaggattttggtggtggctagagagagagagacgacggagaggaaagagagagagagaaacgtgtgatgatgtggttgtgttgtgtctctctgaatgtttggtttggttgccgaaatgagaaatgaaaccaaactaaactaaaaatctatgtttagggtttttagggaaagactcagtccagttgtttccagatacgcgcagtaccagattcgcttaatactcgcgtttacgtttatttcgaacttaaccccatttattttattttctctatttaaacccaagttggttttctcttaccaccacacactgtatttgctgatatttcgaatgtgaccccataagtttaatttttacaaaattaacctcttcaacattggacttttcaaagtcatacttaattactttgcaaaattgcaatccatcgtgacaaccaaacatcctcgaattttcaggtgtttctcttataatgtcagaaatatttttacgacgaacgaacctaattttatgaattttttttgtcatcagtttttatttagagaactaaacttcaaataaaataattaaggattcaaatacaaagcttatttgtttttaatttaagtcaaaaggccaaaaaaaaaaattcgatttaatttcgagagcgtaaatagaagacaaaataaaaagcataaattcggaagtaaataatcgaaaaagttttgcaaactggaaacctcctcccgcagtcacacaactgcgcagagccaaaaataaacgaaacctccggcgaaagctacggcgaagagactgcgtctaactccgtttacacgccgattgtcttggagagagagagagagcacgaggtaaatcacgcaagggttag

SEQ ID NO: 14579 - DNA, 3000 bp, Unknown
  misc_feature (1)..( 3000): cDNA_ID_2730273_gDNA_ID_2684203_Annot_ID_137247 3000 nt of promoter + ATG
ttcgcgtgtagtttactacgacaaggcatgagacagatctgcataacatcaatgaattcagaaggaggatcccaagattcaaaaagggtatgtctaatggagttgcatgatgcatattgctaaagtatgaatttaaagttccttcaactaaaatttcgaacctcactcctatatttctactgatgtgttaggttgtgaaagagaacattttgaatcaactcacaaaagctgtacaaatggtgaagcttgagaaggatccgcatgctgcatttgctttgattattgacgggaaaactctaacttatgccttggaggatgatatgaagtatcaattcttggctttggcagtggattgtgcatcagtcatttgctgtcgagtgtctcccaagcagaaggctttggtatgtatatatatatatatccttcccttattcgtttcatcgcattcctccttgactatgcaactcccgaaacttcatacaaaaaaaagaaaatctaaatttatctattttgctctttcccaaattcaaggttgttaggttggttaaagagggaactggaaaaaccacattggcaataggtgatggtgcaaatgatgttgggatgattcaagaagctgacattggtgtaggaattagtggggttgaaggaatgcaggttcagtttttctctcagcaccatgccttttctgtttttcaagccatgttttctgtttcttgactagcagaaagttcattgaaaatcaaaccatgtcgacatttttgctgatccttcttacttttgcaggctgttatggctagtgacttttcgattgcccagttccggtttctggaacgattactcgtcgtccacggacactggtgctacaaaaggatagctcagatggtaatatgtagttcttttggccattttagttactcttacatttagtttgtttctaaccttatgttgttctacatccagatttgctatttcttctacaaaaacatagcatttggtctcactctcttctactttgaggctttcaccgggttttccgggcaatcagtatacaatgactactacttgttgctcttcaatgttgtccttacctcattgccagtaatcgcccttggtgtctttgaacaggatgtttcttccgagatctgcttacaggtaagctttataaatctcccttcttgaaaagctatttcgaatctctgctgatcatcgacaataatctgtgtttttttcgcttgtgcttgtgtagttcccagctttataccaacaaggcacaaagaacctcttctttgattggtcaagaatacttggatggatgtgcaatggcgtctatgcatctcttgtcatattcttcctcaacatcggaatcatttactctcaagctttcagagacaatggccaaacagctgacatggatgctgttggcacaaccatgttcacttgcataatctgggcagctaatgttcaaatcgcgttaaccatgtcccatttcacttggatccaacacgttttgatatggggaagcatcggtatgtggtatctctttgtggctatctacagtatgatgcctccgagttattctggaaacatttacaggattcttgatgagattcttgctcctgcacctatctactggatggctacattgttggtcacagtggctgcagttcttccttacgttgctcacattgcattccagagattcttgaatccattggatcatcatatcatccaagagatcaaatactacggaagagatattgaagatgcgagattgtggacccgagagcgtacaaaagcccgagaaaagacaaagatcggattcacagctagagtcgatgcgaaaatcaggcatctaaggtcgaaactgaacaagaaacagtcaaatctctcacatttttcagctcaagacgcaatgtcacctagatcattgtagccttgtatagtgtttgttgtttttctacaggtccaattctctgatgcatcagactttggagacaggtcttgaagctaattttgttgagagtttataatagagtgagatcatgtaaagagtagcctctgatgttttttctacttgttgggttcgaatttttctttatcttgtacacattatacttaggttttgtgtatacttaggacagaatgcaaaaaaacataacaaagaatcttccttctgtgcctcttctgtgcctcttctgtgcctctaatcatttaattggtcatttatataaatttgtttatacaaaatctgttaagtgaatcttgactttagaaaaaaagagagaaataactctcaatagcagtgatttgtaaaatgattttcatttcaactagaaataactctcaatttcatttcataagtttccacaaagaaatattatagaaattgttgctttagtaaatggtttcgtatccaccaattggcatttaggtaattaggtaatgaaatctccaacttatttgcgtgtctgttactttctagtttctagtgactttagagatgaagtggttggcgaataaattaacttactttatactaatatattaattttaatttaattaattattctgggccgggttttgcccaatatgggttcagtacggcccaacaactccgcaattattattatttttccatggagaaaataaaaaaagaaaagaataataagagagatttggttaaaatgagagtgtaagcaattctgagtctatcccttcccttttgggatattttcgccgcgtggattgatatgacgactctctttcgccggaagtcaatcggaatccgcgacaacttcttccttcaatccctttgatttttttttggctctacttatcccaaacccttcaaatcttcaggtccaatctcttcttctatttgttttttaattaaaaaaatccggcgaaaggtgaagctcttggattcgagtggtggctagtaatcgatttcggtagtttagaagtagtttataggttttatcagctttcgatttgatg

SEQ ID NO: 14580 - DNA, 3000 bp, Unknown
  misc_feature (1)..( 3000): cDNA_ID_2730269_gDNA_ID_2684203_Annot_ID_137248 3000 nt of promoter + ATG
aaaaagtggtcaatatcgtgtgcagggaaaaaaaagaaagtacaaaactcgagaaaaggactatagaatcatgaacgtggaccgatccaatgtgattatccttcgaaccaaagttaacttgatgaaagcttttttgaatggaaaaaagaacaataccttaaatattccacgttgacagtatacaaatgtaaatcctaatacaaaaacaacaacaaaaaaacgcgaacaaagtaaaaattcgtttttggttcattgagtttttcttaataaaaaaacgtcaaatcgtatccaaatttaaattcgattgtttacaatttctaatgtttaaaattcaaagaatattacactttagcatggtaacgaggatttattcagttaaactttgattttggctagtgacagtctttgtactatttactcactcattatgtcgacaaatatgctttattgaaaggtcaacagcaaacaacttaacgtctctttctccaaaacactaatccacctatatagttatcctataattacatctaaacatctaatcgaaatacacgtaatgtaaaatatgaagcgtgtcacggcacagtttctatcttataaaaatatctggttggttagaagaatgtaacatctacattgttttatttaatgtacgtaaaattaaatacattcacagatttgttttgttcatcacgtctttttctcttaaggtgtgtgtgtgtgtgtcattcgagttattgatattagaaaacaatctccactacacgaattcatcacgtaactgtacatgaaaacaatcttacccgattagtgaaagcaatgaattccaataaatatttatcccgatctataactaacatgaatttcatctaccacggaagaagttttccatatatagtttgtaacatttcatgttcttatgagtccaaccaaaaccaacgtccaaatgtctcaaaattggtaatgtagaatgtttatagaatttacctagttaattaagatttgtaagtatatgtttatatgctaacaaccatatcgaaaatacaagcataagattctgatttaaaatttataactggagttccatatatctgatggatggattaacaagaaaaagaaacggtggggattggttgaaccactccctgaaaaatttgcttcgttttgcagatgagaaaaaggttgtgacaacgtcaccaccatctctctctcccctatgtttttttctttctttattggaatatctctcataagcttctgaatcagatacccttttttttctttttcagcaaatcatagacctacgaatacgattttccttttttctttgtcgggacaaaactagaactttgttttcctcttaagaaagtgatattcagaaacaaacgctttctagttatggacttttaccaaaatactccaagattttacacattcttttttttcgtactataagagagttctttacacagaacacaaaattcattaaaatacatgctattttctttaaattctttattcatagttttgtagttatattacaggaggttaattaaaactaggaatgtaatatactactatataaaacaacattattatgagaatggaattataatgttagggatataataaatactatacattaaaaaaaatcaagatattctagaaaacagagacaatatttgtttttgaggaaaataacaaattttcaacagtcacgcctaataaaataatttaaattctgaaattcgaattaaacacggattaattacaatttttttcttgttttgataattacagctggatcataaatacattatatatatatatatttccagattttgtattgatttactttgcaaagcgctctctcacaagttaaaaactctcttttgttggtaatggcatacgtatatgttgataataacgtatctaccaattagactattttctagtataaaattgttaattaagttaattagattattgttgaagagagagagagaagacgtagaagtagaagaagaagaagcagacccgaaagtgcctgcactggttcagatttgcagagtcgctttgatatacaaaaacaaaaacgagtgagaaattttcagacacaagaaaacaaatctctgtctttctctaaaaccctttctctattttttctttttttgagtctcctgagaaaacaagagaaagaaaaagacagctgatagagagagagagagaaaaaagctgcattttttttgctttgtgctcttgcttcttgatctaaccattgccgacaaattctaggcgaatcaatcagtttcttcactcaaatgggtttatgttagtttgtcatgttatccacagaatctctggtttgattcctggtttgtctcctgattctctacttctccgacaaatctccactaaacctgtctgaaattttctcttcgttttggggttttccattgtgcttgacttgttgttgggttctgggatcttgtctcagcttttgtttttttacagctgtcaaattgcgtttgcgtgttcttcatcacctcctgcttaatccttatctatcttaatttaagaatcaattcatgatttcaaatagtcataagaaggcaaatgtgtttgaaataattggtgtttggtaaattcattttcctctctgggtttcgtaaagtcaacatctttgatagatttgcaattttaaaattttattgatttgctatcattcagattcgagtctgttgaccaattttgagtatgttttgtgtttaataatttttgtgtttaaaattatgtgacgagcttccgaaatttatgcttctttgtttcagtcttctctgccattttaattatgtttctgaaagatcaaagctttcgaaatttttactaatgggtttggttcatttttctacaggactatgagatatgaagcactaatctgattcttgaggaaataaagtgctggattttgttaaaagatcatagagaagttcttgtggaatg

SEQ ID NO: 14581 - DNA, 3000 bp, Unknown
  misc_feature (1)..( 3000): cDNA_ID_2730221_gDNA_ID_2684203_Annot_ID_191314 3000 nt of promoter + ATG
tggctgaggacttcgctaactttggtgagatcgatagtctttacaaagaaggcttgcttctcaagttagggtttcaagatgatatgttcaagaaattccctttaccgaagatcgtcactaccctccaaaaatcaagcgagggcttgcttagatacgacactcctaaaatagtttcaagtaagtacattaattatttcttacagcttttaatcttttgacagctattacaacatttaattatgtcactaattcgtttatctgaaaaatatttcgaaagattaacacatgtgccatcacatgcccgtttatggaccaatccttaaaaaggaatcctaatgattctcattacctttattttatggtttgctatagttctatcacttccgtgtgtatttggaaccaacagtgaaagttccctttagattcccttcaacaaggaaatatgattcacgtgctctattcatttgtttatttgttgtttccactaaaagataaattttgctatagtggtggactggtggtggtagttgtaagagattgcttttatataattaaaagcgtggttctgttttatattactagctctttaaactgcttacttataggtcttgttattatatagtttaacttgtctaatgaatcttttttactttaatgtagaggataaatatgcatggcttcgagatgacgagttcgcacgccaagccatagctgggatcaacccggtcaacatagaacgagtcacgtcttatccaccggtcagcaatcttgaccctgaaatctacggaccaggtcttcactccgctctcacggaagaccacatcatcggtcaacttgatggcttaaccgtacaacaagtatgaatatacatcatctcattaacttacacaaagacaaaaaaattttgagtaatattattaatttgtttatcttttgattgaattttcaggcgttagagacgaaccgtttgtttatggtggactaccatgacatatacttaccgtttctagatagaatcaacgcgcttgatggacgcaaggcttacgcgactcgaaccatattgttcttgacccgactcggtacactcaagcctatcgccatcgagctaagcctcccttctcaatcaagctcaaaccaaaagtccaagcgcgtggtcacacctccagtagacgcaacctccaactggatgtggcagctagccaaggcccacgttgggtccaatgacgctggtgtccaccagcttgtgaatcattggttacgtactcatgcgtgtttggaaccgtttatattagctgctcatagacaattaagcgcaatgcatccgatattcaaattattagaccctcacatgaggtacactttggagatcaatgccgtggcacgacagactttgattagtgcggacggtgtgatcgagtcgtgcttcactgctggtcaatacggtctagagattagttccgctgcgtataagaacaaatggcggtttgatatggaaggtctccctgctgatctcatccgaaggtaatgtctctgtacattattaaatttagaaacttaagtattaaactaaatctgatgcataaaacttaaaaagtgttagaaacatttctgatttattagaattacatgaaatctagctccaacagtttctaatggtttcaatcatactcatgtgataaataatgtagtgggcatagtaatagattgttgtagtgactagtgagatagatattttgttgtctggttaaatttggatttttttttcttcttcttttcatatacaatttgaatctaacaattttttttgttaaattttttatttcatttttagggggatggctgttccagacccaacacaaccacatgggcttaaattacttgttgaagactacccatacgccaacgacggtctcttattatggtccgcaatccaaacttgggtccgaacctacgtggaacgttattacgcaaactcgaacctaatccaaaccgatactgagctccaagcctggtactctgagtcaatcaacgtaggtcacgctgatcaccgcgacgccgagtggtggccgaagctttccaccgtcgaagatctcgtctccgtcatcaccaccatcatctggctcgcctcggcacaacacgcggcactcaacttcggacaatatccttacggtggctacgtcccgaaccgaccaccgctaatgcggcggttgattcccgacgagtcagatcccgagttcacgagttttatcgaagatcctcaaaagtattttttctcgtcgatgccgagtttattgcaaacgacgaagtttatggcggtggttgatacattgtcgacacattcgccggatgaggagtatatcggagagagacaacaaccgtcgatatggactggagatgctgagatcgtagatgcgttttatggattctcggcggaaatcggacggatagagaaggagattgacaagaggaatcgtgatcctagccgtaggaatcgctgtggcgcgggagtgttaccgtatgagttgatggctccgagttctgaaccgggtgttacgtgtagaggagtgcctaatagtgtatctatttagaattattcaatttttcaaagtatagagaattttataagtatataattagattttgacgcagtatggtttatttgccgatattgtaaaattcttacaaggattttattatgttgatttattaaaatgtaggcgacacaaataattaaaaatcaaggctttaaataattaaaattcttaatggtcgtttaccatcaatcaaattaaaatcaaaaccaaagtgatcatcaacacaaacagtgtcgttatttggcatcggctcgtatcaaaccgtaaaaaatcggaccaaaaccaaaccaaaccaaaaatcggtttaaatagtcttcaaaataaaacgaaaacctctagcttcttcggaggctctgacgtttattgaagtttcatcgcctttaatgttggaccatcattatcaatg

SEQ ID NO: 14582 - DNA, 3000 bp, Unknown
  misc_feature (1)..( 3000): cDNA_ID_2730254_gDNA_ID_2684203_Annot_ID_191301 3000 nt of promoter + ATG
aattggtgataaattttcttattctttcagctatcaattcaggtttattgcattctgataatgtgcaaccatatacagaccaggtaaagtctcgatctgaggttagtaccagttcaaaagtgttgaaaatagaattaaaatttatggcattgtatcatttccacagttagattcttaatgttttcataagaactccatgagagaccagatggtcttactcctaagattttgctccatctttgagatttttgcagtataacgaggagatgttgcaaaaggttgaacaggaagagaggcttgagaatgtacatggatctcagatgccttccactcctgcagatgccaatatccagtgttctaatgaaaacaacttttttgaggaggatcaagtccaccatgaagctttactgcaggatgaatgcaagatgaatgaatctgatatgatggaacgatgctcaaacgcagttgctagtccaaaagaaactgcattgtctgctgctgctcaaaaacctgatttttctagagttagaggtgagatctgcttggataatttaccgattaaagcactgcaagaaacattcagggcaacttttggccgtgatacgactgttaaggacaagacgtggcttaaaaggaggattgcaatgggacttattaattcttgtgatgtaccaacaactaacttgagggtgaaagataacaagttaattggaaatcaagagaagtccaacgatgtgacgaatgccattagaaaggagatgggagatgacgtaagagctactaaaatgaaagatgctccatcgagtactgatcatgtgaatggacattcaaacggtggcaaccactattacgctagtgaggattattccagtgaacagagggctgcaaaacgagttaggaagcctacacgaagatacattgaagaactttcggaaacagatgataaacagcaaaatgacaagtcagtgattccttctaaagatcagaggttgtccgaaaaatctgaggtcaggtctatcagtgtctcctcagggaagagagttactgtcaccaggatggtatcccttgctggatctgaaattgaggttccttatgtttctcatgtccggagaagccgtccaagagagaacattatggctcttttggtatgtctcttggttactcatgctcctcaatatagtaaattaatctcatacctttcctttgaactgaaaaaagcttccaatcatctggctcgtgttacatctgtgccttgtgtcacatgccaaattctatctcaagaagcacagatgtaaaaataataaaataagtgatcatcttctatgccattattttgctttgctgttatgtcggaatgtaattaaggattttacaacattgtgtagggatgtcattccagttacttggaagataaagctagtgcagcagagagtaacctcaatctgagtccatcccagttaagcagtgaggttgtgaaccgagattcggtggaaaagtctgcttctcgaccggtccaaaacgaagtaagagatatctgttgtttaagttaccttactctcgtaattctcatttcgtactttgctgatagtagaaatggtatagggttagatctcatttaccatctacctgatataagatgaatttggtgttccaggtatgacacagtttctcattgctttattggtttgcgaatgcagtttgctacaagtgacgagaacaatgtggagcatattctctctgaggttgatcaagagatggagccagagcacatagactcatctggaaatagctcggatgagaataacattggtgtgccaatcatgcaaggtggtgcgcttagaaggaagcatcatcgagcttggactctgtctgagatagcaaaactagttgagggtgtatcaaaatatggagccgggaagtggtctgaaatcaaaaagcatttgttttcatcacactcctatcgtacctctgtagatctcaaggtaattcaacctttttaaccctctttgcttatactatcaatcaaggctttggtttaaacatcttgttgttttttaggacaaatggcgaaaccttttgaagacaagctttgctcagagtccctcaaacagcgtggtacctccctctctctctctctctctctctctctctctatccctttagcttccaactggagtttcttttgctcaagttgtaataacgagagcttatgagtatactgtcgtgtttccagggaagtctcaagaaacatgggtcgatgcatattcctacgcagattctgttacgggtaagggagcttgcggagaagcaatctcagtaagcaagtttgttggagatagcaacagaaaggaaatggaaacaaggtccgacttcttgtagctgagttttttttgtaaaatagcaactcaagtaagggagacgagaaatgtgagataagataacagtttctgtagtagacttgtaactttctaaggaggctttgtgggttatatatatttatgagaaaagtattaagtagtgtctgtgtcctgaattggtatgaatgattctctataatatccatggaagtttgactcggacttgaattgggcctttttttgtattcgatccattattccttggaggtggttctcgaccaacacgtacatgtatctttctcgctttctctagaaccatcctacccctattaactcatcaaaatttctctcctttcatgcaaaagcttcgatcttttaatgttgtttgatcggtagacaatcgatgccaaagtggtgagattttgtttgttagatatgttactaattttagagttctttagatgatttatctcagtttaaagtttgtgtctttttgagttaatggttaatttggtggtgattttatgatttgcctttgaattctgtctgattgttgttggttctttttatgctgaaactagtgaagatacctcagtccttacctatctccagaaattgcagtagtagattctgaaagaaaatg

SEQ ID NO: 14583 - DNA, 3000 bp, Unknown
  misc_feature (1)..( 3000): cDNA_ID_2730258_gDNA_ID_2684203_Annot_ID_191300 3000 nt of
acataatcaattggagtgctctcatcaatgtcgtcacttgttccatgagtctctttgtcatggtgacgactcttggacttttcatgatgacccattgcctctatttcttctttaactcgttcaaacacatttggcgatttcacagtcttctcctctgtggaaatacccaattaaaacaaagggtttagattcgtgtttcataagagacaaaacagagcaacgaatcaaaaatagacttatcatggcgtgtttctattgtttctttagagaaatttccgatcaaaaccatccattaatagacgtgtaattttgattgtgaaatttgaggaaacgaacataacttgatcaaaaagtcttcctttttaacaatatgcataaacctatgatgagatctgatcgttcattgtgtttacctgatcggttttgatccgccatcgatggtttttgtcttcttgatcttgcagctttctatttttggttcctgattcggtggcgttttgcgtcagatgcaaaagagtctttacagtataaatcaaaatcgatttcaacttaaatgggccttgttgggttataatgggcctttttgtttgtaagtgagtccaaggaaaaaaaacaccagaccagattgaaattgaatcacttgcaaaagcaaaattgattactctgttttggttttggatcagatcaaccaaaggaagcgaagaagaagaagactttatacactctcgacgctattgatttcgtctgtgcagttttgtttctctatcagttagttttaaagatgagttcttcagagagtgtggaaaacgagtgcatgtgttgggctgcaagagatccatctggtcttctttctcctcatactatcactcgcaggtgagattcatatgatttagtgatcattttcaagcaacaatctttgacacacaatcatcatcatccaggtctgttacaactgacgatgtttcactcacaatcactcattgtggagtgtgttacgctgatgttatctggagtagaaaccaacatggagactccaagtaccctttggttcctgggtatgttttcaaaaaccaaactttagattatgaaattgcaccttactagtggaattgatattcatttgtttttccttattgtaaggcatgagattgctggaatagtgactaaggttgggcctaatgttcaacgattcaaagttggagaccatgttggtgttggaacgtatgttaactcctgcagggagtgtgaatattgtaatgaaggacaagaagttaattgtgcgaaaggagtttttactttcaatggcattgatcatgatggctctgttactaaaggaggctactctagtcacattgttgttcatgaaaggttgttataatctgctttcctctcttgccatttcatacttttgaaagttgttagtgcctatatgagtttagtttgagtaggaagcaaatgatttctcagtactagtttcttttgtgtttcaaatattgaatacaataggtactgctacaagatacctgtggactatcccttggaatcagctgcaccattactctgtgctggaatcacggtttatgctcctatgatgcgtcacaatatgaatcaacctggtaaatctcttggggtgatcgggctaggtggtcttggacacatggcggttaagtttggcaaggcttttggacttagtgttacggtttttagcaccagcatttccaagaaagaagaagctttgaatctgctaggagctgagaatttcgttatctcatctgaccatgaccagatgaaggtagtgaaatgacttaattagtttcttgtgattatttaggattggaaccagataatacttaacttgtgaatctatctatgcaggcactagagaaatctctagactttctagttgacacagcatctggtgatcacgcgtttgatccttacatgtctctcttgaagattgctggaacttatgtattggttggtttcccaagtgaaattaaaatcagtcctgccaatctcaatcttggtatgtttctcaaaaggtcttataatctccaattttacatacatactctttaagatactgtcatactgaaaccaaagatgtctggacaggtatgagaatgctcgctggaagtgtaaccggggggaccaaaataacacagcaaatgttagatttctgtgcagctcataagatttatccaaacatagaggtgattcccattcaaaagataaacgaagctctcgaaagagtggtgaagaaggacatcaagtaccgtttcgtgattgacatcaagaactccctcaaatagatgttgctcaaaggaaggaataatggagtctgtaataagagaataatactcactgctacaatctttattacgtattttctcgtttttcattagtaaagcaaataaattaagactactgagaagaaattgctcgtaagcttgggtaataagaggaaaagagatttacaaaaactacaaaaattcccaaaattagactttaaagagttatgggtaaaaaataaagaaacaagaactaaggtggccatctcgtaataaactctatatatatgtacctaactcaaattaaaggagattaatatcacgcgaggcatgagagataaattatttctttttccaatgtatgagttatttaatttatgtggacgaaagcgaaatgtcaatgaatgttgttaccgttaaattaaaaaaaaaatgatttttctccttccttccccaaaatttcaaatttcaaactcttctcttcttttaacaattgtaaacctttttgtcgacatcattcttcaggccaccaaagttcccagaaactttctctttcttcttcttctccttcttcttctctctcgagtttttttacaaatatattctcgaacccacctttctccgccggatctgattccaaaacctgtgaaagtctccagctttactacagatttttgaagaacaacaaaagggtttcaaatttgagcaa

SEQ ID NO: 14584 - DNA, 3000 bp, Unknown; identical to SEQ ID NO: 14580
  misc_feature (1)..( 3000): cDNA_ID_3018101_gDNA_ID_2684203_Annot_ID_191296 3000 nt of promoter + ATG

SEQ ID NO: 14585 - DNA, 3000 bp, Unknown; identical to SEQ ID NO: 14579
  misc_feature (1)..( 3000): cDNA_ID_2730273_gDNA_ID_2684203_Annot_ID_191295 3000 nt of promoter + ATG

SEQ ID NO: 14586 - DNA, 3000 bp, Unknown
  misc_feature (1)..( 3000): cDNA_ID_3018105_gDNA_ID_2684203_Annot_ID_191294 3000 nt of promoter + ATG
ttttgggtccaaaaccattaattggagtaataaatatattaaaagtttagagggcaaatcgggaaagaagatatttaagttgttttccttttcctacttggaataagcaaagtaaaacctaaaaaaaaaaaaagaccgtaagtagttacaagggtggaagtataaaggagcagtcttttcttcttctttcaaccccacggcgcagatcctacgagtttggtctttgtctctatcttttcaatctttctctctcaatcgctcttcaatttgataacagcaaaggtttgtttgaatctctcttctttttgtatgatttgtattttggatccccattgtgcttgcttttatagaagttataggttttgatattgtttgattcatgtttgcttcatcctaatacaatgctgattcgtaaaggatcggtttttgtacaaggatgatttagatgttctattactgcgacttggttatgttttggttacattaattgaatccttaggattatgcagttgactttacgaagatgaatgcttgatttgcttctgctctttctatctctcttggtgcttctatgtttttatcaccttttacgtgtttgttatgtgatctcagagacaacgagttcgattataaattgtaatctgttttttttttctaatgtcgatttcatatttttgttatgcttgtccagtcatggcaggaatggcatctgatggaactcaatatgatcctcgtcagtttgatactaagatgaatgccatgtgagttaaattttagtatcttaatatctgaatccctttataacaaccaagaactgacttgtgtaatactttctagtctcggcgaggaaggagaggaaacattctacactaactatgacgaagtttgcgacagctttgatgcaatggaattgcaaccagatcttctcaggggtatttatgcttacggtaagtgaagtatttcctttgagaacacattctatacataccttcattgtttctgtctagttttgtattttcttttgtttgtttcaaagcttagtactgttactcttaaacaacctcatattggttttgttatttatcattaggtttcgagaagccttctgctattcagcaaagaggaattattccattctgcaagggtcttgatgtgatccagcaagctcaatctggaactggaaagaccgctaccttttgctctggtgttttacagcagctcgatattagtttggttcaatgccaagctcttgttttggcacctacccgagaacttgcccagcaaattgaaaaggttatgagggcacttggtgactaccttggcgtcaaggctcaggcttgtgttggtggaacaagtgttcgtgaggatcaacgtgttcttcagtctggtgttcatgttgttgttggaacccctggtcgtgtctttgacttgttacgcagacaatccctccgtgctgatgcaatcaaaatgtttgttcttgatgaagctgatgaaatgctctctcgtggtttcaaggatcaggtttaatcttgtttaatctcccattcacattttctttttctctctgataaaatcaagtcatttgttcttataatttgatttctctgtcagatatacgacatcttccagcttcttccttccaaggttcaggttggtgttttctctgctacaatgcctcccgaagcccttgagatcacaaggaagttcatgaacaaaccagtcaggattctggtcaagcgagacgagctgactcttgaaggtatcaagcagttttatgtcaatgtagacaaggaagagtggaaactcgagacactatgcgatctctacgagacactggccatcactcaaagcgtcatctttgtgaacacaaggcgtaaggttgattggctaaccgacaaaatgagaagccgtgaccacactgtttcagctacacacggagacatggaccagaacacaagagacatcatcatgcgcgaattccgctctgggtcttcccgtgtcctcataaccactgacctccttgctcgtggtatcgatgttcagcaagtctctctggtcataaactttgacctcccaacccaaccggagaattaccttcatcgtattggaagaagtggaaggtttgggagaaagggagtagcaatcaatttcatgacatcggaggatgagagaatgatggctgatattcagaggttttacaatgtggtcgttgaggagttgccaagcaatgttgctgatcttctctgaagcctttcttttttctgttttttactgagaaagtgctgtgtttacccctttttttggcagcttctctatgctttgatttttgttttcaggctactacttagatttatagttcttggctaaaagcgaacataactcattacatgattttgcttttttggcaatcaagaatttcggcattatttatctttttgtgaacgtggcttacaaggaaggatactctatgagactaaagacttttctctacttgagtttcattaatgaacttttgttgattttctagttttctactcttgaatttacaataaatatatactacataaggttggggacgagccccaaaaatttccctcgaattcatgaagtgagaagcggccatgtgtaaatccaaaggacatgagatcttacaaaattttcttaggaaaaataaatatgcaaaactgtactaagtacagtgataactaatcgctagtaatgttttttttttaaatgtaacaaacaaatctcatctaaaacaatatacaaacaaaaaaaacttcgagtaactaaatagatacagtattgaggttgtgattactgcactaaatattgaacaagatatagaggtgatgtctcattctataaatatgtcaaaaactcgcaagtgacaaaaagcagaagagaaagaggttggagataaaacccaaaagcaactatctcctttttcttcctaaaaaagcagagcaatctttttttgaggtttgtttgcaagtgaag

SEQ ID NO: 14587 - DNA, 3000 bp, Unknown; identical to SEQ ID NO: 14576
  misc_feature (1)..( 3000): cDNA_ID_2730291_gDNA_ID_2684203_Annot_ID_191288 3000 nt of promoter + ATG

SEQ ID NO: 14588 - DNA, 3000 bp, Unknown
  misc_feature (1)..( 3000): cDNA_ID_4265714_gDNA_ID_2684203_Annot_ID_191285 3000 nt of promoter + ATG
aacaaaaaatgttcctgagatgtgtttcagagctcaatctctatctgtacaacttttcctaacctcgccgcaaatttctatttacaatcggagactgtaacctatccccaggattagaaagaccaaaaatttctaaaaaagacaaaacaaaaattaggattcaacgagaacgaaagaggaaagatttcagaagccaaatctcaaagcaagagacgacggcattttttgcgtctgtggaaccacgtcttcgatccaaaacgatcaccaaaaccatgcggatctaactctaacaacaacatcttcgaaaacagaaccgattaatcgaccttaccgaagaaacgatcatcctcgccggtaagcgataaagaaaaatctaaccgcgaaactcgtttccttcgccggagatatccaataagcaccaatacaagaccgatgttagaagagagagagagagctcaaagagagtaatcgcgacgagagcacacgaaaatgagaccttatacagttatactgttacgagcgagtctagggttccggtttttttccccctgtaaatataccaaattgagataccggtatagattataaaccggcttgcattttccggttcgattagctgatttctctatgtaacaaaatgccatttacagttttcaaatttaccggttaaaattgacctaaccgaaacaaataaagtggaaatgttttagtttttgattcaactaagtgtatcatcaatggattttatattgtttccatattgtgcaaaatgtaatcagaaaatgatcacgatgtgcaaattggtttgcttaatttaagattgaattacagatttttttttatcgaatattaaaggatttattaaggaaataaggaagatctggtaaaaatcagatgctggcaggtgacacgtgtcactcatgactaaggtcttaaactcttacggataaagaaagcgacaaactgggagcactcttagaagacgaagaagatcgacggcagagatagaaaaaagctaaaaggtcgtcatcgaaaacaacggctaagatcttgttctcggatcagacccaacagaggagagagaaaatggatccgcttttgtgatttggataagatgacgtggcgtccatatccttgggtcgttgggcagagaagagagcagaaggcagtgtgagaggcacgtgatctgtcacgtgatttttgattctttttcactgttacacttccactatcgttcgagctatatttttttttatgaaaaaagaatctaaagatttatcagagttcctcctagagatgctaaatttataggaacagtggtggtccttggacaatagtatgatactaccaaacaccaacagaaatcatttttctgtcgttgtatcatttactgacataacttgattacaaaaatatagtattaattagctttgggagtttcacatattttagtatcaaatcaaatatacaacagaaatcaatactatagtatttggaaatgcccactacctaaacatatactacatttctttttcggtccacgcttacttattacatcgttaatccttatcttcaacagattagatgttaaagtgagtagacaagcttagactgattccaaccatgtgatttgattccaaaaagaacattatagctgtgatgggcttgagtgacgaacaacactgttggttctgtatcaactggtgatgaccattatttcagcccacaacttggagataaaagaaccaaatcataagcagtttccacagactaaagcaccaacaaaaactatggaaagcttttatcgagcaaaagatcacgagtcacaaacataacaaaaaagtacacgaatcatgaaatcaaatttctcaagttccctatcaaaacgctttaaaatacagaaaagggatcccttctcatttattgtgtcgttctctcccaaaccccaaaacactattacccaaatttagagagaacacacaacggttagttgaggtattcagagtttgaatcaattctaattcaagtcttttatttgaagtataagcttattgggctggtttttcacaatgactgtatatttgacccaatccgcccaatgtgacgaaaaggaggacccataactagtggtgtcctttactttctttttcttttccaaaaacgttaagatcataaactccatacctatatacattaatatgaactatgaagtgtcgtctactttgtatgaatgttgctctcatagtctcatctcattatttatttttgtcctttaaaatgacaaaaagatagtgacatttattatttattttttgtttccgtcgcttgtaatatatttatttgattaataaaatgggacgaaatcacaaatatatattagaagaacaaagaacaatagatacaaataatagtaacattatattttactcataagaatatacttcatgtgtggcacatgtctcatgtagtccatacattcgtgtttttttttgttgttgcatatttgatatcttaaacactaaaatttacacatgattcatgaatgtcaaagattcatttctccctagtgcttctttctctaccatcaaaagaaaattcatgactaataatccatacaaataatagtaacattttactcataagaatatacttcatgtgtggcacatgtctcatgtactccatacatacgtgttttttttttttttttgcatatttgatatcttaaacactaaattcacactagattcatgaacgtcaaagattcatttctccctggtgctttctctaccatcaaaagaaaattcatgactagagagatatatacataatttggaaattggaatgacaaatgaaaaacaaacaataaatgaatactttcgtcccaatatttattaggttataaataaattacttgtgacttgtgactaaaggtgtcaacaatcattcttctatccaatcaatatcatcaaactcttcactttactctctctctcactcata

SEQ ID NO: 14589 - DNA, 3000 bp, Unknown
  misc_feature (1)..( 3000): cDNA_ID_1988786_gDNA_ID_2684203_Annot_ID_191281 3000 nt of promoter + ATG
agcgatctggttcgtgactttatgaacgaggaatattctcaagaggtaaggctctcttctctataatctgttccctttaaccccctcataagctatatttttaagttgtgacttgattgattctcattttgcacgtaggctccatttcgacttgtttgtataacgaaatactcaattgcttctaccaacaatatgcgaacctcatggagggaacctatgaggatcaaactacctaagattaaagctgcccccaagcttgtgggattctttgtccaaatcatggttgtttgcgaaaagcccttccatctacagtttccagcgttttcttataattgggactgtgaaggtagcaggttatatcggattaacctcaaaccaaatctctatcaatcatcagagatgatggaggacaacaataatagaccatataaatggcatcacctggtcattgtccaaatcccaactggcatcatcagcgcagaaattgatgaggtgcaattcgaatcccatatccaagttccggagccgggcgacgagataattttgtgtggagttgaacacgttgggttcgttttaaagtagctggtgcggagatcaattcttaagatgatgatggatctgcagatttctaaacacaaggatttgtaccaattttcgttttggaactaaataaattactacccatgtaacctcgtgtcggtttgcttttataatcggtttggtatttttcggtttaattgtgacttgattttatttttttccttttaagagaaccaattttttctttctgctttgtactcgatgtctgccctttttgctcaacaagctttaccagattgtattctggtatttcatcaggctagaaatggagaaagaaaagttggagctgccaaacccacaggagttgtgttctcactggaaatgttacattaaatatcattgcaaaacaactactaatacattgaatctcctttgattttggtccaaagaaaggtgaataacttttgattttggtgcatatgggatgatgacggactgatgagtacccaatatccagtgcccacgtgtcctaattcttatggatcaatcaagggcttaaaagcccataaacattaaacagagggaataaaggaatgctaaaaactaattaagaaaacatcaagtaacaattattatgttttggttgttacttgttacttccaaggataaaggagggattcctatgcttgacttgcactagagctttatttcattgcaaaaaaggttaggtacttgattaagaacccaacctaagttttagtattatacaatcctttttcccatctcattttacatgcttacactttcattaaactattatactcaaggaaactggttgcaggtctataacttgtaaattaaaactgttcgtgttatttattcccatgataaaattgtaagagcgtgtgaatcacgagcttaggagagcgtgtgaatcacgagcttaggagagcgtgtgacatcaatatggggaggggcggctaaagactaacgagtaaaggcataagggggaaattaaggactgttcagagttcagaaatgtttttagtctggaaacgacaatacactttggacaaaaagctaaataacattttaaaagcttcatacaaattaaaaatataatcaaacaaaagctaacgtggccaagatagctaattacttttttggaatcattattagagataatggaaattaagaaatcatacagccaaaacaaaccgtagttattatattcgtaacaaaagatgggggaaaagttaatataaaacaaaccttatactagtatatataatacatggctcataatacattactgctaaatgagcaaaaacaaataaaggtaaagttcttaacggctttgtagagataggaatcattaattttagagaaaaaaaaatcttgaattgtacgtttacctttccagaattacattatttgttggcttttaattgttaatcatttttgttgtgtttttcctccaaattataaaatttaaaaactgtgtcagggaatttaggaatctaatatagttggacgatttcgtattaataaagattttcaaaaaaagagtctgctctaatcgttatttgggggtaaattgattctataaggtagggttagccagagagccttattctgtgttttgggttaaagtgagaccaaataaattaagatatttaaaatgaataattaagagcacttaagacaataattaacccagaaggagaagctggtgtagtggtggttctcatggcgatgttggtttcccaggaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggtttctttctctatctcttatctatttctttctgcatctgtagtctctttgttcgaaaaaaagatgtttaatttctgtcaaatttttctccttttttctttgttcgattattggtgtatctgtcttgtggcgtgcgattgatgtttactgattctgaaaaattcttgctaaaataattcatcttcaagtcaacgactttttgcccaaaagtgatgacgggaacaagaaatttttcttggtcggaaaattactaattttagccaatcgtagcgatctctgcaatcgtgttttggttacccaagatagtacgatcgaatcagttcgtttagagaattaaaaaattactcaaatttagaaacttccaacttctgtttctttctattctgggttttttcacccacttggattattagctttaaaaatctaatctttgagtcatttttgattgttatttaggttgttggttgtgagaataattagcttgttaaggaagacgttatg

SEQ ID NO: 14590 - DNA, 3000 bp, Unknown; identical to SEQ ID NO: 14583
  misc_feature (1)..( 3000): cDNA_ID_2730258_gDNA_ID_2684203_Annot_ID_137251 3000 nt of promoter + ATG

SEQ ID NO: 14591 - DNA, 3000 bp, Unknown; identical to SEQ ID NO: 14582
  misc_feature (1)..( 3000): cDNA_ID_2730254_gDNA_ID_2684203_Annot_ID_137252 3000 nt of promoter + ATG

SEQ ID NO: 14592 - DNA, 3000 bp, Unknown
  misc_feature (1)..( 3000): cDNA_ID_2730237_gDNA_ID_2684203_Annot_ID_137261 3000 nt of promoter + ATG
aaacataacccaggagaaactggacgatgctaaaagtagaatccacctcacacttctgcatgacataaaaaactgatggcagaacttcgttcagcaaatccatggagactgccttggtgtcctctgagttcaaacgcttatggcattctagaacctcaacagcatagccagtaagcaaagcagatacttttgataccaaatcggaatcaacatctccggatactaaaccaaaaacacgactgatttgaagggtctgcaaaaggggcagttttgactggggatccatccgcttagaaaccatggctaagacacacccagctgctgcaccgcggacttgttcagacaatccatcagacaaaatcaattcaaacagcagtggaacaaatgcatcattggcaaccaaaccaatgtcaatccaagatacaaatcttctcatgcaatctaacacagtagcagaaagatcaggatcggaattcttgtacatcgatacaatgtcataccatgctctggctatctgagggacacattgttgcctcattgcatccttgactcgagcagcaacagatatctcttctggtgtccgggggtaatccaagctaatcaactcatcgtccaaggcattcaaaacccgacaaaacatgtcgatcacaacagcacctttgcacaaatgaagcatgaaatcaagaaacaccgaggaccaaatcaaagggtactcataatagatcaaagtagccaaaacctgtgcaagcttgtttttaacaaaaggaggtccttccacaactctaccagcattctcattatcaataacctccaaacaagccattgaaaacactgatttcctcacataactctgctcatccaagctcatagatccatatttaacccttaaaacatcctgaagcgtttgcaaacaccagaactgaacttggacaagcttagaaaaccataacttctcaatacatatactacaaatagaaggagtctctttgatttgctgacaataagtaacagcttgagactttaaagccgaatcaacagcaccagtttcaaagctaattactattgcctgttcaaggtcatccattgtgttaacttaaccccactacaaaaaccctaaaaaccgagatttcaaaatccagtcctggtttgttgcatacaagtcaaacaatgccttgaattagtatcgtcagctagcttctctccttcactgttctcttcccttatcagattttgatgcgaagaagaaaaagacgaaacttttagtgggtttcgcttgagagcttaccagaaagtaaggatcgtggcgattttagcgatcggatttatgagagtgggagatatagtagaaaagggattatggaaaccctagtttgggtttctctttgaattcaaagaatacttttttttggtgagtttctagaaaatttcccttacggatttataaatatgaggaaaattgtgagactggagagaagacggagctgtagggtttttttttttttatacacagatttttattagcttgcagaatattttcccagagaactataaatattattgccagcgaattgaaaattaaccgtcatctgaattcagtaaatcagcccatgggcttgaatctctctcaccttaggccttaggtgttgcatactgatagattaagatagacatgtataaatgttttgtgagttagcaaatataatggtgttttttcactttcttaatctaatgttttataaaacaaattgtcacattaatacatataactaaactacttactgtgaaattattcatggagacaacttctgtagctaagacctctcgatttttattttgtatactacaaactaggtaattgtaagaaaaggtttgttctgtaatggcattgtcgattacctcgtagaagaggttggaatatttccgatgcccgtagcaagatataaaatcacaaattcatttttcagttgttaaagaaaacaattgtggctttttgtgtagaacgacatttcgttatgtgggtggcgagtatggacaaactacccactaagtcttggttaacagcttggaacacaatttcattttctatctataagcaacatatgcaatataatcaaccaaataagagagatcacttattcttttgttctatcatattttgtgtgtctgttttcaaaggttataccgtcacattatccgcttctcacacttgaggcaaattttatgagttagatagcatattgccaaacactccagctatatatatcttttatcttttagattgatctttgtctaatctgcgaaaacagcaagatcatttcaggcttctccatcacagttagaatcattttcaaacggatcgattgaatgagcaatcaaaaacacatttttatcgtctaaggagaaatttccttgcaatactactaattttagtacaaattttgtttacttttaaattatgtaatgttctttaagtttattaaaaaatatcccaaattatatcgaaagaaagacattaataaaagaaatgtattattgtctaattaacatatttcgaaagaaacaaaatactgacttttttaagcgctactgtgtgctttttttacggaaaagttaatcaaataccaaagaacgaaaattttcattgtagtgtgtcatgtgtatctcccatatatatatacgtatacatcgaaaagatccgagggagagtgggcacaaaactctagaagtcagatgcaagtgtgtgtgaaagagaatgtgaaagagtgagggagagagaaacttcctcttcctttctttcatgcttacgacaaaacttcaccgccacctgttttgtctcaaatcttttttccacctttttaattatataatttattaaatgttttagacttatgaaaaatattaatgtatattcgcacgtatgagactacaaatcatataaaacgaaaccctatacatataaactaagagcgagaaagacagctagagagagagagagagatg

SEQ ID NO: 14593 - DNA, 3000 bp, Unknown
  misc_feature (1)..( 3000): cDNA_ID_2730233_gDNA_ID_2684203_Annot_ID_137262 3000 nt of promoter + ATG
agcatattgaatcggaaaattattttgtatttgttttttctgaccttgtcttcctctccttgtctgtccctccttcttacagctattatcccataagtgagcttcatatctccctgtccatctatgcctgtatacacgcacaacataaatatgtgtcgacacaattatacataatctacaaaataaaatgacaaatatacataagtaacataattgtggcattcacatttttcttacgtgtaagtttgagacatcatttaaaccaaaacaaatgtttgagacgtcattatttaataacgtacgtaccttgtaactccacgatactgagaagttctttgtccataactatcaaccgacttccgaggaacggattcctttacctgaggtttaacaaccaatctcttccgcttctcatctaccttaaccggttcttcgacccgtgcggatacattcgattcgttgatcaaatcagaacaagccccatggctcaaagccaatgatagcattgagccattggtgttataaccagtctcttcgttactaaaatgactaatattattgctcgtaccagcctcttcagtaacgtaatgactcgagagtgggaatgctggagtgccttgctctaaccaagatttgaaaaccgagaccgaaccgaccctctcaaaacctccataatcattgctaaggttcggatctaggttcgggtaatgtggtgtaactacggtttggtcgtggagaaggtaaccgggtgggtttaacctgttaaccacagtggtgcagttgacattggtttggttatggtttataggatactcggtttgatgagagtttgagaggagatcttccacctttggaacgtcttcatcatgatgatgatgatcaaagttaatatcatatctccaaactacacataaaatagaaatcaaattaagaatattaatagtggccacaccaacaacatatatataccagggggatgatgtgtgaagaagagagtaccatcggaaccgtcatgcctaagttcttcttcttcactattgcagattctcaaaggaggtgtcaatgaaaatcccaaccatttcttcatctctctctctctctctagctgtctttctcgctcttagtttatatgtatagggtttcgttttatatgatttgtagtctcatacgtgcgaatatacattaatatttttcataagtctaaaacatttaataaattatataattaaaaaggtggaaaaaagatttgagacaaaacaggtggcggtgaagttttgtcgtaagcatgaaagaaaggaagaggaagtttctctctccctcactctttcacattctctttcacacacacttgcatctgacttctagagttttgtgcccactctccctcggatcttttcgatgtatacgtatatatatatgggagatacacatgacacactacaatgaaaattttcgttctttggtatttgattaacttttccgtaaaaaaagcacacagtagcgcttaaaaaagtcagtattttgtttctttcgaaatatgttaattagacaataatacatttcttttattaatgtctttctttcgatataatttgggatattttttaataaacttaaagaacattacataatttaaaagtaaacaaaatttgtactaaaattagtagtattgcaaggaaatttctccttagacgataaaaatgtgtttttgattgctcattcaatcgatccgtttgaaaatgattctaactgtgatggagaagcctgaaatgatcttgctgttttcgcagattagacaaagatcaatctaaaagataaaagatatatatagctggagtgtttggcaatatgctatctaactcataaaatttgcctcaagtgtgagaagcggataatgtgacggtataacctttgaaaacagacacacaaaatatgatagaacaaaagaataagtgatctctcttatttggttgattatattgcatatgttgcttatagatagaaaatgaaattgtgttccaagctgttaaccaagacttagtgggtagtttgtccatactcgccacccacataacgaaatgtcgttctacacaaaaagccacaattgttttctttaacaactgaaaaatgaatttgtgattttatatcttgctacgggcatcggaaatattccaacctcttctacgaggtaatcgacaatgccattacagaacaaaccttttcttacaattacctagtttgtagtatacaaaataaaaatcgagaggtcttagctacagaagttgtctccatgaataatttcacagtaagtagtttagttatatgtattaatgtgacaatttgttttataaaacattagattaagaaagtgaaaaaacaccattatatttgctaactcacaaaacatttatacatgtctatcttaatctatcagtatgcaacacctaaggcctaaggtgagagagattcaagcccatgggctgatttactgaattcagatgacggttaattttcaattcgctggcaataatatttatagttctctgggaaaatattctgcaagctaataaaaatctgtgtataaaaaaaaaaaaaccctacagctccgtcttctctccagtctcacaattttcctcatatttataaatccgtaagggaaattttctagaaactcaccaaaaaaaagtattctttgaattcaaagagaaacccaaactagggtttccataatcccttttctactatatctcccactctcataaatccgatcgctaaaatcgccacgatccttactttctggtaagctctcaagcgaaacccactaaaagtttcgtctttttcttcttcgcatcaaaatctgataagggaagagaacagtgaaggagagaagctagctgacgatactaattcaaggcattgtttgacttgtatgcaacaaaccaggactggattttgaaatctcggtttttagggtttttgtagtggggttaagttaacaca

SEQ ID NO: 14594 - DNA, 3000 bp, Unknown
  misc_feature (1)..( 3000): cDNA_ID_2730229_gDNA_ID_2684203_Annot_ID_137263 3000 nt of promoter + ATG
tgcaacctgtctttcaatgcttttgtactttttgcaacttcagttgttgactgtaattctctgccctaattgaaactgctctgtatttactctttactgaccattggtaaccttctccgtaatgtagacactggatgttcttctaagggtgctaattgaatttccaaaggtcgagcctttgcggagtaaggtatgagtttagttgtattttattaagtagacatattgtaatcagtagtgttgcatattcttttccattaagttattgattcacaggtcagtgattagcttgttccccttttctgtaggtcacatcattcatacaccgtatggttgatacccttggatccgctgtgttcccttatcttcccaaggctttggaacagctacttgctgacagtgaggtaaaacgaaaatttcaaacctccccttattattcaatgctccactgctttcatttcctttaattaatattaagttgatctcctacgattcacttacttacctgggagtaatatctactaatcaagatacgtcatttcgggcaatgatgctgcacactaatttgattacttcttcaacaaaaagtcttactgtgtatgtgtattgttgcagccaaaggaaatggttggtttcatggtattactcaatcagcttatctgcaaattcaacagcgctctccatgatatactggaagaagtatatcccgtggttgctgttaggattttcaatgtaattccaagagatgggctcccttcacgccctggggctgttactgaggtatttcgtttgattttctttcttaactcaattttatgatctgcaattgtaacttgagaacctgctgatatcgtagcatcctttacatccagtcatatatccttttttttttggtgtaggaaatgagggaactgatagagcttcaaaggatgctgtatacatttcttcatgttatagccacacacgatctttcttctgtatttcttacgccgaaaagtagggcgtatctagatcctatgatgcagctggttttgaatacttcttgtaatcacaaggatattaccgtacgtaaggtttgtaacactttccctttggttgcatattcatttaattttgatgatctttttcgcttacttattatccacttgttttactctttgccataaaaataggcgtgcgtgcagatatttataaagcttattaaagattggtgtgccgagccatatagcgaggagaaggtaggcttgttaaataatttttattaaccttcttttcttcatgaaagaaggacaaatgtcataatcaagaactatttttgctttcaggttccaggttttcagaatttcgtgatcgaagcgtttgcaacaaactgttgtttgtacagtgtgctagataaatccttcaatttcagtgatgcaaatacggtaagcttaagaaacttcaattctcttttcattttggagttttatctgtccgttgcagttgtataaacttctgaattgtttccacaactgactgggtttcttccttcgctatgcatcgcagcacgcattgttcggggaaatcatcacggctcagaaagtaatgtatgaaaaatttggtaatacgtttctcatgcatcttatgtcgaaaagtttcccatcagcacatattccacaagatttggcggagcagtattgccaaaagttgcaggtttgttaagttttactccctcaaaacgaccataagtagataaaaaattatctcgtcttgtgcttaaacatagtctctcctttccgtgtttggtattccagggcaatgatatccgaagcctcaagtcatactaccagtcccttatagaaaatctccggcttcaacaaaacgggagtcacgttttcagatagcattcgaaatacagctagtttcatagaaagaaaggtctctcaggtcaattccgctacgagctctaatggttttaccaagaaagctctcttcctcaatttttgtacatgacaggtttgaagtcatgtgcttaatataatgttcatctctttacaggcttctccagatgtaaatagtatttgtcaatgtctacttgagaggtggcaacaaggttcgctttcaccatccagatcaaattagatcaaaagcttgagagagattcatactgttgttgatgttggttcttctcaaatctgcagttgtatcttcttacacataatcatgttctccgactcgaaccaagggccttacaagttgttccagtgcacacacacactctgaggcagatcagctgttatttcttattgcgctttgttgtgagattgtgtctataaagcccttccttttttggtcctatctccaagttttgatggtcttataactctctgcagtcgatgttttctgtttttctttgtccatgaaaatactttagaaaaaaactatgagagatcataaaagacagacacacaaaacaattttggctgaattttgttttcctattttattcatttaattaatatgaaattgtattatttttcgatattgaggtctcctcttattttctaacttattttgagacaccaaacacagattgttcttttgacaattgaagtggcaaagaaaataaaaagaggttaaaaaaaactaagataaaagagatcgaaacaatgaatttgttatatttcgggatggcattgatagataatttaatattttgtgtaaactacgtatttttacccaaaaaatctgaaatctatatgtttttaagtgttaaaaagtgtcatatccgtaaaattttaataaaaatagcaatttccaaaattttatatgaaaaatagcaaaatcaacaataacccttaaaaaataaaagagggttatatttatatattgtaacggtgaaaaatcgtcatctacttcttcttgaaaccctagttccaaaatctgcacacacactcagaagaagaagacgtcatctctctatctctgtctttctgctaatttcacgaagaatctgagaat

SEQ ID NO: 14595 - DNA, 3000 bp, Unknown; identical to SEQ ID NO: 14581
  misc_feature (1)..( 3000): cDNA_ID_2730221_gDNA_ID_2684203_Annot_ID_137265 3000 nt of promoter + ATG

SEQ ID NO: 14596 - DNA, 2683 bp, Unknown
  misc_feature (1)..( 2683): cDNA_ID_3034789_gDNA_ID_2684204_Annot_ID_137266 3000 nt of promoter + ATG
gaattctttgcaccagcaacatctgatcagaagtaaacattcaccacacagttcatcaattacagaaaaattaaaaagcaacatgttacagactgccgctagggaactttctctttcacattctttcgctaaacatactaaaagccaatcatgaacacaactagtatgtcctaggaggaaaatcaggaaagaatcaatactgagtaaatataacaaaaagtattgtgaccgcaagtaaccaccttccagagacaactaatgtggcatattaagagatgcgagttcatatgattgtaaaacattgagttcatcagattgttatttaccatttgatgcatgacgagaagagaaattcatccgaccacccctgctaccacggccccctccaccagatctccattgtgattcagcagaatccttgttgttgatgttctgtaccatttcaataacattgtcaatacccatgtcccaaatatatgcggtttaatagacatcctttacacagaaacccatgaagagaccaaaagaactgcaaaaaccccatacctctttcctcttatcacgcttttttttaacctcatggaatggatctgcagagtcataaacaattttttgcattagcacataagattgtatagaaaaacacaacaaaaaaaaacttaaaacatatcctagcaaccatctctaaattacatggtacacaagcaggttacatgaagcactcgaaaagcctgatgcaataccacatctccaaagaatcctattttcataacaatttgttttggtaagatgatgaaaatgtggatttctaagcactagattcatctacaacgcagcagtctttgtttagaactcatacctagcaaaagtattattcctagacaaaccactcagaaaaattctagttagaagctaattctctttgtttcacacatcactagtgtaagtaattgattcccgtatattccaaatcaattcgtgaacctttttttgtgaaaaggaggttacaacacaatatcacataaacaactagagacagcttaaaacttaataggcgaagaaaccgatgatagtgaattcagataaaatctgaaaaaaaaaaatcaaagagcagagaaatcagatgctaaaacctaagttacaggagaaaaccccaaatcgaaaaatacaatctcgatccaatcaaagaagagaaattaggtaaagaaaaaagtgcagagaaggtcgagattataccctgaagaagtaagcgttgagcggtctcatcaggatccatgttacattcatgaagcattgcgataatctcatcctcgctatagttcccagcagtggtctccttaatgttctgaatcatcttccgagtagtagccgaaatcgaaaccctagcgccactgccgaccatcctctcttctatcaaacgtaaaatctcgcttctgatattttaacaggaatcgaaatctggacctagaccaaaagaggtctgagtacctatatatgtatacgaagaggcgagtgataaatcagtacgagaggatgggatttgaaactagtttgggtcgacgaaggagaagaagaaagaagaaggaacaagaaaaaaaaaaaaaaaagaggaagggggcgagagaaaggaatgagcaaaataatacgcactgtgattttggaagcgtagggctctcttttcttttttcaattttgttttgcattcctttgtagctttttaatattgagtttttttgtttgttttaatctgaatctttggtaaataatgataaccaaattgttgtcacaatctttttttgtccacaaatatatttaaattaggatttaggatatcttctgaatatttacactacataataatgacaaacataaaacatagtatttaagaaaataagaagaagataagttttgattgtaacttgatcatattaaatctcaactatctcaaacgatgttacccatatcattatgagatgagcgatttaatgattagcatattattatttatatttttacatctcagtaacgtattattgttttctatgtaaatatttaaattatcaaataattataatacgttattattatccccaccatgataattacatatatatttaatttactgaataagtttattttttttgtctttggtaatttcttttacaataccaaattaaaatattttaaaaattggatttcaaaaacataatgagttatatggttgtccaaatatttaccaggtccagtacgcttttagcattattaatagcaattagcaactctagggattgtcatttacataaacaaatcttcaattttttcattaattttcctgtgttttgggtccctattgcttctaaattctaataaaccgtccagatattgctgttatggaaacaatttttcaataaatctcatcaactgattctatcaaaatctaatcactaggctttttcccattagcattagcgcataacaaagttttgaatattaatatcattatccataggcagcttagattttttttccttagcatcaaattaaactcaaaaccgaaccaaaccgtaaatccacaaactaattttggttcgaatttaaaaacattatcttttaattttgtcatgccccctctgctaagtgcaaccattcgtcttctcgcttcatcgttttctcttttccgatg

SEQ ID NO: 14597 - DNA, 3000 bp, Unknown
  misc_feature (1)..( 3000): cDNA_ID_2995037_gDNA_ID_2684204_Annot_ID_137267 3000 nt of promoter + ATG
tgcaagacactgctcatgtctttttcctttttcttttcctcagttatgaagatctaagaagcaggatattttccaaacaccctcaacttttccctaaagaggtaactggtatacgcccattttgctacagcttactatttggacatgtaataagatgcacttctgtaattacaactagtgttggttctattttattatctgagcttaaatttgttttgtccacatgtatatgagtgtgctatttcttggttgcaggttttcaatgatgagacatttaagtggtcttttggaatcctattctcacggttggtaagaactactgtatcataagcaatcattatcttgataattgatgtaaatctagatgtcttgaatttgaaacaacagacttgttctttaatcttagcatgactttctgcataatatagctgtctccaacaatttattgtttgaacaatgaccactcacaaccaaaatattgcattatttcgtttctctttccttccgtgtgctgcgtgcttgtctctgcaattcagacttaagcttctctaacacaggtgcggttgccttctatggatggaagatttgccttagttccatgggcagatatgcttaatcataattgtgaggtacttctacttatctttatgaccaattagctcctagattctcctaatcagaaagcatgattgacttatggtaatcaatatttcaaaatctgcttggaaaggttgagacgttcctggattatgataaatcttcaaaaggagttgtctttacaacagatcgaccatatcaaccaggtgagcaggtaaataagataaattcattcagataacctgagcgagcattgaagtttaatataagtcagtgtataacacaaagaagtcccgtttacacagtttgccttttagcgcttcagtaagtcagtccaaagtggaaccaatgttgtctgaagtctctgatatgtttcagtaacatgacattgtgcaggttttcatatcctatgggaataaatctaacggagagctattgttatcttatgggtttgttcccagagaaggaaccaatcctagtgattcagtagaactagcattatcacttaggaaaaacgataagtgttacgaggaaaagctggatgctttaaagaaacacggattatcgacgtattccattctccaccatccatgttcccctctcaaatttgtagatctctcttgattaacttgagttttgttttgattgtttgtgttaacttttctctggcagacctcaatgctttcccgtaaggataacgggttggccaatggagctaatggcatatgcttatcttgtggtgagccctccagatatgagaaacaactttgaagaggtttggcaactccatcttgaccctttttaccatccaattcttcccaaattcataatacatctcttatcaattattatccatttcagatggcgaaagctgcttcaaataagacatcaacaaagaatgatctaaaatatcctgaaatcgaggaagacgcattgcagttcatactggactcatgcgaaacaagcatatcaaagtacagccgatttctaaaggtaagtaacaaaacagctcatctctctctctttgtgggaaaattttcactccatctgcttatagtttgctttgtcaattatctaattgtaggaaagtggatcaatggatttggacataacatctccaaaacagttgaaccgaaaagcgtttctgaaacagctagctgtagacttgtccactagtgagcgcaggatactgtaccgtgctcaatacgtaaggaacaactttctagccaatacgatagataagagtctgtggatcgatccatgatattgtggaatctgtgtttttttttttgttttgtttgggtcagattctgaggaggagactgagagatatcagaagtggtgagctgaaggctctacggctcttcagtggacttaggaacttcttcaagtgaatgttgaatgaggacatttcaacagctttaagatggatcaaaggtaggcctcgttgtgcttcaaccaaaaatgtagttttttattacaaaaaaattgaacgttggtgtaggcatggttggatctgtctcactcgtataggaatatattggtccagccatatatgtaatttgatcattttctataaactcaaaacctgaacctaaattgattaattaaggaaacgcatgagagagtaagggtagaaacatgttcttcgtatttgatccgaatcgaactgaaataatcgatccaacaaacaaagataatttgaaaattaagaatatatctgactacaactcataacgaaaaccgtaccaaaactcacactccttgttaccgcaaacaagataatctgatggtacacgtcagaacatttgtttctttagcaaagcaagtaaacattccactgtggcaaagtaaaaaacgagaaacctataaagtcttcctaatgaaacgtactgattttatggagtttccattttcgacataatatgacgtggcaatatctaaatggtttaaagatgttttatctccaatgatataacgccacgtaagcccgctgaccaaataacccaaagagtaagcaagcgacgtcgtttatagtttgatgatcttgtcgggtaacgaaactgccccttgagtcaaaacaggcttcttcgtgtccgattctgaacgagctcgctctttctcatccaattctctccaccgtcttctactccgatcaatcttcaaattttcttaacactcatcgaccagatcgagtttccatcgatctaatcaatcaatcatcagatttgatcttctcaagaaggtaaatccctctcactctctgtgtcaaacctaatcacctcgtaggaatcgaaattggaacaattcaatttggtttggtttggaatctctagtcgattcttcttctaaacgattgaattgcgttttgtgctttgatataattcgaaattattgtggcag

SEQ ID NO: 14598 - DNA, 3000 bp, Unknown; identical to SEQ ID NO: 9943
  misc_feature (1)..( 3000): cDNA_ID_2186609_gDNA_ID_2684204_Annot_ID_137268 3000 nt of promoter + ATG

SEQ ID NO: 14599 - DNA, 3000 bp, Unknown; identical to SEQ ID NO: 9936
  misc_feature (1)..( 3000): cDNA_ID_2730397_gDNA_ID_2684204_Annot_ID_137269 3000 nt of promoter + ATG

SEQ ID NO: 14600 - DNA, 3000 bp, Unknown; identical to SEQ ID NO: 9935
  misc_feature (1)..( 3000): cDNA_ID_2730390_gDNA_ID_2684204_Annot_ID_137271 3000 nt of promoter + ATG

SEQ ID NO: 14601 - DNA, 3000 bp, Unknown; identical to SEQ ID NO: 9939
  misc_feature (1)..( 3000): cDNA_ID_2186625_gDNA_ID_2684204_Annot_ID_137273 3000 nt of promoter + ATG

SEQ ID NO: 14602 - DNA, 3000 bp, Unknown; identical to SEQ ID NO: 9938
  misc_feature (1)..( 3000): cDNA_ID_2730381_gDNA_ID_2684204_Annot_ID_137276 3000 nt of promoter + ATG

SEQ ID NO: 14603 - DNA, 3000 bp, Unknown
  misc_feature (1)..( 3000): cDNA_ID_2996092_gDNA_ID_2684204_Annot_ID_137277 3000 nt of promoter + ATG
tttggtgtggttcaaatttctttcaagaaacctctgtctttctaattatattgatatcatttttgtggtgtttgtggccagtttcctcggtacttgagctttgttaaaggtgttgtggactcgcatgatctcccacttaatgtatcacgtgagattcttcaagaaagtcgcatagtaagcgctcatatccaattcgtatgcaaagcctttatgatatatgttttgttttaagtgcaatgctatgttaagcttacgattttgtattgtgtctccaaggtgcggatcatgaagaaacgtctagtgaggaaggcttttgatatgattttgggtatatccttgagtgaaaacagagaagtatgtttcataactcttgttcccctaagcttacagtttaaccttttttaattccctttagaaatcactgctacgttctggtgatgattttcctgacgaatgagaatggcattgttaacctatacaggactatgagaagttttgggataattttggcaaacacttgaaattagggtgcatcgaagaccgtgaaaaccacaagcgtatagctccactgcttcgatttttctcctcccagagtgagaatgacatgatcagcttggatgagtatgttgagaacatgaaacctgaacagaaagccatatacttcattgcttctgacagcattacaagtgctaagaatgcacctttcctcgaaaagatgctggagaaaggacttgaagtatgtgttgttcttctgaatggggcctcgttttgttcttccttgcaaatattcctattaactcagaggtgattgacatgtatttctttgtattgtgaacgtaggtactatatttggtagagcctattgatgaagttgccgtacagagtttaaaagcttataaggagaaggattttgtagatatcagcaaggaagacttggatctaggcaagtgcctgatgtaattccttgatttagcatgtcaggtaatcacttatgtataataacaaattctggctttgatctttgtattgacaggagacaagaacgaggagaaagaggcagcagtgaaaaaagagtttggacagacttgtgactggataaagaaacgattgggtgacaaggttgccagtgttcaaatttccaaccgtcttagttcttccccctgtgttcttgtatctggtaaatttggttggtcagccaatatggagaggtaagatctgacctttttcttaagcaaggatttccgttctccttttttgcccctggtgaactaacacagaatatgttatctggacaggctaatgaaggcacaatcaactggtgacacaataagcctcgactacatgaaagggagaagagtgtttgagatcaatcccgaccactcaattatcaagaacataaatgtgaagtcaccattcatcataacttgtacctggctattataattaaatctaggagccgctttttgagcttggcttgtttttttcttgcaccctgcaggctgcttacaatagtaacccaaatgacgaagatgcaatgagagccatagatcttatgtatgacgcagcactagtttctagtgggttcacggtgagtcctattctacattaacattcttaactttttgttgtctctagaattgaaataaagtaaatactggtaaaacttaattgttgtttctcaaaactacagcccgataatccagcagagctgggtgggaagatatatgagatgatggatgtagctctttccgggaaatggtcaagccctgaggtgcagccgcagcaacagcagatggcacattctcacgatgcagagacgtttgaagctgaagtggttgaaccagtcgaagtggatgggaagaaatgaacacaagcctaatgttttatgtccctgctacgattctcatcatattcttcttcttttattagtagtagcagtaaaagtagaaccccaaaactcagaacaataggcaatgagcgaatgataatctctatttatgttggagagattaataattgattgagcttgtttttgttccagtttgtgttgatcctcctcggtataattttaataaccgttaagaaaaattcagttggggtgtttttggaaagatttttcgagttttatctaacaaaactaaaattttgggacatatggtaatttttaattaaatagagggatgttgttatcgtacgaattgggttggtttaaaactttgtttggacagattcgactcaaacgttgaacgcgtttaaaaaagtcaacaaaagtcgaaggttaccggctggtcaggttaaccgttagagattaatgaactggcagctgtatgtcttttttatagttctgtcttaacaggcaaaaaagtgtttaatttatctttcctttgggtttctcacggagtcacggttcctcgttcgtcctctcccgtcgtctctccggtgagtccttaattttccggcggtctttttccctttctcgtctgtttggtgctttctttatgtctgaggcgaatacagcaaaacgtatctgttttggttgttgagttcgaggctggtcctgaaaattcggtgacaaaaagagtcaataactctcgtgatcgagttggatgcgttgttttgagggttgattcagtttatgactatgtattttggtacttgcaagattttctgattttatgaagattcgtgtttgacttttatagcgtataatctacggggcaaacagattcgagcaacttgtttttttctagcgcttgttttgtgtttactctgtcatgtgtttgtattttttgagcttccactagtgattaatcatctcagctcaatttgaacataggagatgtagtttttatctgtcggtggatttctagggattttgcaaaatgttttgggctttcctgaattagtatgtgatttggtcgtaaagtattttagggatttatgtgttccttggggtgaatctgacattgacattatcttggtgtctgcagcactaaattg

SEQ ID NO: 14604 - DNA, 3000 bp, Unknown; identical to SEQ ID NO: 9937
  misc_feature (1)..( 3000): cDNA_ID_3433655_gDNA_ID_2684204_Annot_ID_137280 3000 nt of promoter + ATG

SEQ ID NO: 14605 - DNA, 2683 bp, Unknown; identical to SEQ ID NO: 14596
  misc_feature (1)..( 2683): cDNA_ID_3034805_gDNA_ID_2684204_Annot_ID_191329 3000 nt of promoter + ATG

SEQ ID NO: 14606 - DNA, 3000 bp, Unknown
  misc_feature (1)..( 3000): cDNA_ID_2113870_gDNA_ID_2684204_Annot_ID_137281 3000 nt of promoter + ATG
aacaaaaaaaaaaaaacaaaaaaaaaaacataagaaaaaaattaaaataaaataaaataatgggttcatattttggaatttctacaattttcgtgatatgtttgctgggattttcagccaatgctcatgaggtgcttagacttacgtcttctccaggttctgatattacgcaggtcagttctattacttttcatttcttgatcccgaagcaatctataaagcctgtacatcatgactatgttttcttaacttactcgttacggtttcattgcattatgcaggcgcttctgagagcattcacaacggcatgccaatctccgacaccgaggaaggtggtgatcccaaaaggacagttcaagcttggtgagatcatgatgtcgggtccatgcaaatctccagtcgagatcaccttgctaggcactgtcctcgctgacggaaactcgatccatggaaaagaaaaatgggtcgtgttccaaagaatggatgggttcaggttgaacggaggtggaactttcgacggtgaaggtaacgcagcttggagggtcaataactgtcacaagactttcgagtgcaagaaacttcccatcgtaagtttttctttaagttagcatttgtttctaagttaggccacacaaaatatagcaattgtaattttcttttgttctatttttacagagtataaggtttgatttcgtgacgaacgctgagatcagagacatatcctcaatcgatgccaagaactttcacatcaacgtgattggcgccaagaacatgacctttgacaacgtcaagatcatggctccagcagagagccccaacactgacgggatccacttgggaagaagtgtcggggtctccattatcaactctaggatctccaccggagatgactgtgtctctgtcggggacgggatggtgaatcttctagttaagaacgtcgtgtgtggtcctggacacgggatcagtgttggaagccttggaaggtacggacatgaacaggacgtcagcggcattagggtcatcaattgcaccctccaggagactgacaatggcctcaggatcaagacttggccctctgcagcttgctccaccactgcctccaatattcattttgagaatatcatccttagaaacgttagtaacccaatcctcatcgaccaagagtactgtccttggaaccagtgcaacaagcaggtatatatatatccttatcatgaatattggatacagagtctcgcttaatttagccactttcaccatatgattagtatatgaaaaatatgattaaaacttcgtaacgtgtgtttcaattcacagaaatcatcatccattaagctggcaaacataagcttcaggaggattagagggacatcagggaacaaagacgcagtgaagctattgtgcagcaagggatatccgtgtgagaacgttcaggttggagacattaatattcagtacactggagccgatggtccagccaccttcatgtgctcaaacgtaaggcctaagctagttggaactcagttcccaaaggcttgtaacacaccacccgtgctgacccaacctaagtaaaatgtagaaagttctcataacatttaggaatttctcatccattttttcttcaatcttagtttttcccaatgtcacacaagggagatttcttttatttaaaaactgtaaaagaattttgtttcactttttatttgtttgatgccaacacaaatacatagatgtgtgtgcgcatatatgaatgcaataaaactaaaaagatgcaggttattttattttatttgtattttaatatcgtttgttatcaaaatcctttttttttctttttccaatcaatttcttgaaataacttgattagaaaaaaaattaacttcaaaaatataaatcacgtgtaattcaagttattatatgctttgagatttgcgtgttcatggaccatccgtttttcgtgctaaaaaggtagtgagtctgacacaacgaacaaaaaaggacgagtgcctccgagaaaacgttttcaaagctcgagcataggacgctagacgtgtgacgataaagaattaaagactaaaggacaaagttaccgtagacggtagaagttataaaaaaaaaaaccttaaactgggggcatcacttgaatctagcagccatgttgttgtactttcagactgaaagtttcagtggataaacacatcaccatgcatgtatgggtttaatgaaaaaaataaaataaaattaaagtggtattattgtgtaacatcagtgatcactgatcagtacgtgaaccggtggaatataatatactccagctagtagcatatatgcttcgattaattaagaaaataaaaaatcaaattaccttatttgactaaaaataataatcaatttgtttgattttcaattaaaagtgtaaatatgcacgaatgacttccattttcatgtaaacaaaaatatatgtgtataatgaaatgaatggtataattaacgaacaaacttaagagttttacgttttgattttaccaaagaatattcaacacctaaattttttaaaaatatatacttctaatttttataaagataaatataaagacgggatggtgaaaaaatttaacaagggattccaggccaatagtcgaattttatactatcgttgttttgtgtaccgaccaaactattaacatgaccatatttaggcaaaattagactttatatatatagaaattctctttgaatgaaaatgtcccttttagatactttttagttttcatccttagttcaagatacaaaattagacatcagacttcctgatgggtcaaacgacctaaaaaatgagaggtggtgagaaattttcaaaaaatagacttcaacatctctcctccatccaacgcactatataaaggtaaacctgagcttaatcaaattccagaaaacaaaaaatagaataacaaatagtaatattagtagtaatttttttatttttttggggaaaaaatg

SEQ ID NO: 14607 - DNA, 3000 bp, Unknown
  misc_feature (1)..( 3000): cDNA_ID_2730369_gDNA_ID_2684204_Annot_ID_137282 3000 nt of promoter + ATG
aattttttcaaataaaaaactcagtttacagaagctgagttgaaaaaaactcagtttattcaaataaaaaaactcaactttctgtatgcatcttaaagcttaaaaatatagaaagttgaattagaccaatacagaagctttaatacattagtttttaaggaatgaaatgatacatttggaaaagtacatatatatatatatatatatatatatatacgataacatattacggctaaaaattatacgaatgttataaacatgagtggaacaagtcttttctctaagaatgaaacgctaatttatcaaaaatagacctacttccttaaaaatggggcaatcaacaaaaatttaaacgttgagagaaaattgtgcttcaaaatatctctattcaagatactatatagagcagcagatgcttagttaaatcctcagaaaaccaaaaaataaataaataaaaaatagaataataaaaataaaaataataataaatgggttcatatttaggaatttctgcagttcttttcgtaatatctttgctgggattttcagccaatgctgaggtgttcaacgttggtggttctccaggttctgatattactcaggttagttctatgacttttcatttcttgtttcccaagacatcacaacctttggctaactcgttgaagtttcattgcaggcacttctgaaagcattcacatcagcatgccaagctccgacagcgagcaaggtggtgatcacaaagggtgagttcaagcttggtgagatcgagatgacgggcccatgcaaagctccagtcgagatcaacctccaaggtactctcaaagctgatggaaaagctatccaggggaaggaaagatgggtcgtcttcctaagaattaatggctttaagttaaacggaggtggaatcttcgacggtgaaggcaatgcagcttggagagtcaataactgtcacaagactttcgagtgcaagaaacttcccatcgtaagtttttctgttcttaatagcctttaagcagatttgtaaaccaaaattaaaccattgaagattttgagttatgtatttgtatttgttgttgcaaagtataaggtttgatttcgtggagaatgctgagattagagacatatcctcgatagatgctaagaacttccacataaacgttctcggcgccaagaacatgacctttgataacgtcaaggtcatcgctccggcagagagccccaacactgacggtatccatttgggaagaagtgaaggagtcaagatcctcaactctaagatagccaccggagatgactgcatctctgttggggatgggatgaagaacctccacgtcgagaacgttatgtgcggtcctggacacggaatcagtgtcgggagtcttggaaggtacgtgcatgagcaagatgtcacaggcattactgtcgtgaactgcacccttcagggaactgacaatgggctaaggatcaagacatggccatctgcggcttgcgccaccaccgcctctggtattcattttgagaacatcatccttaacaacgttagcaacccaatcctcattgaccaggagtactgcccttggaaccagtgcaacaagcaggtatatatatctttatcattcattttgacaagcagacatgttattctgatggtttcatatttcttgaggatttgccatgttagtatatgaattctgtccactacaactcaatgttggcaaactatggacgttttaaatgtcacttaattacctcataatatatgattctgattctcaaagggtgtttttttattaattaccagaaaccatcgacgattaagctggtggacataagcttcaagaatattagaggaacatcagggaacaaggacgcagtgaagctattgtgcagcaaggcgcatccatgtgcgaatgttgagattggaaacattaaccttgagtacaagggagccgatggtccaccgactttcatgtgctcaaacgtttcccctaagcttgtgggaactcagaacccgaaggcttgtagcgccggacccactcccaagacagctgctaagggagacttgtaggaacttatattttttgaaaatcacataagggagacttttaaaaagctgtactgtaaaaaaattgtttctctttttttgtttgcttgatcgatgccaacacattttatatatagatgtgtgtgtgtgcataagaatgtaataaaactaaaaaaattatatatcttattctacatttgcttatttaattttaatatatcgaactcaaaacaattttggcaatgaagaatgtttcaatctcatttcgatgtgagcttttcatcacatgtcccccaagacgattttcttttccagtcattatcttgatgatatgtatccagtataggactaatttcggaccgtgtcgatttcagtttgtatcatttggaaaaatcttatatgtggaatcgatttcgtctggggtgggggcagcctgtgttccaatgtgtgatcgcaaggacggaggcataatttgtagtatttctttttaaaattccatattgaaatctaaaaattcaggtaatatttcatatgatttaagaatgtttttaaaatttatacgaagaaatcctaaagcataagttcgaacacttataaataataattcgttgtattttaagaagatatttaaaattctataacccacgtacataatatcttttttgttaacgtttctagtaaagatcttctaaataaacttgttcaaaatacgagacgtgtaattaataaaatacaaaacacgtgtaattaatttaaagttcggcatcgattaatttgtgggttcgaacaacctaaaaaacgagacgtggagaggaaaatggtgcttcaacatctctctatccaaggcactatataaagcagcatatattttagttgaaatcttagaaaacaaacaaaaaaaaaaaaacaaaaaaaaaaacataagaaaaaaattaaaataaaataaaataatg

SEQ ID NO: 14608 - DNA, 3000 bp, Unknown
  misc_feature (1)..( 3000): cDNA_ID_2730365_gDNA_ID_2684204_Annot_ID_137283 3000 nt of promoter + ATG
tgactgcgtttccattggagatggtaccgaaaatctcattgttgagaacgtagaatgtggaccaggacacggaatttccattggaagtcttggaagataccctaatgagcaaccagtaaaaggagtcaccgtgaggaaatgcctcatcaagaacactgacaatggtgttcgcatcaagacatggccaggatctccccccggcatcgcctccaacattcttttcgaagatatcacaatggacaatgttagccttcccgttctcatcgaccaagagtactgtccttatggccactgcaaagctggggtatgtaaccgaatcgaatctaatacataaaatacatattttggtttgtttgatagtatatgtatcaatcaagttgttaaatctcactccaattaatttacatgaaggtaccatcgcaagtgaagttgtcagacgtgactatcaagggcattaagggtacatcagcaacaaaggtggctgtgaagctaatgtgcagcaaaggagtgccttgcaccaatattgctctctctgacatcaacttggtccacaacggcaaagagggaccagctgtctcggcatgttctaacatcaagcctattctcagcggaaagttggttccagcggcttgcactgaagttgctaaaccgggtccataaattaaagtcgcttgtccaccataaatccatccaatctggtgaagacgctttgattagggtgcgatgaaaaaattttgcaatatttttttgacatataaattatatggatattttatagataagacggagtccattcaggattggagtttataacctgaagagtgactcgtgaattgggtagtaattgttgtgtggattcgcatttatgcgagaatgttttaataattattcgaaaagtaataatatcattgaaattttgaagttttatttttttttgcaccatttagaaataattagtcaataattagtccccaaatgcactaaacccatttaagctagttacaagttttaaacacttctcactaaaactcaattgtcttacactagggtcaaaaagatgctcaaggtttcttattatacaggtatcttattgattgatggtttcttgaaagctacaaagttcttactgttttgttcttacatacggtcttgcctacaactagttaccctaaaaagttacactactttatggaaacgtgtttattgatttcttcgtttcacattttggttagctttttgtagaaactccacaatagtaaatgcactaaacccatttaagctagttacaagttttaaacacttctcactaaaactcaattgtcatacactagggtcaaaaagatgctcctatcttttgcttttatacaattccattttatattcagttttatttcataaataaggatatgtttttcatgaaatacaaatccataataatttatacaattattatcagtttaggaataataaacatgaagttaattgtattcgctaaagttttgaaataaagccaaattcataccgctaataattaacatgattcatattgatccatcgctaaccaaactaatccaaacacttatgaatgatatgcacagaaacatagagatatacacataagcgaaacatacataatgtgctaagttcctaacaaaaacgttaatctctccaaaaatattcgtaacgattaattcagcgaaagagtcatcataaattaaaagatctgtgtgtcacgtcgagggtagcagtgtcaccgcgtcactaggcatctcttgtataggagaatttgttttgcaattattcacctgtaaataggagaatttgttttgcaaatgttagaagaatttttaaatgttttggtgaataatacttgtataggacattgtctttgttaggttccaacataaaaaatatgatgaaagaaccaacactgatataaaaacgacatgaatctctctatttattgtgaatttgtttaaaattgaaacacttttaactttgggtcacactgatgacgctcttttcatcttcttgctgattggtggacattcctttatcagcgatcgatcacatattgcgttccaaactattctaagttttaatgatatccaaatgctatatataaatttttatattaatttatgaaaacataattattcgtatttatctgaagtttacatttttaaataatgaacctttcaacttttcctagttacacatttcatacaaagtatacgcacaaaaatagatatactttctatttgcatctagaatctgcatatacagtttgcggtaaagtacaaatccgttgtgtgtgactgtgttcataagaaatacacactaattacatgtaaacacaatgtaaatacaatctaacaaactcatggttaattttgttcgtaagtaaggttcactttccaaaaatgtgtgtatcttagcctgatcgatataatgtatacccaacatcatgcattatcaacattagttttttttttttgaatgaatgttaaattttttcaaataaaaaactcagtttacagaagctgagttgaaaaaaactcagtttattcaaataaaaaaactcaactttctgtatgcatcttaaagcttaaaaatatagaaagttgaattagaccaatacagaagctttaatacattagtttttaaggaatgaaatgatacatttggaaaagtacatatatatatatatatatatatatatatacgataacatattacggctaaaaattatacgaatgttataaacatgagtggaacaagtcttttctctaagaatgaaacgctaatttatcaaaaatagacctacttccttaaaaatggggcaatcaacaaaaatttaaacgttgagagaaaattgtgcttcaaaatatctctattcaagatactatatagagcagcagatgcttagttaaatcctcagaaaaccaaaaaataaataaataaaaaatagaataataaaaataaaaataataataaatg

SEQ ID NO: 14609 - DNA, 3000 bp, Unknown
  misc_feature (1)..( 3000): cDNA_ID_3018196_gDNA_ID_2684204_Annot_ID_137284 3000 nt of promoter + ATG
tttttttaatctaagttgtttaaaatctaattattacttttggtcgttaatagtatacaactatatttagttctttaccttctgttttataaatttgtacactttcaaatttatttttagttcagttcttttttttattttcgaaaaacaaaaggcctttttcttaattagagttgcattgtttgtttgtaatgtagatcatattagacttttctctatatgtctctatttgtgttgatgggtttcagtcataattagtgtgtaaacatcagttagatgaagagtttggatcaagagatttataagtaaaaattctaattttttttttgtcaatcattaaaaaatctaaatactttgatcatttattacagtaaatttatttgtctacattttaacgatatgatggcacaccgcaaacatatagatttgaatcgaaaatttccaagactttaatgtatcaaatcgatgccaagtgactttttaatcaatagataatagatctaagtatgtaaaaactaaaagaaatggtgggtgggggcagttgtgccgtgtgtgttctttcaaaagctaaaaagtaataacattttagtaagaggtgcacaagtttcccaccactttggtttttccaaacactagataccaatactttaggctgtaaattatatgatttagcatcggagcaaagacattttcgtaggcccatctatgttcaaatcatatatgttatgttagcaatttaagaagagatgtctattgtttatgtgttgactttgagatattaccgtgccccttgcaaaatttaaaacttgttaaagtaataacctttgtattaccaatagctgagaacacgcatacgtcggcattgcgctctggacaagaatagttgggactcagctacaaaaccttcttcagctgcaagacattttctaaagtaaaaaaatgtattgaagctcaaattcctttcggtttcctgttttatttaataatgaaaatattagcagttttctgctctgttattcacattgccaccaataattttactgcttatacactgaaccggatgaatacaaatatagctaaaccaactcccacaagtctattaaagatcaatcctaagctgactacttgtgataaaccaactcccacaagtctatcacagaattcacaagtagttgctgctgcgtgttgtgctgctggtgtattccaaggtgggataaaccacagacggaatctgttagttttgatttcatccgtgctgagacgactttgtccactccaacctgatcaaaattcaccacttgtgatagtaacaaaagtagcaatgatgaatggaaaaaagtgaaatcagcgtgtagtgcaatgtttcagaatcccaacaaaacagtaagaaaaataacagatttcattttgcgaagagaccctcagaagttgccaagtatcttcaacaatggttcctctaaaacctccacggaaataatccaagagggagccccattttatcaccgttccagattactaaaatgttcatcactgggaatcttaacttagtttcgaaaacatatcagacctaatgtctcaaatcatttgatcaatacttaagtaaaaccccaagtcattcttgacaagtatataatgatttgatatcctgccatgtctcagggttcttagctcaagtgttgagtgatatacctaagtttagtcgaatcaaacctaccaatgctatctaacatgtgaataaagctgagagactggttttggttaccaaattataaaaaggcttcaagaagaagtcttgtggagagaacgaaagagacgatgcttcttcctcttggagtgtcttcctcgacccttcttcatcacatatggcatgaaagtcacctgtattcatgacacacaacatacatgtcaaaagagttgaatcataacccaattaactcttaattgagattggattatacagaggtgtttaacctgagaattgttccggattccaacatcctgaagaacagcattatcgtcaagcaacttctcattattacacgaaagacagaagtttgaccatacatgcttcctgcatattcccaaaaactcctctattaaacaattttactgtattcataaatgttacttgagagaagctatttaccaagaaatatggcgatgacccatgtttgcttgctccatttcgttaactttcttcttgatcaaaagcttcagatctttcaaagtagctgaattcatgaccgccacatctgcaatgaggaagcaaacaagtaagaaacccatgtaattttacaatgctgcacaccacttgttcgacataatgcccaaacgaagtatatatgtaccaagggaggagccgtcgagcttgacgacggagagacgcatagcgcttcccttctcaaggctgacaagagtgacgacatcagaaagtgttggattcctcggaacgtcggcgagaatcggatcagcaaggagctgagagagaaccgatttaagcttctctcttttcgtctcaacatcgtaatcgccgctctccattccgtagggtttagggtttgtctcgtctaatgggttacgtttttattcatttgttccatctcacacccaagcccattaaccattcttcacgtataggcccaattagataaatgattatgtaatatgtactctctcttttgcaacaaactctgatttattttaaattaccaaattgtgtgagatgtttacattatcaagtccataaatagaaaacataccaagtcaaaaggtatcggcctccatgatttggtcattcttctacctgaagcacaatcctcggaattatttttagcaaggcatgagtttgtggttttcgatctccctttgctcctctataaaacggagtctcgaatcatcagaacaaaacatcaataaacacaaaaacaaaagaagaagagaataaacaaaagaagaaaaaaaactaataaaacaaaatcaataaaaagagaataaaaaatg

SEQ ID NO: 14610 - DNA, 3000 bp, Unknown
  misc_feature (1)..( 3000): cDNA_ID_2730357_gDNA_ID_2684204_Annot_ID_137285 3000 nt of promoter + ATG
tgtttggattagtttggttagcgatggatcaatatgaatcatgttaattattagcggtatgaatttggctttatttcaaaactttagcgaatacaattaacttcatgtttattattcctaaactgataataattgtataaattattatggatttgtatttcatgaaaaacatatccttatttatgaaataaaactgaatataaaatggaattgtataaaagcaaaagataggagcatctttttgaccctagtgtatgacaattgagttttagtgagaagtgtttaaaacttgtaactagcttaaatgggtttagtgcatttactattgtggagtttctacaaaaagctaaccaaaatgtgaaacgaagaaatcaataaacacgtttccataaagtagtgtaactttttagggtaactagttgtaggcaagaccgtatgtaagaacaaaacagtaagaactttgtagctttcaagaaaccatcaatcaataagatacctgtataataagaaaccttgagcatctttttgaccctagtgtaagacaattgagttttagtgagaagtgtttaaaacttgtaactagcttaaatgggtttagtgcatttggggactaattattgactaattatttctaaatggtgcaaaaaaaaataaaacttcaaaatttcaatgatattattacttttcgaataattattaaaacattctcgcataaatgcgaatccacacaacaattactacccaattcacgagtcactcttcaggttataaactccaatcctgaatggactccgtcttatctataaaatatccatataatttatatgtcaaaaaaatattgcaaaattttttcatcgcaccctaatcaaagcgtcttcaccagattggatggatttatggtggacaagcgactttaatttatggacccggtttagcaacttcagtgcaagccgctggaaccaactttccgctgagaataggcttgatgttagaacatgccgagacagctggtccctctttgccgttgtggaccaagttgatgtcagagagagcaatattggtgcaaggcactcctttgctgcacattagcttcacagccacctttgttgctgatgtacccttaatgcccttgatagtcacgtctgacaacttcacttgcgatggtaccttcatgtaaattaattggagtgagatttaacaacttgattgatacatatactatcaaacaaaccaaaatatgtattttatgtattagattcgattcggttacataccccagctttgcagtggccataaggacagtactcttggtcgatgagaacgggaaggctaacattgtccattgtgatatcttcgaaaagaatgttggaggcgatgccggggggagatcctggccatgtcttgatgcgaacaccattgtcagtgttcttgatgaggcatttcctcacggtgactccttttactggttgctcattagggtatcttccaagacttccaatggaaattccgtgtcctggtccacattctacgttctcaacaatgagattttcggtaccatctccaatggaaacgcagtcatctccggttttgatctttgccccaattaagttgactccattggaccttccgatgtggataccatcggtgttgagactctccggaggtgcatcaataccaatatccgaaagagtaatgttcttgcagttaaggatgttcatgtggaaaagtttgctgtttgttgatgtaatactattaatctttgagtttgttagaccagtgaatcggatgttctgttacaaaaaaatcataatattcatcaagtcattccatgaaaataataacgtttttagtgtaattatgtaaaattgaatgtgcttacgatagggagagagttgcatttgccagttttggcacaatcattggccttccaagcgagggacccttgaccgtcaaaaatagctttgtttccattcaaagtgaaatcagctatattttcgaaatcaatccatccggcatgtggcttagtggtcttgaccgtagccggagccttgaaattgccattcaattccaaagtgactggacctttgcatggacctttgaactctaggctctctaccatatactcaccttttggcactgtaattgtgctccctgctgcacaagcttctttccatgcagccgcaaatgcctatatatacatgcatgaatcaatgtgaaattctttcttaaacaatacaaaaacgaagtataatataaaatatacaacaaacatttggtacgtaccgcactatcatcagttttgctgtctcctttggctcctgatgctttaacatcaactgctgcgcctggtttggcacctgatactttagcaccaactgatgcagctgcaccgccaactgctgtagctgcattttttgctgtatcttcaactgctgtagctgcattttttgctttatcgacaaccggtgtcccgtttgctattgtggtggccataaccactagtagcacaagaagcactccgcttgctttgtgagaacccaccattttttattctctttttattgattttgttttattagttttttttcttcttttgtttattctcttcttcttttgtttttgtgtttattgatgttttgttctgatgattcgagactccgttttatagaggagcaaagggagatcgaaaaccacaaactcatgccttgctaaaaataattccgaggattgtgcttcaggtagaagaatgaccaaatcatggaggccgataccttttgacttggtatgttttctatttatggacttgataatgtaaacatctcacacaatttggtaatttaaaataaatcagagtttgttgcaaaagagagagtacatattacataatcatttatctaattgggcctatacgtgaagaatggttaatgggcttgggtgtgagatggaacaaatgaataaaaacgtaacccattagacgagacaaaccctaaaccctacgga

SEQ ID NO: 14611 - DNA, 3000 bp, Unknown
  misc_feature (1)..( 3000): cDNA_ID_2730349_gDNA_ID_2684204_Annot_ID_137287 3000 nt of promoter + ATG
agaccaagaaattcacattaagattcgcatcttccatgccggagtttgacgtggtaggctcttgtaacggtttgctctgtttgtctgattctctctacaacgattcactctacctttacaatccttttactacaaactccttagagcttcccgaatgttccaacaagtaccacgaccaagaacttgtcttcggttttggattccatgagatgacaaaggaatacaaagttttgaagatagtttacttcagaggtagtagtagtaacaataacggtatttacagaggtcgtggtagaatccagtacaagcaatcagaggttcagatcttaaccttgtcatcaaaaacaacagatcaatctttgtcctggagaagcttaggcaaagctccttataagtttgtgaaacgttcatcggaggctttggtcaacgggaggttacattttgtgacaaggcctcgtaggcacgtgccggatcgtaagtttgtatcatttgatcttgaagatgaagagtttaaagagattcctaaaccagactgtggtggtctaaaccggaccaaccatagactagtgaaccttaaagggtgtctttgcgcggtcgtttatggtaactatggaaaattagacatatgggttatgaagacttatggagtcaaagaatcatggggaaaagagtatagcattgggacttacttgccaaaggggctaaagcaaaatctggaccgaccaatgtggatttggaagaacgctgagaatggtaaagtggttcgggttttatgtttgttggagaatggagagatcttgttggagtataagagtagggttcttgtggcatatgatccaaaattgggtaaatttaaagatcttcttttccatgggttgcctaattggtttcacactgttgttcatgctggaacattgtcttggtttgatacaccccttgatttatggtaaaataattaaagttttgaatttttattacatttagagttttgagatttgggtacatcttcttgccccctttacataccaactaagtacattcttttgtacgtaatgggtagattaaggtgtatttcttttcaagttcttgtttcgtttctgttgaatttataggttccttttcatgtcttcggtaaatgtaaatataatttctaagtgttagcggtaaatgtttccggtaatttggttctacactataaactattacttattgtttgggactaacccacgatcgtgccatttgattttattgctttattattgtatgttattatgttttgacatgctcgatcaccaagcaatgcagaaaaaaaaataaaaaaatcttgtagaatattctttagatctatagaattcatataacaagatattagatgacgacgataaagcaaactttaaagatatatcataaaaaaaaaagaggctttcgcaaatcacgcaaatcatatagttttcactaaaaagaaaaatttgtgtattaataactaaacgatcttcgatctaaatattaaacccatgtggaaagattccctatcgcctgaaaataaaatgaaaactctattcatcggaagatctaatcataataatatcttactaaatatataaacatctatataaaacttgaagtatatgcatttttcgtggtctcggaattataacatttttgtacatgatcatgatggcgaacgtaattgggtctataaagttacaatgtgaacgaccagaaataatatcgactgactcgacaactgcaaggccaaatggccgtttattctaggttaccgcgatacctctggagtatactgtatacgttctctctaaattctggcttttttttgggtgaatttaaaatggaatcacttcaccaatatgtacatgggtcaactccaaaactgaagacgacgaagagaagcggaagaccgcaagaatgccaatcaacatcacaaattgtttatcgtcttctctcttctcttccattccacttattttcagaatttatcttcaatattttcaaattacatcaatagagtcatgtagtgaaatagatatgccgtccggcactataatgctaattagcaacaactgttttatttatttttcatgtcatgagtttgactatcttatttcatgaatctataaaacgaattaggttttggtacggtgtcgtgtggacagtaacctaatgcatgttgactaatatgggattaattaatacatgtgtaacgtagaaaatgctttcccaaaaaaactagcatatgactttggaaaggcattgtcaatacttctatagcgtacatgacttcggagtttcgagtctatataggaaataacactagtgagagaatttgttatggaaaaaatcagtgtgtgatgttgagataggagttaaaacaatcaaaagtgacataatctatatagacataatcacgtgattataactttataagcaaaacgggataggttttgcatgtctaggtagcacctattgtttgattggtggcaataaattccatatgttttaaaattgaaacacaaaaaaaggggcagaagcatatgcccttgtttgtctcatgttaggttggatcccaaaatcagaccggataaaaccgggatatatcattaatgcaagtaataatgattgaagacgagattagaggactaattccgtaattacaaacaaatgattttattgacaattcagtgattattaaaaataaaaaacataacaacattagtggtcattgtcgttgtcgtggctcgaggctatcgtctctcctatgcgcgtggaagaaatagcaattatgctttcttttgtatttgattattatccgttagtgaccctcacgatctctttctctctcatataactcggatcaccacatgacttgatcttcttgccgttaccaaaaccaaaatccctaaatttgccctcatttccctctgattagatcccttaccccgacaaagacaccaaaattcttgagggcgagagagctgattg

SEQ ID NO: 14612 - DNA, 3000 bp, Unknown
  misc_feature (1)..( 3000): cDNA_ID_3018160_gDNA_ID_2684204_Annot_ID_137292 3000 nt of promoter + ATG
cgcctcgtaagttccatagacagcacctgaacacaacaaaaacaagtcttaatatcatctccataaccaaaacccgtgcccaaattcccaaaatcggatacatttaaaaggcgattagattgtaattctagggtttaggttttttttttccagaatgtaaaggaaatcgaaagcgtacctactgcgccgccaagagcgccgccaacggcaactccggcagtgattttggccaaacagctatttttcgccatcttcttctttttagagacaattcgtttcttgtgtcggagaatagttttttacggttgccctcgccgcttttaaggtttttaactttgaagtttttgcttacgcaatggattgattttgcctttcgctacaaggtcgagccacaacaccgacctgttccttaaccggcctaaccgattcgaaccaaatttctggaaagacgtcattggtttacttacagctttacccaatttactaatttacccacccgactccaccggatcttaacccaactaagccggcactattattttttgttataagtttagcaaaatagacattttaatttcatttggaaaccaacaattatttaaaaaatttacactaatattttaatgtgttagttactttgatatagattttggtttatggtaatttacattataaataataaaagggtcatattcttttaagaatgttgtttatcgaattaaatgaatgttatatggtgtaaagaaaatttagagaaggttagttattggaaaaacatatgtttattcaaagggaagctaattgctcaaaaataaatgtgccggcaaaatccaagtcaagtcaaagcattagcaagttagcagaataagaaggagaagaagaaaagcatgacctcacaactccaaaacatgttctttagtaattagacatctcaagaaaagacgactactctctactcacttgagctaccaatatatcaatcacttgagctacctgcgaccaaaattgattttgattggcgccacaggtcgtcctgatccacactgtcaaaacaaaccccatacgttcatatttgcagaatagcaaaacaaaattggatacttcttaaatactagtattcagacagtaattactcatttacttgctcaaccaaattagcttttatcatgcagtacgtaggcaaagatatcagcatcacatcaagatgatgcaatatagtaagcctccgaatgagttttgtatcactcttaactacgtaatatcagacactaatgttggcaaattcctgactaggtaaaagaaacagcaatcatcaaagataggcattggcttgttaagtatcaagagaagagaattttcttaagcagctttcctattcaatcacgcagaaagcaaaaaataaaaacttgtccaaggcaagagaagctaattgggtagagttttacctttccacatctcaaaaagaagagacgattctcctttgaaagaattgcctctgtgctcttgcaaggaatgcacatgacgtagtcaactgaaattaacagcaattagagaaatcactttaagaaatcaacagaaggatgtttagttgaatcctaatcttgagaggaaatgttacttacggatatatcctcgtaataacgattcaaagtccctctgtgtaaatctccccctaacaaccaacctttgctgatcatcaagtttacccctagtacccagctcagcaagcaagaacgccataacatgatcagggtttcgatgcatcctgaaaaagttttagttccaaatacaaacatgaaaactcactacgttctagtaacaatggttccaaaagtaaaagtaaaaaagtttgaaggggcagagatatggtaatttcttcatacgtcttgcaatagtccataaagttgacaaagactgtcttctttgtgcctttcgctgtctcttcacgaagaacttgtggtggccatataattgtaagaagccaaattccaacaagctccggactattttcacgcaggatattaaagaccctacgaagaatctgtacatataattcccatcagaaaaagaaaaaaaacaagcaggaagaagtatgcattgacttaaggaaagaatgctccaaagcaatatttatataagtcgcacgttctagtaaccaaagagaatcatctaccaactatgcatgcttaatacaagatcctgaagtacaactgtttacttggttttcatttttggttgggtcaaaggatagctgatgtaaaagggcaacaacaacaatcaaaccaaacgaaaaaggaaacaaaatctattgtcttaatttagggaattaatcaaggagtccttgtagacaaaaacaaaatgtcaaaagccaaacttacttcttgctcatcatccttcacttctttcttgttctcattactttcatcagccatgatttactgccaagaaaagcattcagaaaacaaaccaaatactaaaatcaagaatagaatgtgtatgatcatcaacaacaaagattggactctgttacctaaaacatgataagtagtaatttctattccgagtctaaaacatgataaggatttacctttggtaacgaaaccgcaatgcaagattggtcttaacgaggaaaacacaagcgagagaagctatgaagactgcgtttcccaaccctaattttttttctttctcaaaagctttttataattaaaaaaaaaaaaaccataattttttagatttttgccacaatttaattcgtaaaacaaaaacgtaattgacacaaaaagagtctaaatttacacactgacggcaaaaagggatataatttatcgacaaactcacaaaagtatcggcgaagaagagattggattctctgtttcagttccttaagagtttgaggagattctctgtgtataaattgagatggttcctcccataatttataagtataagcgaaggaaagatcggcgacttggtagggacgatgatagttcagtgatg

SEQ ID NO: 14613 - DNA, 3000 bp, Unknown
  misc_feature (1)..( 3000): cDNA_ID_2730328_gDNA_ID_2684204_Annot_ID_137294 3000 nt of promoter + ATG
taagagatttttataaggctgtttttgtaaaaaaaagaagtaattaaatgttgtgataattgttttaatgacgtgtcaactacaatatttgcacgaaattgaaaatcacaaaatcgaaaatccacttttttgttttgtttctctctttggccgacaaataaaaaaaaaacaaaaaacacaactaatcataggcttctccatcttcttgtctgcaggatgatgcaatttttcagacaattttcttccaaaatcttttcgtaattctgttttatttttcaacgttttaggtttttaccaatccgccgtagttatatccaacattaatttttttccctcttctcagaaaaaaataaaattcaactcatctctagagtttttaggttcttccaagaaattgaatttggaaggaggctttgatgggtttgaattttccataatcgtcccttgtttacggtatttttctcaaggaatccctgaaaaactatttcttggtctttgtgtaattgtctggtgcaaatcaagttattgtttttatcttgtgttgttgattcagactcttgttgtttgaaaatgctatggctcgtgaggggatgttgttttgattttgggaaagtcttgtttgaatggtcacggcttttctgaacattcgcgtgttctttcttgtctcggctctgcttcgaaatgtctctcggccaagaaaatgttgatcctgttgaagtttcaggtaaaatcctacacaatcctttaataattattatccaccaagtttttaaacttgtaaaggtttcaaatttttgcctttttgttttatagggtcgcatgcttgcttatatgaacttttatgttctgagacacccaaatggactcctcttagggttgaagatttgcaaacatcttcttctggtaattattacttaatgatggagataaacattcttaagatatgttttaagtgttagttggagacaatctcatgtcctgtttgttttgttttagatcccagagatcggttggagaagttgctgaagcaacctgggaataaatattgtgctgactgtggctctcctgaaccaaaatgggtgtaagttgattaatacttctgtgttgtttgtacatttcttttgatgaactggattgattcatttcatttcgttttagatcgttgagtcttggtgtatttatctgcattaagtgttctggtgtacacagaagtcttggagttcatatatcaaaggtactttcttttcatagacaatcttgatttttctctgcttctgtgtgtttctagagtcttttatcgataaatttgattgaatgatgatcgcaggttctatcagtaaagctagacgagtggacagatgatcaggttgacatgcttgtaggttacggtggaaacacggcagtgaacgaaagattcgaagcttgcaacatcgaccagtcaaagaaaccaaaaccagattctactaatgaggaacgaaatgatttcattaggtgacattttttacttaacaatttgttataatggtattgtatgtataatcatcttgtccctaaatctttaaatctttcagaaaaaaatatgagcagcaccagtttatggatccaaaggatggtgctttgtgcacttatcagcagcctagcagaacaaacacttcaccaccgtctttatgttctgcaagccaccgttctacaaaaaaccgtattggtcatgcatttaggaatagctggggaagaagagaatctgatcacaaaggaccaaagaagagcaattccatggtaacaatcactatacatacatacatacatgtttgggtagttactgttgccaacgttagttaatttttgtgggtgttttataggcaggtatggttgagtttgtggggttgattaaggttaacgtggtaaaaggaaccaaccttgcggttcgagacgtgatgaccagcgatccttatgttatccttgctcttggccaacaagtgagctctctaccaaatctctctagacttgtatgatttgaagttaacctcggtctttttcaatgtttgtttgttgtagtcggtaaaaacacgggtgataaagaacaacttgaatcctgtgtggaatgagacgctaatgctttcgatacccgagcccatgcctcctctcaaagtggtaagaacagagagcttttccaaactcggataaacactactactgaaccgagcttgatatgtaaattttttgcagctagtgtacgacaaggatacattctcgacagatgatttcatgggagaggcagagatagacatacaaccattggtgagtgcagcaaaagcatacgagacatcgagcataaaggaaccgatgcagctgggaagttgggtggcgagcaaagagaacacattggtgagtgatggcataatcttacttgaagacgggaaagtgaaacaagacatttcacttaggctacaaaatgttgaaagaggtgttcttgagatccagcttgaatgtcttcctctcactcaatgatgatactttcttcttcatccctcttctttttttttttctttaaaagatttatttctaaatttatagtgaagaaaagatgctgctactttcttgttgttccacctcaaacaaaacctctgtaaaaaaacaacaccatgatttgatttgatgattcttcagaaccaatcctagtttcctctaccggaagatcaaatacaaagaaaagcaatcaatatatcatcaactctctgcattgacagatagattggtattaccgaaacacccttcatcacttccaagttccatcagagcccaaaaacccatatgggggtataatcgtctcgtaaataacacataattaattgtttttaatacgtaagtgtttttttggggtcaaaatacataagaatttatgataattaagtggataataactttttcgttaaaaataattaccgtgttattttttgtttgttgttgttgttacttgttacattaaactataatttatat

SEQ ID NO: 14614 - DNA, 3000 bp, Unknown
  misc_feature (1)..( 3000): cDNA_ID_2730324_gDNA_ID_2684204_Annot_ID_137295 3000 nt of promoter + ATG
tgtcaacacttgggtttacgattttgctactggatggattttgttgtgctcccacatttgcttcgattctgtgtgatctctgcgctaaactaattgctaattcacggttttgaggaaattatgggttctatatgctgttaaattacttaggatgcgaaatttgatgctcgcttggtaaattacgtgattggtcttcgaattacattgaaactattgtgatgctacttgcacattgtcattctctaatatctactttaggctagaactattattaccatgatagttctgacttgttacaattctgaactcgcttcattataggactattccttttgcctggaatctgataacaagcggctattttgaactctcagtatatggggtatgtttctatgtttttcctctagttcaacttgttcctatccaatccagacttttcatctatagtacttgaattcacgagtgactgtttgcaatgttgcaggttgtcttcagcaccgtttctctcctttttatgggaaagttcctggaacctgtctggggttccacggagttccttaagttcatctttgtggtgaacttccttacgtatctctgtgttttcgttacagccattgccttatactacataacgaggctggaagtttacctgtaagtaacctaccaccttacacataccaagtgtctactgcttgtttattttccttctcttacttaagtatgaagggggatgtccccattatgaaaatttcgttgaaatccttgtgattcttttgcttccctgctcgttaagtttaatatttaccactgaatatgataaatcctctctactttgttatatttcattattatccactctataataacgtgttctttgttttctcctggctagatatatgccctttgctggttttcatggtgtcttggcaggccttcttgtagggataaagcagataatacctgaccaggagatattgctgttaaagataaaagcaaaggtaatgttttgctttctagtaagaaatgatagagctttgacattttctcactttaactttttttaatcgaagttctcacatcctattcttacttctggtttatgtgtgcagtggttgccctcaattatgctaattttgtcaatagcctcaagcttcttcacactagattcagcagcatatcttcccactttgatatttggtacatatatgggctggttatacctcaggtacctacagaggagaccagaaacaaagctcagaggtgatccaagtgatgactttgccttctctactttctttcctgaacttctcaggtgaacgacatttctccctttttactgtactttcgagtttgcccacaaatcaattcttgcctcatatgttgttggtaattttgtttttcaaaataaaatgcaggccagtaattgaccccattgccttaatctttcaccggatgctttgtggaagatcaaatgccaccagtgaagaccatgattattctaccagtggtgcaccattgccaggttctgattctgctgaagcatccaggaggaggtaaaaaattattttcttttcctttttctctctttcctgttccacttcaaatcttcaatggtagtttagatgcaacgatcttactaaattccctgctctttaggggttaatgcagttcatgtcttcaaaaattagtatacaccgttttttattggcttgacactgttgaaacataatttaagatctagttgatgcaagagataatgaatgatcctgttcacttgattctaagaataaatagtaatggctcgtcatcagttttaatcaaaatgtaagagttagtcttacgagtgagaaaactagaaaggcaaaaaacttgttataacacaaaagatgttgttgttgcagagaaagaggggcaagagctctagaggagagactaggaacggaaagattggttcctgcaaggaacaaagatgaattgcagagtgatggtttagataacgtataagtggagattgcaataagcattttgaagaagctgttgttggttcttacttgtgttcatgtggacagtttttttttgttttttttttttgttaatgaaattggcgtttatacagaatcagcttcgtaaattcctttgacagctcagaaaggtagtacatttccttggacaaaccaccaattagaaacaattttcttggacgagaggatataaaagtagttatacatgttttcacttgtctctaaacttgttattgaaacagtcgtaactcgtaatggttcactctaagacacaaaaatgtttcttaattgaatgaaaaccaatgaacaaaaatgatataaaaaagaagtcttcataatatacaagagagagggagatgataggtcagaagatggcccataaaagaagggattccattgactagatgtattttgactatatgtttttttttttttttgtgttaagaatactgtatatgaaaatagaaagagagagaaaagaaaaggaaatgacgtcagcattgacaaggtaaccacgtcgcaatgtagcgagtccctccagatgtctggtttggtagtcgctttaggaatcaaacgcggagctccaataacaatggccattaccaaactcttcaatttctctatcgattcttcacacaacaacattcctctttcttcccccctttttttcctcgttttcgatttcctcgtctcgtctcttctttctgttgtcttcttcttcgttttctcacgccattccccccaaaaaaagaaacatctcttttatctctctctctctctctcttcgtcgtccttggcctatactacattgaaatccgataagttctgaaagaaacccaacacagtaaatgcggcttcgcgatctaagctatggaggaacgaatgagaaaaaacatagaatccaacaataaaatgtgagaaaagagacagagaaagaaaggaaaaaaaagtgaaatttggaagaaagaagaagagagaa

SEQ ID NO: 14615 - DNA, 3000 bp, Unknown
  misc_feature (1)..( 3000): cDNA_ID_2730316_gDNA_ID_2684204_Annot_ID_137297 3000 nt of promoter + ATG
ctacaatgtcactgcaagagacaaagaaaatatcaaaatttcgatcaagtttttatacttctaaaccagaaataaaactttgttttcagctgacctgcatgctttccaggggtaagataagcgagtgacatttgcgtggagagccttctgaacgtccaagcggttaaaatacacattcgaatatctctctgtacaaggatcataagctcttgacatccatggctgagttaccaatacaaagttgcagcatattagcacatagaaacaaacaacctgaaaattctttcggatgtgtgaaacttacgtagcgaccctttaagaatctcttaagtgccacagtactgttgcaaggtttggtgaaaatgctatatggatcgatatttccttgctctaattcggcatttctcagagccaccatacactgcattgaaggatgctgagatgatactgagtagcacgcggtctttagttggtgatacgtggaatcggatatgagaccgtgattccaccagtattcaaatgttcctatataatcatgatagtcatctgtaacagcatttcccacctgaataagcagacttttaaaaatcccagagttcacaaacttgtaaaaagtctgaaattgtttcaatctttaccataaaacctttgaggtttatagccgggttcttgaagcccttgttcctttcatggacaagtttagacagttgaggaacaaaatgacctgtccaatagagaaactcaagactaagacatcagccattttaatgtcattgatgagagcttgaaggtagaaactgaaacctgcatagctttctccaacaatgtaaaactccctatgcttgtattgtggaaacctctcaaaccagttgacaagaaatatgtacgaatcctcagctacagattcatcaagacaagacattaaataaagctcaagatagcctgattgaggtaataaacttcagacaaatatattcaaaaagcagaacctgttctctgatcaccggttgtgtaaagatctgaagttgtgtttgaatatgagaaaccaactccagctggagactccaagaatagcaagtttgccactgagagaaagagacaaagaacaaatctgaatcggaatcgtgaagagaagagcaagatatggtgagagatttagttaaagatggatattacatttattccaagcataaagtttggaatgaagagtcttgccatcagaaccaacacgaaaaggtccaatttcttcagcagcaccataagcaacagaagaacaaccagggccaccattgagccacagaaccaaaggtctagactttgggtcacgggccaacggagactcgaccaaccagtagaacaaagctcttccacgttcttcatgcacagtgacatagcctgagtactgtctaaaatcgacattactaggttgtccaggtaagttactgattctgtctctcaattgttcttccacataagaagaaggagcagcacaacatgaagtagagattgtgagtaagagaatgattagaaggaaagagtaatccatgataatcagatctaagagagttagatctgatggaactctggatttcctcacgatttggaggttttacagacacatttactatttctcgaagtcaaacactaaccttacagttacttaacagaacagcgcactactactactgtcttgtcgtcagactcaagtttttctttttggattggtcaaacgaaaaataacttttttaacttgacagtcttttcatattttacccaatttctaggatgggcttttttatccgacattattttggtctgacatgatgggcaattgggcatgcctgatttttatcgaggctagaactaaattgtctttttttttttttgtgtgtttctagtaaaataaaaaaaaatcaatatccaaaatttgatttttttttttttttttttttaaccatgatcaatgtaaatgtgtaaatagctgagtgttgttgtctgttgtgtgatatgtttttgggcgcggaggctggatatgatttgtttccactcaaacttatgctacaaagaaaatgatcaataagttacatataaaaactattaaaatcgttgtttaataaattaattatctaatttttttttttgtgtaaaaaaattaatttttatgaaagttacaatattgattggttataaacatctaattatccaaaatcttatctgataattctgattacgccatttgaaacaatgtataccaaatccgccaattaaaaacgttataataatttttccaaatctaaattgatgataaggtattagtaaatattaaatactatccacatagattctctatgtaacaaatgaaaattaacaccaataaagcgaaacaatatcgaattcaccaataaatctatagttctttcacttttttggctttggtaactcaagcgattaacaagtattttcgatctactaaatttgaagcaacaaagcattccctttcgacatgtctaaagaagtaggtatactatgatatatactcttgttatttatcgtatatctttcttcatcttctcattttcacttttaaaaatttaagtgtattccacaaaagctttttaggaatttttatagttttagaaataaaggggtgaaatcgtaaataaagaaaaaagtaaggaccctagaataaaataaggatactggcgcctgagaaatcgaacaaaagtattctgacttccgctaatacagttcgtcaatttccccaacccaaaaaaaacttttaatttttataaaataatttgattaattttgtcgtaatttattacacaactgtattaaggctggcatttgatcttcaaacccatctcgaatccttacaaattttctcaagatttaaaaccctaattctttaattttgttcttgtgaattttccctcgtaaaaaaaaatggatcaaattccttgagtagcaattttgtttggtgctgacgagaaagagatg

SEQ ID NO: 14616 - DNA, 3000 bp, Unknown
  misc_feature (1)..( 3000): cDNA_ID_2730313_gDNA_ID_2684204_Annot_ID_137298 3000 nt of promoter + ATG
agaattgggggaagcaaaagaaaccaaaattcaattgacttaagacaaactcgtaaaatgatgggaaaacctgaacaatgcgatagagggctggcatgggttgcagatcatagtaaggaggtacacaagtcaaaagttcaataatagtgcatccaacactccaaatgtcagaagcagcacaaactcctgacaattcaataacctaaaacaaagtttgggtatccgtcagtacacaaaggagaaaacatacttgtcagaataagaacaaagtccaatttcaaaatttacatatggaattttgacctatacagaatatataatggtaaaagatacatatattttatcaaaggtgtacctcaggagccatccagtaaggagttccgaccactgagtgagtgttaaaatcagcctcgttgagttttgtggcaactccaaaatcagcaagcttaacaaggccctgaagtataatatagtcaagtaatagcctagaagatcttgtgcatcccagaatacaacagattttgaaacggaaaagcgtaccaaagacatgagaataactaataagatccacaaggtacagaaaaacacacctccttggttgtcaaaatatttgcacccttgatatcacgatgtatgacaccctgctcatgaagatatactaaaccttccaagacctgtattcactagttagtacataaatatttttttttaaaacttaactcaactagaaaaagatatatacggacctgtgcaatgtaaacagtcaccaacgactctgggaaaggtccaaatttattaggtttaataatgtttgcaagagagccattctcaacgtacctgcaaacacataattggacttgaaaatccagaccgtagtccagcgtggaccaaaattaaacacaaaagtattacttactccagaataatgtgaaggtgagtctttgtcttcaacgatccgagatacttgacaatgtttttatggttcaagttctgtattgaaatatcatcttagaaggtatagaggaagattgcatcttaaccagcataaacattgtgtaatggtggaagaaagaagctacctttaggagatcgatttcttgctgatgaaattaacaaccaagaagcatcaaaacaaggattcagtcagcatagcagtggtaaggagatgagagatcacatctagtccataaagacagaacaaataacgaagatagatacaaagtaacaaaccattatggtgttaagatcctcttgaccaatgttttccaaagagacttgtttaatggcaacaaagtctccattctccaagtctaatcctatataaactcgaccataagctcctttaccaatttcatctcctagcatctgcgctcaaaagtcataaagaacaaaacttggagtagtgagtccacaaaagatttcaaatttggtagagcaaaagcaaaattagtaagaagaaacccagaattgcggaagaagaaaagctcacgtatttgttgtcgagagtctttgatttgtggaactgggatgacgtcatctgtcgcgccatctctttctcgtcagcaccaaacaaaattgctactcaaggaatttgatccatttttttttacgagggaaaattcacaagaacaaaattaaagaattagggttttaaatcttgagaaaatttgtaaggattcgagatgggtttgaagatcaaatgccagccttaatacagttgtgtaataaattacgacaaaattaatcaaattattttataaaaattaaaagttttttttgggttggggaaattgacgaactgtattagcggaagtcagaatacttttgttcgatttctcaggcgccagtatccttattttattctagggtccttacttttttctttatttacgatttcacccctttatttctaaaactataaaaattcctaaaaagcttttgtggaatacacttaaatttttaaaagtgaaaatgagaagatgaagaaagatatacgataaataacaagagtatatatcatagtatacctacttctttagacatgtcgaaagggaatgctttgttgcttcaaatttagtagatcgaaaatacttgttaatcgcttgagttaccaaagccaaaaaagtgaaagaactatagatttattggtgaattcgatattgtttcgctttattggtgttaattttcatttgttacatagagaatctatgtggatagtatttaatatttactaataccttatcatcaatttagatttggaaaaattattataacgtttttaattggcggatttggtatacattgtttcaaatggcgtaatcagaattatcagataagattttggataattagatgtttataaccaatcaatattgtaactttcataaaaattaatttttttacacaaaaaaaaaaattagataattaatttattaaacaacgattttaatagtttttatatgtaacttattgatcattttctttgtagcataagtttgagtggaaacaaatcatatccagcctccgcgcccaaaaacatatcacacaacagacaacaacactcagctatttacacatttacattgatcatggttaaaaaaaaaaaaaaaaaaaaatcaaattttggatattgatttttttttattttactagaaacacacaaaaaaaaaaaaagacaatttagttctagcctcgataaaaatcaggcatgcccaattgcccatcatgtcagaccaaaataatgtcggataaaaaagcccatcctagaaattgggtaaaatatgaaaagactgtcaagttaaaaaagttatttttcgtttgaccaatccaaaaagaaaaacttgagtctgacgacaagacagtagtagtagtgcgctgttctgttaagtaactgtaaggttagtgtttgacttcgagaaatagtaaatgtgtctgtaaaacctccaaatcgtgaggaaatccagagttccatcagatctaactctcttagatctgattatc

SEQ ID NO: 14617 - DNA, 3000 bp, Unknown
  misc_feature (1)..( 3000): cDNA_ID_2730307_gDNA_ID_2684204_Annot_ID_137300 3000 nt of promoter + ATG
ttctcatattcaaacacaacttcagatctttacacaaccggtgatcagagaacaggttctgctttttgaatatatttgtctgaagtttattacctcaatcaggctatcttgagctttatttaatgtcttgtcttgatgaatctgtagctgaggattcgtacatatttcttgtcaactggtttgagaggtttccacaatacaagcatagggagttttacattgttggagaaagctatgcaggtttcagtttctaccttcaagctctcatcaatgacattaaaatggctgatgtcttagtcttgagtttctctattggacaggtcattttgttcctcaactgtctaaacttgtccatgaaaggaacaagggcttcaagaacccggctataaacctcaaaggttttatggtaaagattgaaacaatttcagactttttacaagtttgtgaactctgggatttttaaaagtctgcttattcaggtgggaaatgctgttacagatgactatcatgattatataggaacatttgaatactggtggaatcacggtctcatatccgattccacgtatcaccaactaaagaccgcgtgctactcagtatcatctcagcatccttcaatgcagtgtatggtggctctgagaaatgccgaattagagcaaggaaatatcgatccatatagcattttcaccaaaccttgcaacagtactgtggcacttaagagattcttaaagggtcgctacgtaagtttcacacatccgaaagaattttcaggttgtttgtttctatgtgctaatatgctgcaactttgtattggtaactcagccatggatgtcaagagcttatgatccttgtacagagagatattcgaatgtgtattttaaccgcttggacgttcagaaggctctccacgcaaatgtcactcgcttatcttacccctggaaagcatgcaggtcagctgaaaacaaagttttatttctggtttagaagtataaaaacttgatcgaaattttgatattttctttgtctcttgcagtgacattgtaggaagctattgggacgattctcctctgtctatgcttcctatatacaaagaattgattactgcaggtctcaaaatatgggtcttcaggtaccaattttgtattgaactttgtgatgttcacttgtagtaaatgaatgtttacagatgcgactagtgtagaagatgtatgtaaagtcttgattacaagtgaagattgcttgatcagtctgcctacattatatgcagtggggatacagatgctgttgttcctataaccgctacccgatactctgtagatgcactgaagctagcaaccatcacgaactggtacccgtggtacgaccatggcaaggtaaagaaacaagagctctctcatgttaatttccatgcataatattcagatattgatttgaggggtattgtacactttgtaggtaggtgggtggagtcaagtttacaaaggacttacattagtgacagtagcaggagctggtcatgaagtgcctctacaccgtccccggcaagcctttattcttttcagatcctttttagagagcaaaccaatgcctatgacttgagataaaaccttgaatggacctcttctccaacttcctgttctttcttcttcatcatcaataaaccaaagtgttttttcattcactgtcttcctcaatcctcagtgcatccaaattcaacagaagactgattagctgtctagtacaaatcataagcaactcttctttcttttttttgtgtaaaatctttctcaaacagtttctctatcttttctccattattgtatgctgcaaagcaaagtctttcaactacgaatcataatactataagatagtttatatagagttcgattccacaactaaacaaaagaccaaaccatgaacgtgtaatacaatgcagactcttgtcatttggttaagagtcactgaaagatctctacaaggtgctgccgtcacttgaagactctttctctttctctcttcgatttcccaagacgtggaacaaccacaggaccaccacgcactctttcaagggcaaaacttatcctcaacggtcgacccaataatccctgtaacagagagaatctcttcagaaaccattcataatgatagcaacacaaattcttttctttttttggttttacctttccatccatggcgtcttttgcagatagagcatcaccttcttctgcaaaatcaacaaaaccaaatcctcttgatctcccacttcctttgtcatacgcaatcctaactgagaacacatttatatttgacacattaaagaatctaaatgaaattgcaactcaagcacttcatgtgagagagtaagagctcttcaacccaaatcctataaactcatattaacacatcctacaaacgattagataaccaaaagtcataaccaaagactcgttcaggcttttcatcgaacacctggaagagtttagaaatgacaaataccttctgcaacctctccaaaggaagagaaagcgtctttgagagattgctcatccacagaccaggacaatcctgcatacttacgggtatcaaaaatcattcattatcatctacatatgtaaatgtgggtactttgttacaatactcttaacctccgatgaatagcttggaactgggcgatgcagaagaagaagtgcaaaattgaggaagaaaatggaagctagaagaaatagagtgttgaggtatcgctgaaactcgtctcactaatagctcaataccatttttcatcatgatcacaaaaacttgtttcttcaaatttaagctttgttttgggtttgaagttttttttatttatataagtgaccaccaaaaaataaggagccaaacaaaaaaaaaacttattttattattgaaatatctttgtggatgaggaaggagtaaccgaaaaggataaatcatttcttcttcttcttcctctgctttcttcctaaagcctactccttttca

SEQ ID NO: 14618 - DNA, 3000 bp, Unknown
  misc_feature (1)..( 3000): cDNA_ID_2730303_gDNA_ID_2684204_Annot_ID_137301 3000 nt of promoter + ATG
aactgttttcttcatgtcggttttctttggtgactcttcgaagtttccattacgaagataacctgaagaagtaaacagagagataaatcttagatctagagactaagattgaatctttttcttccaaaaacaccaaatcttgctttagaatcacaagtagagaagacccatcttccagaatcgaaaacttgtcaaaagcaaaacagagcaaaccagtgcaaaccatagacagtgagtgtgtgtgtgtgtgcgcgcgatttaccttcagaagcaggagctccgagagcagcaccacagatgagtagcaagataggtagaataatggctttgggaaccgccattgtctctgttgttcttcctcggagaagagtgagtgaggggagcttcaggggagagagaaaaggtccgaagaatttgagattgtgagaggaagacgatctcgagatgctacgactttatacaagtgaaaggattaaaagcgagtggagagagaggaaatcacgtagaaagaggtaatgtgactggaccccaacgatggattttgtctgtctgtcttactgaaccgaaaccgacttttctccttaattcatgctctctaatctcgtattggcacttgtgccttgcttcatttcttcctaagatatttgtggccttttatttggtaatttttgtacagtaattagtaaattttgtatggtaataagagaaattgagaggaactaaagttagctaaatgagacaatattgagaagatcaaagatgagaggagataattagagaatgagttttccttggttagtgttattgatatatgcttgttactgtagagatattgaaattttactacataaatctaaaaatgttttcatgcatgcatatacatagagttattgtttcctcataacaaagctagtgggaattttgtcgtctttgatggtaaactatcttggaaatgatacttagtatgcgtagagatatggctgatgtcaaaaattatcgatgtgctaactaaacagagcaaatattctcaagacttcaatattaaactactacattatagtaaatatactctacctcatcatataagcgttttaaaaaagaactggtctaacatgtaaaaaaacacaaaatataccactaacttagtttataaatctcaaaacatcggtaatgaacaaccaagtcacatataggcggcaggcggcagcatctataaaacacacgtatattattaataacgattaccgagttattaaagtatcatttactttggcataaagttaattgcacattcaaaatcagattctttttcatattgtttatgcttgacaagatcgtataagaattgcacaagatatcatcagattgttggctctttttttgttgatcgtaataacgggaattgcggcagatgcaaaggtaattatggaggaagagaaggcgttggcaattctgcctttggctggttccaataataattggcattttaaatgaatatctctatctatacaaaatcagaggcatgtgcaatattatgactataggcttgttatagtcagcgaatgcatgtggctatcagctgaataatagaataaacacatcactaaattacgtgttgtgtagggtccttggcgttttctatctatttatgttatccactcgatacatttgcccccatgcggccgcgattgctccatgttgcaattattaattacgaatggttatgtctagctttcacttgccttctcttatttttgatcagattaactcgttgtaagttgtaaccataataacacacactagattagacaagtgttttgctcgggaatataaaacctaaaaacatgttttgtaagctatgatatactaatcaattaatttagtagttttagttaaataagagagagtagttgagtttaaagtaaagatgctttgtagttgggtagtttgtacattgatgtctacattgaataatcaaccccaacaacaaaaaataataatttgtatgggactttacctcatagaaagctggcctaaaactagtttggagcccaaatgtatcattttacctttcattgataaaagttttgagcccaattttaaatcatagaaagttggcccaaaaccagtttggagaacaaatgtttttcgatcatcttctctctcgttttagtggggctggtcgagaaaggttcttgatactataattcaaattcttacttgagtttctccctctcgtcttcttttagatttggtgttattatcgtaaaggaagacttggctactctaacgtttcggggagatttatgtttggcaaaaaaatcaagatcatttgtagtcattagatcattaaatagataaattgcatattaaattttctgttgtgcacaaataagcaaaactgtgtgatggcatatttcgtaaaaaatattgttacaatgtcaccatcggtgtttttagacaataacaaatttaccaagtcaaagattttggatttctaagtttttattgctctacagatttttctcttctatatatatatgattatttggtaaaatacttaggaaagttttgggttaaaaatgcaacagctgtctatccaaaaattccaatattgtatagtgaagaacacaattgtgatgtgacgtggaagcttttgattggaagaagcaacacgcactcggtttctttggctgcatcttaaaaacatcgttgattaaggttgagatgagaaaagcaccttatctctgcgtccaaaccaaaactcacagagctcaccaaaagagacgaccctttttctactacacaaagaaactactgattaattcattaatactaatagagttattaacattaccgatccttatattattatattaaatataaaaaaaaaaaagagaaagaagcgatctctaaaaatcaaaatctcgatttttttttttttttttccgtttggaggcgagaggaataatttttgttggggtgaggatatatgggatg

SEQ ID NO: 14619 - DNA, 3000 bp, Unknown
  misc_feature (1)..( 3000): cDNA_ID_1580298_gDNA_ID_2684204_Annot_ID_137302 3000 nt of promoter + ATG
catcaacaccagaaccaatagcaccatctccaacccccaaaatcgaaaccgtctgaggagcaggaacaaccttaggaaccctaacttgaacggtacctccaataaaaacattagaagaaacagcaggatccttgagaaactcctccactcgaataacctctttcaaaaacttatgtttcgcattggctccacggagatcccgagaaaaccctaaggagcaatggcaaatccgacgactacaacaaaagagagtcgattaaacagagaagaagataatagtgaagcgttaaaggaatagatagatagagataccatgtaattggacaagctacgtgaaaggccatcccatatatcctcaccccaacaaaaattattcctctcgcctccaaacggaaaaaaaaaaaaaaaaatcgagattttgatttttagagatcgcttctttctcttttttttttttatatttaatataataatataaggatcggtaatgttaataactctattagtattaatgaattaatcagtagtttctttgtgtagtagaaaaagggtcgtctcttttggtgagctctgtgagttttggtttggacgcagagataaggtgcttttctcatctcaaccttaatcaacgatgtttttaagatgcagccaaagaaaccgagtgcgtgttgcttcttccaatcaaaagcttccacgtcacatcacaattgtgttcttcactatacaatattggaatttttggatagacagctgttgcatttttaacccaaaactttcctaagtattttaccaaataatcatatatatatagaagagaaaaatctgtagagcaataaaaacttagaaatccaaaatctttgacttggtaaatttgttattgtctaaaaacaccgatggtgacattgtaacaatattttttacgaaatatgccatcacacagttttgcttatttgtgcacaacagaaaatttaatatgcaatttatctatttaatgatctaatgactacaaatgatcttgatttttttgccaaacataaatctccccgaaacgttagagtagccaagtcttcctttacgataataacaccaaatctaaaagaagacgagagggagaaactcaagtaagaatttgaattatagtatcaagaacctttctcgaccagccccactaaaacgagagagaagatgatcgaaaaacatttgttctccaaactggttttgggccaactttctatgatttaaaattgggctcaaaacttttatcaatgaaaggtaaaatgatacatttgggctccaaactagttttaggccagctttctatgaggtaaagtcccatacaaattattattttttgttgttggggttgattattcaatgtagacatcaatgtacaaactacccaactacaaagcatctttactttaaactcaactactctctcttatttaactaaaactactaaattaattgattagtatatcatagcttacaaaacatgtttttaggttttatattcccgagcaaaacacttgtctaatctagtgtgtgttattatggttacaacttacaacgagttaatctgatcaaaaataagagaaggcaagtgaaagctagacataaccattcgtaattaataattgcaacatggagcaatcgcggccgcatgggggcaaatgtatcgagtggataacataaatagatagaaaacgccaaggaccctacacaacacgtaatttagtgatgtgtttattctattattcagctgatagccacatgcattcgctgactataacaagcctatagtcataatattgcacatgcctctgattttgtatagatagagatattcatttaaaatgccaattattattggaaccagccaaaggcagaattgccaacgccttctcttcctccataattacctttgcatctgccgcaattcccgttattacgatcaacaaaaaaagagccaacaatctgatgatatcttgtgcaattcttatacgatcttgtcaagcataaacaatatgaaaaagaatctgattttgaatgtgcaattaactttatgccaaagtaaatgatactttaataactcggtaatcgttattaataatatacgtgtgttttatagatgctgccgcctgccgcctatatgtgacttggttgttcattaccgatgttttgagatttataaactaagttagtggtatattttgtgtttttttacatgttagaccagttcttttttaaaacgcttatatgatgaggtagagtatatttactataatgtagtagtttaatattgaagtcttgagaatatttgctctgtttagttagcacatcgataatttttgacatcagccatatctctacgcatactaagtatcatttccaagatagtttaccatcaaagacgacaaaattcccactagctttgttatgaggaaacaataactctatgtatatgcatgcatgaaaacatttttagatttatgtagtaaaatttcaatatctctacagtaacaagcatatatcaataacactaaccaaggaaaactcattctctaattatctcctctcatctttgatcttctcaatattgtctcatttagctaactttagttcctctcaatttctcttattaccatacaaaatttactaattactgtacaaaaattaccaaataaaaggccacaaatatcttaggaagaaatgaagcaaggcacaagtgccaatacgagattagagagcatgaattaaggagaaaagtcggtttcggttcagtaagacagacagacaaaatccatcgttggggtccagtcacattacctctttctacgtgatttcctctctctccactcgcttttaatcctttcacttgtataaagtcgtagcatctcgagatcgtcttcctctcacaatctcaaattcttcggaccttttctctctcccctgaagctcccctcactcactcttctccgaggaagaacaacagagaca

SEQ ID NO: 14620 - DNA, 627 bp, Unknown
  misc_feature (1)..( 627): cDNA_ID_2730299_gDNA_ID_2684204_Annot_ID_137303 3000 nt of promoter + ATG
ttccaattacgcaaaatgattcacttttttagtggaaaatatcaaagaaaaatgagaagtttatatgaaaataaactctttcccactatgatgaatacatgtaagaaaactttcatgaaaagaaaacttatttactcaatataaaaatagaagactctttatctttcacgagtaaaagttcacgaaaaccatattttcctattgattaaagaaatcatagaagttaaaataatcaacaagggcaagccaaaaacttctagtgtgggatttacttaatagaagtatatatattacgatgtttatgcgtacctattttccctcaatgagaagagaaattccataatattggtgtcttaagtttggacggaaataaagagcagcaaaaaagttagggaaggaaacctttgttttcttcaataattatagaaaataatttcttttattgatttagatattaaataagcaaagatatgcatgctcattacgtgtctataaataaaaacacgtttgtacatagcatctactataaacgttccttttgcttccccgattcttcgaaacacttattgatatcttcagacacaacaaattaattacagagacagttacagaggaaaaagatctatg

SEQ ID NO: 14621 - DNA, 3000 bp, Unknown; identical to SEQ ID NO: 14607
  misc_feature (1)..( 3000): cDNA_ID_2730369_gDNA_ID_2684204_Annot_ID_191343 3000 nt of promoter + ATG

SEQ ID NO: 14622 - DNA, 3000 bp, Unknown; identical to SEQ ID NO: 14606
  misc_feature (1)..( 3000): cDNA_ID_2113870_gDNA_ID_2684204_Annot_ID_191342 3000 nt of promoter + ATG

SEQ ID NO: 14623 - DNA, 3000 bp, Unknown; identical to SEQ ID NO: 9937
  misc_feature (1)..( 3000): cDNA_ID_3409314_gDNA_ID_2684204_Annot_ID_191341 3000 nt of promoter + ATG

SEQ ID NO: 14624 - DNA, 3000 bp, Unknown; identical to SEQ ID NO: 9938
  misc_feature (1)..( 3000): cDNA_ID_2996092_gDNA_ID_2684204_Annot_ID_191338 3000 nt of promoter + ATG

SEQ ID NO: 14625 - DNA, 3000 bp, Unknown; identical to SEQ ID NO: 9939
  misc_feature (1)..( 3000): cDNA_ID_2186625_gDNA_ID_2684204_Annot_ID_191334 3000 nt of promoter + ATG

SEQ ID NO: 14626 - DNA, 3000 bp, Unknown; identical to SEQ ID NO: 9935
  misc_feature (1)..( 3000): cDNA_ID_3593294_gDNA_ID_2684204_Annot_ID_191333 3000 nt of promoter + ATG

SEQ ID NO: 14627 - DNA, 3000 bp, Unknown; identical to SEQ ID NO: 9936
  misc_feature (1)..( 3000): cDNA_ID_3018217_gDNA_ID_2684204_Annot_ID_191331 3000 nt of promoter + ATG

SEQ ID NO: 14628 - DNA, 3000 bp, Unknown; identical to SEQ ID NO: 9943
  misc_feature (1)..( 3000): cDNA_ID_2186609_gDNA_ID_2684204_Annot_ID_191330 3000 nt of promoter + ATG

SEQ ID NO: 14629 - DNA, 3000 bp, Unknown; identical to SEQ ID NO: 14619
  misc_feature (1)..( 3000): cDNA_ID_1580298_gDNA_ID_2684204_Annot_ID_191363 3000 nt of promoter + ATG

SEQ ID NO: 14630 - DNA, 3000 bp, Unknown; identical to SEQ ID NO: 14618
  misc_feature (1)..( 3000): cDNA_ID_2730303_gDNA_ID_2684204_Annot_ID_191362 3000 nt of promoter + ATG

SEQ ID NO: 14631 - DNA, 3000 bp, Unknown; identical to SEQ ID NO: 14616
  misc_feature (1)..( 3000): cDNA_ID_2730313_gDNA_ID_2684204_Annot_ID_191359 3000 nt of promoter + ATG

SEQ ID NO: 14632 - DNA, 3000 bp, Unknown; identical to SEQ ID NO: 14615
  misc_feature (1)..( 3000): cDNA_ID_3018172_gDNA_ID_2684204_Annot_ID_191358 3000 nt of promoter + ATG

SEQ ID NO: 14633 - DNA, 3000 bp, Unknown; identical to SEQ ID NO: 14614
  misc_feature (1)..( 3000): cDNA_ID_2730324_gDNA_ID_2684204_Annot_ID_191356 3000 nt of promoter + ATG

SEQ ID NO: 14634 - DNA, 3000 bp, Unknown; identical to SEQ ID NO: 14613
  misc_feature (1)..( 3000): cDNA_ID_2730328_gDNA_ID_2684204_Annot_ID_191355 3000 nt of promoter + ATG

SEQ ID NO: 14635 - DNA, 3000 bp, Unknown
  misc_feature (1)..( 3000): cDNA_ID_3018160_gDNA_ID_2684204_Annot_ID_191353 3000 nt of promoter + ATG
gagtgtatatatatgttttcaacaagaaagattttcattttacaagatgactcagaataagcttaccttgactctaatcgcctcgtaagttccatagacagcacctgaacacaacaaaaacaagtcttaatatcatctccataaccaaaacccgtgcccaaattcccaaaatcggatacatttaaaaggcgattagattgtaattctagggtttaggttttttttttccagaatgtaaaggaaatcgaaagcgtacctactgcgccgccaagagcgccgccaacggcaactccggcagtgattttggccaaacagctatttttcgccatcttcttctttttagagacaattcgtttcttgtgtcggagaatagttttttacggttgccctcgccgcttttaaggtttttaactttgaagtttttgcttacgcaatggattgattttgcctttcgctacaaggtcgagccacaacaccgacctgttccttaaccggcctaaccgattcgaaccaaatttctggaaagacgtcattggtttacttacagctttacccaatttactaatttacccacccgactccaccggatcttaacccaactaagccggcactattattttttgttataagtttagcaaaatagacattttaatttcatttggaaaccaacaattatttaaaaaatttacactaatattttaatgtgttagttactttgatatagattttggtttatggtaatttacattataaataataaaagggtcatattcttttaagaatgttgtttatcgaattaaatgaatgttatatggtgtaaagaaaatttagagaaggttagttattggaaaaacatatgtttattcaaagggaagctaattgctcaaaaataaatgtgccggcaaaatccaagtcaagtcaaagcattagcaagttagcagaataagaaggagaagaagaaaagcatgacctcacaactccaaaacatgttctttagtaattagacatctcaagaaaagacgactactctctactcacttgagctaccaatatatcaatcacttgagctacctgcgaccaaaattgattttgattggcgccacaggtcgtcctgatccacactgtcaaaacaaaccccatacgttcatatttgcagaatagcaaaacaaaattggatacttcttaaatactagtattcagacagtaattactcatttacttgctcaaccaaattagcttttatcatgcagtacgtaggcaaagatatcagcatcacatcaagatgatgcaatatagtaagcctccgaatgagttttgtatcactcttaactacgtaatatcagacactaatgttggcaaattcctgactaggtaaaagaaacagcaatcatcaaagataggcattggcttgttaagtatcaagagaagagaattttcttaagcagctttcctattcaatcacgcagaaagcaaaaaataaaaacttgtccaaggcaagagaagctaattgggtagagttttacctttccacatctcaaaaagaagagacgattctcctttgaaagaattgcctctgtgctcttgcaaggaatgcacatgacgtagtcaactgaaattaacagcaattagagaaatcactttaagaaatcaacagaaggatgtttagttgaatcctaatcttgagaggaaatgttacttacggatatatcctcgtaataacgattcaaagtccctctgtgtaaatctccccctaacaaccaacctttgctgatcatcaagtttacccctagtacccagctcagcaagcaagaacgccataacatgatcagggtttcgatgcatcctgaaaaagttttagttccaaatacaaacatgaaaactcactacgttctagtaacaatggttccaaaagtaaaagtaaaaaagtttgaaggggcagagatatggtaatttcttcatacgtcttgcaatagtccataaagttgacaaagactgtcttctttgtgcctttcgctgtctcttcacgaagaacttgtggtggccatataattgtaagaagccaaattccaacaagctccggactattttcacgcaggatattaaagaccctacgaagaatctgtacatataattcccatcagaaaaagaaaaaaaacaagcaggaagaagtatgcattgacttaaggaaagaatgctccaaagcaatatttatataagtcgcacgttctagtaaccaaagagaatcatctaccaactatgcatgcttaatacaagatcctgaagtacaactgtttacttggttttcatttttggttgggtcaaaggatagctgatgtaaaagggcaacaacaacaatcaaaccaaacgaaaaaggaaacaaaatctattgtcttaatttagggaattaatcaaggagtccttgtagacaaaaacaaaatgtcaaaagccaaacttacttcttgctcatcatccttcacttctttcttgttctcattactttcatcagccatgatttactgccaagaaaagcattcagaaaacaaaccaaatactaaaatcaagaatagaatgtgtatgatcatcaacaacaaagattggactctgttacctaaaacatgataagtagtaatttctattccgagtctaaaacatgataaggatttacctttggtaacgaaaccgcaatgcaagattggtcttaacgaggaaaacacaagcgagagaagctatgaagactgcgtttcccaaccctaattttttttctttctcaaaagctttttataattaaaaaaaaaaaaaccataattttttagatttttgccacaatttaattcgtaaaacaaaaacgtaattgacacaaaaagagtctaaatttacacactgacggcaaaaagggatataatttatcgacaaactcacaaaagtatcggcgaagaagagattggattctctgtttcagttccttaagagtttgaggagattctctgtgtataaattgag

SEQ ID NO: 14636 - DNA, 3000 bp, Unknown; identical to SEQ ID NO: 14611
  misc_feature (1)..( 3000): cDNA_ID_2730349_gDNA_ID_2684204_Annot_ID_191348 3000 nt of promoter + ATG

SEQ ID NO: 14637 - DNA, 3000 bp, Unknown; identical to SEQ ID NO: 14610
  misc_feature (1)..( 3000): cDNA_ID_3018192_gDNA_ID_2684204_Annot_ID_191346 3000 nt of promoter + ATG

SEQ ID NO: 14638 - DNA, 3000 bp, Unknown; identical to SEQ ID NO: 14609
  misc_feature (1)..( 3000): cDNA_ID_3018196_gDNA_ID_2684204_Annot_ID_191345 3000 nt of promoter + ATG

SEQ ID NO: 14639 - DNA, 3000 bp, Unknown; identical to SEQ ID NO: 14608
  misc_feature (1)..( 3000): cDNA_ID_2730365_gDNA_ID_2684204_Annot_ID_191344 3000 nt of promoter + ATG

SEQ ID NO: 14640 - DNA, 3000 bp, Unknown; identical to SEQ ID NO: 9941
  misc_feature (1)..( 3000): cDNA_ID_2186596_gDNA_ID_2684204_Annot_ID_191328 3000 nt of promoter + ATG

SEQ ID NO: 14641 - DNA, 3000 bp, Unknown
  misc_feature (1)..( 3000): cDNA_ID_3018324_gDNA_ID_2684206_Annot_ID_191387 3000 nt of promoter + ATG
atcttggacttgatactgctcgtcatcaacaaggaagtgcacatgcttctactggctaagaagaatcctgtccagcttgtcattcagcgctttgatctccttcttgtatttgttatcagagtcagttgtgcctctgatagttctgtcgtagtcctcgttgtaattaccatctgattgagcaaggttctcaaccaattcccagccttcttcaacatctttgttctagaaattcccattgttggcggtatccagaagcattctgatccgtggtagaactcctctgtatagagtgctgagcagagaagctttcttgaagccacgatgagggcattggttggtgtaacccttgaaacgctcacatgcttcacagaagctttcaccagtcttttgtaaaaagccagaaatctcatttctgagtcctgcagttctggcattggagaagaactttgctaaaaaagcctttttgcaatcatcccaggtggtgactgagtcacggggcagattcttttcccagatgtgtgctttgtcgcccaaggagaatggaaacaaacggagcttgaatccgtcttcactgacaccattgatttttgttaggttgaagagcctatcaaattcatccatgtggtcgagtggatcctccattggcagaccatggaatttattcccctcaatcatcaagatgagaccactcttaatctcgaagttgttgttctggatagcaggaggtgcaattcctttcctctgatggtggtcccgtggtgcatctccagcaccaatgtttgcagggccattctgttgattttgttcgtcagccatttcgagtggttgttgaggtataaggttgactgtgtttctcctttctctgagttcacgagctaggcggctgatgttatcgttgaaaaggaggttctggttgcctgttgatcgagtttgaatatagcagaggtgtacctcaaccgagaagacaacaagaaaaacacacagtcagtaactgaaataaaaattgaaaaagaactctatctaagcaagtctgaaatctcaaatgtaacaaacaaacacccaattggcaacggcgccaaattgataataggtttttaagatcaattatcctaaaacaccaatcatgtcgttgtagtattttaggttgtcaatccaaattggtgtgatgctaacaatcaagatgtgattagaagtcactaagtcaagccaagcaataacaggttttagtgtgttctagcagttctaagtgaacatgcagaaaccagaaattcaagcagaaacaataaaacacttgaccaacacagctctttgcagagcactgggtgaggtctagtgataggtcgagtaacagacagacagtatgacacagataattgactgcacagtctgttgccagacaactgggtggtcgagtataaggtcgagtaacaaaaaagaattgtagaaactaagcagcagatgacaggatacagtaaacagcagtggagtaaacaataaaatcaatcggataaagaattctcgaggatggggtaattgagtagtttcgtttcctcagtttacaggtgactgacatgctcaataaattatccctaaacaacaagttcattaaccaaatctaagtgccaccgcaacagagaccctcaagttaacctagtcccagactcaatcaccattgacgagagctaacctaacaggcattacgaatcaacaagttaaagccaaaacgctccttgcaaccaataccttggtacagggccacgaatctctagaattaatggttcagacatttcatcgaacaccttttgggcgcagaaatatctgggctcaaattccagttgatcagaaagcaataggcattaagaacaactaatccagaagggatctatcaatcaatacttaaccacctagcatactgagaattctacactactctaacccatcctcagaaacctattcactactcagacatcattgtagagaacataaacgttgaacaggatgaaaacacgataacaacagtgtaatagcaaaacgataacaggatgaacaacagtaaacgaaatcaagaacaaatactgaatgctaaatactgaatagataaagagaaatccggattacaaaaggtctagaacacagtgtctgcggaataaaactagataaaaaaaacttgttctcgaaaatgtagggtacatgctacttatagcaaaatattccgaaaccctaatacttaaaacgacgcagtattgggacggattaagaactgtactcgacctaggtggtcgagtgggaggtcgagtgaatagctggagtcttcttttctttcttatgcttgaatgtctggttgagtgcggaatgaagaagactctgaagcttgccatcgagtatgtagtcgagtggtggtgatggtgatactcgacttcccggtagagaggtgtgatcgcggtggtgatctggtgatggagatgaagacactcgaccttggggtcaagtgaggtgatcgagtggtggtcaggtgatggagatgatgacactcgacctcagggtcgagtgatatgatgaaatcgagaagtcctctactcgaccagggggtcgagtggtctcttgaggtcttgaagcttctactcgacctcggggtcgagtggtttgacatgatcaggtccgcttcttccaattagctcgtcaacagctccaaatcacctcaaatcaacacaaatatgcaacatgcatgcaaacctatcctaaacatgcaaagtgatgacaaatgatgagaaatggtataaaacagtaatgatatggtgctaaaatgatgacaaagggatgctcaaaacatgcaaaatacatacttatcagctatttcaagaaatcagatagtagaggtgaatgctaagctggattcagttcataacttgctcacagggaagaagcatgtctactttgcagctgaggaagagactattgagcctgagcctaagttagaggaaggagtcttctacataaatg

SEQ ID NO: 14642 - DNA, 3000 bp, Unknown
  misc_feature (1)..( 3000): cDNA_ID_3018264_gDNA_ID_2684206_Annot_ID_191405 3000 nt of promoter + ATG
tgggaggcaacccactggtttgatttttcttttccctttcttttattttcttttatttttgatttatttttcccgctttctctggatttgaatgccactggggactgtgtcgtctaagtctgggggaggttcttactattgatgcttttatttttgtttcttattatttttcgttttgcagttcatttggttacttcttttatttcccttcccaaaaaaaaaaaaaaacgttttctttagtttagttaggaatcatgatctatatttctcttgtttattgcctgatttatgagtgctgcaggttcgagccaatccgactattggaaaatctagatggcaaaccaacagactagaggatatcctagtttccaactcaaccactaaggctggagctaatctcactactcttccttttacctcttcaaacggttagtattcatagatcttgattcctcgttcatacctgatattgagaccaatgtgataaaaagaatatgttcctctccccttataaaatgaaaaaaatatatataatgagagattgagacgactttcggatagtgtataggggtaggaatgtttcctatgaccccattattatacattttttggaataatcaattacaaaggttggaaaatgccgagggtgtcgatctagtatgcgagttcccctttgtttactctcaaaaaagaataagtcagggggagagaaagaacactgaaaaagaaaaaaatatataaagaatggttaatttatcatggtatagtacatgaatgagtctagaaggatcttgaatggtggcttgtttgatgagacccagcgatgaaagcctggtggatatagttgtggaacttaggtatggaatctagaatgttgtgtaagcttgcagagaagtacatgttggttaggatttgattagacttgttaggcatatggacttagtttgaatgatcatggtaataggctagagaatgttgggagttcctttgttttcaaaacctcttccacgggttcggcttttgtgttttgcttgagggcaagcaaaagctaagtctgggggagttgatataacccgattttcaccaattttatctatgttttacgtataggattttgagtctttaagttatttctcgagtatttttagtgtcttttcaggtattcaattcaatgggacaacaatggagataaggagacattttggagcaaaagctaaggaaaaggaagctaaggacgattttggttcagaaatcagcgaggagtgtcgatcgacacattcttggtgtcgatcgacaccaattttggcccagcaaaaaccctagacgcttttgagtttataaaagatcaaatttgccccaaaagacttccctatttgcattagtagtccctggacgtttttagggtctatatatattgttttagacctaagtttcgtaaataaagtcttttatcaagttctttgcaaaaccctattgtgagagacataagctattcatccattgttcttgagagattcattctagtttttaatacagtgaagagatcctttctttccccttctctgtttactgtgtttatgctttctatctcaattatgttgtttgtttcattcaatatgtctgaatagtctgcttgttaggaatatggtttctcattagggattcatatggtttagtagattgccccctttgctaggttatctgtagaattcttcatctttaattatgcttaatgctagatctagagtaattaactagatcttgaatctagacaatagatatgcccgccataggtatctatagttggatctattatttgatgagtctggtttataggtgtgtaataagaatcggcctatttactaagatgaaaaattgaactcgttaagaatgcatatttaggttgatagtttctcggcttctccggttattattggctatagatatagggagtttcgcggcacgccccccggttattccataattagagtttgagtttaagaatggttcgataacaacctagcttttattaaatctactaactaatagtttcctgaggataccatgttcctagctcttttcctaatcgtttacaacccaatcaatctgctgtctttttactttgtttacttactatttcactcataccctgctagcttaatcttgacatttaactcattgtttgaacaaaagaactttgagaattcgatcctaaaatactgcaattgatctcttatttgagagagtagttctaggtaatttgaaccatatcacacgcgtgtaacacccccgaaccgtcctaaaactaaggacaaattcggaagcatcacgttagacccttgtagttagtcaaccaggtgtccggaacacgaccgttcacatagtcgaccaaccgtgagaaacttttcgtcgtgttcgtggcctaaggcttttcaacccgttccgagaacacgagttgtgttagtcttggactagactaataatattatcgattcaaccatcaattccattataaaaagggttaaatcattacattatatatatacgaataaaacgttaccaaaactcgtatatagggcggatccttattaattttcataggaaatcatatataataaacattatcagtatttgcaagagctgtaaaatctaagctggttggcctaatgatcatcgcgccgtttatagattccccgctaaggtttcgtgtaaacaaaaaggtagcatcatgagtaacctagtattactcaattagaccgggatctctagggtttcacctataccgctatcggaacacctaactataccaagcaatttacaatcaacaagcaagactcaatcgacaatgttgtcagaacttgggtagcacaacgtttatactacactttaacattatgcaatcacaacaaaagacaatgcatcacacaataattatcacttagtatgatttactaacctcctaggcaattataagtaaataaaattaaacacctaaacatg

SEQ ID NO: 14643 - DNA, 3000 bp, Unknown
  misc_feature (1)..( 3000): cDNA_ID_3018234_gDNA_ID_2684206_Annot_ID_191414 3000 nt of promoter + ATG
agaggatcaatagcttcgacatcctgtttgactatcttgctgataaagatcctgctttagctgcaattcttcgacgtggttcctcgacacagacaggacaggccaacgcaaatgctccacctgtggctactgctccagaacagcaggtggctaatgaggagacaacagttgctgccctagctaaccttgcaataggatcctctcctccatcaactgtattttgaaaacattgtctttcttttttgccttcttatctctttctttagaacaagttcttatggtttcaaacaatttagtatacattttttacttatgcaatttcagcttcaattgtgtgttttatctctttagaacaagtttttttatgaaatttcagctttgaattgcatacaaaatcatctctaattaacaactaattaactaggtaattagaggctaatcagacactaatcaagtcttaatatatcagaaaacattgcagaacgcttgcaaatccatcacaaattctgctagagatttgctaggcgaaaaaaaagaattgcaaatccgtcgcagtaattgcgagggaagtactagtacgataattgcgtgtgatttgcgaggaaaacagttcctcgcaaaatatgcgagggaattgcgatattttaccatttgcgagaagcgatttgcgaggaacttgttttcctcacaaatcccttgcttttagctgtttgcgagggattagcgagtaattcttcccttgcaaatcgactgttttcttgtagtgtttaagaaagaacaggtaggctcatagaagggctctggtttagatactaggtgaattaatcaagcttattaacaatgcatactttagcataggatttatcggcttctctagttatcttagctttaagtatagagagtttcgcggaacgccaccggttactctagaatcatagtttgagtttgagaatcgtgcgattacaatcctgatattagctagatctacaatttatatatctcccgagacaattccttagactcgatgctttaatcacttgaatctacaactcatttacttgcttatttgtcttttacattcaattacttcatttagcttattaaacaacatcataagtccattgtgtgagcatcgagagctcagtggaattcgacccttaagtgctaaagacgatcttttatttgagggagtaagcttaaggcaatttgagctatatcaaatttggcgtcgttgccgaagttctcttttagttcaccattagactaggtgtcatattaagtctagatactacttttctaccacctattcacgtgtttctttgtcttttggtctcttgtatttcaggtaccttcagattgagaatcacgttcccatggcagactttcacggttatgtcgaccaacaccatcagggtgtcgatctacaccctctgcagaaccagactgctacaataggcgattttaacagaattgacctcttctacacaaaccgatcagcattcaagctacctccattagaaagagatgactttgctatacaccctgcctattatgatattgtatcaagaggaaagtttagaggagctcccgacgaatcaccattagatcatttggaagtcttcgtagacatcgtttcctctattaaagcagaagggttaccatgctgatgaccttctttgcaaactcttcccccactctctcgcgagcagaggaatatcatggttgcgtcaactggaaccaggttcattaaccaattggactgatacaaagaatgcattcatgaatcacttcttcgatgaatccatgacagaggcaattcgtttgcaaatctcttcattcactcaggcaccaacagagtcccttagagcatcttggctccgtttcaggtcttatcagcttgaatgtccctaacatggcttccaagagacccaactcatcaacctattctacaaaggaatagacaagccataccagaatcaaattgatgtagcgagctactgtaacttcatgacaagaactactagtgaagcattactcctcatcaccaatgctttaacttgtctttcgatgcagggatttgacaaagaacgaagaatttcagctgagaaagctatcaagagcaaagagactcctgttttcgcaatttctactcctatccaagccccgcctccaccctcatcagagaccagaatggagtctatgcttgtgcatcttcttgcaggcctaacaaagcttgatagcaaatatgattctctctccacaaagcttgatatcaactatgattctctctccacagatctcaatagcaagattgacaatctatgctctcaattctacaatctttcacctacatcaacttctatcaatgcagtcacactacgtagtggaaagcagctcaacccaatacttcagcgcgaatgatcagctcagccttcatcttttccaattgcatacaatgaatcagtgccgatcgatacaccagggtgtcgatcgacaccaattactctagaagactctgtttttcctttgtcgaatggaatcgacaatttcgcgcaggaggaggaaactattcccgatggtgtcgatcgacacttagctcttgtcgatcgacacccagctcgttcagacaatgtctaaattccagctgcaaccaagtcagcaaatcggcgaattcccttccccaaaagtcctaaaaagtcaagacaagccttagatgatgtcagatgcaaagttatgattgataaactgattgttgagatggctctagttgaagctattcatctatctcccacaattagaaggtatgttaagccaatggtcactaagaatttgacgaaagaatgcagtgctatgatgatttcagagcaggggcagcgacatcattcaggaacgaatcccaagaaagctacgtgatcctggaacttttgtacttagtgtcaccatcaatcacgatcctttccaagaactttatgtgatctcggttctagtgtgaatctgatg

SEQ ID NO: 14644 - DNA, 3000 bp, Unknown
  misc_feature (1)..( 3000): cDNA_ID_3018282_gDNA_ID_2684206_Annot_ID_191399 3000 nt of promoter + ATG
attaccaaggcacttcaatatcatttgacgaggaagaaacgcggcacctcgaaagatctcatgatgatgctctagtcattacgctcgacgtggctaactttgaagtgtcaagaattctcgtcgatacgggtagttcggttgatttaatctttctaggtacattggaaagaatgagaattagtcgggcaaacatagtgggacctccatctcctttggtggttttcacgagcgaatcagccatgtctcttggaacaatcaagctacgagttctagctggaaagatgtcgaaaattgtggactttgtcgtttttgataaaccgacaacttacaacatcatcctcgggactccctggatttatcaaatgaaggcggtcccctctacgtatcatcaatgcatcaaatttccaactccaagtggagtagaaaccattcagggagatcaagaagctttgcgcacatgttatctagtcagccatcgtctgaagatccaatagcaattaacaaagcccgcgaagaaaggaataatcccaagatttctgagtgggcagaaagtggatattgtggtgatcgaagtaatgttagaggaggataaaccagattggaaagttcgaattggagccactctaaccggcaaaataaaagaagtcctaatagaactcttgaagaaaaataaagcatcgtttgcgtgctcagcagcggatatgtatggcatagatccaagcataatctaccacgagctaaacgtggatccaagctttaaacctgtaaaacaaaaaaataagaaaactcagagtggaacaagcaaaggcggtaaatgacgaagtggacaagcttttaaagataggatctataagggaggtgcaatacccggattggatggcaaacaacgtcgtggtcaaaaagaagaatggaaaggatagggtatgcatcgactttacggacctcaataaagcttgcccgaaggatagtttcccactttcgcatatagatcgtcttgtggaatcaaccactgggaacgagttactaactttcatggacgccttctctggttataatcaaataatgatgaatcccgaagatcaagagaagacatcatttatcaacgatagagatatttattgttataaggtaatgcattttggttttaaaatgcaggagctacttatcaacgattggtcaacaaaatgtgccacgaatatcttgggaagacgatggaagtttacatagatgatatgttggtcaagtcgttgaagaaaaaggaccacgttaagcatttagaagaatgttttgagattctcaatcaatacaaaatgaagctgaacccggcgaaatgcaccggggaattccttggttatattgtgacgaaaagaggaattgaagccaatctgaatcaaatcaatgcctttctcaacatgtcgtctccaagaaacttcgaagaagtacaacggttaactggtcggattgtagctttaaactgttttatttcaagatcaacaaataaatctttacccttctatcaatttctaaagggaaacaaaggatttctttgggatgagaagtgtgaagaggcatttggacagcttaaggcgtacttaaccacaccacccgtattgtccaaacccgaagtggatgaaaagctcgacttatacgtttctgtatcaaaccatgcagtaagcggagtcttgatacgggaggatcgtggagaacaaaaaccaatttactacatgacagatccagaaaccagatatacaatgatggaaaatctcacacttgcggttgtaacctctgcccagaagctgcgttcgtatttctagtctcatcaaatcgaagtttgaaccaaccagccacttcaaaaaattcttcatagtccaagtcagtccggaatattagcgaagtgggaagtggagttaagtgagtataatatagagtaaaagagccgagtcgccatgaaggcccaagttttagcagatttcttgaccgaattatcagtacttggcgcactagagcaaccggagagtcaaacttggaaattgcatgtagacggatcttcatcaaaagaagggtccggagtgggaataatttcgaatctccaacattggaaattcttgaacaagcattccgattttatttaacgctactaacaacgaggcagaatatgaagctttaatcgcaggacttaggctagcacaaggaattggagccgaagtagtactcgcttattgtgattcgcaactagttgttaaccagttcaatgttcaatggagattatgaagccaaagattcaagaatggaagcatatctcaatgtagttaaagatctgactaaaagcttcaaaaagttcgaactcattcgcatacctcgtggagaaaatatgactacggatgcacttgctgctttagcatcaacatcggatcctaaggttaaaagagtcatcccggtggaatgtatttcagagtaagcattaaagagaaaaaaagaagccctcgtcatttcaaagcagctatacgtgatcatggtgaacccgagatagagttgccacctgtcaaatgaagaaagtcaaatggttcaaccatacccgggcccggcgtgtcaaaagaaaatagtagcgaggagcccatcaatccgacagaagatgcagttccagaaacaattataagaaccgagccactaatcgaggaagatatccttgagccaaatgagcatcccgaaccagaactatgaatattccacgagatcgaccaaattctggctaaagattggagggctgattggagggagccaataaagtagtacattgtgacaggcaagctcccaaaaaataagtggcaagctaggaaaatgagaatcgttagcgcaaaattttgtctttcaaaggatgctttgtatagacgaggtgtcagcgatccttatctattgggcatttttgggctcgaagtcgagatcgtcatgagcgaagtacacgaaggtttgtgtggcattcattcgttaggaagggccatg

SEQ ID NO: 14645 - DNA, 3000 bp, Unknown
  misc_feature (1)..( 3000): cDNA_ID_3018307_gDNA_ID_2684206_Annot_ID_191392 3000 nt of promoter + ATG
tgttggtgtcggatcccgcaccatgggctcgggaccggccaaagattgctacacaagtatgggaggcccataagatgaaaagcccgtaagattcttcaaagtaagagtatgggtgagatgtcgattggcgaagtgggtgcaacatcgaagttaggactactcgaattgaagaagacaaatgggccgaagggtgaagtccaggaggcccggagtggtttcaaattcgaacgttgaataattaattcaaagactagaaacggatacatttaaggtagaataattgtgtgtaaatgaggattaaatgtattctttgggtataaattatgggtcaaagactatgtaaagacacacacatttttgtgcaaattagctatacacattttctctacaaaactcacagttttctctataatcatctatctattttctagtatatttgtcctcaagaataatccttctcactaaataaataaatacttgagtatgtgaatctaacatccacattttggcgccgtctgtggggacggaggattcttgagtcgtcagatttcttctgtgtattacataaccgaagtaagccgcaatgtatggagaggatgctaccaacgcttcgatagccgaaaccctcaagaccatgcaacaaactatgggatatggcgcagaagttttcaaacgtggaaaaaaccgtcgaaacactgcaaacaacccaggtatcgcttagccaaaatgttagtaccattccgtctcatgtccgttctttaaatgcgggaaattctactagagttcgaaggactatcttcggatccccaaactcccttccacgaaatgcaacaagcgatcaaacgaccctggatggtacaaacgcgaatagtcaaccggaatatggagaaacgcatcctaaagatgataaccagttcgatgatcagcacgagcaagaaaactttgatcagctcgaaaccatgagagaagtaagtcgggaactcaaagaaatgaggtcgaaattccatcaagctacaagttcggagccagacatcaaccaagttatcgaggaggctaggcgaacaccgttcacccgcgaattgcgagtttgagaatcagagattatcaaaaactcaacttagaaccatataatggtttggaagacccgaaaggctatctcgcagcttttctaatagccgctgggcgagttgatctaaacgaagccgatgaagacgcagggtattgcaagcttttctctaaaaatctatgtgggctagccctgatgtggttcactcagttggaaccaggatcgattagaaatttcaacgaactatcggcagtatttttaaaacaatactcaattctgatggataagagcatttcgataccgacctctggaatctatctcaagggccgaatgagacacttcgggcttttatcaccaaatttaaaaacgtgctttcaaagctcccaaggatctcacaacagtcggctctatcggctttgcaaaaaggactatgtcatgattcgaggtttaaggaagatctaatacttcataagcctgatactattcaggatgcattgtttcgagcaaacaattggatggaagtcgaagatgaaaaagaaattttcgcaaaaagaaataagcaagcaaaactagcggtcacttttccaccaaagaagttcgaacctcgggaaaatcagggaccaaggaagtttggttcacaaccattcaataacaacgtcggaaagcagtttcaggggaaaggaaggtcaaatacctgggtccgagatgaaacctcgtactgcgatatacatagagtcacaagacatctgaccaaagactgcagtatccttaaaaggcatatcgcagaattatgggccagtggagacatttcaaaattcaacatggagaactttgtcaagcaatatcatgaatcaagggataactcagaggctcaaaactctaaaagaccaagaccggctggcaaagaggaaccaagaactttaaatggtaaaataaacgtaattcttggaggatctaaactctgccgtgattccattagcgcaatcaagaaacatagacgcaatgttcatctgaaatcaagcttaagtgaagaagtagactttcaaggcacttcgatattattcgaggaaaaggagacacagcatctcgaaagacctcatgatgatgcacttgtaattacgttggattcgaagtatcgaggatcctcattgataccggtagttcggtcgatctaatttttcttagcactttggaaaggatggggataagcagggccgacgtggtaggaccgccatcccccttagtggcttttacaagcgaatcgctaatgtctctcggaacaatcaagctaccagttttggctggaaagatctcgaagattgtggattttgtcgtttttgataaaccagcagcctataacatcattcttggaactctatggatctaccaaatgaaagcggtcccctctacttatcaccaatgcctcaaattcccaactccgagcggagtggaaacaattcagggagatcaagaagcttcgagaacttgttatttagctagccaccgattaaaaattcaatagcaattaacgaagcccgcaaagaaaggagtagtcccgagattccctagcgggcagaaagtggatgatgtcgtggtcgaagtaattctagaagcagacaaaccggatcagaaagttcgaaacggagctaccttatctggcgaggtgaaggaagccttagttgaactgttaaaaaggaacaagaaatcatttgcttggtcggcagcagatatgcccggcatagatccaaatataatttgtcacgagttgaatgtggatccgagcttcaaaccggtaaaacaaaaaggaagaaaactcggattggagagagcaaaagcagtaaacgacgaagtggataaactcctaaagattgggtctataagggaggtgcaatatccggattggttagcaaacaccgttgtggtcaaaaagaaga

SEQ ID NO: 14646 - DNA, 3000 bp, Unknown
  misc_feature (1)..( 3000): cDNA_ID_3018428_gDNA_ID_2684208_Annot_ID_191465 3000 nt of promoter + ATG
ctcactattccttagttttctccgaaacaactcacccacttccccacttgccctcacttgtgttacaagccctcgttactaagctcggctaagattcttcaaaacattaaaatcttggttgcagtcccccatggtgataacatcgtatttctccaacttttactatttttttattgggttttccatggagaaatcaatagttacaggacacttcaaggcatacttcgagtatttgggcttcaaggaagaattatgagttttcatgctaaaaggagtagaaatcgacaaaattccgtttcagaacagtttttgtgcctcagatgtttggcatccgtttaaggtctttacgatcttggcatggaggtatctcggtgtcataggaaagctagaagagtcaatatttacatcgaagtcgaatcaaagcaatccatgaagccgttcagaagttatggcacgaagagtgaagacatgttctagaatcgtggttttagaaatgatcaatttaaaattgtcggccgaagagacttgaaccctgacgtcccctcaagtattccatcgaccactacggcgcacaaccactccttcccttcctcttgccgccaacttcaaccctccctaagaagcccaggaacttggcccatcacttactaattaatggaaagacgtttctaccctttgacctaatgaagccctataaatacaaggataaggggaaaccctaatcagaacccacaaaattaggctgcctcatgcgcctctcatcgcctccaagtcgtcctcctcttgttattcatttgttttctcttttctcttctattctttattctctacttgtaaaaggaagaagattcatcaagctttggatttccagaaaagatctctaaacccatttcatactcattttctttttatgcaatttcttcttcatatgatgttgtgttctttgaatatgtgtgaatagatctctagttaggttttaggggtttcgaagggttttcatggggactttagatcaagtttaagttggcagtttttatggttttatttgatcgtttacactattatttctatttgaatttaatcttcatgcatgtatgtccggaacgccacctagtacatgatcttaggtagtttatacttggaagaatcttgtataattgctttaactaactcaactgaataaagaactataaccgttgcacgcccgccgagtgatagggacttatggactagaatcgaacttgaacttaatgttttgatcttgtatctcgaaaccatgttatcacctactagccgttagggaaactgagtacgcaaggtattagtggtattagtgagaatagccggcttccacatactaaccgttagtgagtttcctatgtccgagaatttggaagtaaacaaacctaaccatgttatcatctagattgggatttatacctttatgttaaactatgatgcccgaagaaaaccccgaagacctagcgttttgttttactagttttacatcactcttcttattgacatttacttttattgcctttttatagttaacttccattgctttcttatttccattgaattctttacttattttcactgcattcacaaaacctccactgtttcgtttgtcttgatctaggttacctaacttgaattcttccttgtagctacactccctgtggattcgatccttaaatactactctgatatactttgcactcgcatgagtcgtgtggtctttcaggtaaaagcctggggcgaaagaaaacctgcatcaagctttttggcaccgttgctggggagtgattcaagataccgttgcaggggctaacctcctgtcaagacactttaagctcaaggcttattctctttctttcttactctactttgataacttcttgttccccttctagctttggtttttgacatctgcaggtgcatgacaaagagcaaaaactccggtgtaccgccatatcaagacataggtcaactggaacacaaaatccgaagacttcaaagacaacaatcatggccgaacaaaggaaccgagattaaggtctccctgcgtatcagccgcaacaagttccggccttaggtgagcacggacaacccttacacgatgatgatggcaaccccatctacgaggcggccgaagaacatgtcgatccacaagaccgagagtatcttgaagctcaccctctatgcgtcggagaaaacataaatgttcctcttccatgacctcccaattttcctaggcaaccgacatatattccaccaataagactggccgctcctcaacgtacgatagtcaattacgacgcacctaaccggtaccctcaggattgagctgccatacgagtacctagtctaaggcaagattttgagatcaaacctcaaatcattggccttgtgaagcaaaacaaattccatggtttgaacatagagcacccgatggatcatatcaacctcttcgaagaaatctacagtactacacaatcccatgggatacgtaaagactattttaagtgtaagctttttcctttctcgttggccgacaaggacattagatggttaaagtctttatctccacggtcgattactttgtgggaaggatgtaagttagccttcctaaatcacttctatatgaagtccagatccaagtctttaaggaacaagctgcaaggattctaacaaagaccggtcgaatccttctatgaagcatgaaaatgatttaaggactacgaacacgattgtcctcatcatggtttcctcgaaggtaacgttataagtaccttttatagtggactgcataccaagttccaactctttcttgatacggctagcaatggcgacttcacaaccaagaatgttgacgatgcacatgcctatatagagaatttggcgaccagcaacagaaatgcttccactgattttgatagaaccatccatactaaagactctgactcaaacaagatgttcgaactgaagaacacgatg

SEQ ID NO: 14647 - DNA, 3000 bp, Unknown
  misc_feature (1)..( 3000): cDNA_ID_3018399_gDNA_ID_2684208_Annot_ID_191476 3000 nt of promoter + ATG
gaggagaacaaattgtaagtttgaaatttttgagatatttctatgagtttgtttgcaaagtagtacgtttacagaacataattataaaactagtacacttactatttacaatatgtaatgtaatacaggtggttactgttggtttttttgtgaccccggttctgccactacgatttcaatgtaattacagagttgccactgaaacaaaaaaaaaaagaaatttcttctcgactcttcatatttctggtttcttaaggaggttgagggaagttggtttctgtagtacgaagaatatctgcaatgacgaagaaaaagttgagtaaatcgaagacaataagccctccggtggtaatgaaagaagaactgaagcggcgaaactccagagcagatgcacggcgaggtaagtcgtaagactgatgacggttcttcaatcaattttcgtgataatttctgggttaaaaggggttcataattaggtttctgggttatttgtagatacgcttgcaaaatctccggcgattgctcgagggttaagagacgagtctccaatttcaccatcgccggcgaaaactccggcgaaatctggaggattaagaaacgaatctaaactaggtaagcaaactcttatttgttgtccctttgccggtgaatttgatgaaccttatttcttgtcaaggaacattttttttgatttgggtttttctgatatgaacaataggagatgagagatccagagatagtgaatttacaaacccgagcctcccttgccgtttgctgcatccagcggagttctcggatgggggacgccttaacatacactcaaagccggagtatttgggaattctggtggaattactggagggttcggaggcgtgggatgagcaggtgtcatcactctgcaaaactcattcatgggatgcttgcaagacagcttctgacgaagaacaaacatgaattgtggacagtgtatggagggttcccactccgtttctctctacgagaattccaaatgacaacagggctgatttgtgataagcttccatctgaatctgaggtggaagatcaccacgacccagcatacctgtctgtttggaaccggctgtttggtgcgaaaagtatagtcacagtaatggatgtgatagatatgctaagggaggatgctaaagcggagactcggaagcgattctcaacatggaagaagctgagtcttgcattggtggtgctgattgatggggttgttgtatgcagcaataggaaacaacatcgggttacacgagactttgtagaaatgctgcatgatatagaattcttcttgtcttacccatgggggcgcgtttcttttgaatcaacaatggaacggtttggcccttctgctggagaagaagatccaattggggagctgaaggcccggctgtaacacccctatcccgctatataaatataaacgaaatagaagcgttacgttagacgcccgcagtcggccaacccaggtttccgaaacaaattcgtatgcccgagtcgtccaaccacaagagtctagcctcccgcccgtggcctaaggcttttcaacccgtaccgcagacgtgagttgtgttagtccggacaagactaataatatcagtgagtataaccatataactttagaaatccgaatcttatacttatatatatatatcatacgaaaaatggttaccaaaacatatatagttttcggatcctctttgaaaacatacataatatacttagtaaaatcttacaaaaagccgtaaaatctacattggtttgtcctaagtcacgagcggcctctacaaggtgggttaactaaggtttcctccacaaaaagtagcatcataagtaatctagtattacttaatgagccccggatctagacagaactaccataatacctctaccctaagcagcatcgacagaatctaatactacgacctaagaagaataaatacgaataatgcaaataacacacagacaaagaaaacacgcaacaagcaatgcaagcaagacataatggacaaagaaaaatgcatgcagactcgatttcctaatatgcaatggacaactaatgcaagtatgcttgtaacaacctaggtaaggccttctacgaatccatgatctcccaggacatgcctccatctcttagacacaaagtctacaagagacatagcattccctaatactacatcgtcatgtagtgcccggtcggtagcgatccagccccgagccttcgtatgccataacggaacggggttacacgcgacgcacagcatacggacgggatcctcatggttcggctaatgttagtcatctaattaaagactactaacatgacaacagactcatatactactatgcaactatcctatatgcaaaactatactaatcaaacaattaatcatacttaattaccactaatcgcggttagtttccctaatctaggtttaactagtcctaatcatgcttagagaatactaatcctaattgggcatcactaatcctaattaactattactaaacctaattaactatcctaatcagggattaagcgaataattaagctaactaatcctaattaacctcctaagctataataaggaaataaaataataaactatcctattcacgtgctacttcacgtgactcaagtactcacatggattttcgagcggtttggcttctaaggtcttctcccgcgaactaggcgttttctagtggattttgggtctgaggaacaaatgggacgaagtggactatttatagggtcttaagtcggtcataaggtcggccaaaacaagcaggaggtggcccggaccaatcaaagttcgataagtgtcactccacgggcgctccgggacactaatcggtctccgattggtttcctccatttttttccggataaacatcatccaaaatgaataagctcgaccctaaaggataaggatgaccagaattatggataagcttgagccttaatagataaacatg

SEQ ID NO: 14648 - DNA, 3000 bp, Unknown
  misc_feature (1)..( 3000): cDNA_ID_3018420_gDNA_ID_2684208_Annot_ID_191469 3000 nt of promoter + ATG
aaaactgccaacttaaacttgatctaaagtccccatgaaaacccttcgaaacccctaaaacctaactagagatctattcacacatattcaaagaacacaacatcatatgaagaagaaattgcataaaaagaaaatgagtatgaaatgggtttagagatcttttctggaaatccaaagcttgatgaatcttcttccttttacaagtagagaataaagaatagaagagaaaagagaaaacaaatgaataacaagaggaggacgacttggaggcgatgagaggcgcatgaggcagcctaattttgtgggttctgattagggtttccccttatccttgtatttatagggcttcattaggtcaaagggtagaaacgtctttccattaattagtaagtgatgggccaagttcctgggcttcttagggagggttgaagttggcggcaagaggaagggaaggagtggttgtgcgccgtagtggtcgatggaatacttgaggggacgtcagggttcaagtctcttcggccgacaattttaaattgatcatttctaaaaccacgattctagaacatgtcttcactcttcgtgccataacttctgaacggcttcatggattgctttgattcgacttcgatgtaaatattgactcttctagctttcctatgacaccgagatacctccatgccaagatcgtaaagaccttaaacggatgccaaacatctgaggcacaaaaactgttctgaaacggaattttgtcgatttctactccttttagcatgaaaactcataattcttccttgaagcccaaatactcgaagtatgccttgaagtgtcctgtaactattgatttctccatggaaaacccaataaaaaaatagtaaaagttggagaaatacgatgttatcaccatgggggactgcaaccaagattttaatgttttgaagaatcttagccgagcttagtaacgagggcttgtaacacaagtgagggcaagtggggaagtgggtgagttgtttcggagaaaactaaggaatagtgagaaaaaagttgaggagatttttggaaaaagagagtgatgagatgcgagttatggagggcaagagccgaaggtgtaaagattatttctgaagaaggaagaaaacaaaagatcaatgagatcatttggaagaatgaagagaaacacctattaattggagtaaggcatgagggaagtgaagaagccgagaagaagcaagtgattggaaggagagttattggagttcacttaactggagagtaaggagcacaacaaagaagtgggtgaagaaaagattgagtatcgggggaggaacaatttaagagacataggtgatgatcaaaaatcaatatatatggtgagtaatgatggagttcaagaaaaaagatggagtaaattttcaagatcattataaagggaaaaggaagcatagtaagacaaggtgaggtgaatcaaaaactgagaaggtgaagtttgatcaaaggaatatatgttggtgtcagatcctgaacctaaagtccggacaacccaaagattgccacaagaggtatggcccaaaagaaccccgaagtgaaggaaaagatgtagcgaggtgtctatactacgagatggcgataaggccgaattaaggacagttcgacttggagatgttgggccggacagcgaagcccacgaagatcaaagtcaattcaaattcgaacattgaggcattaaaacttgaagatcgtaacggaagcattaaaaggagaattatggtgtacaattaagattagataccatgctttagtataagtaagagaggccttgagccatgtaagggacatgcaatttctagcaatcttactatagacatttgaatataaacttacagcttttacatttgatttttgtcctcaagaataatccttctcacaaataaatatatactttgtgtgaatccgacattcatattttggcgccgtctgttgggacagaggattcttgagtagtaagattttttttcaccacattttcgagacaagcagcaatggccgaagaaagtgtcatcagtgcatcactgggccaaaatactcaaaatcatgcagcaaagcatgtcagacataacgaaaaagttctaagatgtggagaaagttgttgacacactacaaaaaaaccaggtatctcttagccagaacgttagtactatacaatcttgtattcggtctttgggtgtaggaaaccctctaggagttcgaagaagcatgtttagttcgcctggctcccacacgatgaacggtaccagtggacaaacaaaccccgattctgttaataaacaaattctgccggaggatactgcaaatcgatctagaagaagtcgatgaagatgcatggtactacaaggttttctctgaaaacctttgcggacaggcgctgatgtggttcacacagctggaaccaggatctattggtaattttaacgagctgtcagccgtgtttttaaaggaatattccatccttatggataaaagcacttcggacaccgatatatgaaacctgtcgcaaggaccaaacaagtcacttcgtagtttcattacaaagtttaaaggagtgctctcaaaacttccaagggtgtcacactaatccgcgttatcggctcttcgaaaaggattgtggcatgattcgagattcgaagaagatctaatacttcagttagtgctatcaaaaagcataggcgaaatgttctacttaaaacaagctgaagcgaggaagtctattttcaaggtgcctcaatctcgttggaagaagaagaaacttgtcacctcgaaagaccgcatgatgtcgccttagtcattaccctagatgtcgccaacttcgaagtgtcaaaaattctcattgacacgggtagctcggtagacttaatttttctaagcacattggaaagaatgagaattagttggaccgaagtgatttggcacccatctcctttagtagcatatacaagcgagtgagtc

SEQ ID NO: 14649 - DNA, 3000 bp, Unknown
  misc_feature (1)..( 3000): cDNA_ID_3018357_gDNA_ID_2684208_Annot_ID_191488 3000 nt of promoter + ATG
catgttctttaattgtcatgattgatattttaaaacaagttctaaaataagttacgaaaccgatgatttatatacctaaagttctgtatgtactctatatcactaaaatgggtgtttttcagtaatttttatcaataagattggatcaaactatgtggatttcaaaagtttgttttctgaagttttccaaaacgtcacaaaacagtcgctctttgcaacttatttgtgacaaaaaatgaaaataatcgcactttgcaaccaattacctacgtattaccaactctcgatttttgcgtttcgaaattttaaagttttggtgtgtttatatgttttcttatatgttgatactttaatttgatcgatattagatataaaaacataaccaaacactcgaattctgaattttacaaactaaacattaaaaaaaaaactaatctatatgataagtttcatgttctttcattgtcatgattgatattttcaaacaagttctaaactaagttatgaaaccaatgatttatatatacctaaagttctgtatgtactctatatcactaaaatgagtgcttttcagtaatatttaacaatagattggatcaaactatgtggatttcaaaagtttgtcttttgaagttttccaaaatatcacaaaacagtacctctttgcaccttatttgcgacgaaaaaagaaaactgtcgcatcttgcaaccaattacctacgtattaccaactatcgatttttgggtttgaaatattaaagtttggtttgtttatatgttttcttagacgttgatactttaatttgatcgatattaaacataaccaaacacttcaattctgaaatttacaaacgaaacattcaaaaaaacctaatctatatcataagttccatgttctttcattgtcatgtttgatatttttaaacaagttctaaaataagttacgaaaccgatgatttatatacctaaagttctgtatatactctatatcactaaaatgggtgcttttcacagaaggacatggctgctcaaatcaaagacttccagagtaagccaaggcccccatctcccactcccaaagtaagaagaagcggatccacgagttcagctgcaagaagggctgacaagattgaccaacctcgagcttcatcatttgatcctcgggaagtgatcttcgagctgagagagccaaggagaaggcagaggagagcatccaaacgctcgacaacctactcgatcggacatgacgagcaaaatcctcccgcttcaacatcagttcctgcttatactcaagagagtatggacgatttcgtctccgtctacttcacctgatcactgaggtaacaccaccactactattgtatataccgtagctttttgtttttctttgtttgttgtttgttttggtcttgatttttattaactgtgtaatttaagtttggtggagagttcaagacgtatttgacattgtgttctcttttcttaactcaaattttgcatcatctaaggcatagaaaaaaccataaaaatttgatttttttcaaaaaatgatttcacaaaaacagagtgtcaagtagattgcattgcattttacggttgtatatagtgtgcttgcatttaggattgctcatttgcataggggataatgatgatttcaaacctattagcatgtaaattcagtgaagtaagttcaatgcacaggttgttagttctctgttgcataaccgattgtttctctgaagtaagaccgcaccccactttgaatttacaacttgactatactacaagaaaacctgcattttgggacggttagttgtgaccttttattcagtcataaaatatagttacttctttgtgacgacaatctccgttacacattcaaatagaattcgtccttcccaatatcagccggcgacacgaccccataagtcaccaccccaaacgatacaaaccccgactcctgctcgttctcactcgcaatctggctctcaacaaccgcctcttattcgtcgaaagcaacaacaacctcttgcttgtcaacatcagattccttatcttcaagaacagccttctcaggatccaccagagacacagttcataccaaaccatcaaaaccctaataatcatgaagaggaagatggggaagaagatggggacgaattcaaggaagaagatggggaggaagtcgacgaagaagaacaaaaccctaatgtcgactaccaagagctgttggatcgcttacttgccttgccaggccgacaacatcttatgattctgtctcaagagcctattccatgagtcgagactctttggtaagctctataattctctccttctagaaacagatgaagattatgaaatggtgataaagctaagtatggtctggattctttgtgttggacggcactatttgttttgtgttggctctagtgcaatgatttggctttagtgttggctctagcgcaatgatttgggctgcagtttttgtttggtcttaatgtctttgttttgtgttggctcacctaaagtcgatttggtctgaagtttgtgcttggtctgtttgtatttgttaaacaatgtctcacctaaagtcgatttggtctgcggtcaacagttttggtctgcttgtctttgttttgtgttggcaagtcgatttggtctgtagtctttgtttggtctgcttgtaatgttaagtgttggctcacctaaagtcgttttaaaatagtctttgttttggtctgcagtctttgttttgttttgcagtctctcttttggtctacgagtttttgttttgtgtttttgttttaaaaccatttcatttttgctaattctctgttggttgcagcaactaagtcgattatgtttatatttgcaatgtcttggtggtttacctacagtgacataggcttaatacttagtcatattttttttacaggtttaaccaccacaatggaaagctgtctaaagtgattttgagcatatttaggaggaagttcgatg

SEQ ID NO: 14650 - DNA, 3000 bp, Unknown
  misc_feature (1)..( 3000): cDNA_ID_3018365_gDNA_ID_2684208_Annot_ID_191485 3000 nt of promoter + ATG
gaagtgaggatcttctccatgatggctatgcacttagcagcatgaatctcctgcttagaacgacgcttcctaggataagggataggaggagtgtaaacaaactcgggctgcattgggatttgcacctcacaaggtgtagtccgcatccagtgttgatcgacactagaggggtatcgatcgacatcgtcgtattgagtcgtcttagaaaagagtgtcccatagggtgtcgatcgacactggaaggtgtcggtcgacaccatatctgcaactgcgagctccaacttgtcttcagtgtccaattcttcccacacatcatccccttctgtgatcaagatggcattacagctcttccttggtttagcatcaggattaccaggaagaaagccctcttgtctcttgattgattgtgcagttgagctacctgtacatccagcttcttcaagtgagagctcagattgtcgatcttcccattaagatttgtttagacagcatcaaacttgccattaaactccagaacgagctttgttttgttctctcgaatctgctcaagtatagattttattcttgtctctgatgagagtggagggggggggcttggtaggctgaattaccataggtcctctaaggaaaggtcttctagaaagccggcttgggagtatagttggaggaactctggttccctgtaaacctgttgccattgaagttgccttgtggttgtccaaacttcatgtagctctaaccatcgatgtagaagactccctcttcagactcagtctcaggctcaatagtctcatcttcagctgcaaagtggacatgcttcttccttgtaagcaagttatgaaccaaatctagcttagcattcacctctgccatctgattgcctgaaacagctccaacaatcttcttcctctcgaagtctgtgttcttagtgatgttgctacaagcaagattctctatcagagctgtagcatcaattaggtaacgtgtgttgaagttaccattgctcgctgcatctagagccatctggtatctctaatcgactcctccgaagaaggtaccaagaagttgtacctcactgaaaccatgatgttggcagtcccgttgatactccttgaaacgaacccaagcaaccttgaaaacttcagctggaccttgtgtgaaggtagacagcatgtttctcaactcctaagacttagcatcatcgtagaaattgttcaagaaggctatcttgatgcttctccaagtcttgagggaacctgctttaagttgtttccgccaagaagcggcttctccagcaagtgaataagggaaaaacttgcacagtaggtagttctctgagactccattagccttgatgcttagaacaaggtcctcaaagcgctcgatatggtccattggctgctcatgagataagccatggaaaggatgctggcctactaaagcaaagtagctaggcttcagctcaaaatcgttcctctggaagggtgggggtacgatcattgatcgattagcataaaacaggtaaggcctgttgaaatccccaagagtacagcgtgagtaacaaagtgaaagtaaaaactagacgaaatctctaaactaaactcaatggtgattcccaagaactttggcaacggcgccaaatttgatacggttcaaattaccctaagaactactctctcaaaaaagagatcagttgcagtatttaaggattgatttccacaaagttattttgttaaaacaatgagtttaatgtcaagattaagctagtagggtatgaatgaaataaaatgagaacaaagtaagaaaacagcagattgattgtgtgtaaacgattaaataaaaggctaggaacagggtattctcaggaaactattggttagtagatctaatgaaagctaggttgttatcgaaccattcttaaactcaaactctaattatggaataactagcggtgttttgcgaaactccctatatctatagctaagaataaccggagaagccgagagattataacctaaatatgcattcttaatgagttcgattgttcaccttagtagataggccgattcttattacccacctataaaccaggttcatcaaataatagatccaactatagatacctatggtgggcatatctattgtctggattcaagacctagttaattactctagatctagcattaaacataataaagatgaagaattctagagataacctagcagagggcgcgatctactaaccatatggatccctaatgagaaaccctattcctaacgagcagtttactcagacatattgattgtaacaaacaacatgattgaataagaaagcataaacacaacaaataagataaggggagggaaagaagagatctcttcactgtattaagaactgaataaatctatgaaaccactcgatgaatagcttctgtctctcaataacagggttttgcaaaaacaatataaagaccatataaaatgtccagggactaataatgcaaataggaaagttttctgggaaaaatttcctcttctgtaaacttgaaagcgtcatggactttgttgggccaaaaatggtgtcgatcgataccaggagtgtgtggatcgacactctctctgatttctgaatccaaaatcgtccttagcttccttttccttagcttttgctccaaaatgtctcctaatctccattgttgtcccattgcatagaatacctgaaaaaacactaaaaacacttgagaaataacataaagactcaaaatcttatacctaaaacatagataaaatcagtgataatagggatatatcagctataaacatccaacaagaagatgagtctccaacaagttatcagactcccaatattgaggacaatatggttcaagaaagggggagattcaactcaaattgctgcacctactacccatcaatttatctggactataaagcacacacctttgctgaatactcaccattctggaaaaaaaaaattaagag

SEQ ID NO: 14651 - DNA, 3000 bp, Unknown
  misc_feature (1)..( 3000): cDNA_ID_3018389_gDNA_ID_2684208_Annot_ID_191479 3000 nt of promoter + ATG
ctgtaattacattgaaatcgtagtggcagaaccggggtcacaaaaaaaccaacagtaaccacctgtattacattacatattgtaaatagtaagtgtactagttttataattatgttctgtaaacgtactactttgcaaacaaactcatagaaatatctcaaaaatttcaaacttacaatttgttctcctcgcgtgtaatggctcgttccacccaagttgtgcgtagctattcctttcctgcctcgatcgcttttgcgatttttggagttagtcttggatattgcttgggtctccggtttcacccaatgtagttgcaacccttcaaaaactttatcattcacccctctaggttttttatctttgacccacctttgcttccactcattgattgtgccacgataacgagaagatatgtctttgtcaaacgctttacgaacctctagcgtcaaattccgatcccaattaaactcttgctacaaaataaaaaaagtacgttgagtaatacataattaaagaacaaaaatacaagcatcatcttcaaaaaaataactaaccgcgaattgtttcaaccacaaatcttgttctttcgccggcattgacgagtaagttggatatggatccttgagtagtccttgcatcatcttcaaaacagatttgcttatcccgtttcccgaactctcaaacctacaaaagtttgaattttataaatttatattaataattcaaaaagatagaaaatgtgaattaaaattccaacacttaccatgtttcatgatcgattctatcgggatggagctttgtgagtcgttctcttcctggttgagagatgaagtcctcaatgctcatcaccatgggagtctctgacgttggcgactccggactaagactaggggttcgtgaatttgaacgggacggttcttcacaatcttgagtagatcttgattggttatgacgacggtagttaccataattcctaaaacaaatgtaaaaagaacattggttatttatgaattaagtcatcaaatttatgaaaaagaaaagtagataaataaaactcctcacaataaaccaaaacaagaaataaaaataacgtttatacttaggaaaatatagctttcaacaattcaacaattgattcacaaaatcaatagattcacaaaaattggaaaactaattcaacaattccacatcactaacacatatatgactaaattcaacaaaatctaacacatatgtgtttaacccataactatccaccgaagcatataaaaatccaattgaaaaagctttaatctaaagaacaactgtatatagaaaaagataaactaattacacaaggtccatttgaacaagaagattacacgatgacatggtacccacggtattgacaattacaattcatgccaataattgaaacagctttgtacgcttggaattttattttattagttaaaaagtaattagagaaatcacttacatgttagatgtgacgaaggtgctgctctaagggaaataggaggagagaattggcggaaagaagaaggagggtttgagagagatgaagttaaaaaagaaaatggagaagagggattaaataaggaccactggttttcccattattatgatataaccgacagattttttgtcggtttacgagaaaactaaataaaatattaaagggcgcgctattcgatagttttgggaaaactttatttggcgggttcaattttgagatgcgttggtaatccatcggttaaaacaacggtttatcaattaatttcgaaatttttatgctcttcttataatgatcaattaaacgattacaattctgaatttattcttccgtcaggaaaccgtcggtttatattatgtattaaccggttccggttaggataagtttagggtcaagagttaaaatttcatataaacaaaatgaaatgatcaatacaattaatgataacattaaaataaaactatattaagtgtatatatgtctctattttactctcatttacaaaaaaaatgtataatgaaaaaataaaaatgtcatctacttaagacaattacataagttaccttagaagtttaagagtacttgtgttaaaacaatttcgaatctagaaaatcaacaaataggaatcaattgaaaatagtttctagactctaagttatttagaaatcatcaatgaacatttgcaagcatgttaggctaattaatttgtactttcgataccctaaaacaaaagtcgttgggtaaccgtcggtaatccgtcggctaaaactaacggttaaccgacggaatttttggataatctacttaacatttttgaagtacaacttaacccatcaatcttgggtcggtttttttttatgggtttaaccctcttttttttggattttcggccaaacacatgatttgagatgatatttggcccgtaaagaaatcttaccaaaatttacaaatcgctttaaatactaatcaattacaattaatgatttcccttattatcgaccaaattgaattcgtaatatatgagaatatttcaaaaatctcgctaaacaattccctaatatctcgctaatcaaatcatggatagagattgtgattattttgatttgttaccaaaaatctctcaaaacaattccataaaatctcgataatcattatatattatctatttaaagtaaagaatttgaattgaatttctatgctaaactatttgccatataaatctccacagaatattgaaactatattattgtattacaaacggatttggtgcatattccttaaaaatttgattacaaatatttgattctcatttagttaagactggaataaattttattggccaccaacctaatcggaactcgcctatatatactttctacctctcatcacaatatcaaacacacaaacaaatttcatcacatatctttggattcgagacaaaaaatgaaagaaatgattcatgttaagagattagctgaattcatcat

SEQ ID NO: 14652 - DNA, 3000 bp, Unknown
  misc_feature (1)..( 3000): cDNA_ID_3044781_gDNA_ID_2684211_Annot_ID_137329 3000 nt of promoter + ATG
gcttgctcacaggggaataatacctgtgacccgattcaacgcggaggcccatgtcagaaacctgatttgaccgttttgcacgccagttacgcctttagctcttattgggcccaatttcgtaagatcgggggaacttgctccttcaacggcttagctacacaaaccatcaaagatccaagtaagttaaattccaaaatccaaatcataattaaaccgattcgtaaattagttccggttcagtgatatcaggatgttaaaaccggtggtggattttgggtttgctaaatttttgtactctgttgtcgcttgaaaccaggttacggacgatgtgagtttccgagcgtgacattgtgaagacttacgagttacgaaaatgcatggtcgagaagagacgcacgagggaaaaccgcacgatgttacggctttcattaatggaaacagcacgtgactctctgtacgatgttacgtagcttgattatttagaaacggcacgtgattagtgtttaacttgctgtttatttattttatttttcttttcccgcgaataatgaaaactcatgaaataattaattcgttttcgggtaatgcaatcgccaatcggtctcttatgtgtgttaagctgaacaaaacaataaaattactaatgttctaatgggaaaaagtttgcaagtttcagactgtttccttgtttttattgctaaaattattagaggaacaaaaatatatgatcttcttttgttaacaaaaagaaacgtttgcaaaattgatcttacttttgaaaaagcacatgtaactattgagaatcggatgccatgattctcttctctgcatcgtgactcgtgagaataggatgtcgtcatagctttctttctcactttgcaaagaaaatgtttgaccttttgcagctaaaaagtacaaaccatgaagttgtctctactttactcttctgcatgtataaaggattcgtatgtggtcaatacattcacaactccatttcaacttcataagcggtaaaaacttgttacacaattctctcttggttgattgattgctcttctttcttgttaccaagtacaactttggatgtaattagtgatgagattgttatttatttgatcgttttgaccatgttttcaaatgtcgaaattttcattttaaccatgcgttcgtacaccttctactctctattgtatcatttcattcaatatctggtatatatatatggcgacatgtgttgtgctccatagtgccctcatatatatgttcgcttttgcttccctttttttcttctgctaattagctttaattacatctactaaaaaagtaaaaacacatttatgaaaaaaacatagtaataactagactatgacacgtaaattagtggtttaacttgtgtttgtaccattgttatatcaccatggagatttatcaaaatatatatatatttttaaaaaaagagtttagtttaacaactatatttaacaactatatcgaacatacacttagacttacatctatgccattgtctcatctattcacatttgaaatcttttagaacgatgggttaaaactctagattaggctgtggaccacccaagtgatagcaaacaatgtacacgccgctatgataggagcttccacttatcctaataattaaagtattcaataccacgattcagaagtcatccaaagtcaaaacctcgcacgagtcatgggctcatggcttacccgctccgcggttgtactttgtatatgtttcaaaagcaggaaaacattttttaaagcaattgtaaaataacaaaacaaacataaattatttgatagccggaaactatatatgtatttgttacggccagaagttgattataaccaaagtagttaaatcttgaatctgctttttcattctaacttttttttttaccacacatcaatccaaaatactgccgatgaaatttgtaattagtatcaacttctgtctaaaatacaaatttgaacttctaatttagatccaagcgatgacaactacatttcaagtatcattgtagtttgatagactagtgttacactaaacctaataaatataccaatcaacacacaatgaacccttgttcaggagtaataagggttcaaatttgcaactcttttgtcaagggaaggaaataaataatcaaattgttagccgatgcatgattgacgaaaagtaggggtgttttttacaaataagctaagatggctttagaggaccaccaatcggtccaatcctttaacactcagagcctgaggcagagaacacgatgggtcatcttatatttgtttataaaattgccaataattgagataaggtatcatgattcatcaatctagctagactgtgtgtaccatacataaactataacccatgtgtataaaatatacaaatatctgtgaacatcaaccacctaactataatgaatatgaaaatcatacgactaaactaatttacgtaaactatactactttgaaacaattattcatcaaattctcttatactattaattgtggtttactaaacttccaagttttatgttttactaatcctgtaaaattagactttagccgagtccgtttgaatctaggatttttgaaatttccaggtggctcaaagctaaagaaaatgtgaatgagaaatgatttcaacgaaaataagatttacataatagccaatgacatatatgcacttgtcaagttggagttaaacaataaccacacaccgaattgaggagcccattggaaaaaacagaagcaaatatatttttatgtaaaaatagaaacggaataatatagtaacaaaaagatactctcttcaaccttatccattcttcgccacttctcccactaatccgctaaatcattcttcttcatctctctctcattcacaattcccgaaattctctcaaatcacagatccttttagggtttttccactgtttctaggttttttttattgctcaaatctgatca

SEQ ID NO: 14653 - DNA, 3000 bp, Unknown
  misc_feature (1)..( 3000): cDNA_ID_2730470_gDNA_ID_2684211_Annot_ID_137330 3000 nt of promoter + ATG
ggtcatcttatatttgtttataaaattgccaataattgagataaggtatcatgattcatcaatctagctagactgtgtgtaccatacataaactataacccatgtgtataaaatatacaaatatctgtgaacatcaaccacctaactataatgaatatgaaaatcatacgactaaactaatttacgtaaactatactactttgaaacaattattcatcaaattctcttatactattaattgtggtttactaaacttccaagttttatgttttactaatcctgtaaaattagactttagccgagtccgtttgaatctaggatttttgaaatttccaggtggctcaaagctaaagaaaatgtgaatgagaaatgatttcaacgaaaataagatttacataatagccaatgacatatatgcacttgtcaagttggagttaaacaataaccacacaccgaattgaggagcccattggaaaaaacagaagcaaatatatttttatgtaaaaatagaaacggaataatatagtaacaaaaagatactctcttcaaccttatccattcttcgccacttctcccactaatccgctaaatcattcttcttcatctctctctcattcacaattcccgaaattctctcaaatcacagatccttttagggtttttccactgtttctaggttttttttattgctcaaatctgatcaatggatagttgtctctctaatcaaacggcgcttcagtttctcccgtcgcgttccaggagacagagcggcgatggaggcggtggttttgttattccggcgaagaggaagatccagtatagttcgatggttgtggttgcggcggcgggacagagtcggtgtgagcctggaagcagtctaaacgcgccgcttgagccacgatcggcgcaggggaggtttctgagaagcgtgttgctaaacaaacggcagctatttcattacgccgccgctgatgagctaaagcaactggctgatgatagggaagctgctttagctcgtatgtctctcagctctggttccgatgaggcttctctccacaggtccgtgaaacctttccttatctaatctctcacaattcaaagatccgtaaacagctgtagaattataaacatacaaagaaatatgtgtaaatcattacttacatactcttatttaatcgaccacaaatcagtattttattagtatttatcacataagcttgtaaagtttgattataagttgtttgatggtgtttatcagtttatgatgatttgagaatcacactaatgatatggttgaattgaaacaagagaattctgtagttatgatcttcaggtgctttctcatactctgccttgtgaagcaagttttgttttagtgtttgataagggctggttttgcttttttacatttcattgttgcttagttcgttaaatagtttccgtatattttagtttcttgcctgtgttaaactctctgacttgctcaggccattttatgctctgtttgtgaacattttctcaactatcttctgctcttttacgaacactaacactctgattccatggttggcagaaggatagctgaactcaaggaacgctactgtaaaactgcagtccaagacataatgtacatgttaatcttttacaaatactccgagataagagtccctcttgttccaaagctatccagatgcatctataatggaagactcgagatctggccttcaaaagactgggagttagagtcaatttacagctgcgatacccttgagatcatcaaagaacacgttagcgcagtcatcggattacgggtcaactcatgtgtgactgacaattgggcaacaacgcagatacagaaactgcatctcaggaaagtatatgctgcctcgatcttgtacggttacttcttgaaatcagcttccctaaggcaccagcttgagtgttccttatcagatattcatggaagcggatatctgaaaagtcccatctttggatgctcattcacaacgggcactgcacagatctccaacaagcagcagctgagacattacatctcagactttgatcccgagacattgcagagatgcgcaaaaccaaggacagaggaggcaaggaatctgatagagaagcaaagtttggctctttttggcacggaagagagtgatgagaccatagtgacatcgttttcgagtctgaagcggttggttctcgaggctgtggcgtttgggacattcctgtgggacacggaattgtatgtagatggtgcatataagctgaaggagaatgggaatgcagaagaacaagaaggaaagaaaagcatatgatgaacaagtctggttagaagaaaagcttcatgatcttctggtagtgtatatatagagaaatgtttctgccgaatctctcaggcagttgttcagttcaatgtatagatcttgcttagaaatattttgatttctgaataagaatgtggtgtggttataaggaataagagatactgtagttgggttcaattttatgttatgtgttaagtttccttgttcaatttgatctttctccttttgtcaaaagactcaaaacctcaaaaacaaaactaaaatttgggtcccaaagaagctatgcaaagggaaggagatactttgataatgcttgtatttttgggcttattttaggcccaaatagcaccttatttcggcccaaaagttagacctaccaaaaaaccttcaattgtcactagagcgaatgaatgtaaaaatctggtctcctattatcaattccgtttctctctcgccggaagatttttgctacttcatctccttatcgccccaccaccgtcacatattcactggtaagcatatccattttgcttcctcatcttccacattaggcttctcccattttcttcttcctcccgccgcgaatcgcgcgtgattagggtttatgaaatctaacgcctcaggtttcgcattttctcaagtttctcgttaatttcggttaaagaag

SEQ ID NO: 14654 - DNA, 3000 bp, Unknown
  misc_feature (1)..( 3000): cDNA_ID_2730462_gDNA_ID_2684211_Annot_ID_137332 3000 nt of promoter + ATG
attcctagagggtgtaaaccaaacgtccacacttacactgttttgattgatgggttgtgtagagacggaaagattgaagaggctaatggggtttgtcgaaagatggttaaagacaggatatttcctagtgtaataacttacaatgcgttgataaatggctactgcaaagatggacgggttgttcccgcttttgagcttcttactgtaatggagaagagggcttgcaaaccaaatgtaagaacttttaacgagcttatggaagggttgtgtagagtcgggaaaccgtacaaggctgtgcaccttttgaagagaatgctggacaatggcctgtcacctgacattgtgagctataatgttttgatcgatgggctttgtagagaaggccatatgaatacggcttacaagctacttagctcgatgaactgctttgacattgagcctgattgtcttacattcaccgctataataaatgctttctgcaaacaagggaaggctgacgttgctagcgcgtttttaggtttgatgcttagaaaaggaataagcctagatgaagtaacaggtacaactcttatcgatggtgtctgtaaagtcggtaaaacccgtgacgcattgtttatcctggagacattggttaaaatgagaattttgacaactcctcactccctgaatgtgattcttgatatgctcagtaaaggttgtaaagtgaaggaggaattagcaatgcttgggaaaatcaataagcttggtttagttccttctgtggtgacatacacaacattggttgatgggttgattcgatcaggtgatattactggttccttcaggatcctagaactgatgaagttaagtgggtgtttgccgaatgtctatccatacacaatcatcataaatggtctttgtcaatttggaagagtcgaggaagcagagaagcttctttctgctatgcaagattcaggagtttcaccaaaccatgtcacttataccgttatggtgaaaggatatgtcaacaatggaaaactagaccgtgctcttgaaacagtaagagcaatggttgaaagaggatatgaactaaatgaccgtatctattcttcattgttacagggatttgtcttatctcaaaagggtattgataattcagaagagagtacagtttccgatattgctcttagagaaaccgatcctgaatgtatcaacgaactcatatctgtggttgaacaacttggtgggtgtatcagcgggttatgtattttcttggtcacacggttatgcaaagagggaagaacggatgagtccaacgatctagtccaaaatgtactcgagagaggtgtttttcttgagaaggccatggacatcattatggaatcttattgcagcaagaagaaacacaccaagtgtatggagctgataacacttgttctcaaatccggatttgtcccgagtttcaaatccttctgcctagtgattcaaggtttgaagaaggaaggagatgcagagcgggcgcgggagcttgtaatggagcttcttacctcaaatggagttgtagagaaaagtggagtgttgacttatgttgagtgtctcatggaaggagatgaaactggtgattgcagtgaagtcatagatttggttgatcaattgcactgcagagaaagacccaccttctaaaattattattacacatgattttgtgtagcttttttgtttgtttgtagtagcaagaagagaatccttttgaagtacagcgtgtggagatcataccttgagtaataccaaggatcctagttgggctgggcctggaagatattaaaataaatctacgaatgggcttttagcccaaatgttaaattgtggcattaaaagccctttctctttcgtctctcaaatataaattccacttttgcgaaattgagaccaaagtttcagtttcattggctggggttttgagagagagagagagagagattcttcttcgtctcgtaaaagagtaatagttgtaataaaaaaaagaaaagaaaaagacacagaagaaacattacagttatatacagaaagagaaggtatatatatatatataaacacgcacccatatgccaacacatggagattgatagagagagagagaagagaagatatttctcagtttcttcgtttgtatatcttcttcttctctctctcttttgagatcttccaatctctctctctctctcttatatatgattttttcaaataaaataaaataacggaagctggtttaaagaacaccgttgaattctattttcccataagctgaaaaaaaaactaaatttttgtgttgcccaccaaaaggtttgaaattttgatccgacgatacttgagctgatttacgttattagtgctatttcgatttcctcaaagatttcgttttttttttcttctaaatttcttagttaacctcttgcgtgtgcaattggtgcacttagcaattcctcttctgggctggtgatttggtttgcgattgttttttttttttagggtttgattggatcgtggccctgatttagaacctaattgcggtcaaaagagtctgtgggaggattgaattggaataaagtgttatctttttttgattggcggaattcacattcaatcggaaagaggccaacttgttggcggcttccgatataaaggtgcttttgagctctgctcatatatcttatttaactccaacgaaattgagagacgaatggttccgattttgattttctctgctcatcatgggtttggcaggttagctacaaatcttgaggtccccaggtgcaaaattactaattttatagtgtatacttaaggataattgaagtgaaatttgggagatcataaagaaatgtttggagcttctaagtgatattattggatatggtggactggatcatagattctgatctggtcaggtgctgggacttaggagcgacaaagtaactagagagtggtttaaagtataccacttttaacggataagtggtc

SEQ ID NO: 14655 - DNA, 3000 bp, Unknown
  misc_feature (1)..( 3000): cDNA_ID_2686488_gDNA_ID_2684211_Annot_ID_137333 3000 nt of promoter + ATG
agattttaaaatatagagaataattcaatgtgcctttattttattttagagaaaattctattttagatatatataatggactaaaattttttatataaaaaaaaatttcttaaataaaaaataatataaaaatgaacattggagatggtccgtaaaaaaaatggaatattggagatgatcttgtttaaatactaattacggaactacctactttagagatatctatgtgttaataattgtggtatgtgctaatgatatggctatgtcatcctcttatgttatattgcaagttgtttcaaaacgaaaagtatttgaaaatggtcgattattatacgtatatacgagtaaaaacatatttcagtccgaactaatataattatactctctaactactttctttttttggtgaagtactctctaactaccttacgacaacaattattacctgaacattgaacaatgaatttattacgaaatacaacatgatctacaagatatatcgtgaaacacatttaaatagtccttatttggcgttaaaaattgtgttcatggtaagtttaattagcgtataaatatgtacgatagatatagtttgggttgaaatcgtatattttccccttttctccgttatatgattaaaaaaaaaacaatttgaggcatagaataagcccatttaactcctactagcctcactcacttccccaaatttcttaatcaccactggatactatgggctatctaatttattttaaaataataaataataactacttaattttttataacatttttgggggcaacaacttaatttttaatggaccttataattaatggaaaactgaaataattaaaataattattactagatgactaacttttttatacaaattaccaaaagtgaatatggaagatttttttgtttttttgtttttttttgcaacataccctcaatagtttaaaactatgcacttttattttttacatttaatgttatttctaatgatactgtattacattttaaaaaaaaaatttattttaaatatagcacattattttaacatattcattatgcactttagttatgattttgtcacatatttttgttatctatctaattagctcaataattaattactcttatatttgcttaggatgtaaaatggaaacttatcataaaataacatgtaaatattattaaaaataatttattttcttatttgtcaaagataatgtacttattataaacactaaaacaaaaataagtaatcaccattaaacttatttttatgtaaatgatatctaatgattaaatggtatatattggtggataatgatgtagatatattcaaagattaaatactatttttatgtctgtacatatatggttattttaaaatttttatttatgtctatatgtctccttatatatgaatgattccaccaaaactctttttttttctcaacacattccttatgaactttgtatactttggctatatatatcaaattaaacacaaagaacaagaatgtacaataaaccattcttctgccatggatacaaaaggtactttccttgtcctatctttcttcaattatattacacagcccttattttacatttgatatctacaaattaacatacatttgtatatgtaaatcagttatcaatgctcttccactatcgatttggtagtctttcttctccaaagtccaaaccatgttgcattgagaggatcatctctattaatgtctgaaaatctgttttttttttcttcatacatcatgttttctcagtcggcttgaggaaggcaacgctttccacttgatctaataagatattcatctcaagctaacaagagaaagctttttttgttctctttctgaaactaaaacttataaaaaaatctctaatgttttcttatcctttcactcgtaaacgtattacgtataacagtagaaacttatcatgatacaaatagttcgtttctttgattactttttaaaaatgactttgtaatttcattgattctgctttacgaatgctgaatctggaattttgttttgcttttgtttagattatatatattttagatacatataatatagttagtttcagttagagtatatactaataaagagcgaccgatctaataaaattagtctactagattggttaggtagagtctttaaatataatcttgcaattgatattccctatcagagcatattataagaaaagttccggtgacgtattcaaccattaaaccaagagatagagaatatgattttaaaaagttgatttggagattatcatctatagttttttctgccatctctggtaatgtagattttttatttccacaaataggtgaaaaaaaagaaggaaaagaatcaagtgggttactagctaggttggtcggtaacattattattttgggacagaacatgttgaaaggtttggtgcattcgaaaagtcttcgccgccttgcctttttaaataatttttgttttaaacatcactaaaaagactatagtctatagaaaaagaaaagaaaaaaagtcattagttttaatcgcattacgctttcggataacacgaaaggttaaattataaaatgaacgattttacgaatccacatattcctggatcaacgggaacccttcgtttctttcccacccgcgtgttatcccgtttctcaaatttctcatctttccgggaaaattcactttttttttttcctgggaagattcgttgtgttgtgaattttagtgggcaccttcaaattttcgattttttttttattttccttgtctcttacctgatttggtgatttattattacatcaaccactcgattcgttagatttccggatttgaaaaagagtcaccaacttgtacggattctcgttttggggatcgagtattgctgatttgtgattttgttgtttttgggtactttccctttgtggattcggatctggttggtggctttgtcaaatg

SEQ ID NO: 14656 - DNA, 3000 bp, Unknown
  misc_feature (1)..( 3000): cDNA_ID_2730454_gDNA_ID_2684211_Annot_ID_137335 3000 nt of promoter + ATG
tatgtgttgacttttaacagtgtatgcgttgactaagtgatgtacagtaatgagacggggaaaatcatactaatatttccttccgacaactttatctgtactatgcatagtacttttgagacaactttatctgaattttgtatagtatacttttgggttgtgatatattttctcgtttgatttttcttttcaactaaataatatgcaaaccaaatccgctttcgccataagaaaacaactaaaaggttaaatttacccgagagtgtattaatgttgaatagccatataggctatagtatgtatatggctgaaaatagcttatgcgatttcttgaagagagagaaaaggttaaatccgagagtgttttactcatcaatgtcattgtcattctacatatacaacgtaacaaagaaaagcgagaaaaacttaatccgacgagtcaccaaggtcaaaacacctaacacccacttatacactcattacgtggaaacataaaagatatactaccaatcatcctgctcctgcactaacaatcatctcgatgattatgagagtagggtaacgagggaaacgaattcaagggtaactcttccctttgatctcgtgttgatgacgaaatgctccgggtattttctcagcagcatcagcaaaccgtaccatggtttaccttttgcttcagggatagcccagtcttcttgtgataggtatcttcttactcgactgtgatgccatacgtttccatactcctttaatatctgtcacagaccaaccactaccatgcattagctgcaaaaattgttgatcatcagcttcacgatctgcctttgatcttccctctctcttcttctctgcacaaatgaagcagatacaatgtcgtggtgtcactatcattcaatctaagtctaacaaggttcaatcatcaaccaccacagtaaaacttatactcaaagtctagaacaagcctgaaatctatttagtgacacaatgaagttaagctatcatgagcaatttggttttacctccagaggcatatactccttcatgtccatctctccatgttttctttccactgcctctgatatcctcctcttcatcgtcgtcttcatcatcgtactcatacaactctctactccggacgccattcttacccgacccggaacctggacccgaatgataattatggtacggaacaacagtagccttccctaagacgtggtgcctgggtcccaatggaccgcctaggatactccaaaccggaagcaggaagtagaactccttgtcaccaatctgcaaaaggtcctgtgaatcgagcttgacgttggggttcccagggagatggaggacaccttcaacgaagcagccatttttgccaagtacctcgagagagaagcgtcgtctagtgaagtcatagaagatccgagcgtggttgcgagaaatgttcatcccaccgccgagagatgagaggtcgacgtcgacggtcgatttcttagaattccggccgagaataatggagtaagactgcatatagtactcgaaatcctcaccttggagcttcgcaaatccaacctctacatcgctcccgcttccaacggctgtagccatgccgtgaaatttctccgattttgaagtcggagatcaaatttggggttacatagtaatagaatgtgtttggaaaccggtttagatatgttgtggttaaaccgtacaatgaaaaatataaaggcttctcaagtaaatgactattatacccatcatgttttcagcctctccactgtcaatgttacgggccttacggcgatcaaatcaaaacgggcagtttgtttccacggctaacaaaagaaacagctttagttgggccttatctaaaaagcatcagcccattaacgtgaaccggatcttatgtacataaacccagtagtatgtaatattcggggataagcatgacattgacatgaatatggatcatgtgataaccgtaaggcttgaaattatgatgataaaatatgatgaaaagttcataagaatatcgtcacatttttgtcaaagaaatagcaaagtcaagaatggttttctttttctagaatctttgctttacattttgttaaacatttaatcaaccgaaaaaatcacaacgagaaaagaacatttgctatattccacagtgtattcgcagaatcttcctttgtttttcttgtcaacaattcaaatagtctcaatcctctttccactttccaggtgcaattcatgcaagagtaaggctggaacttgtgatagccaagctataataaagcaacttcaacaagctattccactattcgaataaagacacgagtcatctatctactcaacataattctttacagccatttgtcatctagcacgtgcccatgaagccagccaaacatgaaccacgtcgacacacatcagatgagaataaccgttacggcgtcatttgctgacctggactgtctaacctattgcactgtctctcgaagatggtcgccacatgtcaatcccggggtcgtgtttatgctcgagattcgcggagtcagatacgaacacaagaattcaaaacacccaacgtgtcctcgtcaaagccagcaggatctcagtgtacacgtgttaactgtttccatgcacgtgttacacgtggcgtctcggtacttttcgtcaaaattttacttgatttttacaaccaatggaaatagaaaccaacaaaataaatggaaagcgtttatcgataatccgaaattgtagcgctaataaagtttcttaacctttctcttagtgaattttgaaaccgcccatgtccactatccttatcggacatgtgtcatgttccgaagcctttaccattctctttttaattatctccgccccttataatattcctttctcatacaacaaagttggcgaagcttcaaaacccttcaagaggaaaattttgcggaagacaagagaccatctttttgacattatatgtttgttgaatctttatca

SEQ ID NO: 14657 - DNA, 3000 bp, Unknown
  misc_feature (1)..( 3000): cDNA_ID_1017434_gDNA_ID_2684211_Annot_ID_137337 3000 nt of promoter + ATG
gtgccattaaaggatatctatagaagtgaattccttcaaataacaaattgccaattctaaatccattacgcataatttccacacatcttaagcaacttatgtccagaccagaatctagcatagtcatgataactaaaagaacagtaaaatgcaacccaaaccatcaaaatgggaaaggaaaaaaaaacgacttttcacattttcttggatctcataatacaagcggtcaggagctcaaagccctttaagcataatttgtagaacctgaatcttaaaaaaaaaaagaaacacaaatacatgatttcccaccgttcctcaggattttaaacattctatagtcagatcctcaggaaatcaaagccattacacaacacatttcagaacattataggctaaatgatttgaaaacttgaatcctaaaattcattaagctgccccaaaaccaagcttctactaacaaaacaaactacaattaaccatccgaatcaaaccatgcacccaaaactcgaattgaaatttgatatatctaacaatgattgagctgccatcagaatgaattattagaaaataattttgtcacggttccttcagaccagagtaaactccaatcatccgaaactcaaaacccttgcgcaaaattttcaatcatcatttggcaacttattcaatcaaaccaacaacgaaaataaacaaaaggttacataaaactaaccaagcctatgttctaaagcaaacgaaatcaaaaaattcaaacaatcaataagatgctccactatttgcgggagagatggaacctttaagctcacagatctcgccgccattctcaatgtttcttcggctgttttaaatagttgtgtcattagggtttttattcaggtcttaaaatcatgggtataatcgtcaatttcacaaaataagcctttgtcctggataagctaaaccagtttccaaacaaatcttgcttcgattcacaaattattacgattgcaatccctaatttggaagtcccggttcctctttcgatcaaatcggagaatttcacggcatggctacggctgttggtggcggaagcgatgtggaggttggatttgcgaagcttcaaggtgaggatttcgagtactatatgcagtcttactccattatactcggccggaattctaagaaagccaccgtcgacgttgatctctcatccctcggcggtgggatgaacatctcgcgcaaccacgctcggatcttctatgacttcactagacgacgcttctctctcgaggtccttggcaaaaatggctgcctcgttgaaggtgttcttcatctccctgggaatcctaacgtcaagctcgattcacaagaccttttgcagatcggagacaaagagttctactttctcctaccggttcggagcatcttaggcgggccgttgggacctaggcaccacgtctctgggcaaacaagtgttgttccataccataattatcagtcgggtccaggttctgggtcgggtaagaagggcgtcaggagtagagagttgtatgagtacgatgatgaagatgatgatgacgacgacgatgaggaggacgatatgagaggaagtggaaagaaaacaaggagagatggacatgaagtagtatatgcttccggaggtaaaaccagattgctcatgattgtttgagttttcattgtgcaactagatatgtttcagattatgatgcttacttgatcacatcaggcttgtttctttagactttgattgtggtggttgctgattgaaccttgttagacttggattgaatttgaatgctagtgacaccacgacattgtatctgcttcatttgtgcagagaagaagagagagggaagatcaaaggtagatcgtgaagctgatgatcaacaatttttgcagctggaggaaaaagatgttgtatcgtctgttgccactgtgctttccgatttgtgtggtccgggagagtggatgcctatggaaaaacttcattcggtggttagtttttatgagaaagttccttgcctttttctaatacagaatgtagtacgagtaatcaattgaaacaagacttgtataatgtcaaggtgataattagtgtgaagctaggtccttaattagttttccaatggaaacgcgctacgctacttatatgtgtctaagtctagaaagtatgtcagttactccatagattttgaatgactagtgtagtctgactatgaacttctttgtgattcaatatgatggctaatgcatggtagtggttggtctgtgacagatattaaaggagtatggaaacgtatggcatcacagtcgagtaagaagatacctatcacaagaagactgggctatccctgaagcaaaaggtaaaccatggtacggtttgctgatgctgctgagaaaatacccggagcatttcgtcatcaacacgagatcaaagggaagagttacccttgaattcgtttccctcgttaccctactctcatgagaactttaccttagtgactcggattaagatttaagaagcttttctctcttttctttgtttcatatgtaaaatattttggcattgattagtaacacgctgtgtcgtttttctgcacccaaaaacgccaacttcttggtccttgcagttgagagattttgattttctttttcttgattcttatttttgataaacccatcgagatttttctttcatcaaagggcaaaaaattcgtgccaattcagaaatcgttatgttcggtggatttgggccataaaaagagaaaaggccgaaacagagaatgatccaaagtggctcaagtacgtatccagacaatataaaaaggttggaatgtgcaaacttagggttatactcgtatcttgtagcagccactaaagcaaaattctgagatcgaaaaagctatataaaaaaaaaaaactgcttccgtttcatcgattttgtccagatcttccccttcttccggtaatcgaagcttacgagatagttgagtgaagatg

SEQ ID NO: 14658 - DNA, 3000 bp, Unknown
  misc_feature (1)..( 3000): cDNA_ID_2730446_gDNA_ID_2684211_Annot_ID_137338 3000 nt of promoter + ATG
aggaatccagttccagaagtaacaccatttggtccggagacagagattcgagccatcgccggagctttgccggtaaaaatggaacctttcatcttctcgcttttgccaactcctttacaaaagcaccatgagtccaatatcactcccattgtctctctatctcttgattatgctctcagatgggttttgtgtcaaattccctaatttggcaatctgggttttggaggagagtgttttggatctgaaaaggatgggaatttaggagagaagtgtgaattggatgcgagttagtaataatgggattagggagacacaacacatgtatgtgtctgtgtctgtttgtgctgtaaaaacatcaactttctccggatttggtctcgatgaagacccaagaatgggagaaaactcgagaagaggtaagtgagagagaaacaagagacaggggaatcgtgaaatgagtaaagagatgtgcttctttaaggagctagctggggacttcttcttcttcttttatcacttttatttttttctttaattcaaaagaaaatgtataaagattgggggaaatgttttctttatttggtttaagtgtgtcattttgtaagaagaagcaaacagaggaaaagtctagagtgacagagaggatctttgtacatgtgatgaacatggatggactttttgcttattatgattagtgttttttgcttaacgttttctttgcttgtcgatttgtctaatcatggtttcattaacttatatctctctttgttatcaaatagatttggtcatttaaccaaattgtaatgtatatgattaccagttttaaccatctcggcaaaaatgtaaaattaaaacgacatttccatttcagaaatctagcttataataaacttggaatagttacatgttgttagattggttcagttatggttgcaagtcaatttattatcacttatcagcattcaagtccaactttttacttcaaaacaaacaaaactagaaaatccaattcaatcaattttattggagcatttaagttaatctcaagtagtttaaacttgaaagagttggattcacaacttattgtatacacgagaaaaaatgtaacaaacgatattccaaaaaaaaaagtcaattaaagtgaacttatcagaataacattgttcttcatcatgtttaaaaccccaaaacaaaatccaattgcaaacaccggtttctcaatgtacatctctcaaaaaaacatagtaaacgactgtacataatgaaaatgggaactctttctatgaaccatcgaagactccaagtattctattacactggttagggagttgaaaagaagtaaaccataatgtgtcaaatccgatccaacatcaattccgttagcgcttaagaagtctttttgcatctgcaatatcctgcaatataacaatagcaccaaaacaaactagtacataatcaacattaacaacagctaggagcaaaagcactagtcaagaacttaatttaaccttaattaacaattcgagttaacaaagaaagaaaagagtactgaaagtacccgctgcagaaaaactgcttctttaggagaggtagggaactgcactaaaccgattccaacaattaatagcaaaggacactacaacgtatataggtagctggtgcaaagatatacattattaatattgactaactgagaatagcaataagcaaaaatgagcacaacagactcattactaaccaactatgtttggctacgagccataattgcagcctgcaagagagcaaactaaaaggcagagacagctaccagcaggctcaaaatcttgaccacatgcttcattgtccttgaaacaaagtttatgtaagatttgagtattgacaatataccagaaaagaggactacactaatgcattttccgatttcttgcatatttggagctgaccatgaacgggtgccattaaaggatatctatagaagtgaattccttcaaataacaaattgccaattctaaatccattacgcataatttccacacatcttaagcaacttatgtccagaccagaatctagcatagtcatgataactaaaagaacagtaaaatgcaacccaaaccatcaaaatgggaaaggaaaaaaaaacgacttttcacattttcttggatctcataatacaagcggtcaggagctcaaagccctttaagcataatttgtagaacctgaatcttaaaaaaaaaaagaaacacaaatacatgatttcccaccgttcctcaggattttaaacattctatagtcagatcctcaggaaatcaaagccattacacaacacatttcagaacattataggctaaatgatttgaaaacttgaatcctaaaattcattaagctgccccaaaaccaagcttctactaacaaaacaaactacaattaaccatccgaatcaaaccatgcacccaaaactcgaattgaaatttgatatatctaacaatgattgagctgccatcagaatgaattattagaaaataattttgtcacggttccttcagaccagagtaaactccaatcatccgaaactcaaaacccttgcgcaaaattttcaatcatcatttggcaacttattcaatcaaaccaacaacgaaaataaacaaaaggttacataaaactaaccaagcctatgttctaaagcaaacgaaatcaaaaaattcaaacaatcaataagatgctccactatttgcgggagagatggaacctttaagctcacagatctcgccgccattctcaatgtttcttcggctgttttaaatagttgtgtcattagggtttttattcaggtcttaaaatcatgggtataatcgtcaatttcacaaaataagcctttgtcctggataagctaaaccagtttccaaacaaatcttgcttcgattcacaaattattacgattgcaatccctaatttggaagtcccggttcctctttcgatcaaatcggagaatttcacggcatg

SEQ ID NO: 14659 - DNA, 3000 bp, Unknown
  misc_feature (1)..( 3000): cDNA_ID_3018473_gDNA_ID_2684211_Annot_ID_191528 3000 nt of promoter + ATG
cgtttaggcacttttagataattttatgagaatattacacgtagaggtactattttgaaactttagccacaaataggcactttgaaaggagaaggcactttaccaaatcaaaattcccaaattgccctctgaaccacaacgctttctcctcattttctctctcaactcttttctctatcgtctttatttctctctctttccaaaatcaaaaccaattttttacgggaatctcaatattccaaatcaaaactaaaaacccaatttcatatgatttatcatcatcttccctgtctctcaacaattatttgatttggttccatttatttctctccttgattaaggaatctctgtcatcgattacaatgaaaagtgaggatgttaaccatgatcagttaccttctaagcaatctgggcttgaaacggttcgtgatgttgagaacgcgagtagcagcaaaaaggccattgtcgatgtaacttcatctgaggcatagttgtccattgatgagtgtccaagcattcaagtccaaatggtcatctaataactcacatttgaagcatagttgtccattgataagtgtccaagcactctagtccaagtggtcatctagtaactcacatctgaagcatagttgtccattgatgagtgtccaagtactcaagtttaagtatataaagcgtgtaagaagatcaattgtagcagcaatgttctgttgttgattcttaatatattcttcgtttttaagttatgatagagaattttgagataatctcagaatttctatgatttgtaagaattatagagaaccaccatgattgatgattttgaaaaagaaaataaaaatgatgaaaaaaaaaacatggaagacagagaagataaaaaatgatgctagtttgtctccatgataacttgtccacgtaaacgtaaccatgtggaaataagtgattctcataagcaaaagaatatgcttttaaggttagacgttcaatgaaacatcaatttatcaagaaagaattaaattgtaccaaacaaggcgatcaaatggatatgaaatttaatactggaatttgccaacttgggttttccataaactctcaaatgtttgattttgataaactcttaaatgtttgattttgcaaggaaagaaaaaaaagtaataatgagaagagagagagagaagagagagagaagagagagagagagagagagagagagagagagagagagagaggaagaagaaggaaaaaaaaggaacgtggagagatgaaactttttttttaattataattttttaattttcaggggcaaatttgtcaaaagtttaatgaaaaagttggaaaagtgcctcatccctgacaagtgcctcaaaaggaataaaattctctaaaagtgcctaaacgagtccatttaaatatatccactcggaaacctttttactgatccatatctaatctatataccatgtccataataacaggagattcaattaaccgtggttcgtatagaaaccaaagttccatgtccataaggtcttgaatgtggaggtctctgcaaactgaaagaaaaatcaacaaataattttttggtatccataataacgagtccatttaaatatatccattcagaaacctttctactgatccgtatctattctatatatcatgtcaataataacagaagattcgattaatcgtgttttgtaaagaaaccaaagttccatgtccataaggtcttgaaggtggaggtctctgcaaactgaaagaaaaatcaacaaacaattttttggtatccataataacgaatccatttaaatatatccattcagaaacctttttactgatctatatctattctatatagcatgtccatgataacaggagattcgattaactgaaatctcgatgctacgtagatgaaacgagtttgacacatgagagaaagcaaaaatcaaatcaagccgctgttgttgaagaagaagaagtttcttttcattttttacaaagatgaagagagagagagagggagagagagggagagagagagagggagagagagagagagagaggagagagaaagaaaaaaaacgtggattaagagaatattttagttagaagttattttagtaaaaaaacataaagaaagtgtctagtcttttgaaagtgcctaaacatggaaatagtttttaaaaaatgtctaaaagtgtaatattctctcattaaaatcatctttttgactcttcctattcagtcaaaagaatttaactggatatgaaagaattcaaattcctatacatatctgtttgtatttttaaaaatttattgctattgaattgattgactgttattttatttatgatggttttgataataatatcactttttatgctcccgttagataagaatttatttattactttaatttctaattgtttttttgttcagttcaattattccaaattctattgcttgatatccactgggtaatcatttgaaaaaatcgttaaagatcgacaaatgagtgtatatcatgctctggtatatattaaactcctatccaatagaaaatagtattgtgaagagagaatataatctgctaaagtattcccactatccagaaaaatacaaagtagaaaatgcacaaaacattatggttagatttctatccactatcgaagattggaatactagtttataaaaccaaaaacgtcacggtgtaactcctcgactgcacgtaatgcatcgaataacgaaatagtgatatatacacagaaaactatatagtatcatataaaattctttagtaataattattaggtcttaagaaatacagtagttgcgagtttaattgactagagagagtcatgattagtttaacgataatgactatttaatcgggcacattcttttccaaagatacccctacgacaacattaaaaaatacaaaaagccgaaacccgcccactacaatgaaaagctccgccaccaccaccaccctctggaacg

SEQ ID NO: 14660 - DNA, 3000 bp, Unknown
  misc_feature (1)..( 3000): cDNA_ID_3018493_gDNA_ID_2684211_Annot_ID_191521 3000 nt of promoter + ATG
aacaatattacattgagaagggaactctaggtatcaggcgcatttgatgtacttttcgttgttgtgtttatcttaaggcttctctcacatcaaaagtggtgcaatcaaacagtgtatgtttcaccatgtttacgattacagatgtctaaccaaattctaagctcttaaaatgggcaaaatacaatcaagagaaaaagagccaattcatttctgacaattcttaatgtaacaactccagagaccattcacctgagcttccaaccatcaggtagatggcactaagctcttagggtttagatcccaaagcaagaagtatcttcttcctcggaccctgcaacgaaaacatagcttgtgaaaagagagcgtaataatgttgaacgaagagagtggatgtagtttttcgcgttacaacagatcaaacaaaactgagaaattgaaattcattcaaaatctgcaagatatgataagagtgatactagatgttgtgtggcaactcaacatgaagcttaccatcggtatgagcatagccttgaggtcatcatctgtcatatgcatgagagcatccatatcaacctgtgaatgaccgaaaaggataggaacgttatatatgcatcatccataacataacataaatttcaacctaatagaagatattacatacttcttccacttgaaacgctgttgaatatttctcgagacccaatgattcaagaaagctatcaaccgatgaatcagcctgaaccagaagatgacaagcaaagaaacattagtggatggcctgtatacaagggaagagacatcgtaagctatgtgtctaactacattttcgcaccggtcagaagaatggtttctcccaagcaataaagtactgatggaaaaatatagttgaagaaaagtgaatcatattgcctgctgtgatttcttcctggtagcttgactggaagtttttctagtctctgtttcagtcgctacgctcttcatacttggcctagcagcctccgctttggattttggtgggtcactgttttttggttgctgattcattgtcccagagagctgatcccgtaaatcccgcacgcctgaaccagcttctcgcccactttgagacccatgatgtctcttttggagcttcaaacgaagatctctaggatcaaccctgcgatctaaataagccatccgatagagaatcaacaaccaaacagaaatacttttgtcatacttaattttctactgaaagaatagatgagggggaaaaacatacttgaaagttgaggtttgtcactactgaaaagatcatgctcccatttgtcgtcctgcctttgcctgaaagcatgaggaaggagaaacttgagataaactgatatgtaattaacaatgaagactacataacgagaggaatataaaccattccccaacgcaaaagcaaaaaaagttcatcacccaaaagattcaattaaattgccttaaaaccctaatcaaatcaccaaccatcaacaaaaacatcatcagatagatcacatctccagatttaactatgcaggtaggcactcaaactagagaagctcataaagctgatctaattgacaatgcagtgaagttgattgaaattaccaattcaaaatgggcaaatcagagagtcctagtaagctaacaaaaagagcggattccatactctaattcatagagcgaagcaagaatcaaacttggggatgctacaaggaagattatacacaagaggaaaagactctaacaccaagtaccagctaacatactgaagaattttcgaggaaagcaagatatatctcaatagaattatgacggagagagggagatagataagaacctcttcccagtcacttgtcgcacgcgagtagagatgtctccagaaccgccattgatacgatccttaacgaccttcctgcttccagactcagcctccaatttatcagcatacatctttatccccttggatgaaaaatacagaaatttgtcctaaccctaaattaggaaaactcacaaactaaaaagttgtgtggactattagcagctctcaggttagagatgcaaatagaaatcctagaatctacccagaaatcacagagacggaagagaagctctagaacagaaacaatccattaatgtagaaaactgcggattttgctcacgatgcctttggcttcaccaggatctacgttgcgagagagtattcgggaaattaacatccaatcaaagtaacgggtcgggtcgggtcgagaatcaggattatgcgttcagaacaaaaaaaacgataaccggtttgactgttaaccagagttaatccggcgattcaaaagacgtttcggttcgatttttctttgacaacgcggctaagcttttcatttctttttttttgttttgtcaacacgcggttaaatttttgtttgtcagattcattttttttcttgataaaaaacatccagattcctttctttgtaatgttttagattaaaataaacaaaaaatccctaaaaaacgaaaaagttttgaaacttagaaagacggacataagcgagctagcttctaagctttcttcgctaaattcttggctaattctcttctatgactgatccaattctgcttcgactccatatctgaggtttctgacgtctgattaggtaactcccgcttttgttttttttggggggttttatccatttttaatgtctttgttgtctacttgtttcaatcgtatgaacttgagacgcgagaagctcagattcaggatccctaaatttttctctatttttttttttagttttgtttcgttgattacaactagtcctaggttaaagaacaacgtttacaacttattttgcttttttcagttgtgcctaggtcacttgtccgaatctgtataattcacgtgtatcttcctggatttgattacatttcatttacttagtgttgggttttacgttagtttaagctgctgagtactttgatgttttttgtttgtagaaa

SEQ ID NO: 14661 - DNA, 3000 bp, Unknown
  misc_feature (1)..( 3000): cDNA_ID_2995039_gDNA_ID_2684211_Annot_ID_191515 3000 nt of promoter + ATG
ccgagggatgagagatcaacgtcgacggtggctttcttagaattccggccgagtataatggagtaagactgcatatagtactcgaaatcctcaccttgaagcttcgcaaatccaacctccacatcgcttccgccaccaacagccgtagccatgccgtgaaattctccgatttgatcgaaagaggaaccgggacttccaaattagggattgcaatcgtaataatttgtgaatcgaagcaagatttgtttggaaactggtttagcttatccaggacaaaggcttattttgtgaaattgacgattatacccatgattttaagacctgaataaaaaccctaatgacacaactatttaaaacagccgaagaaacattgagaatggcggcgagatctgtgagcttaaaggttccatctctcccgcaaatagtggagcatcttattgattgtttgaattttttgatttcgtttgctttagaacataggcttggttagttttatgtaaccttttgtttattttcgttgttggtttgattgaataagttgccaaatgatgattgaaaattttgcgcaagggttttgagtttcggatgattggagtttactctggtctgaaggaaccgtgacaaaattattttctaataattcattctgatggcagctcaatcattgttagatatatcaaatttcaattcgagttttgggtgcatggtttgattcggatggttaattgtagtttgttttgttagtagaagcttggttttggggcagcttaatgaattttaggattcaagttttcaaatcatttagcctataatgttctgaaatgtgttgtgtaatggctttgatttcctgaggatctgactatagaatgtttaaaatcctgaggaacggtgggaaatcatgtatttgtgtttctttttttttttaagattcaggttctacaaattatgcttaaagggctttgagctcctgaccgcttgtattatgagatccaagaaaatgtgaaaagtcgtttttttttcctttcccattttgatggtttgggttgcattttactgttcttttagttatcatgactatgctagattctggtctggacataagttgcttaagatgtgtggaaattatgcgtaatggatttagaattggcaatttgttatttgaaggaattcacttctatagatatcctttaatggcacccgttcatggtcagctccaaatatgcaagaaatcggaaaatgcattagtgtagtcctcttttctggtatattgtcaatactcaaatcttacataaactttgtttcaaggacaatgaagcatgtggtcaagattttgagcctgctggtagctgtctctgccttttagtttgctctcttgcaggctgcaattatggctcgtagccaaacatagttggttagtaatgagtctgttgtgctcatttttgcttattgctattctcagttagtcaatattaataatgtatatctttgcaccagctacctatatacgttgtagtgtcctttgctattaattgttggaatcggtttagtgcagttccctacctctcctaaagaagcagtttttctgcagcgggtactttcagtactcttttctttctttgttaactcgaattgttaattaaggttaaattaagttcttgactagtgcttttgctcctagctgttgttaatgttgattatgtactagtttgttttggtgctattgttatattgcaggatattgcagatgcaaaaagacttcttaagcgctaacggaattgatgttggatcggatttgacacattatggtttacttcttttcaactccctaaccagtgtaatagaatacttggagtcttcgatggttcatagaaagagttcccattttcattatgtacagtcgtttactatgtttttttgagagatgtacattgagaaaccggtgtttgcaattggattttgttttggggttttaaacatgatgaagaacaatgttattctgataagttcactttaattgacttttttttttggaatatcgtttgttacattttttctcgtgtatacaataagttgtgaatccaactctttcaagtttaaactacttgagattaacttaaatgctccaataaaattgattgaattggattttctagttttgtttgttttgaagtaaaaagttggacttgaatgctgataagtgataataaattgacttgcaaccataactgaaccaatctaacaacatgtaactattccaagtttattataagctagatttctgaaatggaaatgtcgttttaattttacatttttgccgagatggttaaaactggtaatcatatacattacaatttggttaaatgaccaaatctatttgataacaaagagagatataagttaatgaaaccatgattagacaaatcgacaagcaaagaaaacgttaagcaaaaaacactaatcataataagcaaaaagtccatccatgttcatcacatgtacaaagatcctctctgtcactctagacttttcctctgtttgcttcttcttacaaaatgacacacttaaaccaaataaagaaaacatttcccccaatctttatacattttcttttgaattaaagaaaaaaataaaagtgataaaagaagaagaagaagtccccagctagctccttaaagaagcacatctctttactcatttcacgattcccctgtctcttgtttctctctcacttacctcttctcgagttttctcccattcttgggtcttcatcgagaccaaatccggagaaagttgatgtttttacagcacaaacagacacagacacatacatgtgttgtgtctccctaatcccattattactaactcgcatccaattcacacttctctcctaaattcccatccttttcagatccaaaacactctcctccaaaacccagattgccaaattagggaatttgacacaaaacccatctgagagcataatcaagagatagagagaca

SEQ ID NO: 14662 - DNA, 3000 bp, Unknown; identical to SEQ ID NO: 14658
  misc_feature (1)..( 3000): cDNA_ID_2730446_gDNA_ID_2684211_Annot_ID_191512 3000 nt of promoter + ATG

SEQ ID NO: 14663 - DNA, 3000 bp, Unknown; identical to SEQ ID NO: 14657
  misc_feature (1)..( 3000): cDNA_ID_1017434_gDNA_ID_2684211_Annot_ID_191511 3000 nt of promoter + ATG

SEQ ID NO: 14664 - DNA, 3000 bp, Unknown; identical to SEQ ID NO: 14655
  misc_feature (1)..( 3000): cDNA_ID_2686488_gDNA_ID_2684211_Annot_ID_191505 3000 nt of promoter + ATG

SEQ ID NO: 14665 - DNA, 3000 bp, Unknown; identical to SEQ ID NO: 14654
  misc_feature (1)..( 3000): cDNA_ID_2730462_gDNA_ID_2684211_Annot_ID_191504 3000 nt of promoter + ATG

SEQ ID NO: 14666 - DNA, 3000 bp, Unknown; identical to SEQ ID NO: 14653
  misc_feature (1)..( 3000): cDNA_ID_2730470_gDNA_ID_2684211_Annot_ID_191502 3000 nt of promoter + ATG

SEQ ID NO: 14667 - DNA, 2798 bp, Unknown
  misc_feature (1)..( 2798): cDNA_ID_2730401_gDNA_ID_2684211_Annot_ID_191535 3000 nt of promoter + ATG
cttgtcagagggtgttgaagctaaatagagattctggagcatgctctagcattcaattctcaaacagtgggatccttgggttgccctattggttgttcattccactggagagagtttttaatctgttagtgatttctcattcattatcttatccattaacaacacttctcttgttctgaaactttctaattgatgttgtgttactttggctaaattataacagagctaatggagttcaggaagcacatctcagtcatactcaggaactccggttattgccaggtgcgatttgctatacagaccctaattttttgctcatttactcatttgcttatgctagtcttgatgttagcagttcatcaccccagtcccaattagctgcatcatgaagatggtttaacattggttccagccggaattggtttgatttaattgctactttttcatttaacaggtaaaattagcatacggttgaacatagagattcctccatgcacggagcttgttgaaccgatacaagaaagctgcatatggcgacagacaagaggcgcaatcagtgaattctcgagtgctggaagtgcagttgaaccttcagaaaaggttatttaagagaattgcattcccgaattgtatggtttaaatccaggtagctcagaaattttgttttcataacttgcagattggagtttcacaacaatggtatgatgaattagacagcctcgccaaagaaatagccaaccctgaagcagctgaggaagaggaagaagaagatgttaacccctctgaggttgacagagaagaagatggacgtatccacattgattgtcctgtcaaaacaagtcctggctcaagtgaggtacgcctaaatctcctctcaagtctcttttatgtacagaagccaaactttactattagaaaaaagtataactttgtcgactccggtttgtgcagcttattgtttatgcagctttgtatttaagactagcgagaaacgaagagacagaaagtgcgacccaggaagaactggcgagaaaaatagcaaagattttaaagccagtacggaacattacaactatgaaggaagatttgtttgtgaatttgttgtccaagtcaaagagagaattgagagacattgtcttcataaagccgatgcatgtgcggataaggttagactcgaaggatcatccaaaagccgataactcaagagacgtaatcttgactgactcctctgttgaggttgatgtctctctctgacaacgaataacgatgcttttgcagtccattctttctcaaaggtaccaaatggctactctaattctttttgaggtggtaaaaatgagctcaataagacttgtataagtagtttatgacattatattaacgatggtccaagtttcatttggatttctatatttgagtgtttcttctatttttggttaaaaattagaaaatatcaatgaaattagcaaatttttgggtgccattagtaaataacaaaaaagagtgaaaataagaatatttggaaaaatgaagacacgatcactagaaaaaacagctgtcaagctctttaatttttcttttaaaaaccaaacagtttcaaactgaaatccaaactgatttttgaaatatgaggaacaacgaaattttgaacatatatagcatgttattgttatggtcctaataatgactgatttgcttgaagaacttatttgttactattccaacttattacatacatgtgtgttgatagatacatacatggataagaaaagtgtacatccatatgtttatctcaaatcttatttgcaagagcctcatgaagaagatatattgttgacttctttttgtaaacacaaggagacagagaaatagaaatgcctgccttttcttctgatttgttcgcattttttaaatagattttgggaataacaataatcttacaattattcgcatttgattttaaaaatatttagttcgtgcagccatcaacattacatcaaaccctttagttgcatttatcttatacacttcatggtctccatgttattctctctttttctgtttccagttttctctttcttctcattatttcccatttcttcaaactttacaatattaatcacttttataatctgttttaaatctataatacatatatgtgggggaaggttagagaaatgtgaggcacacaaacatgagaactatgagatatgtactccattttgcatatttaattattaacttaaagagtagtttaattgtctatattaagagaagaaattcagaaacctaaaacctgaaagaaaaaaaatccagttatctccttccatttttttaggagactcttccgcgcttcggatcccaacggttttggtgtagatttttcttgatctgggttttgttacatctttgacgaaaataaaacatatcaacgtgatgagataaagggaaaccctatgggtttcttgtgaaaggggcaaccattgtttatgaaggattctaaggtttgttcttcgttctgcattttttttaccaatccacatatgttttcctgatatttatctgaaaatgtgtttcttttgttcttgtcaacgcaggcattaattaattgaacaaaacgattcgaacaagacccattttttggtcttaatttgtggtcctcagactctgttttgtacaagtttcttcggactttgaatccaattcgccgtggtttgaaataagtttatgtctatataatcacaagaagaaggggaaaaaaaaaaggagagattcagacaacagctaccggagaaatg

SEQ ID NO: 14668 - DNA, 3000 bp, Unknown
  misc_feature (1)..( 3000): cDNA_ID_2730409_gDNA_ID_2684211_Annot_ID_191533 3000 nt of promoter + ATG
taggtatgtgaacgttgaggttatcagttgatgttttttatttcagctgtttggagtcatgggtgatagttaagtttatcagcctgtaattacaattctttggtttcttgaagggactctggcaaaatacactggaggacaggtgtactattatccaggtttccaatcatctgttcatggagataagttaagacacgagcttgctagagaccttacaagggaaactgcgtgggaggcggttatgcgaataagatgtggaaaaggtttaatagtttatgataatatattcgtttttgctacctgctatgtcaatatttgctaatgcattggtgtgctacttgtgatcttatatatttttgcatgcaggaattcgtttctcgtcctaccatgggaacttcatgctaaggtctactgacctgcttgctcttcctgctgttgactgtgacaaagcgtatgcaatgcagctatctcttgaggagactttgctaacatcccagactgtgtatttccaagtggctttgctgtatccttgaatagttgatattttaaacatacttgagtttaaacatacaacacatcatttagcttttagtaatccttaacagaactaagatataccgcctcttgtggagagagacgtataagggtacacacatctgttgcaccagtggttacagatcttggggagatgtatagacaagcagacactggttccattgtgtctttatatgctagattaggtaagctatattcaaatttttttcatatgctacttttgatactatttaatgacaatttaaattctgcagcaattgagaaatctttgtccgcaaaattggatgatgcacggaatgcaatacagcaaaagattgttaaagccctcaaagaatatcgtaatcttcacgcggtgcagcatcgcttggggtccagattagtatacccagagtctctgaagttcttgccattgtacggattggcaattactaagtccactcctcttctaggtggacctgctgatacttctcttgatgagcgctgtgctgcaggcttcaccatgatggctctgcctgtcaaaaagctattgaagcttttgtatcccaatttattccgtgttgacgaatggctcttaaaggtttgtgtatttttatctcaatgtccattatcaaacatcagtgttcaagaaatagtaaataatttgtgaattcacatgcttgcagccatcagcagcccacgatgactttaaagacgtattaaggagattgccgctggctgcagagagtttggattctagaggcctttacatatatgatgatggttttcgattagttttgtggtttggccggatgctttcacctgacattgctaaaaatcttcttggggttgactttgcagcagacctctcaagggtatgtatttttatccacatatatccttacatatgaatatatgaacaggcggtacattcgatgatgtatatgcatcattagtgtttttcaagaatttgaaacatgataatatgtgtgaaacccttgtctttcttcgtgttgggtctcttaggttacctttcaagagcaagagaatgggatgtcaaagaagctaatgaggttggtaaagaaactgagggagagtgatccttcatatcaccccatgtgttttctagtgagacaaggagaacaaccccgagaaggcttccttctcctcagaaatctcattgaggaccagatgggcggttcgagtggttatgtcgattggattctacaacttcaccgccaagttcaacaaaactaagatagctcacaatggtaaggaaaaaaccatcataatacttccaataacatgcttaaagtaccacatcatgttcgacgcatcttatgaagcggttttactttcagacaactcgggtgctaggatgccacctctttgtaaccattgaagaactcttgagctcaaaaatcttctacttaagcaggatcatggcggccttcttccttgggccataatgtgttgttttggataaagaagtgctactttttgatttttcttcatttgtttttctatatagaccttttttctcaagattaggcttttatttgcctaaccagaatggttatctccgtaagattagtcgttttttaaatcttttgttgccttttttttttgtcctcattcgattttttgttgatgtgcgtctgttctagatttattttgggagttgcagttcatgaatctgtcctaattagggttattaacaagaagatgctactgttaaaattttaaaatatttttatgaataaataatgttgtgaaaaccttagatttggatgaaacgcatcgttggtatacatcggtaaagttcatacataaacaatacggtgattgatcgctgtaagaccaactgttcctgcaatcacaaatagataaattaggatttcaatttttaactgctgtaattctgattcaaagattctggtcggttgaaccgggacggggaaaatagacgtggcaatgtcttattggatggtactttctagaaggttacagaataaaagcggtcgtcggtataggggtcaaagtagcttaaacgacgtcgtagaggaatcttcgaatctcccaatagcttgcctttataacaaacctctctgaaccattgctatccaagaaatctttcagatttgcgcatatcgacaattttccgagcggccagtttacgtattttgtttgtacgtgatcaaatctccctcgctttctcgctatcaattttatcaattatgtgttcccgattgtttctagatttggattttctatttgcggatactagttcttttttgttcggaatcgattatggatttggtcttaagatttgcggaaattcttttgtaggtctgatatagtttgttcggaatcattcttgttgctcaggtcttagatcattgcgattgtaaattttgattttgattttttttttcttcaggtagttaacgtgtttcaaggactttgaca

SEQ ID NO: 14669 - DNA, 3000 bp, Unknown
  misc_feature (1)..( 3000): cDNA_ID_2730416_gDNA_ID_2684211_Annot_ID_191530 3000 nt of promoter + ATG
atagcactagtcgtcagtcgtagatatctagaatggcaattcattgggtacatttcagcaaatgaatttggctccacgtcaccatccaatggccttgggaatgatttatgatcaagtcctggttccagcgatccaggaatagatgaaagagatagcgagttaaaatcttcagtcaagccttgaacgttactgggaggaggtgcatagtttggatgcagattctgctgtgctgccatatttggtcgctgagcaaaacctcctgtgtgaggaggatatgatgagactggagggggtcctgggggaccttgagatgtctggaatggcgtcggagcctgtaagacctgcttgctaggataaccaggaaaagatggctgcgaaccgcccacgccaggataagacggagtaactggaggcattgactgttgaaaaccaggcctggcaggcatatgataatctgtagcagggggataagcatttgctccaggtagcccagaagtcgtactttgtggcggaggccccattgctacaggtgccatcggttgctgtgggcgaagagacataggaggagataagtgacctgcaagagtttgaggtggtggtgggccctgaggagggttttgtgtagtcgggaatggcggggatggaaaacgctgaaaaggggcaccaccaggaggaccatatgctggtgaaggaaacgaatttgatgatggcggtggaggtctactcccaggaatctgagaaacaaaaggagacggctggccaggcctcatcgtacccactggtggagccggaggaggaccagaggcagtgaaaggtcttgtaggttgggatgcagatggtgtaaaaggtctaaagccaaccgcctctgatccagtgggtggtccacctgattgaggaggaatccctggtggcggagcagatgcaaatggagaggaagcaggcctagctggaaaatttggatagccctgattctccgtacccattattgatcacaacttatcacttacaacagttgtcagagttatagccaaactggaagctaagggaccagatcaatacaatcccagattctcttcgatgagtaccttagaatcagattcgttcacggaagcttcatatcatctggaaaaaaccagtgtagttctctttcacagtgccgacctggacagatccgcctctcaaaatccgtagctatctctagtgatctttcaaaattggtaacttctgtgagatatttgaggacgatcttctacgatggtttagatcttttcaaaaaagtaagcctctccgattcacagttccttattcaattacttaaaaacttttcaattcttttcgagcaagacgatcttaccgggtgatagatatccagtgagaatcgtctacgaaaaagtccctctccgtaagtgaattctcttatgaagatctggatcaataaccattgaatatcagctaaaattcaacattaatatcaatctaacatgattagggtgtcgaagactacctgaagtgagaggaaactcgagaaactgcggagcacgaaactgattctacagcgatcggcttcagatcgtctgacccgaagaagattttcgatacggaattggagaaccaccaagtgcagcgaaagagacgatgtgatatattatgggccaggtagtggctaacagttttatatctctccagcccatttaacagtttcgtcctatcactgtttttttaataaaatatccttttcttttcctttttgataaagaataaatctgtaaatattactttcatagatttcatttctattattttataaaatagtaaaatgaaatttaatactaacagtttaaaactcttcctgattatgtttttcggaatttctaaatcaatttattttaaagatattataaataagaaagttatagttataaacaataattttataagaaattaataaagaattcattgatgttttatgccaagattttatcgatttattatgctcacatgatcatgctataactatccggaaaatcagtaggagtataatgcatgactgtgaagactagaaccaattctgcatagttttgaagaaactaaggtaatgtcacttacatgattaatatataagatgtcttatacacagacaatacagagagatataaaagcaaataatgttaaccaataaccatagtccatagaaatcttcttgattgcccccaaaccacaaatcgattttcatggaaatgatggagtttggtgtagaatcgaacaccaagagccaaacctaagatgaaaagaggaacaagaaactgaaagagcttaatcaacaacaactcagaactcttcaattcaaagctcttgttatcttgattatgctctgtctgatttggggtagtagtagtagcaatatcactggccttggtagagagatctatgtctccaacataaaactcacttaacatggcgattcctgtgttgagaaagctccgacaagtttaaaacctttccatttccgaccatttttaattatatatttttccaaaattgtggtgtgtaaatttccaaggaaagagaatgtttttgtatttgtttatctgattgttgaaaattgagattagctctaacatcaaccgtttctatcgtatgagtaccagaatccacgcttgtcttgttgtcacacaaactcattcacgtaagtaaaagtgtatcatacctttctcctttttcttcttcttcttctaatttcttttctactttcacaattaaaccccaatattttatattatttccctaatcaaccctttggcatttaaaatttacatataaaacataagagaaaagatgggcctgactatcctaaactaagtacataacccaacagacaattatcacggcccaataaaatggtgctaaaaggcaccgcaaaaccctaatttgaataagctgctcacttttaatcaccccggagtagtaagcttgcggctgatcagagctgagtgaaaaatg

SEQ ID NO: 14670 - DNA, 3000 bp, Unknown; identical to SEQ ID NO: 14661
  misc_feature (1)..( 3000): cDNA_ID_2995039_gDNA_ID_2684211_Annot_ID_137339 3000 nt of promoter + ATG

SEQ ID NO: 14671 - DNA, 3000 bp, Unknown; identical to SEQ ID NO: 14660
  misc_feature (1)..( 3000): cDNA_ID_4254519_gDNA_ID_2684211_Annot_ID_137344 3000 nt of promoter + ATG

SEQ ID NO: 14672 - DNA, 3000 bp, Unknown
  misc_feature (1)..( 3000): cDNA_ID_94091_gDNA_ID_2684211_Annot_ID_137345 3000 nt of promoter + ATG
attttcttatatgggagggcatatctggtaagcctggtgaactaatgttggttgtgacgcatgtgctatcttcatcagtgattattgtacgattaattcttgcatattagtactggattaaggtctttataaccctgcttgtgtttggtttatgctaggcactttctggagttggagctactattcgagaaagagctattcttctggacgatactgcacttagcgccgccttgaatgctcagtttctgtttcagattggtgtcttcactgctgtgccaatggttttgggatttattttggaacagggttttctccaggtactggttcctcaccattttagtcatatcatattgtaatgccatattttctgatatgattgacagggagactgacacgtatactgagttagctctttcatttacttgattatctacagtatacttttattggattataagtcgacttatggtcacccatttacatgttttctttctgatgttttgttgttagttagaaatttgtctctgtttaggccatctttcgtggcgcattgtcacttacagctatgcactgtattctggagatgaacttttgtaatctgaatgatcatatttgtttgttcgattatctgaaggatatccttacatttggtcaaaacgaataatttactttttgtgttttgcttgttaatagaacttaatcttctccatcttccattgtgtaggccatcgtcagtttcataacaatgcaatttcagctatgtactgtcttcttcacattttcccttggtacaagaacccattattttggacggacaattctccatggtggtgcaagggtatattctcattctcggttctaaaaaatctctgtaaattttttggaatgtgataaccattgtttgttaacagtaccaagccactggaagaggcttcgtcgtgaagcatatcaaattttctgaaaactaccgtctttattccagaagtcattttgtcaaagcgtaatctcctcttctttagttcttatgtatatacatttctgatgtatacctgtttagccatagtaaaggattgaaaattcattgatatgctacttctttttcgtttctctagaatggaagttattcttttattggttgtgtaccttgcgtatggcaatgatgaagctggtgcggtttcctacatcctgctgacagttagcagctggtttttggctgtttcttggctgtttgctccgtacctattcaaccctgccggatttgagtggcagaagtaagtggtgctatcttatttatatcatgttgagtgttgagtaacgtgtttctcattgaacaacaataaaattatgctttcagagtcgtggaggacttcaaagaatggacaaattggctcttttacagaggtggaattggtgtgaaaggagctgaaagctgggaagcatggtgggaagaagaactggtaagaactattctcagaaagttttcttgcttgtctgagaactaatttttctaacttagaaaataattattatatctgtgtgtcgacagtctcacattcggaccttgagcgggaggataatggagactattttaagtctacgattctttatcttccagtatggtattgtctacaaactgaagctacaaggatcagatacatcatttgcggtagagcgctccccttcattgactacttgtatctacgcctttgcatatcttagtctgctagtatttgtgcttaataatatcactcatctatctgcaggtgtacggttggtcatgggttgcatttgcaatgattatagttcttttcaaggttagtttattccatcagcatgcttcattttccgataacctttgatcctctgactaaatttgattacatgatctgagatatctcccatgtgaactttgaaataggtctttaccttcagccagaagatttctgtcaatttccagcttttactgaggtttatacaaggtctatccttattgatggctctagctggcataatcgtagcagttgtgctcacacccttgtcagtgacagacatatttgcatgcgtattggcttttataccgacaggatggggaattctttctgtaagttgttcttcttgctcacctcagataccttgatttctttctcatctctgcagattcctcctaattttgacaaacaaatcttctcccgttgtagattgcgtgtgcttggaagccagtcctaaagcgaatggggatgtggaaatcgattcgttccctagcaaggctatatgatgcgttaatgggaatgctcatatttcttcccgttgctctctgctcctggttcccttttgtgtcgaccttccagacacgtatgatgtttaaccaagccttcagccgcggtctcgagatctctcttattcttgcaggagacaatcccaattctggtctttaaacttttggaagctgttatgtttatgtttttcatacatttatttgtgtttagttttccgagtgtagcagtagtaaatgatgggagcctctctgtagctttaggcattttaagacttctgtaacatttgtccccaaaaaagaaaagacttttgtaaaacataacctagaatctttaagatattacgtagaaatgcctttggaaagaaagcgattcaaggaacaaagattaatttattcattaacggtaaaagaataaacctaattactggatccagtcattaacgcgcatgttatgtttgtcgttgttgacgaatccgtgatttggatcctttgaatgtttttggaagtattagtggttagggatcaaataaagcccaattattcgacaggcccatctaacaaaattggggacctaattccaggcgctgaaaggaatcgctggcacaagtagaaggttctagtcggaaggtctcagaagtctgtctacagaggtaccgttggggcagagagcaacatattactagaaaactccagagttcgttattggagcttctaagcagagagag

SEQ ID NO: 14673 - DNA, 3000 bp, Unknown
  misc_feature (1)..( 3000): cDNA_ID_2730428_gDNA_ID_2684211_Annot_ID_137346 3000 nt of promoter + ATG
tttttggttttataaactagtattccaatcttcgatagtggatagaaatctaaccataatgttttgtgcattttctactttgtatttttctggatagtgggaatactttagcagattatattctctcttcacaatactattttctattggataggagtttaatatataccagagcatgatatacactcatttgtcgatctttaacgattttttcaaatgattacccagtggatatcaagcaatagaatttggaataattgaactgaacaaaaaaacaattagaaattaaagtaataaataaattcttatctaacgggagcataaaaagtgatattattatcaaaaccatcataaataaaataacagtcaatcaattcaatagcaataaatttttaaaaatacaaacagatatgtataggaatttgaattctttcatatccagttaaattcttttgactgaataggaagagtcaaaaagatgattttaatgagagaatattacacttttagacattttttaaaaactatttccatgtttaggcactttcaaaagactagacactttctttatgtttttttactaaaataacttctaactaaaatattctcttaatccacgttttttttctttctctctcctctctctctctctctctccctctctctctctccctctctctccctctctctctctcttcatctttgtaaaaaatgaaaagaaacttcttcttcttcaacaacagcggcttgatttgatttttgctttctctcatgtgtcaaactcgtttcatctacgtagcatcgagatttcagttaatcgaatctcctgttatcatggacatgctatatagaatagatatagatcagtaaaaaggtttctgaatggatatatttaaatggattcgttattatggataccaaaaaattgtttgttgatttttctttcagtttgcagagacctccaccttcaagaccttatggacatggaactttggtttctttacaaaacacgattaatcgaatcttctgttattattgacatgatatatagaatagatacggatcagtagaaaggtttctgaatggatatatttaaatggactcgttattatggataccaaaaaattatttgttgatttttctttcagtttgcagagacctccacattcaagaccttatggacatggaactttggtttctatacgaaccacggttaattgaatctcctgttattatggacatggtatatagattagatatggatcagtaaaaaggtttccgagtggatatatttaaatggactcgtttaggcacttttagagaattttattccttttgaggcacttgtcagggatgaggcacttttccaactttttcattaaacttttgacaaatttgcccctgaaaattaaaaaattataattaaaaaaaaagtttcatctctccacgttccttttttttccttcttcttcctctctctctctctctctctctctctctctctctctctctcttctctctctcttctctctctctcttctcattattacttttttttctttccttgcaaaatcaaacatttaagagtttatcaaaatcaaacatttgagagtttatggaaaacccaagttggcaaattccagtattaaatttcatatccatttgatcgccttgtttggtacaatttaattctttcttgataaattgatgtttcattgaacgtctaaccttaaaagcatattcttttgcttatgagaatcacttatttccacatggttacgtttacgtggacaagttatcatggagacaaactagcatcattttttatcttctctgtcttccatgttttttttttcatcatttttattttctttttcaaaatcatcaatcatggtggttctctataattcttacaaatcatagaaattctgagattatctcaaaattctctatcataacttaaaaacgaagaatatattaagaatcaacaacagaacattgctgctacaattgatcttcttacacgctttatatacttaaacttgagtacttggacactcatcaatggacaactatgcttcagatgtgagttactagatgaccacttggactagagtgcttggacacttatcaatggacaactatgcttcaaatgtgagttattagatgaccatttggacttgaatgcttggacactcatcaatggacaactatgcctcagatgaagttacatcgacaatggcctttttgctgctactcgcgttctcaacatcacgaaccgtttcaagcccagattgcttagaaggtaactgatcatggttaacatcctcacttttcattgtaatcgatgacagagattccttaatcaaggagagaaataaatggaaccaaatcaaataattgttgagagacagggaagatgatgataaatcatatgaaattgggtttttagttttgatttggaatattgagattcccgtaaaaaattggttttgattttggaaagagagagaaataaagacgatagagaaaagagttgagagagaaaatgaggagaaagcgttgtggttcagagggcaatttgggaattttgatttggtaaagtgccttctcctttcaaagtgcctatttgtggctaaagtttcaaaatagtacctctacgtgtaatattctcataaaattatctaaaagtgcctaaacgtgtcatattgccttttaatgattgtgtttgtcaaacttgacgaagcccaaacctttcggagcccacttgcatacaatcccttattccccttaaatctcaaaccgagagtaaaccagaacaaaccgaaaatcacaaactcacagatcccaaaccgagagtaaaccagactccgattttggtcatcacttgattcgttatcgtttcttcgccggagctcagcgtttatactctgtaatgccagatccgcggtaacgcaagtcagtgacctactccggcgtttatcactgaatccgattatg

SEQ ID NO: 14674 - DNA, 3000 bp, Unknown; identical to SEQ ID NO: 14659
  misc_feature (1)..( 3000): cDNA_ID_2730424_gDNA_ID_2684211_Annot_ID_137347 3000 nt of promoter + ATG

SEQ ID NO: 14675 - DNA, 3000 bp, Unknown; identical to SEQ ID NO: 14669
  misc_feature (1)..( 3000): cDNA_ID_2730416_gDNA_ID_2684211_Annot_ID_137349 3000 nt of promoter + ATG

SEQ ID NO: 14676 - DNA, 3000 bp, Unknown
  misc_feature (1)..( 3000): cDNA_ID_2730412_gDNA_ID_2684211_Annot_ID_137350 3000 nt of promoter + ATG
attattgctataatacacgcatgacaggaacttatgttcttaaaagcttttcatgacgatgttcaaatcagcttaggtacagaaagcatcacatcagtaaaagtgaacagtacacaagagaaactaaaggtgaagtgaagcataccttgatggtgtcgtagtggttccacccgacttcagaagaaaggcgacccaacagacagtatttgtgtccagcctgcagcctcaagaccctgatcaagaaggaagaatcaaagtttcagagactgtagctacttgtaagtataaatgaaggaaactgaaaaaaaatgaaaatgaaagggtaaaaggacaaacttgagagcatcaggaacgaccatcctcttgatcttgtcatatggagtaggaactccttcaaagaccttcaagcgggcaagtgcattagctccacgcttagtcttgtgtggaatcatactgccacacaaacaaaaacaacaattcaacatcggatttggcacattttctcaaacaaaaaacaaaaactacacattgtacaactacaaaaacatcaaagtggattctctactttagtatgattccaatcctagagcaattttcaatgaaataagagttcatatgcgctttctacattattcacagtactaaattcataaaatcggtgctcgaatcagtagctaaaaataacaaaaccagagagagatcgaagtaacgaacccgcgaacggtacgccagaagatcttggagggagcacggaagtgaataggtccgtgagaaggtttagtgttcatacgcttacggagaaacctcatgtacttcatcttctgacgaacaagtccgccggagagacaaatctcctcgcaccggacaaccacaatattctggccattgagcagatcctttgctacaaccgaagccaagcgacctagcatgtggtgacgagcatcaaccaccacgcgcttcgcgcaaattcctgatccagacaccatttttcactcagctctgatcagccgcaagcttactactccggggtgattaaaagtgagcagcttattcaaattagggttttgcggtgccttttagcaccattttattgggccgtgataattgtctgttgggttatgtacttagtttaggatagtcaggcccatcttttctcttatgttttatatgtaaattttaaatgccaaagggttgattagggaaataatataaaatattggggtttaattgtgaaagtagaaaagaaattagaagaagaagaagaaaaaggagaaaggtatgatacacttttacttacgtgaatgagtttgtgtgacaacaagacaagcgtggattctggtactcatacgatagaaacggttgatgttagagctaatctcaattttcaacaatcagataaacaaatacaaaaacattctctttccttggaaatttacacaccacaattttggaaaaatatataattaaaaatggtcggaaatggaaaggttttaaacttgtcggagctttctcaacacaggaatcgccatgttaagtgagttttatgttggagacatagatctctctaccaaggccagtgatattgctactactactaccccaaatcagacagagcataatcaagataacaagagctttgaattgaagagttctgagttgttgttgattaagctctttcagtttcttgttcctcttttcatcttaggtttggctcttggtgttcgattctacaccaaactccatcatttccatgaaaatcgatttgtggtttgggggcaatcaagaagatttctatggactatggttattggttaacattatttgcttttatatctctctgtattgtctgtgtataagacatcttatatattaatcatgtaagtgacattaccttagtttcttcaaaactatgcagaattggttctagtcttcacagtcatgcattatactcctactgattttccggatagttatagcatgatcatgtgagcataataaatcgataaaatcttggcataaaacatcaatgaattctttattaatttcttataaaattattgtttataactataactttcttatttataatatctttaaaataaattgatttagaaattccgaaaaacataatcaggaagagttttaaactgttagtattaaatttcattttactattttataaaataatagaaatgaaatctatgaaagtaatatttacagatttattctttatcaaaaaggaaaagaaaaggatattttattaaaaaaacagtgataggacgaaactgttaaatgggctggagagatataaaactgttagccactacctggcccataatatatcacatcgtctctttcgctgcacttggtggttctccaattccgtatcgaaaatcttcttcgggtcagacgatctgaagccgatcgctgtagaatcagtttcgtgctccgcagtttctcgagtttcctctcacttcaggtagtcttcgacaccctaatcatgttagattgatattaatgttgaattttagctgatattcaatggttattgatccagatcttcataagagaattcacttacggagagggactttttcgtagacgattctcactggatatctatcacccggtaagatcgtcttgctcgaaaagaattgaaaagtttttaagtaattgaataaggaactgtgaatcggagaggcttacttttttgaaaagatctaaaccatcgtagaagatcgtcctcaaatatctcacagaagttaccaattttgaaagatcactagagatagctacggattttgagaggcggatctgtccaggtcggcactgtgaaagagaactacactggttttttccagatgatatgaagcttccgtgaacgaatctgattctaaggtactcatcgaagagaatctgggattgtattgatctggtcccttagcttccagtttggctataactctgacaactgttgtaagtgataagttgtgatcaata

SEQ ID NO: 14677 - DNA, 3000 bp, Unknown; identical to SEQ ID NO: 14668
  misc_feature (1)..( 3000): cDNA_ID_2730409_gDNA_ID_2684211_Annot_ID_137351 3000 nt of promoter + ATG

SEQ ID NO: 14678 - DNA, 3000 bp, Unknown; identical to SEQ ID NO: 14652
  misc_feature (1)..( 3000): cDNA_ID_3044781_gDNA_ID_2684211_Annot_ID_191501 3000 nt of promoter + ATG

SEQ ID NO: 14679 - DNA, 2798 bp, Unknown; identical to SEQ ID NO: 14667
  misc_feature (1)..( 2798): cDNA_ID_2730401_gDNA_ID_2684211_Annot_ID_137353 3000 nt of promoter + ATG

SEQ ID NO: 14680 - DNA, 3000 bp, Unknown
  misc_feature (1)..( 3000): cDNA_ID_2730534_gDNA_ID_2684212_Annot_ID_137355 3000 nt of promoter + ATG
ttattgtttctccaccttctccttcttcttcctcttcttctttccttttttttttttattgcaatttttcttataagttagtgatggagggtgacttaattagagtttgtatctagtcgaattccaaaaaaaaaaaacagtaaaaattggtgggtcaatccacttgtgttctgaaattttttaaactaaaatatctatttcgatgtgtaatatatatttttgcagtttaactttaacatttataattgatattactcattgtttttggtattttctctacaggtaaactttatttttgttgtcatttttctaaaataaaatattgtaaaagctttttaaaatggactttgatacagacattttaaatacaaacagacaaagacgagcaagagaataggggaccctctttgtcatttgattgacatatacaggtatatactataaaagaaatgtgacaaacagtcatctatattcattttagtgatttttgtttcacctaatctcttaaagtttaagtgtcacattatactgtatattactagccctgtaattctgaaacaaattggactattattttatacactagttctgtttacacagaccagtaccgtttctgctccttaactggattaactttaatttttactatatcaataaataactgaaatagtgcatgttactgaaatgacgtacgagtacaaaagatttccaaattattataccagatacacatattctgccaagtttaatgatattattatcgcagacagattagttttaaaggatgaaaaaaaatatactttgacaggggccaataatattgttttgtgacgcaggtgaacagcactataatatatatagcagaccgatggtatcacttgggcaataattaaactgaaatagaaaaaaataacaattttgaaaaggataaaaaaagagagtcacagaaatattatcagagctataaagattatagatcccctgacgaaaaataatttagattgtaaatagtacagaaactatatataataagcatttaataatggataggcttaggtaagcctatgcaagtacagcaggttttgaattattggatgaaacatttgtttcaaatattagattttaatttttataaatctatttgtgtaatacttatatatatatatatatttaaaaatgaatattatagggttgtgtaggggttagggtaaaagaatgacttgggagatttaacataagatcgtgtgggcagttaatatttagtgagatagatagatagtgtagtacgtttgcatttattatctttttacctgattcttttgtatcattctacacacacgtgccaccgccgacacctgctatctttctactgtttcattttaatttttatcttacatttttgtcaaacatttaatatcgacaatatgaattaaaagtttttgtttccaattatttttctcacaataattttttaaatagttgtgttgagacacttgacgaaactcatgctttatgtattgttggtttactataaaccgaacatgtttgcttcgttttttttttttttgaaaaaatgatagtaaaaatatgtgtcaaaaccgaaacacaaacaaccttatattccattttttattatgaggaagagtatagaatcaaccgaaccaacaaaagaaacaaagtgtaatacacagaattgagttaaccgttggagaaagtggttaaaggaaaaataaggaaacgatcgaaaggaattggtatatatctgaggggagaatgtgtataaaataaaagaaaaaaaggtctgactcatgaatgtataatgatatgcttacacccgcacgcataaacctctgccatctttttactgcacactcttttccttttctcttctttaaagtcaattttatttgctgataaccacaaaatgtagcaattttagattacattatttgtttcacatttcttgaaatctgaaaacttttaactgcgactgcaattgttttggttgagaaatcgatcgacttggagtatgagattaccttcttatcagtgtctttagtataacggttgcattgcatatatatttcctctcaaactttaatgatatcagttcaactagtctggatcaaatgtaatattgatactttccttgaaaacacattatttggtgcgtgggaagaatgatcttaaagagatgataaagggcactagagttttggttttctttgtaaaatagtgtatttatgcaaaactcaacattatatggatgtttgcattatggtatttttcaactaatatacacccaaaacagtatccttattaaacagctctctctctcgttttgttcaaactaacaagagaaaaatgtcagcttttgttgaaaaatagataaaaattatgacataaaacccaaaaccaaaacgtcaacaccatttatcataaattacatttgtagttagctaaagtacaaaaacaacactgtaaatgatccattgaccaatcgagtagtcattaacgaaagatcacaacttaacatcacccagtctaatcaaaactccaagaccataagaattttgctaaagcagcagtatagtgataaacacacaaaacgggaaaagttgttttacaatttagaatgtcatatactttaattattatttgcatagggaaaaatagaaagagactcactccccaggtgagggcaaatagaagcccctgctccctgaatttcacagcctttatcatcaatgctcctctaacctcaaacactcaaaatccacacatctatacacatacctctacatacacactccattttctctctctatctctattatatcttcgatttatgtgccattttggtatataaatatataatcttgcacacaataaggttatacttcccatcaccttttgtatcattgctatctttgttcttccttctggtgtctcttcagtgtaacaaaaagtctctttttcagttatattaagtaaaagatg

SEQ ID NO: 14681 - DNA, 3000 bp, Unknown
  misc_feature (1)..( 3000): cDNA_ID_2730530_gDNA_ID_2684212_Annot_ID_137356 3000 nt of promoter + ATG
tcactgggacattgatagactttacgaaattcgatgttgttcctcgttggagctgtcaagaacagagattgccgcagaaattgatgaacatcttctggaatctggaaagaattagctccaagaatatgaattttgtaaactacgatgaatcagtgaagactgtgagagtgagagagattgagaggacctgtaatggtaacgcggggattcgaaaagctctgaggagaagataaccatggagaaatcgctgccatgtgtttcaagatatgtccgcttctctgttttcacgaaatctatcgctactttgctgtttcaacttttattattttttagtcctaaaataatgtttttattaagtgactgaggattaaaattcaatatttataattttcgaataaatgctctaacaattaaaaacatatataaaataaaattatgtaatgcatacatccaagtcgacacataatgacacaacatttacacaattctgtttttgataaaatgtagaaaattataaaataatgaatatctttgagcaattgacgaccccaaatttttaaaattatttgtattaattagaatgatgaatactgaacaatgtacaccttcctagttagttgttaaatattactgtacttggagacactttcatagtttttttcaatcccaaacaataataaaactacccaaccatcatattaaaagtatctattttcctaaataagccacatatatcttttaatttcatcatttctaacttaaaatttttagtactttatctaatacttttgtaaatatttcgagtgatattaacttttagttttaccttagtcatagaataaattatgccagcagtagttggtcatccacatcttttacctgctggcatagaatagtttaccttagttttcaactaaaaaaacataagttaccatagtcatatttcaactttagtatacagttgaaatatgacagagcatgtaaaaatgtggatgtttttggttacaaggtttctttagtcagaatggtcaacaaagtttctgacacgtgtcttattcagagtggttactttgaccagctgctagttatatttttgactcatcaaattcaccggcaaatccagtgagtaacgacggtcacgctgttccacgaagcttcgctgtcaacaccatcatcggaacttaccggagttcgttacggtaccttaaacccaaacccttctccgttttcgctttgttgattatcttcttgagtgacttcgttttgagaatttttctgggtttcggcattgtggaatcgaaattagtttttttttttctgttttgggtctcctctgtctcctttaactccattttcctacgaatctgtttctttaaccctaggaagacgaaaattatcgcttcatcgccacttattctagggttttgaatgcaaagaagaactaatttcataaacctgattgagcttagatttcaaatgatttcgactgattcgtactatgaaactcatcttccacatttagtttctcaaatcatttgagaaatctagctcaaacgattcgagtttcagaacttttgttcatcaaaattaagaatttggtcatgatctagcttagtttgtttcttcccttgtactttcaatttgatgttcttggaatcttccttcagagagattagatccttttactcataaagttttaacctttgctctgtttgtatagaaaaatcttataggtctctttgcttttacatcttcaaacttgacttgtgcttgtgatttgattgttgtcttcttcttttgctttcttaattgtgatattattaacaggtaggtttggattctatctcttgtgaaaaaaacagaaacacaaagatgaacgctgagaataatcagactactactactcactcgaaagtgatctcacatgtattctgcactggtactgctaagctaggctctgttgggccacccattggtcttgttgatattggcgtcagcgaagttgcttacatcttccgagtctctcttcctggcattgagaaaaatcaaggtaagccttcacatttcttttctccttatgtcctgttgttggataatgaaaataacaacctgttaataccggaatggattcctcatgttttgggttagataatgaccaatgacgtgaaaagaaagctgctttcttttacgctatccgtgtatgaaagcaactttgacccaaaatgctatcttctgttctgttaatagataagatcaaatgtgaaattcagagggaggggagagtttgcatccaaggagttatacctgagattgcgattccaagtgacacgggatgcttatacagaatgcaagtgcaacagctctgtccgcctggtccattctcaatcacgtttaatcttccgggacaagtggatcctcgcttgttttctcctaattttagatctgatgggatctttgaagtcgtcgtagtcaagctcggagtgcgcatcccaacttcatagttccggttttcattcaaccacgatatcctccatgcttaatcagcatttagttgcagtggccgacctgtaagtctttggtcggatttagcagaggttagagactcaagaatgttctagtttcttttgtgtagaaccatgtccaatgatccggttccttaagatgttcttagactctgaaaaaaagcaccttgatgtgaaacggaactgttttaaccaagattttggcaatcacatcttacaactaaaactctttgtaccaaagagggaaatttaaaacttataatccaaattttataaataaagttgtcaaagtcaactaaagaagtggactcgatccagggaggtgttgtgttcctcacagtcaaaccaaagcatattccatatttgtctccaataagaaaaaatctccaaaaacacattcaaatgaaaaatacaaagacttctattgttctcattctccgtatcttgaaaaaattcttaaaaaatcgacgaaacgatg

SEQ ID NO: 14682 - DNA, 3000 bp, Unknown
  misc_feature (1)..( 3000): cDNA_ID_2730528_gDNA_ID_2684212_Annot_ID_137357 3000 nt of promoter + ATG
ttagagctttgttcagcagattcttcatctgtaaactgtaatacccaaaagagagtcgttgtgttagacataagatactaataagataggttattgtggcaatagactagagttacctgtcctgtgacagtgtataaacggttgtaccatccgtttgttgccattccaattgcagagtacaaatgcttgcgagcttctccagggttttgtaaggtgtactcgatgtaatagaatcctgatcatagattgtgtcaacgaaacaatgccaagatactgcagagattctcattgagttgagatttttgtatttacccttagaagctctgctatcgattagctttgcagtcactcctactggtttttgccagcttctatccaatccactgacctatacataaatgtcatgttgacatttgtaaggaaatctttttgcagagagtttgtttgtttgtttcaattgcatgtagagagactaaccaatgtttcggcgaaagcttcgacctttccgaatgattccatcctggtgaagtctggacctagtccagtgatcgctatactcactgagacgatccatatacatcacctatcggttagctcatgacttctgtctgatccagagagtaaacaaaaagaaacaaattttgataaattttaccattggaagttgaagtttcttgtgggtaaaaagctgtgattgacttgaatccattaggttctgcttgcccgacttgccaatctttatgtgaatgcagatcaaattcattcatcactcataatgatttcgccactatcataagtatctgaaaacagagtttgattagattaccttgtgggattgatatctcgaatttgttcgtttcatctgtgtacacacggaaagcttctgatgcatctgagattcaaaagaagttgttattagaaattctcaaggaatcaatatcatcaaaaacacatagaatcaacaatacttgtctctgcaaatgcaggtgaaatggccaatggaaggaagaaaacagaggaagctatctgtaacatgacgtctcttctcttcatcccaacatgatctctagacctgtttactttaacagattcagaacaaacccagataaagaaaggtagtgaatttcactgggacattgatagactttacgaaattcgatgttgttcctcgttggagctgtcaagaacagagattgccgcagaaattgatgaacatcttctggaatctggaaagaattagctccaagaatatgaattttgtaaactacgatgaatcagtgaagactgtgagagtgagagagattgagaggacctgtaatggtaacgcggggattcgaaaagctctgaggagaagataaccatggagaaatcgctgccatgtgtttcaagatatgtccgcttctctgttttcacgaaatctatcgctactttgctgtttcaacttttattattttttagtcctaaaataatgtttttattaagtgactgaggattaaaattcaatatttataattttcgaataaatgctctaacaattaaaaacatatataaaataaaattatgtaatgcatacatccaagtcgacacataatgacacaacatttacacaattctgtttttgataaaatgtagaaaattataaaataatgaatatctttgagcaattgacgaccccaaatttttaaaattatttgtattaattagaatgatgaatactgaacaatgtacaccttcctagttagttgttaaatattactgtacttggagacactttcatagtttttttcaatcccaaacaataataaaactacccaaccatcatattaaaagtatctattttcctaaataagccacatatatcttttaatttcatcatttctaacttaaaatttttagtactttatctaatacttttgtaaatatttcgagtgatattaacttttagttttaccttagtcatagaataaattatgccagcagtagttggtcatccacatcttttacctgctggcatagaatagtttaccttagttttcaactaaaaaaacataagttaccatagtcatatttcaactttagtatacagttgaaatatgacagagcatgtaaaaatgtggatgtttttggttacaaggtttctttagtcagaatggtcaacaaagtttctgacacgtgtcttattcagagtggttactttgaccagctgctagttatatttttgactcatcaaattcaccggcaaatccagtgagtaacgacggtcacgctgttccacgaagcttcgctgtcaacaccatcatcggaacttaccggagttcgttacggtaccttaaacccaaacccttctccgttttcgctttgttgattatcttcttgagtgacttcgttttgagaatttttctgggtttcggcattgtggaatcgaaattagtttttttttttctgttttgggtctcctctgtctcctttaactccattttcctacgaatctgtttctttaaccctaggaagacgaaaattatcgcttcatcgccacttattctagggttttgaatgcaaagaagaactaatttcataaacctgattgagcttagatttcaaatgatttcgactgattcgtactatgaaactcatcttccacatttagtttctcaaatcatttgagaaatctagctcaaacgattcgagtttcagaacttttgttcatcaaaattaagaatttggtcatgatctagcttagtttgtttcttcccttgtactttcaatttgatgttcttggaatcttccttcagagagattagatccttttactcataaagttttaacctttgctctgtttgtatagaaaaatcttataggtctctttgcttttacatcttcaaacttgacttgtgcttgtgatttgattgttgtcttcttcttttgctttcttaattgtgatattattaacaggtaggtttggattctatctcttgtgaaaaaaacagaaacacaaagatg

SEQ ID NO: 14683 - DNA, 3000 bp, Unknown
  misc_feature (1)..( 3000): cDNA_ID_2730524_gDNA_ID_2684212_Annot_ID_137358 3000 nt of promoter + ATG
cggtcacctaagtaaccaaagatgagctgacctaacgcggtgccaagaagagcgattgcgtaagaagttgagagaagagcggttccgattgagtctttgtggtaatatatttgacttatcattttcatgatcggagctatacagaaaagatcgtatgcgtcggtgaaaagtcccattccggcgactattatcgctttgaaatggtaccactgtatcctcgctgcgtctaacgccgataataaacttaactccggcatcgtttcgtcgattttttaagaattttttcaagatacggagaatgagaacaatagaagtctttgtatttttcatttgaatgtgtttttggagattttttcttattggagacaaatatggaatatgctttggtttgactgtgaggaacacaacacctccctggatcgagtccacttctttagttgactttgacaactttatttataaaatttggattataagttttaaatttccctctttggtacaaagagttttagttgtaagatgtgattgccaaaatcttggttaaaacagttccgtttcacatcaaggtgctttttttcagagtctaagaacatcttaaggaaccggatcattggacatggttctacacaaaagaaactagaacattcttgagtctctaacctctgctaaatccgaccaaagacttacaggtcggccactgcaactaaatgctgattaagcatggaggatatcgtggttgaatgaaaaccggaactatgaagttgggatgcgcactccgagcttgactacgacgacttcaaagatcccatcagatctaaaattaggagaaaacaagcgaggatccacttgtcccggaagattaaacgtgattgagaatggaccaggcggacagagctgttgcacttgcattctgtataagcatcccgtgtcacttggaatcgcaatctcaggtataactccttggatgcaaactctcccctccctctgaatttcacatttgatcttatctattaacagaacagaagatagcattttgggtcaaagttgctttcatacacggatagcgtaaaagaaagcagctttcttttcacgtcattggtcattatctaacccaaaacatgaggaatccattccggtattaacaggttgttattttcattatccaacaacaggacataaggagaaaagaaatgtgaaggcttaccttgatttttctcaatgccaggaagagagactcggaagatgtaagcaacttcgctgacgccaatatcaacaagaccaatgggtggcccaacagagcctagcttagcagtaccagtgcagaatacatgtgagatcactttcgagtgagtagtagtagtctgattattctcagcgttcatctttgtgtttctgtttttttcacaagagatagaatccaaacctacctgttaataatatcacaattaagaaagcaaaagaagaagacaacaatcaaatcacaagcacaagtcaagtttgaagatgtaaaagcaaagagacctataagatttttctatacaaacagagcaaaggttaaaactttatgagtaaaaggatctaatctctctgaaggaagattccaagaacatcaaattgaaagtacaagggaagaaacaaactaagctagatcatgaccaaattcttaattttgatgaacaaaagttctgaaactcgaatcgtttgagctagatttctcaaatgatttgagaaactaaatgtggaagatgagtttcatagtacgaatcagtcgaaatcatttgaaatctaagctcaatcaggtttatgaaattagttcttctttgcattcaaaaccctagaataagtggcgatgaagcgataattttcgtcttcctagggttaaagaaacagattcgtaggaaaatggagttaaaggagacagaggagacccaaaacagaaaaaaaaaaactaatttcgattccacaatgccgaaacccagaaaaattctcaaaacgaagtcactcaagaagataatcaacaaagcgaaaacggagaagggtttgggtttaaggtaccgtaacgaactccggtaagttccgatgatggtgttgacagcgaagcttcgtggaacagcgtgaccgtcgttactcactggatttgccggtgaatttgatgagtcaaaaatataactagcagctggtcaaagtaaccactctgaataagacacgtgtcagaaactttgttgaccattctgactaaagaaaccttgtaaccaaaaacatccacatttttacatgctctgtcatatttcaactgtatactaaagttgaaatatgactatggtaacttatgtttttttagttgaaaactaaggtaaactattctatgccagcaggtaaaagatgtggatgaccaactactgctggcataatttattctatgactaaggtaaaactaaaagttaatatcactcgaaatatttacaaaagtattagataaagtactaaaaattttaagttagaaatgatgaaattaaaagatatatgtggcttatttaggaaaatagatacttttaatatgatggttgggtagttttattattgtttgggattgaaaaaaactatgaaagtgtctccaagtacagtaatatttaacaactaactaggaaggtgtacattgttcagtattcatcattctaattaatacaaataattttaaaaatttggggtcgtcaattgctcaaagatattcattattttataattttctacattttatcaaaaacagaattgtgtaaatgttgtgtcattatgtgtcgacttggatgtatgcattacataattttattttatatatgtttttaattgttagagcatttattcgaaaattataaatattgaattttaatcctcagtcacttaataaaaacattattttaggactaaaaaataataaaagttgaaacagcaaagtagcgatagatttcgtgaaaacagagaagcggacatatcttgaaacac

SEQ ID NO: 14684 - DNA, 3000 bp, Unknown
  misc_feature (1)..( 3000): cDNA_ID_2730520_gDNA_ID_2684212_Annot_ID_137359 3000 nt of promoter + ATG
aaatcagatgagacttgtgtataaatactttgagatctgtgttctctttcgttcactccaaagagcatcctattaagttgctaaagagagagacgccaatggctgtaaagcaaaaggtctgtgttactggtgcaggagggtttattgcttcatggctcgtcaagtttcttctctctcgtggctacactgtccatggaaccgttcgagatccttgtaagggataagatagaaaacaaatcctctcttttttgtgaacttttgaatattctctgtttcttgagtttgaaaaagttgcatgcattgatcccattgttctcaggtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagttcctctcacagaggcaagttcttacatagattcttcttttgtttgtttcttgaatcactaacaaagtctttaaaacattcaggaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgaggtaatattgtatctttgaagctaccatgttggtcagttgtctctgtgttatacatatacaccaagacagtaatagaattgagtgtttaatgtgatgcaaaaaatctgaggatctcagggttattggcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtgatgtaaacatataatgtgtgttctcttacctcctattgcatattttggttaagtgattgattcattcttgataatttgatgaattggtgtgtctcttcttaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaaggtaagaagagtaagaacaaacgcttgatttcaaactttgagatttcggtctgatctgatggaatgtttattggcagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataagcttacagagtcgtcacagtgactgtttcttcacttttatcactcctgaaataaagtggtttttgttagaatcatttcattctcaaatccattatctattactatcatattagtgttgttctttgtaacagtcagttatttgtcactttcaccaacatgaataatttgatggaacatgtcagattctcacggtttctttttcacaaaacaaaactggttttgaatccgaccactagactaaagtgtccatagtccgcggcaaaatgaaaaccaatttaaatgtcgttatacaagctttgtagtctagtagagatatacaaatttaattgtcgttgttagttttgtagtctagtagatatgattagtcattagttacggtttcttaataacattgacatttagaccacaatgtggacttgtggggttaaatgagtcacgagctcatgaacccctagccatttatttgggattttccgaggacgaggcttaatctacaccgtccgaattcgttaatgacggcaaattgcttccatgagtagatttttctttgtctcattagtcattatacaatttcaattctaaggataaaataatcaacaaagtttgatttcagttttttacattatttgtgtaacgttactacaacggatagatttgattcagacaaaacaaaaagatcgatgattacgacgttaattacagaattagaggtataaatatatgggtcccacgtcatttacaatggccagaaacaaaagtatctctttctctctctcttcatcttcaacaaatcacgcaccatcataatcatcatcatcttcatcgtcatcaccaacttcttcatcatcaccatcaatggaattccccaaaccaaaccacccttcaccctaaaaatcgtttcatcttttttccttcttctaattttttttaggtttttaattaacttttgcttcaagttttcttctatagatttcttactcagaaaagtttcgaattcgaccctgtagcttagttgttgtttataatttcttgtgatcattcacagtacaaaaaaactaattcacccaccgacttcttcttcttcttctcttctctgtggcccatccttaaacccacactgcttttgcttttcctttttttttccgggaaatttgatctctttacctttcgtcattattagtagggaatgatcttttagttttttttttgtttcccccaaatctcactttttctcacttcctctccatctcaaatttcacacaaccgagtaaaccctagaatctccgcttctcattcaattggtttcatcactggtcttaatcattgctagggtttactcggttacctttatcatcatcaattgatccttgttcataattcatcctcttttctttctgtctttggcataaagtttcaatttttcttcttcttctctttctcactcaatcatg

SEQ ID NO: 14685 - DNA, 3000 bp, Unknown
  misc_feature (1)..( 3000): cDNA_ID_2731082_gDNA_ID_2684212_Annot_ID_137362 3000 nt of promoter + ATG
ataaagctttcacatcaaacctaacaacaaaacaagaatcacacaataacttagtctcagcttgtggggagacaaaaaaaatcacaattgaagattgagaaagtttcaagaacactaacatgttatcgtggcagagacaaggcaaaccatttaccaagactacaagacataatagtaagtagcagagtgtcctgtttaatggaaaatacgattcttttctgattccaatcttgtaatcagcaaccctgaaatcgtagattccaacaagtacaatcgattttaggctccacagtaccttacaccaatgagaaccaaagcaaactaagatacagattctttaattacgtcgtacgagaaaacatcctagtggacagacaggaccacattattgcttagaccttggccctaatgaaacctgttattcagtagctgtttcaaaattagatccaacatatcatcaagcttatcgacatagcccggtttagcctaatttggttacttgaaacttttttttttttttttttaacttgaaacttttatcttctaaacatttttcatttttttttaataaataaaatgaaggatttgtgcgtttgtgtgaaggaatctgaaaacataaaaccaaaagaatataattggaggagcaattcaatcaatcaatgggttttttaatagttaatttacttaaggggaggtaggttttatttgtctgcttacttcgagtaaggtcgagatccaccagaacgtgacaatgtgacttccactgcttcaggacaaatcaaatatgaacctacgtcacaaaattactattataacaatttatccttatttattctttcttacgactatcttgtcttttgctatcatttacatttgtaaaaaacatcgtgatattattatttactagtatataatatcaaacttttcacgtttaataaaaattattaatttgaaattattcatttttgaatttgattgatatagttgacgaaaaagagttgttagtgtaggaagtttgtccggatatgcaattttttttttgtaacgtgtatcatctcgttaagaactcatatgtattatatgaacaaaatcaatcatgtatattaaaaatggtttgccctaaagatattctatgtttttttcgtgaataggtgttaaggatattaaacaaaaatacccttatttattcttacgactatcttgtgtctatagcactctagcttctacgttggtatcatttatattttaaaaagattttgtgatattattatttactggtataaattttaaaatttctcacgtttaataaaactaaacatattaataatttaaaattattttacttttgatttttattgatatggttgacgaaaaagagtgattagtaatggaagtttgtctggatatgcatttttttttcttcgtaacgtgtatctcgttataagaactcatatgtattatatgagccaaatcaaatcgtgtgtattaaaattggttgccctaagaaaattcaatgtttctttcgtgaaagaaagtctattttttttatagatttgattctcttcttgggatttccacattaaaattattatcttagaggctcagtttgatacatacactatattttttatatattgttcaacgtatagtgactgaatggtagttgtttaaaaggattgtgtaaacgagttggatagccaaaactatgttaacttgatccttgtaaagtaaacaaagccatgcatcctctaattcaacaatttggtcccattaccccaagaaaatgttataaagaggttatctttatcaattacttgtaaacaggacattatctttataaagaaaatgatatacatgctgcatttttttggtttggtagttttacatgctgcattttgtacttgcaaccacttctatactaattgttttagataagatagtaccttcttgtttgatcacatcgtaaaaggatcggatatgttaaccgtctttttccaaacgttatatactcttcaacactcatcataatgtatggagatgtatcaagtatctcttacgaccattggtctttgcggcctaatttgcaacagaaagtcagaaatatccatactataactatgctatttgaaaattattcattttgactcatatataaagtagagttaattaggtgtatagccaaattatggatgaaaattagacaaatgatcatgacattcttttttcttaatttcccaaaagaattgtaatatcagaagggaaaaatacattccacacatagttagaacttagaagaggtccaatcaataggcggtaaaaattaatttgtaacggtaaacaaaaacgataaaggataatagtacaaactaattggcaattaatactgtttttggtcaaatatatatgtcacgacagtagatgaaaataccgtttttggttgaatcgttttattttttactttgtcttgaatcttgtctactcttcaataccgtttttcgttgaatcattcaaaaaaaaacagatctcctagtgatatgaatcaaagtttatcaataaaaatcttagtatacatttgcaaaccataacttcataattttgaataaacgataatgtaagacaggttggctcattagaaagcatatcaaattaattgtaaggacacaaatatctataattaatgcaggcttttatgaatcaatcatcatcattcacatcctcgtataattgtctaatttcgtacctcaaaaaaaaaacaacaacgtgaaaacctaaaattagatgagttacgaaaattaggcaaaaataaataaactaaatcatagtattacaaaacaaaatgaaaacgaaaaaatgaagaaaaagcaagctggtccccaacagacatgcgagttcgtctcctataaaactttgttaatctctccttcacacttatcacgccacctcaccacctctctcctctctcctctctctcccccctggagagattattcattccctcca

SEQ ID NO: 14686 - DNA, 3000 bp, Unknown
  misc_feature (1)..( 3000): cDNA_ID_4255053_gDNA_ID_2684212_Annot_ID_191573 3000 nt of promoter + ATG
aaagacgggcgggctagttgataaaagctcaataaatatgggctggtttagggttaaacagcgaggcccatttgtacaaaatattgacatcgattatttttgttttgcatttgtggatccccaggctgagattacaactcagaaaattacaaaaaaaaaatagataataataaacaacgattataatgatgattctttcaatttgttatgttagagaatcacaatgcttccacacgtgcattttatatcacaatttagattatgataatttgaacaatctgacaaataaggattatttaaataattgacttgttatgttattacaaaataggtactatgagttagacaaaaaaaaagaaatctggtggaatggcactgaatcttagatagcacgtgtcacgtcgaaatattgcgtgcaagtatacatgcgccgttactaacgctgttatagacttatagtacactgaaactgttcatatagtgctgtaatattttcgtgaacttatgaaataggttcaatttcttttgttaaaatttgggtgtcaaagcgggttaatatattttatgaattttaatagatagtgctaaaaattggggtcttaaaatagtaactataatgtcgtcgtaccattgcggagtttgcaagccgatctgcaaactcttcaaatttaaattatttttcaaattttttttcctgcttagttctttatcaaagtactaggattaatgagatcgattattaatacttattagtacagaagtataaactagtactgagtgattaaggagatcgagtgggaattggcggtttatattaataaactagtactgagtgattaaggagatcgagtatacaaattactagtgagctatttttaagatgctagtataactttatagtatatcataactgttttttcatacgaacatcggtttaaatgaagtaagttactcaaggctggcctttcatgtgtttaatagtactaaataagatagtaccagtggccggtaaaattagctagctgttatcaattgttatataatatacatgttcatttattttatgtattattagactatgagatgatatgagtacagaaaaaaaatccaataaatatgtatataaatatctagaaatgggtagataaactatttaaatgagtcactcaacgtgcctgagtttccttttcgatttaattgtcctcattgtgaattggcataaaagtcggtgcgaaggaaagccccaaattatttaacttgaaaacgaaagtttggtccacctctctatattcatttttctgaaatgaaattaatactcaaatcaattttgtcataaaaattgtccaattattaaagtattcagtcgtgtttctatatatatcactgtctttagtcagctagtctaatattgcatatttgcattcacctctatatatgtacacacacatctacgtatggagaaaacattgtacattcactacattcgtgatctcatttatctttagatggctaaaaaaaactcagatagaatatcacacttacccaaaatatactattctttcgtacgaaatcttattactagcacatgacgtgtgtgagaaaaagtacactcattggacattcaaaggtgttaatgttaaaattaacaattgggttttctaactatgagccactaaatcatcttctaaagtcaattataaattatacgtgacgttacttaatattggaaataaatattggagaacaattataagtttgaaatagaaatcataattaactattttactactccaaccatttataactacgaagctaccttaaaaaagagaatgacatgggtatgactttgcccgttttttcttaatgaatttgttactctaaagtcataagtctctaatccgtattaatagcagtaattaatggatacaaaaaaaaatcaaaaagaaagaaaaatagacagggtggcatcataatttatggggacagctgtcgaggtgatgcatttatgaccactaacatgcaatggcacggatgcaaattttaattgttagattcttctacaaaatttacttaattcaatacttctgttttcttcttcttcttcttcgtaatttaatagattctgcatattgtttaatatttattttacatgccagtgatgggttgtcattattctgattcatttttctataaaatcattataaaagtattttcaacttcttgacaaaaataggtgtttaattattactacaaagttcaggtcgattgttatttcgggctacataaaaaaggtttgatttctcgtatgggagtgattacaacatatttattggtattttatgaccccatgtcaactcttatgtagtaatttgtccccacttattgaattgttattagctcaaaggcattaattgcacggtttctaacttttcttctatagtagtatgtttttcacatttgaaaaacactaatcattttcattttgcatggaaataagaccaaatattttcattaatccactaaattgcatttgcaacacaagcccaaatcattatatatataaatataatatattattgtgatgagtaaaatatagacatgcaaagtgactatgaactactgtaattatacactgcaagaaaaacattgccataaatatgaaaacagaagacattgacagatagtaataaaaataatactatatctctaaatataattcagatgttaacgaaagtcttgtggagtaaaaactgggtttcacacacttcacttgcctctcaatacccgggaaaacaaaatgtcggtttcacttgctacttttcccggaaagttacaaagtcattcccttttcaggttgtgaagtcacattaacataagagaagaagcaaaaaggcttggagctttattttttgcttttttttttctttcttctagaaaacatgatcttgagtttccgagtaagattcttttaaaaagagtttgcaaagaacgagaaaaatg

SEQ ID NO: 14687 - DNA, 3000 bp, Unknown
  misc_feature (1)..( 3000): cDNA_ID_2730494_gDNA_ID_2684212_Annot_ID_191567 3000 nt of promoter + ATG
tagaaaacaactagctctaaccaacaacaaaaccacagaacaagaaattccagagatctataaatatgcagatgcatgcacacctcttcactggatgttcagtaatgatctgagcatcagcaactttagcagttgccctgaggaaatgagccaaaggctggcctagagtatgtgggaaggcacgggcaatgatatgagcatcaccagcctttgccacagtggttccatcaccaagttcaacacggacagtagtcccctgtaatgtacattgaatcaataacgaattaaactacgaatcatccaaccaaaaaaaaaactacgattcaatcactgttccagaaaatcactccatcatggtagttcacgttgaaaggcaattctacctaccacactaaactgaaatgttaaatcagacgagtaagtataaaaggatcataaaccctagatcccgattataataacagtgtaaacagatctgcatgaacggaaacaacattgcaagttcctcgagtagacaatcaaaataaacagctcgaagggattcaaaatattcgcgacgtgacgaaattgtgagaaaacgaaacagcagaagagatgatatcaatgaaaaacatagagatccaaacattggagacagtgaacgagagaaggaagcaagagatctaaggaagatacgaatatacaaataaaaggaagaaggagaagtacctggagacaaggaggaagctcagggtggtactgagatcggagttgttgaagaggagagagttctctggggattccgaaatctgaatccatgggcgataactttttaggtttttgtgagaaattaggttggtgagagtgtcagagagactcagagaagattcagagaaagttttttcctttggcccgtcaaaagtatttatatagtatgcgggggacttgggcgatacgatcaaccaaacagccaaaatttggtcttcttcttttttttctttcagtccacgctttttctcgatcagcccttgttattctggttatttacgaaaatgccattggatataaatatatacccttacctttttcggtttggtaatgtttggttagtgaccaaattgtctaattcggtttggtgttcatattttatgggttttaaaaggttttagactgcaaatttatcgaactgtatgagtgtacgtttggttttaagtttagtttataaatgcggttaggttttggtttagtttgagttgacaaattccccacctaagtgcgaccaaactttcaaactaagaaaaaataaaagcaaaaaataggatatgatgatatgctaaaagggagagtgaatgagcaccaaaggataggtgaagggtaaatacggaaatagcgagagaaaaaaaaagaagatggaaatattggggaatatagcattcaatagggagatatgcttttacatggtaattacaaaggaataaaggcaaacatatagtaaaagatacgactctctcattccctcttccccaagtattattattgcctgataattgataaactacccatcgaaaataaatatttattatgcacatggatctttaaaaaaatggatttgtttattatttgacctgatttgggcttttaataaggcttcttatttactctgttgaccgtaggaaaggcctgtcattatttaaagatctaccaactgaatttcatcagtcagtatcgatgggattaggtatattaatggtaattgttattttcataatataggcctagtgtgataagacctcaaaaacaataagctttgatattacgatgagagtaggagtatataataaaagcataagattatgatgatacaaaggacatcaaagttggtgaacacctagaacaacaaaaggagtaggtaaaaggggtcagctttgcattgtgcttatctcaactaccttatgagaagaaaataatatttttttctaaagtcaaatgtttgatgagtgtagtttggataatgccgcattaaaaaaaaaaacgtgaaatgacaatcgaacattgatgattggagggcttatttgtaattacgataactatagtcaaacggcccaaaccattaataataaaaggtgaataaagaattttctgaaagacgaagaagagaaacgaaattcgtagaaatgatctcgggctcggcgacggcgagtcatgggagagtgttgcttccgtcacaaagggagcgacggcccgtctcaactggatcaaatattttacgtttcagagaaacagtaccgagacaattcagcctgatgatggtgacgaaggcgacggcaaagtatatggggacgaagatgagggaggagaaactatcggagatgatagaggagaaagtgaaggaagcgacagaggtttgcgaggcggaagagatgtcggaggagtgtagagttgcgtgggacgaagttgaagaagtgagtcaagccagagcagatctgaggatcaagctgaagttactgaatcaggatccgctcgagagtttctgccaggagaatccagagaccgacgagtgtcgaatctacgaagactaaaatttgagttttcgtgtttttaatgattgtagctaatctcaaaacagaggacttagaacagagactgattctgattaataaatctcaatcgtccattgaaaccgttgttcatcgtgttcacttacaccgattgatttggaatgaaactctgcattttggatcttttgctttggaacaaaacggttgttttgattgtttatggatctaacgatgtggcctgttacttaattgggcctataatctggatccgccgagtccgggctttttaaagaactggcgaatatcattacacgtggccagatccataactttgaaaatttggttatttttaatttttgtggaaaattagagaccgcttcttgctcttctaacttcacctctgctttcttcttctcgagtgaaacagacagccaaatcaagatttgacggtgagccaaattcc

SEQ ID NO: 14688 - DNA, 3000 bp, Unknown
  misc_feature (1)..( 3000): cDNA_ID_1032199_gDNA_ID_2684212_Annot_ID_191564 3000 nt of promoter + ATG
tgacatttgcacttcacctgatatcgctaacagcagaaattaccaatatgtttcaggtagttggtgttccggtcactattaatggagatcttaagaatcagtttgtggaagcaaatgttggtttcgatactacatgcaaggtaactttgaaatctagcgcttttttttcttttactttgtaggtattgtagccaacattctttcatttcgctcaccgttcttttcaggttaataacattttaactcgttatttagactaatatcattctactgtgtacaggtgaattctcagctcattagcaatatctgcaccgatgccctttcagcagagaaggtaaatgttgattccttccaaacgttatcatgttttagaaagattgctaggacactcataaccaacctatattttgttggttaataatgtgaaatttattatggtttgataattgcgaagttgggttccttatgattctgttatcaaattttcttctcaataacatactttcctccgtattgccagtattattactttgtccgtctcatgggtcggaagcattcacatgttgcccttgagtgtacacttcagtctcaccccaacatggtattcttccaaattctgaatatattcaatcgatagtcttggcaatgctgcatctagtttctcatttgcatttgatgcgattgtctcaggtgatactgggtgaggaggttacagcatctaagctcacaatatttgacatcataaaacaaatctgtgatgctgttcaagcaagagccgaacaaggtctgataactaaaacgagcttttggtatgttggaagtgatgtcttttgcttgttccctaactttattgataaactgtctatttgtatcagacaaaaatcatggagtcatcctaattcctgaagggcttgttgagagtattcctgaactctatgctctgttgaaggtaacgattcaatactggcaaacatttctatttatcatttaatgtgctattttttattgtttcttgagttccaaaacatagtaagcatttacatgttgttgtgcgatgcaggaaattcatggattgcttaaggagggtgtgcaggttgataatatttctactcagttgtcatcttggtcatctgctttgtttgagtttttgcctccattcattaagaaacaggttctaattctttgacatggtacttttctttgttttttctcacatgtaaacgagtatgtgttcttatgataaattgtcttctttgtttctgcagctacttctccatcccgagtctgatgattctgctcagctatcccaggtaagaagaaagaaaatgatggagttactgtgctataaaaagttggaattctaattgctcatttactttcttcttagattgagacggagaaacttctggcttatcttgtggagactgaaatgaacaagcgcttggtatgttgcacatctttttcacttgtcacaatccatttttttcaaatttttttgaataaccttgcctgaatattcaagttgtccctaaaactaagttttgaaaatgacagaaagaaggaacctacaaagggaagaaattcaacgctatctgtcacttttttggttaccaagctcgtggatctcttccatcaaaattcgattgtgactacgcctatgtatgtgatcgccaaactaaaatgctattgcaacttcaatattatggacattcacaccattgattataactttgatgcaggttcttggacatgtatgttaccacatcctcgcagctggtttgaatggttacatggcgacagtgactaacctgaagagtcctgtaaacaaatggaaatgcggggctgcgcctatctcagttgagttttgtctcttatttataaggctaaagttgtttagtatatgtgttgatttctgacttcaagtttcagttttactgaccccaatctctttctctgtttaaccttaggcaatgatgacggttaagcgttggtcccaaaattctggttctactacgattggtagacctgtaattcatccagcttcagttgacttgaaaggaaaagcatacgagtaagcttttgttcctcactcattagacaaagattagaatgaacatgaaatcaagtgatataatttgtcaaatgattttgcagtctattgagacaaaacgcgcagaaattcttgatggaagatatgtaccgaaacccaggaccagtccagtatgatggtccaggtgcagatgcaaaggcggtaagtctgtgtgtagaagaccaggattacatggggaaaatcaagaagctgcaggagtatcttgatcaggtgaggacgattgtgaaaccgggttgctctcaagatgttttgaaagcggcattgagtgttatggcctcggtgactgatgttctcactacgatctcatcttcttccaccagcggtcagcaatttgcttaaagatttttttattgttttggttttccctttaaccataaacttcattagctctctctctctctctctctttccattttgaagtcgtcttctgatttacgcaaactttattgttcaaagttgagtttaggaaaaggatattcaaagttaaaggatttgagtaatgcttttttaatgaagaagtctgtgtttgggttcactaatcttcttgttgccttctcgatcataatttgtatatggtgcgaccaaatcaaagtacctacggatatatatgacaagtggacacaaatgaataaatgtaaaaattaaaattaaatactatagtacgtggcaaattaaaaaaaggcgtttatgaaaagaccgctcctccacgctccagtttgaatttcgaaaaatcagtccgttgtgaaagcccaagaataaggattctataatttcaggtctcatttaattatataacctatctacactttgatctccgacaattcactttcccaataagaaccaactgagagagagagagcgccggagaagaagaattttagagagcgatg

SEQ ID NO: 14689 - DNA, 3000 bp, Unknown
  misc_feature (1)..( 3000): cDNA_ID_3018575_gDNA_ID_2684212_Annot_ID_191563 3000 nt of promoter + ATG
gggacttaggtctttcaatagagtttaggtctttctctagttctgaaggctcctctacaacacctttggtaccagacggcacatcttgctcttgcatttcagtatccgccatcatgaagctaattctctgagacatagcatcacaacaacaacgcagaattcaaaatccagaaatcataaatagaaacgcactattgataattccagagagaatgcaagacgcatgtaatcgagaattggaacgcatcaaaactctgagtcctactctctcactgattcgctataattcaaacagtgatggcgactaaagcattagaaagcagagcttcacgaaatcatggagtacatacatagaaacaaaagatacggttaccggtttcgccggaagaagaagacgccggagacggtggagtcgtcgcgggttagggttcgatagcagccggcgaaatggaaggacgccggcggagaaaaagaagcgagaaacggaaagatatcaattaaacggagagatatgcagatcaaaagatttatacggatgatataatgaacacatgaattcattaagaaagaaattaatgcttgttacttgtattaactcttaacgaagatcttaatagcaaaacttattaatgatatttcagaaagttggacttttacgacccatttacataacaaagcccattattgtaaactatgggctcaatatgtaaggtatattatgaatataatcttaggcccaattaaacacggaagacaacgtaggtttctgcttgtctcgattgttgttgtgtttttatttgttactaaagatagagaaagaaatatcgaagcattgtgcgttcatgttcaatatagagtttttgttgtaccaaaaaaatatagtgtttgaatctttaattatagactagctagcatataattaacgtgattaactttacaattatggtgatgatgattttctcagtatgtaggtatagtacttgtcaaagtgacaaataattgcaatttaatgaattggtgtggatccaaaggataacaaatagtatgagcatattcattcgaagcaaaatggtacagaattaagcaaagctttttgtccaaaattctaatgaattaaggaccattatttttagggaataatagtctttgatgccccacatttccaatagtacaaatcaagattttcaatatatgtcaagtttgttattttcattcacggacattaaaacgagtggagcatttcaatttgacatatctttgtccttttctttttgttacagatatcttttgttcacgttctttgaatcatcatattcatagctatgagatcatagaaatatcaaatactgttaattaacctctttaaaaatacatattcacaagtctcttgtgtgagtagaaatcctatacaaacaagtttattcatgctctaataagatagataaataagaagatagctcatgacatggccttcattaggcttgttgcatatacaataagcttacatataaggaattaaggatggtctaatatctcttgcttcacatgagaagagttataggattcgagtcacataagagatttttattgtagtgtgtataatatatcccacttctacaattatccagtctattgtgtatttttcattaataaatcactaaaatttgcactttgacaatatatacttaaatatttgtatctcgtatatatatatatacatatttttagcactgtatgataattctaattattcgctaattgtttttttttggtaagaattagtcgactattttgatattggggttgttacatttatatcttgcattgaattttatggacggacactggtcgcagcctcacacactaatttgaattttccgttatcattaatattcgatcgtttcgttggtacgcttccatcacacaattaatttaagccaccacactattatcttattctcattcagttttgtttccatttcaaatttcttacgacgcatatgaaaatgtacatttttataacaattccccttaaaaatagatgacaaaaagaaaaatgttttttttaaaaaaatatataaaataaaataaataataaatcttcaacaatcgatgaacactttgcaatatctccacaccttgggcaagaaccagaaaaaaacatggggcacgtttcgtagtcgatgtgacgaaaggcatgacgacggttaccatataaattcgtcttctcagataaagccttattattctcaatagtgttatacgacaatatacgaaacaaacaaagaccccgcttgagttgagttttccaaaaattgtggaactgtttcctctttctttttgtacataaactaggttacaaaaaattggaaaatatacaaaatcaaaggacataaacttacgagatatatcataactcataagttgtgaaagttggaattcaaaaaggagctaactatgaatctatgatacgttattttgttgcttatacggaacaaaacaattccaaaaacaaagaagatgtaaaagtctgacccggatcatgcggacaccaagttgtacatacaaaatatgtaggatgaaaatatgaaattctcttcccatatgcatagaataataatttaccttagttaaaaagattagtttctaagtttgccccaaataaagagattagtttcttgaaaaaagcattttgtggatagacaagaatttaaatagaatgaagaggcgaccatgcaagtgttgtactaggccaaattttggagacgctctttctctttcatagagagagagtgagaaagttctgatacggcggcttctcactgtcatctagctgtaccactgacgataaatctctctcttcctctaaatcggttaaaaaattcattcccttcttggattgctctgttttcttcggcggttcttgcagctccattgattctctgtttcctctgctacagttaacttatacttgcagattctcgcgttgatagtaaaaag

SEQ ID NO: 14690 - DNA, 3000 bp, Unknown
  misc_feature (1)..( 3000): cDNA_ID_3018579_gDNA_ID_2684212_Annot_ID_191562 3000 nt of promoter + ATG
caagaagattgactccatcgagagccatataaaatccgactgatgttatcaacagaatctcaacgactggttttgatgaagttatgaacagctccaaaagcttcaccatctttttactatcaacgcgagaatctgcaagtataagttaactgtagcagaggaaacagagaatcaatggagctgcaagaaccgccgaagaaaacagagcaatccaagaagggaatgaattttttaaccgatttagaggaagagagagatttatcgtcagtggtacagctagatgacagtgagaagccgccgtatcagaactttctcactctctctctatgaaagagaaagagcgtctccaaaatttggcctagtacaacacttgcatggtcgcctcttcattctatttaaattcttgtctatccacaaaatgcttttttcaagaaactaatctctttatttggggcaaacttagaaactaatctttttaactaaggtaaattattattctatgcatatgggaagagaatttcatattttcatcctacatattttgtatgtacaacttggtgtccgcatgatccgggtcagacttttacatcttctttgtttttggaattgttttgttccgtataagcaacaaaataacgtatcatagattcatagttagctcctttttgaattccaactttcacaacttatgagttatgatatatctcgtaagtttatgtcctttgattttgtatattttccaattttttgtaacctagtttatgtacaaaaagaaagaggaaacagttccacaatttttggaaaactcaactcaagcggggtctttgtttgtttcgtatattgtcgtataacactattgagaataataaggctttatctgagaagacgaatttatatggtaaccgtcgtcatgcctttcgtcacatcgactacgaaacgtgccccatgtttttttctggttcttgcccaaggtgtggagatattgcaaagtgttcatcgattgttgaagatttattatttattttattttatatatttttttaaaaaaaacatttttctttttgtcatctatttttaaggggaattgttataaaaatgtacattttcatatgcgtcgtaagaaatttgaaatggaaacaaaactgaatgagaataagataatagtgtggtggcttaaattaattgtgtgatggaagcgtaccaacgaaacgatcgaatattaatgataacggaaaattcaaattagtgtgtgaggctgcgaccagtgtccgtccataaaattcaatgcaagatataaatgtaacaaccccaatatcaaaatagtcgactaattcttaccaaaaaaaaacaattagcgaataattagaattatcatacagtgctaaaaatatgtatatatatatatacgagatacaaatatttaagtatatattgtcaaagtgcaaattttagtgatttattaatgaaaaatacacaatagactggataattgtagaagtgggatatattatacacactacaataaaaatctcttatgtgactcgaatcctataactcttctcatgtgaagcaagagatattagaccatccttaattccttatatgtaagcttattgtatatgcaacaagcctaatgaaggccatgtcatgagctatcttcttatttatctatcttattagagcatgaataaacttgtttgtataggatttctactcacacaagagacttgtgaatatgtatttttaaagaggttaattaacagtatttgatatttctatgatctcatagctatgaatatgatgattcaaagaacgtgaacaaaagatatctgtaacaaaaagaaaaggacaaagatatgtcaaattgaaatgctccactcgttttaatgtccgtgaatgaaaataacaaacttgacatatattgaaaatcttgatttgtactattggaaatgtggggcatcaaagactattattccctaaaaataatggtccttaattcattagaattttggacaaaaagctttgcttaattctgtaccattttgcttcgaatgaatatgctcatactatttgttatcctttggatccacaccaattcattaaattgcaattatttgtcactttgacaagtactatacctacatactgagaaaatcatcatcaccataattgtaaagttaatcacgttaattatatgctagctagtctataattaaagattcaaacactatatttttttggtacaacaaaaactctatattgaacatgaacgcacaatgcttcgatatttctttctctatctttagtaacaaataaaaacacaacaacaatcgagacaagcagaaacctacgttgtcttccgtgtttaattgggcctaagattatattcataatataccttacatattgagcccatagtttacaataatgggctttgttatgtaaatgggtcgtaaaagtccaactttctgaaatatcattaataagttttgctattaagatcttcgttaagagttaatacaagtaacaagcattaatttctttcttaatgaattcatgtgttcattatatcatccgtataaatcttttgatctgcatatctctccgtttaattgatatctttccgtttctcgcttctttttctccgccggcgtccttccatttcgccggctgctatcgaaccctaacccgcgacgactccaccgtctccggcgtcttcttcttccggcgaaaccggtaaccgtatcttttgtttctatgtatgtactccatgatttcgtgaagctctgctttctaatgctttagtcgccatcactgtttgaattatagcgaatcagtgagagagtaggactcagagttttgatgcgttccaattctcgattacatgcgtcttgcattctctctggaattatcaatagtgcgtttctatttatgatttctggattttgaattctgcgttgttgttgtgatgctatgtctcagagaattagcttcatgatg

SEQ ID NO: 14691 - DNA, 3000 bp, Unknown; identical to SEQ ID NO: 14685
  misc_feature (1)..( 3000): cDNA_ID_2731082_gDNA_ID_2684212_Annot_ID_191560 3000 nt of promoter + ATG

SEQ ID NO: 14692 - DNA, 3000 bp, Unknown
  misc_feature (1)..( 3000): cDNA_ID_3018584_gDNA_ID_2684212_Annot_ID_191558 3000 nt of promoter + ATG
ttgtagcccggcgacgatgatcgtcatcggaagtgcgaggctgataagaacggaaagatccgttggagttgttgttgttggtaaccggtggtttaggaggcctccgacggagatccattggagggaatgaataatctctccaggggggagagagaggagagaggagagaggtggtgaggtggcgtgataagtgtgaaggagagattaacaaagttttataggagacgaactcgcatgtctgttggggaccagcttgctttttcttcattttttcgttttcattttgttttgtaatactatgatttagtttatttatttttgcctaattttcgtaactcatctaattttaggttttcacgttgttgttttttttttgaggtacgaaattagacaattatacgaggatgtgaatgatgatgattgattcataaaagcctgcattaattatagatatttgtgtccttacaattaatttgatatgctttctaatgagccaacctgtcttacattatcgtttattcaaaattatgaagttatggtttgcaaatgtatactaagatttttattgataaactttgattcatatcactaggagatctgtttttttttgaatgattcaacgaaaaacggtattgaagagtagacaagattcaagacaaagtaaaaaataaaacgattcaaccaaaaacggtattttcatctactgtcgtgacatatatatttgaccaaaaacagtattaattgccaattagtttgtactattatcctttatcgtttttgtttaccgttacaaattaatttttaccgcctattgattggacctcttctaagttctaactatgtgtggaatgtatttttcccttctgatattacaattcttttgggaaattaagaaaaaagaatgtcatgatcatttgtctaattttcatccataatttggctatacacctaattaactctactttatatatgagtcaaaatgaataattttcaaatagcatagttatagtatggatatttctgactttctgttgcaaattaggccgcaaagaccaatggtcgtaagagatacttgatacatctccatacattatgatgagtgttgaagagtatataacgtttggaaaaagacggttaacatatccgatccttttacgatgtgatcaaacaagaaggtactatcttatctaaaacaattagtatagaagtggttgcaagtacaaaatgcagcatgtaaaactaccaaaccaaaaaaatgcagcatgtatatcattttctttataaagataatgtcctgtttacaagtaattgataaagataacctctttataacattttcttggggtaatgggaccaaattgttgaattagaggatgcatggctttgtttactttacaaggatcaagttaacatagttttggctatccaactcgtttacacaatccttttaaacaactaccattcagtcactatacgttgaacaatatataaaaaatatagtgtatgtatcaaactgagcctctaagataataattttaatgtggaaatcccaagaagagaatcaaatctataaaaaaaatagactttctttcacgaaagaaacattgaattttcttagggcaaccaattttaatacacacgatttgatttggctcatataatacatatgagttcttataacgagatacacgttacgaagaaaaaaaaatgcatatccagacaaacttccattactaatcactctttttcgtcaaccatatcaataaaaatcaaaagtaaaataattttaaattattaatatgtttagttttattaaacgtgagaaattttaaaatttataccagtaaataataatatcacaaaatctttttaaaatataaatgataccaacgtagaagctagagtgctatagacacaagatagtcgtaagaataaataagggtatttttgtttaatatccttaacacctattcacgaaaaaaacatagaatatctttagggcaaaccatttttaatatacatgattgattttgttcatataatacatatgagttcttaacgagatgatacacgttacaaaaaaaaaattgcatatccggacaaacttcctacactaacaactctttttcgtcaactatatcaatcaaattcaaaaatgaataatttcaaattaataatttttattaaacgtgaaaagtttgatattatatactagtaaataataatatcacgatgttttttacaaatgtaaatgatagcaaaagacaagatagtcgtaagaaagaataaataaggataaattgttataatagtaattttgtgacgtaggttcatatttgatttgtcctgaagcagtggaagtcacattgtcacgttctggtggatctcgaccttactcgaagtaagcagacaaataaaacctacctccccttaagtaaattaactattaaaaaacccattgattgattgaattgctcctccaattatattcttttggttttatgttttcagattccttcacacaaacgcacaaatccttcattttatttattaaaaaaaaatgaaaaatgtttagaagataaaagtttcaagttaaaaaaaaaaaaaaaaaagtttcaagtaaccaaattaggctaaaccgggctatgtcgataagcttgatgatatgttggatctaattttgaaacagctactgaataacaggtttcattagggccaaggtctaagcaataatgtggtcctgtctgtccactaggatgttttctcgtacgacgtaattaaagaatctgtatcttagtttgctttggttctcattggtgtaaggtactgtggagcctaaaatcgattgtacttgttggaatctacgatttcagggttgctgattacaagattggaatcagaaaagaatcgtattttccattaaacaggacactctgctacttactattatgtcttgtagtcttggtaaatggtttgccttgtctctgccacgataacatg

SEQ ID NO: 14693 - DNA, 3000 bp, Unknown; identical to SEQ ID NO: 14684
  misc_feature (1)..( 3000): cDNA_ID_3018588_gDNA_ID_2684212_Annot_ID_191556 3000 nt of promoter + ATG

SEQ ID NO: 14694 - DNA, 3000 bp, Unknown; identical to SEQ ID NO: 14683
  misc_feature (1)..( 3000): cDNA_ID_3019499_gDNA_ID_2684212_Annot_ID_191555 3000 nt of promoter + ATG

SEQ ID NO: 14695 - DNA, 3000 bp, Unknown; identical to SEQ ID NO: 14682
  misc_feature (1)..( 3000): cDNA_ID_2730528_gDNA_ID_2684212_Annot_ID_191553 3000 nt of promoter + ATG

SEQ ID NO: 14696 - DNA, 3000 bp, Unknown; identical to SEQ ID NO: 14681
  misc_feature (1)..( 3000): cDNA_ID_2730530_gDNA_ID_2684212_Annot_ID_191552 3000 nt of promoter + ATG

SEQ ID NO: 14697 - DNA, 3000 bp, Unknown; identical to SEQ ID NO: 14680
  misc_feature (1)..( 3000): cDNA_ID_2730534_gDNA_ID_2684212_Annot_ID_191549 3000 nt of promoter + ATG

SEQ ID NO: 14698 - DNA, 3000 bp, Unknown; identical to SEQ ID NO: 14690
  misc_feature (1)..( 3000): cDNA_ID_2730513_gDNA_ID_2684212_Annot_ID_137364 3000 nt of promoter + ATG

SEQ ID NO: 14699 - DNA, 3000 bp, Unknown; identical to SEQ ID NO: 14689
  misc_feature (1)..( 3000): cDNA_ID_2730509_gDNA_ID_2684212_Annot_ID_137365 3000 nt of promoter + ATG

SEQ ID NO: 14700 - DNA, 3000 bp, Unknown; identical to SEQ ID NO: 14688
  misc_feature (1)..( 3000): cDNA_ID_1032199_gDNA_ID_2684212_Annot_ID_137367 3000 nt of promoter + ATG

SEQ ID NO: 14701 - DNA, 3000 bp, Unknown
  misc_feature (1)..( 3000): cDNA_ID_2730501_gDNA_ID_2684212_Annot_ID_137368 3000 nt of promoter + ATG
caacagtcaacagttagttagaagaatcaggacagcctctaattacagaacaagctaaggttagaaatagaaaggagaagactcacttgaaatacttatcaaaggtcaaacgatctttgccaagtcctgcaatgtcgaaaccataatcccctggaagttctcctgtaaggtatggaggataatcatatgggattggaccaaaccaacggggacgttcttttccataccacttgctgcacacttacaggaacaaaccaaggaaatgtttgatccatatagttacagtaacatagaacttttgtatgtatctatcaaataatcgttgccgcagaaaactgaatttatctaccattttatcaaacattgccttcacaaaaaaacactgataaactcaatcttacctgtcgtttctagcttcctgagctttagacttgaatcttgaagaattctctacggcttccttctttttctcttctaatctccgccgtagagaaactcctattgagctatttgcaattgctttaaccgcagtgaatggaatcgccgagaaaaccaacactccggcgagctaaaaacaacagcaaagtttcaaaaagaacgaggagaaaacaaaatgatgatttctagtaagaagataaattcaacaaaaacctcttgccacgaagctctgcaaatcgaacgggactttgtcacggcaattctattacgaggcttggacacgagaatcctcggaagagaatgaattgacgaataacttgaggaaagtgatgaaagcttctcctgaaacagtgccatggaatttggctcaccgtcaaatcttgatttggctgtctgtttcactcgagaagaagaaagcagaggtgaagttagaagagcaagaagcggtctctaattttccacaaaaattaaaaataaccaaattttcaaagttatggatctggccacgtgtaatgatattcgccagttctttaaaaagcccggactcggcggatccagattataggcccaattaagtaacaggccacatcgttagatccataaacaatcaaaacaaccgttttgttccaaagcaaaagatccaaaatgcagagtttcattccaaatcaatcggtgtaagtgaacacgatgaacaacggtttcaatggacgattgagatttattaatcagaatcagtctctgttctaagtcctctgttttgagattagctacaatcattaaaaacacgaaaactcaaattttagtcttcgtagattcgacactcgtcggtctctggattctcctggcagaaactctcgagcggatcctgattcagtaacttcagcttgatcctcagatctgctctggcttgactcacttcttcaacttcgtcccacgcaactctacactcctccgacatctcttccgcctcgcaaacctctgtcgcttccttcactttctcctctatcatctccgatagtttctcctccctcatcttcgtccccatatactttgccgtcgccttcgtcaccatcatcaggctgaattgtctcggtactgtttctctgaaacgtaaaatatttgatccagttgagacgggccgtcgctccctttgtgacggaagcaacactctcccatgactcgccgtcgccgagcccgagatcatttctacgaatttcgtttctcttcttcgtctttcagaaaattctttattcaccttttattattaatggtttgggccgtttgactatagttatcgtaattacaaataagccctccaatcatcaatgttcgattgtcatttcacgtttttttttttaatgcggcattatccaaactacactcatcaaacatttgactttagaaaaaaatattattttcttctcataaggtagttgagataagcacaatgcaaagctgaccccttttacctactccttttgttgttctaggtgttcaccaactttgatgtcctttgtatcatcataatcttatgcttttattatatactcctactctcatcgtaatatcaaagcttattgtttttgaggtcttatcacactaggcctatattatgaaaataacaattaccattaatatacctaatcccatcgatactgactgatgaaattcagttggtagatctttaaataatgacaggcctttcctacggtcaacagagtaaataagaagccttattaaaagcccaaatcaggtcaaataataaacaaatccatttttttaaagatccatgtgcataataaatatttattttcgatgggtagtttatcaattatcaggcaataataatacttggggaagagggaatgagagagtcgtatcttttactatatgtttgcctttattcctttgtaattaccatgtaaaagcatatctccctattgaatgctatattccccaatatttccatcttctttttttttctctcgctatttccgtatttacccttcacctatcctttggtgctcattcactctcccttttagcatatcatcatatcctattttttgcttttattttttcttagtttgaaagtttggtcgcacttaggtggggaatttgtcaactcaaactaaaccaaaacctaaccgcatttataaactaaacttaaaaccaaacgtacactcatacagttcgataaatttgcagtctaaaaccttttaaaacccataaaatatgaacaccaaaccgaattagacaatttggtcactaaccaaacattaccaaaccgaaaaaggtaagggtatatatttatatccaatggcattttcgtaaataaccagaataacaagggctgatcgagaaaaagcgtggactgaaagaaaaaaaagaagaagaccaaattttggctgtttggttgatcgtatcgcccaagtcccccgcatactatataaatacttttgacgggccaaaggaaaaaactttctctgaatcttctctgagtctctctgacactctcaccaacctaatttctcacaaaaacctaaaaagttatcgcccatg

SEQ ID NO: 14702 - DNA, 3000 bp, Unknown; identical to SEQ ID NO: 14687
  misc_feature (1)..( 3000): cDNA_ID_2730494_gDNA_ID_2684212_Annot_ID_137370 3000 nt of promoter + ATG

SEQ ID NO: 14703 - DNA, 3000 bp, Unknown
  misc_feature (1)..( 3000): cDNA_ID_2730490_gDNA_ID_2684212_Annot_ID_137371 3000 nt of promoter + ATG
ttctatcgtagtttttttttcggatgtgtatcttagaaagttttgaccatcccaaggaagtagaattaagaatctgatcaaaatattcgtttacttagggatttgtaaacgccttggagatatgttccgtcggtgaattatgaaatatatttgttgtggtgttattttcgaatattttttgggagatattgtaaccgacacctgatttctcccgtgactcgaagaggatactaagaccatcttcattggtagtcttttaggagattttcattactaaaataataaaaataaaaaaaaaaagaagagagagagcgtagaaagtttttcaagtgagaaactatgagatactctctacaagctatctttacatttttctcctttcaattggtttaattttttattaaaataaaaatttaatcatataataaaaatttaataaaatactaatattttttttgtttgagaaactttttgagtttcttcttaatggagatgccctaactcaacaagtgaccaaataagttaatttatttatgtgtatggttaagcactccaacgtcaacttaacatgaaaatattccttagcctaactcaacatatatttcaatttagagactatttggctctctgtaacaaccataatccagataattaatagaatatcttgacatgagatgtgtatctatgcacatgagatatgtatctatgcatgtcgatggaaacaaaaacagtttgtcctcatgcataggttccaagagatgtgtcggccgacaaactaaatacgctcgttagtaaatacataaattatacgatacgaaattattaggggtataatttccaaccataaatgagagtcgttaattgatgtgaaaacaatcttgtaggagtagtaatttagggaacaaaacagaacctccacgttacgtaattagacactaaaataaaactctcccaagaatagcgtaaaagtttttaaaatatatacagaatcgaaagcaatcaaatcatatttttcttatcgttctaaaacaattaatcacgaagagcttcttttcggcattataaaaccgaacatgtacaatttcctcatatccattagttgtttgattggtggtttttttttttttttctcgccaattggtggctttatgatcgctgtataactattgtcaacagagcccattactaacgtaacgtgcatgttcttcggtcaacacttccaatatctcaaatcaaagccataaccgtgattaaataactattttatgagttttttataggtaaaattgagtgatatactatatagtaagaaatttcagaagctcactacattttagtatcttgtttttggtcgtactaattgagaaaaatcgttttattttcataatattttccaattcatcgtgaatgtaagcaaaaaggttgaaagaaacgaataacaattattttaaaagattagaaaaaagtgaaaagagagttttgtagtacaagaaatgaaggaagtacaaacagagaaacgaatgaatgggtgtcagtattctcccaatcaaattgacatctactttccgtaccatacagctgtttccccctcttctcaaacctttttccccacttctatgtacaagtacatacatactattagttagattcacacactaaatctcgtgtattgtacttccttagaaaaaaaagtgcacacagagtaagaagagagggtttaagttttttttatacacatccggaaaataaagaaaggagaaattgaatagctacataaatcaatccgtacaatgcgagagatttcatatagtagttttgtaaaataaaagggtacttatgtctttttgtatcgacaggttttttgtattttatgatgccgacttcctccaaacgtggacgcgctttatggttagtgtgtttaagtaggctaaaaatctctaaagtgaaactcaattgtcaacgattaaagaattaagaagatgtaaaaaaaaaactaattttccaaattaattaataagctcataatatagcgtgattcgcgttaccgaatgtaatttgacttgtggtatactaattgtgactttgtttttatttctttgacattacgtaaaatttgtttctaccaattttgataagtgcacggtcaaatcaaaagaggaaaatgaaaacttggggttgaattctcaacttgaacatatatgatagtcaacacgacaatacgttgtattccttatattgaaatgaagctaattaaggtctatatggaaacaaatatgttatttatttatcaatgacgtatcacattttgacgaataaagagattaatgttatcctttacaaaataatgaaataagaaagaaacagaagtttatgtttgtccaattatcctcaatgtttgttgatatacgaattttgagaattcaaactgaatacaagaaataaaaatgtagtgagataataatacaaatttgcattatttcttccaagattgttttctttaagtaaatgaaaagtatcttggattattacagaaatgaccctaaatctttttgaatttacagtttgtaccaccaccgaataaaataagaaaaagtttcgttaaatgttacgagtgctcgttgaagacgaagtttcgaagacgaccaacaaagagaaagatcaaaatttgagagggaaacaaaaaaagaggaagagagaagaagaagaagaaaacacccttgattaataaagtctcagactttttgattcgattcgaaaaaagtgagtttatgcttgaagctgggaattccaaaactcggaattcgtgtaaaactagttcgatttatcagagttatgctaaggtaacatagtcgattcatttcaaatttacgaactttatgttcatctgatctctctctctttctcttctatttttggtaacgaatctcgaaatttcttgtgttgaattttgtagttagtgaaggtgaatgaaaaagagttgatttttgagagaggagagaa

SEQ ID NO: 14704 - DNA, 3000 bp, Unknown
  misc_feature (1)..( 3000): cDNA_ID_2730478_gDNA_ID_2684212_Annot_ID_137375 3000 nt of promoter + ATG
gagaaagacgggcgggctagttgataaaagctcaataaatatgggctggtttagggttaaacagcgaggcccatttgtacaaaatattgacatcgattatttttgttttgcatttgtggatccccaggctgagattacaactcagaaaattacaaaaaaaaaatagataataataaacaacgattataatgatgattctttcaatttgttatgttagagaatcacaatgcttccacacgtgcattttatatcacaatttagattatgataatttgaacaatctgacaaataaggattatttaaataattgacttgttatgttattacaaaataggtactatgagttagacaaaaaaaaagaaatctggtggaatggcactgaatcttagatagcacgtgtcacgtcgaaatattgcgtgcaagtatacatgcgccgttactaacgctgttatagacttatagtacactgaaactgttcatatagtgctgtaatattttcgtgaacttatgaaataggttcaatttcttttgttaaaatttgggtgtcaaagcgggttaatatattttatgaattttaatagatagtgctaaaaattggggtcttaaaatagtaactataatgtcgtcgtaccattgcggagtttgcaagccgatctgcaaactcttcaaatttaaattatttttcaaattttttttcctgcttagttctttatcaaagtactaggattaatgagatcgattattaatacttattagtacagaagtataaactagtactgagtgattaaggagatcgagtgggaattggcggtttatattaataaactagtactgagtgattaaggagatcgagtatacaaattactagtgagctatttttaagatgctagtataactttatagtatatcataactgttttttcatacgaacatcggtttaaatgaagtaagttactcaaggctggcctttcatgtgtttaatagtactaaataagatagtaccagtggccggtaaaattagctagctgttatcaattgttatataatatacatgttcatttattttatgtattattagactatgagatgatatgagtacagaaaaaaaatccaataaatatgtatataaatatctagaaatgggtagataaactatttaaatgagtcactcaacgtgcctgagtttccttttcgatttaattgtcctcattgtgaattggcataaaagtcggtgcgaaggaaagccccaaattatttaacttgaaaacgaaagtttggtccacctctctatattcatttttctgaaatgaaattaatactcaaatcaattttgtcataaaaattgtccaattattaaagtattcagtcgtgtttctatatatatcactgtctttagtcagctagtctaatattgcatatttgcattcacctctatatatgtacacacacatctacgtatggagaaaacattgtacattcactacattcgtgatctcatttatctttagatggctaaaaaaaactcagatagaatatcacacttacccaaaatatactattctttcgtacgaaatcttattactagcacatgacgtgtgtgagaaaaagtacactcattggacattcaaaggtgttaatgttaaaattaacaattgggttttctaactatgagccactaaatcatcttctaaagtcaattataaattatacgtgacgttacttaatattggaaataaatattggagaacaattataagtttgaaatagaaatcataattaactattttactactccaaccatttataactacgaagctaccttaaaaaagagaatgacatgggtatgactttgcccgttttttcttaatgaatttgttactctaaagtcataagtctctaatccgtattaatagcagtaattaatggatacaaaaaaaaatcaaaaagaaagaaaaatagacagggtggcatcataatttatggggacagctgtcgaggtgatgcatttatgaccactaacatgcaatggcacggatgcaaattttaattgttagattcttctacaaaatttacttaattcaatacttctgttttcttcttcttcttcttcgtaatttaatagattctgcatattgtttaatatttattttacatgccagtgatgggttgtcattattctgattcatttttctataaaatcattataaaagtattttcaacttcttgacaaaaataggtgtttaattattactacaaagttcaggtcgattgttatttcgggctacataaaaaaggtttgatttctcgtatgggagtgattacaacatatttattggtattttatgaccccatgtcaactcttatgtagtaatttgtccccacttattgaattgttattagctcaaaggcattaattgcacggtttctaacttttcttctatagtagtatgtttttcacatttgaaaaacactaatcattttcattttgcatggaaataagaccaaatattttcattaatccactaaattgcatttgcaacacaagcccaaatcattatatatataaatataatatattattgtgatgagtaaaatatagacatgcaaagtgactatgaactactgtaattatacactgcaagaaaaacattgccataaatatgaaaacagaagacattgacagatagtaataaaaataatactatatctctaaatataattcagatgttaacgaaagtcttgtggagtaaaaactgggtttcacacacttcacttgcctctcaatacccgggaaaacaaaatgtcggtttcacttgctacttttcccggaaagttacaaagtcattcccttttcaggttgtgaagtcacattaacataagagaagaagcaaaaaggcttggagctttattttttgcttttttttttctttcttctagaaaacatgatcttgagtttccgagtaagattcttttaaaaagagtttgcaaagaacgagaaaa

SEQ ID NO: 14705 - DNA, 3000 bp, Unknown
  misc_feature (1)..( 3000): cDNA_ID_2730660_gDNA_ID_2684216_Annot_ID_137395 3000 nt of promoter + ATG
taggcattttaccaaattccttttttttttttcgtttggaccacagagaatcagtctagtagtccattatttacaaacaatcgtgggagctagggactcatctgaggtgaaaacgtttcactactaatctaatgaaactattgtcctttttcgaattgttgtcctccgtatgtaatatattttcttttatctttatggaatgttgctataatagttattattaagtgcttaacggaaaacatagagtgaaaaaaaaaatagtaagttaagagatatagatagcagtaaaagaagaatgtgtatgtataaaacagagcaatactgaatacaaaaatagaattagggagttctagaagagaaaggcccaccgtgcatggatggaccatggccatgccaacaaattttattaaaaaacaaaattcttccttaataagaaagttattcaaggtctctttgtggaatggggacccttaatcaaaatgttaaatctcctaaataaataaattaacttacatttcatagtaattatgttttaaaacaaatggcttagcagtcttcttacatgcatcgtttctgaaaggtattattttcttaccaccattttttattaaaaatattttatgaaatataagcttgggatctaaattctgatgcatctaaataatcatctatatgaaaattgcatcgtgccggagaataaaatttggtatatggaactatttataatgaacttttgggttatggtgattagttcatgaacccaacaatgcctaatttaattagcttttctctaaccgccgccaaatataaagatacttctaaataattaagcaaacaataaattaaccacaaccacacattgtcttaattaacagcacgaaaatgattagaaacttccactcatgtgtttatgactgtgtttatatttgtacaaattagtaaaatacaatgaatatgagctaatgcagcttaatttaagaaatttaaaataataaataccaaagtggttgtccccgtcggaacaagaaatctaaagggtttctaatttcgtgccctttgtggactctcaagtaacgaaagtcaagaatgttgacccatctggtctgtgtttagttatgaaatcatattcaaataccaattagacttaatttatttagacaagttaagaaaaaaagcaggacaactaaccgtcgtgaatagtagtattaattaattcgaaattaaactacagatataaataaagagtgaagccgtacgtataatacgcccaagtgcatgcaatgaaaagaaacaacgaaaaagaaaagtgatacacgtaggatttgcgtacgaattttatcattacaaaactaaagagagtttatagctactagtttcgactgaaataccacaaactgttagatagatttaggtgcaatcgtttttgctcctgtgggcgtttcgctctgtttctttgtattttcctattaaagtgcccaaaacaagaattgatacgtcctctaatttggtaaaccaatggatctctgtgctatggctatagctaatgcatgtgatcgttagaccgacaaacgatatttataactcaattcttcataggcccatagtcatatccttagccacagtattcgaactacagaaatttctctaccccatctctattgaaataacacatatatacagataacacgtttataactgcataagtgtatttcaaatgcagatactcttttaagaggacaaatatataaagaatatatattggagtgggcaccgagcggttaaaatctaaaatataagtttctgaatatgcctgctatgtatttcggtgaaattttaccttttcttgattcctaatcttacgaataggaaccgaatatatatcattttccgagatcatgtagagatatgatttttgatcaaattccttaatatattaatacgttgatgtgtatcctaagaatgtcgaataatcctcaaatctcaaggttaagtgattagaaaatattaaaaacattccacgccgtaacacttggtaaattcaataaatatacaaatcatattaagacgaccaatccaacagttttttttttttttttttttttttttttgttgttgttgtaaaactaccattccaacaaattcattttaacataagcctgcctaacctttgagctttgatctactcccttttttttggtgtctaacctttgatacagccgtaacattaattagctgactatttaagctaaatcaatacactgtctatttttagtttaaaacgacacttaaataacactaatttaaaagcaaataaccattcttaacatagcttggatgattaaaaaaacaatctgattcttaaataaaaaggatcttatttcgtgtgattaccaaaaaacaaagtcttctttcttgtgccatcaaaagctacgctcgtatctcatgctacttaattaaaaatatagaccaattatgaaaagattaaacgcattattataaaatcagatagtgcggttcataatctttcaacatggatgaaattaattttactttttccgctaaggttcgagtttaacacatgtctgtctactccaacgaactttttttttttttttttttttctgtatatatggttttaaccgattgactccttataacatttttttttccgatgttctaaatttccattattgtactctatacatttcatttacattgagacatcagacacgtagaaaaaacatgcttaaaaacctaaataactaattttccaaggatccaatggagagtgaaaataaaaagagagaaagagaggcataatgtggccaaaaaggtacagagggagccaccaatgatagatgaagttttttcctatttcttttgtcttctcttccttcttcttataaattcctctactcctccttcaccatttcctcctcctcaccttctctctctcaacatctctctctttctctgtcttctctctgtctcaacgagaat

SEQ ID NO: 14706 - DNA, 3000 bp, Unknown
  misc_feature (1)..( 3000): cDNA_ID_2730608_gDNA_ID_2684216_Annot_ID_191691 3000 nt of promoter + ATG
gatattttcattcattaatttaaattgaaataatttaaaaaactatattaaagttataaaataggatgcagatgaaattaatcttattactattatgcttctatagaaacattaaagtagaagaagatctgcacaagttggtggagaagtccatatatacttggacgatagtatgggccttttaaaagcccaacagttagaacccaaaaaataagagattgatataaccgtaaataaacaatacgacgatatttaagtctccctcttggctaaaatatgttgacttggtggtaaatgatccacatacgcgtaatatattctggttatgaaaatctttagtgaaccggattaaacccggaattaagttgtgtgtttaaaacgtttaattatctataaaatagaaaagggacaccaatactcacccagcaaagtggtagtgactcagcatgatgctggagtcgcaccagggttcgagtaacgaaattggtaccccgagtgagaaggaaaaattgtttcctctcgacttccatcgagtgatgatggttggcttccactgagtgtcaatggaagatgaatgacaaaggagtttattgtgactccgtcatgaccagactgcagtctggtgtccgggtcttccctgaagtgaagattcggggtcgggaatgtttatcacagagaatcatgcctctggtgatagccgaaatgaggtaatccaaattacctctttttttataaaagacagagaatcaacttctgttactacaaacgaggaacagagcatcaccttaattatctgcaaattaaaagacattgacttgttctttgaatagtgtgtttggctgattcattcaaacttcccatcatactactactaaaccgactctgaccagtgcaaaaaataccagctttccaccaaaattcactatttcgtttcatattattctgatttctgaatatatgcaactataatatattatgaggttttttcattcatttatctttatgtagaattatcttcttcttcttttttttgactctatgtagaattatcttaatgtagcttttatctataagtgttgaaattttattctgttcaaaataatcgttgaggcaaatcgtccgtactatatttagattggacccattctcttataatatttgtttagtttattgctcaaatctaataagattttattgtggagataacataacaaaatgttagtagattttctttagtatgtttaatgtaacttgtaacgacataaaaaaaaaaaaaaaattgtaacgacacgtatatataaaatgaaggacaaaatggttttaacttcatatcgcttacgtccaccttttgcatattttcttataaccgtttggatttgttttgaaattaattattcttagagattgtgtgattaacgataagattttgtgccaagtttcatgatttttttgtaagaaaatgaaaaggaatctagaaacaaaaaggaatgtcattttcccagaaaaaagcactaacaatttataaattaaatatattttctatctgatgtttgattcttttgtcctcgtacaagaatggagtatatattttaattggaacctgattttctttatcattttcaataatttaaaaatcgaacactatttaaaaacacagtatgattgtattaatgtttactgcataaccatacaatataatcttcaaaagtaattatattcttgcaataatgttgtcaggtatgagttgttttattttattctaaatgatttgagttgtatgttttggagcatgttacacgacataagggaccattacatggatatagagtgctaccaatgaaatatagccacgtcatcactaacagctgcgattatgatggtgggaccatagatatctgactttgacggctaagattgagtggagaaattagagtccatgtgagattgggtggactacaaagcaggagagagtttgatggacgtcgttacttgcagctaccggacgcaacaaaccggacttgatgcttaccatctcttgtttctcttactctcttcaattgttttgtcttttctttacaactatttcgagaagaaaaaagttctcacatttcattattgctacataatttattattttctacaaattatgaggataagtataaatttcatttatcaaaaacaaaaaagtatgaatttaaaaaatctaacagtataagaatttatcagttatagtttggattttcgtacctaagagttttacacctaaaatccatcagaatttatttcaaatccttcaaacttcagcacattaatatatatcactactttaaattttgttataaaatatcactagaaaaatatataatctgatgtcaatatatataatacaaaaatatggtatatttaactgctttttaatgtatttaattaattttgttgccaccaactaatcatgtttcttcaatgcattgcgattattattcaaaaaacattataatagggaagaaatatataaataagaaactccgtgtattggacgcggatacatagatagaaatacattaaaattttaggaatgaataatatattattataattatggttgaaaattgaaagtgaagaataaaagaaataaatacgtacacacatctttttctctgtctttaagagttaacgaaaacaccattagatttaagtcacatgtggctcttttgcatgttctgtcataaacacgtccatttcattcatcctcttcttcttcttctccttctatcctctgttttttgccctctctctttgtttagtggctgtggtcgtttgtatttggtgaaacataatttaaaaacaagtgcggctatctttaactctggccgacacatcggcggattcgactgtggtcggatcaagaagtgcttcctttttttccggcgtcgtttcttcttttatattcatcgatttggtgctctcgcaacttccaatagattacggctaatttctaaa

SEQ ID NO: 14707 - DNA, 3000 bp, Unknown
  misc_feature (1)..( 3000): cDNA_ID_3018678_gDNA_ID_2684216_Annot_ID_191688 3000 nt of promoter + ATG
atattatatatatatatatttgtcaccatatatattacatttctatcaacatcgagcatcccttaactcacataataaacatagaccgagagaacttagagatcaaagttatggagaatgagagagaaaagctgatttacttggctaagctcggttgccaagctggaagatatgatggtatcacatattctcacatatttgcccttttcatagagatagttgatttgatttaaactaggaggttaattatcatattggtttatgtttttcatgttgtcaccgatccagtttgtgtgttttaaacaaacttatggttactcgaatcatatgataacagaagatgtgttatgtctctcttcaaatatcaaatcatttcatttgatatctattatcagggtcttagaaatgcccaaaattactcttgtatacgaagaaatcagtgtagcaactttatccatctttctataaccttataagaagtaactaagcggttgttgtggcagatgtgatgaaatcgatgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgtaagtcatattccgttatcataatcatgatcaactctttttttttttttttttttaattagcattttgttatattgtttcttggtatgtgtaggaaaggagattattttcgatatatggcagagtttggttctgatgctgaacgtaaagaaaatgcagataattctctagatgcatataaggtcttctttcaatcatgtttaccctcaactttaatattttattttcccctattttcttcgaaatattagtttggaaaaagcatggaaaaacatgaaaaaggcatatattttgtaggttgcaatggaaatggcagagaatagtttagcacccaccaatatggttagacttggattggctttaaatttctcgatattcaattatgagatccataaatctattgaaaggtaatatcacatttgcttataaataaaataagtgcggcgtttcaaaatctatcaaaaactttgtatatataataactaatttatattttcattgccaattaattttaatgaacagttttttacagttttttgaatatcttagtttcttacagttaactaatagtaattttatatgtgaatttatacagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttagaaaatgtaatttgaggcgatatgatgaaggtaaatcattgatcgtgtttatcaggtttaatagtttacataactcaattagtcttcttgttaactcctagtttacaataatactgtgtatttgttttttgtcgtctactgtgtattttaactctcggctttgtgctttggttcatctatcatttcagttttatatacaactgttccacaccattttgatcatcatgcactaattagttatcgaactttgtaaaactatagcatcatttaatccaaaatatttattacgagtatataagtacatacatgaagccacgccagtaataacctgatacatgcaaagtacatcttaaatattgtagtaataagtaagctaccaacatatctaccactttgtcttcaattgattgtcctcgtaacgtgtcctaaactctaattaaaattaggttagccataagctgaagaaatgaacgtttttttatttcaaataattctgtgaaaaatgatttttttttcttcttcttctagagtattggcggattcaagactctccaaactttgacaaagaaaagacgcttataaccaaaattgacaaagctttctaagtcgtctatataatttttggtcttcaacaaaatatctgtgtctcagtctaatatacttttctttttaagaaaaacttgaatattaagttagatagtcgaatttaatttcccaacctacgcactgtcgcaaccttatgttcacattaaagactaaccacatgcctctcgatctcagatacaaagatttttgtaacattcgtgccatctactttttatcacaaataataacaattgtatgtgctgccaaataaaaaagcctatactttaggtcacataacacacattttgcacacaacttcattcaatttcgttttttctcaatttcgaaaaattaaataatccagactctttgcccaaaaaaataaaataatccagactcttgtagaaaaccttttttctcttactagaataatgtgtacacatgcaatgcaatcttttgacttatagatagagtttacatgagaccaaaatacaaatagatacattaatataattatataacaaattataagaaaagaaaaaaaaaacaatttacgaggaacgataaaaacgttttattttctcttaacacaaataagaaattcgtaaattattaattattttacatgtgatgcgactccagtcactccaccgttataacttataaccacatttcaatttaagtctccttcaaatttattgttaattaataataaaaatgtgctcattcgtaataaatcccccaaccgataccagagaaccaaacacaacacaacacaatatctttcaactcaaaatctttttcatttctctgtatcctcctcatatttttattcttttgtaatg

SEQ ID NO: 14708 - DNA, 3000 bp, Unknown
  misc_feature (1)..( 3000): cDNA_ID_2730646_gDNA_ID_2684216_Annot_ID_191678 3000 nt of promoter + ATG
agtccacacgccatatatccaatcatattgtttgccatcttttacattatgcgtggtaatttagtgttcaaatccatgctatgaagataaatcgatatctattgtttttaatcgctaaaacaaaactagttgataatctacagacaacttttttggcaactgattttgtttacgaaacttaaattaagccaattgaaaagtttttcgcgggctgatttttttctccaagtttacaaattttaaaagtggatcaaatgatatgcttatataaataattatataaatgatatgagtcatataaataattattagttatcccttatttttaattacccgtctaatatacatgtttacattcgtattatgaattatacatatgtacaagtatgatgacttcaagtatataatataccgcaatcattttatcacctatttcctctttagtttcatcttgtctttttagaaactatgataattaacggggaaaaagaagtcatagatgtattgcttatgtcaaatttgtaatcatttagttgcacaagatgtaaaaaaaaaaaaaaaaaaaaaaattcgtgtggttgcatataaaagaatttatgcactttgagtatagtagaggtttatcgaatgactttccttgtatatatatatttggttgaagcactttattaaatatattcctttgtgtgtgtgtgtatatatcgatcctctttaatgcatcatactcaaaaatatgaatcagtctgtaacatatatgctttgagttaaaattagccatgcctaagaaattagtacataaattgttttttgtgtgttaaataaatcacaatatatatgcatgtcttctaccttaatgctactaaaacaattgctatgagcctatatactagaaaaaattaccaccgttttacttatttctgaaactagcaatcattttttataatgggttacgttatgtttttaattcataaccgaattttaaatcagtggtttttatgtggaaaaatgctttatttgttagactagagtcgtactgtatatggtccatatacagccccacattatgatgaatagtatattgaaattatgtttgcgttcttggaggaaagaaatcttgaaacaagtatataaatcattatttcgaatagaaatcgttggtttttgactacttttggtatttttgttgaatatttttggaaaaagagagatttaagagaatctggctagttttggattcattaatatacctttggccttcttcgtcgtcttctttaattttaagctagcacgagtttgccaagttgtcggcaggaagatataagcccattcattacatgtacactttctaagaatgaaaaaaaaaaactatgcttatcataccaatttgctgaaatatatcatgaactagatcataatctgtaaaaactgtcatatattcagataatctaagccaatttctaagcagaagtactatgtagatgaagctttaatttgtttgctctagcttctctttagtccgattttttagtgaaatctataaaaaggtttggactttggaggcatacgtgtgtaggtgagaggacaaaaaatgaagataaagcggtcaaagctaaatcaaacatacaacaacagacaaagagatatgaaaagctgccgtaagagacagaaggtccccaacaaagccggcaccgacgaactcacacgaacgaacaagacgatacgagagtcacgagaccgtatcactgtcctcttccacacactgtatgaacataataaaatcagtttatctcaactaagaaaaatgaatcatcacttatctcacgtacaagtcttagttaaaaaaaaaaagttctcgttaatattattttaatggtttaagcgtaatttcagcagaatctattcacgataataatttggtggtgattatcaatatactaatatggatatgacccactttattattgcggatgctttgggcgtttaagaggatagacttaattattccattacttacttttaataaagccactattaagcattgacccgttggttcttaacttttttgttagtgtaccacaggctaatgccattatcataagttggtcgaaatagacaaattttacttccatccatatcacaaattcatgacttttacgttttatcagtcaaaatcacatcataaaacaccaaaatatcgttgatgtttttattacttaacatagcatattagctaatcattgtaggatattagctttaatatccacatcaataagagtcattggatatatttttaatacaattttgatgttgtttacctaaattgctgttgctactattagttggaattaaaaaagtttcaaattagcaatatgagaaagatttattcaaaagaaaacaaccacaaagttatataattatagtgcacagcaactactaacagaattgcttactttaatatgaatcaattgctagtagtgctcgtaactcataattgtctaactaaaggttttgagtttttgtgctctatgatagtcctgtatgttaaaaagtttcgctatctttgtattaattatttccgtaaatgtcgataaataatgataacaacaacaatagtattaatctttcactaggctccaaaaatatttgaaaaatatttcgtctttatcaattaagacaataaacaatcaacgatagggtcagcaaataacaggaatgttttaacgaatcgaccccattaaatcaaattaagatctaatttttggattttagaaaacaaaagtaagatttttgtgttatagcaaaaggcagacaaatcaaaaagttggtttcttggaaagtactccactgtaactcttttcttagacttatataaataatacataaacaactttcatcttcaactaagaaaaaactctctttctcctctgtttcatcaaactcttcatcagtgcttcttattttcttcaaagcttcaaatttctttttttccttcttgcaatg

SEQ ID NO: 14709 - DNA, 3000 bp, Unknown; identical to SEQ ID NO: 14705
  misc_feature (1)..( 3000): cDNA_ID_2730660_gDNA_ID_2684216_Annot_ID_191673 3000 nt of promoter + ATG

SEQ ID NO: 14710 - DNA, 3000 bp, Unknown; identical to SEQ ID NO: 14708
  misc_feature (1)..( 3000): cDNA_ID_2730646_gDNA_ID_2684216_Annot_ID_137399 3000 nt of promoter + ATG

SEQ ID NO: 14711 - DNA, 3000 bp, Unknown; identical to SEQ ID NO: 14706
  misc_feature (1)..( 3000): cDNA_ID_2730608_gDNA_ID_2684216_Annot_ID_137410 3000 nt of promoter + ATG

SEQ ID NO: 14712 - DNA, 1696 bp, Unknown
  misc_feature (1)..( 1696): cDNA_ID_3018798_gDNA_ID_2684219_Annot_ID_191746 3000 nt of promoter + ATG
gaattccgttaaaattattgaccacgtgtatggtcataaacaaattatgaattcatgattcgatcaatattacgacctactacatatgatatgatgttgtaattaaccacattctcttgctttttatctcattaaaatttatttattttaattcattattttataccaccactattttccacgttctatggatgatcatagtggagccacgcatgaacatggcaaaaatagaaatatgcacatggcaatatatatacactatctacgtatgtgtcaatcagggcaatccaactttgttgtggtataaactctaagctcgaacagatccgaagatattctttcgttctctgacctgattaatgatcacgaagctaaaattgattatcttttatttttgtttataaattattagttatccttaatctgaaatcattttaacaaaaattttactgaatttaatcataaaaataggcttatgtataagctaacacatattttccaatgtccattattatttaatggtggaattcgatgtttaacgatatgattcaagttataaaaaaaccgaattaagtatctatttgtttctataataaaattctgaaatccaacatctctaaactatatactgcattatataataaacagatcatatttatttgaatagagtagctaagattaggcatactagttcaaatgtttgatggacatccgatccagttagtccgggccttcaatatttgggctcaaatgggccgaaactatattgggtcgtatatgaaaagttgaaatatctccaaactgaattttggatgggaaaaagcgggaagtcgagagagtaccttatttctaattttctataacgagggtagggcccaccaagaccatatagcgtaaagcaaaatcaaaatcaaacaattaggaaaaaaacataattttctcttttttcgaaattcgaaccgtaattagccttttgtttttcttggaatctaaaagaaataaaagagaggaaaaaaaggaggaacagtgagcaaaatcgtgcgactgggaaaaatttcgaatttttttctcttccggcgagggattcaaacttccgcctccaatttctcgccgtgaatctgagttttttttttccgtagcatttcaataggagcagtcttcattctccgtcgtctacactatagagaggtttatctacaagcttcttcttctccttatggcgttttaggttcgtatcgttttttttttttttggccttcgtctctgtgttacaaaagcgttgttggcttcttagggtttttgactggatctgcgtgattttggtggaatatagagctgattttatgggttgatttggtcgacattgtggatatttgctaagcgagatgttgaaatgtttgaacaaacttcatcattgtttacaatttaaagcaaattttggctgtttatctctttaattggggaactagtcttatctgaaattgaaagcatttgataggtattttaccatatgaggatttggtgtagaatgatgaagtaaggtctttcatgatttaaccatggattaggaattaggaagtatatgtgaaaccaattaacattgatgctaactttgttgttggctaattggttcatttgctttagggtcttctcgctactataattctgggagtcgcgtaatctctgagttgaaatg

SEQ ID NO: 14713 - DNA, 3000 bp, Unknown
  misc_feature (1)..( 3000): cDNA_ID_3018751_gDNA_ID_2684219_Annot_ID_191760 3000 nt of promoter + ATG
gaataaagattcaatttttatacatgccaagataaaaaaaacctagaaattataattcaagaacagtgagtgaaattgcaattctagggtttttagtaaatttaccttgaaattctgaaagagaagaaacagaacagagctcgtgaaactagttaaacggagaagaggaagtgtcaagaatgttttgttttgacgaattttgtttgtgaagatttggaaaaaacaataaagattttaattcttttataaaggctctgttactgaatttccaaaattgggtttggttagtaacggaaattacgggacggagacaagtagagattttccgttcgtgtctaatgagaaaggactttgtgccgtttttatgaatatacactgcatgacgtttgttatgatcgaagaggtactacgtgtagttttctatttaaccgttttgggctttgatttctaaggctttttgattggtaaggctaaggcccataataaacctgcccaatggactcactaataagctaatattatagggacaatttgtaattaggattttttaaaataaaatatatatattttaaatctagatagactaaactgctttaatttttatggtaaagggattaaatttggaatttaggatttacatttagacttccttaattcagagaacttttaaatattttataatatgatctaacattgagactatttccataattttcctaatattcattccatagaaatttggatttgaggttaggtctatagaatatagtgatactagattttaacccgcggtataccgcgggacgatttgtttttaaaagtaatatatattaaaacttgcaaattttatttttataaaatatttatattttacagtttataattgttattaagtaacgctataccacgaattcatgagacaattgttaaacaactgaagttttgacccctattaaaacagcatattaataatattttaaaattttataaatattgattcaaatacatccaccatataacccaattccaaaataaaacacgttctgtaatttttttacccggcccatgatttttttttaaagtagtaatttttaaaattttagaattattttttatatataaaagttttgcaaattgtatcattctctaatacatttatattttatagtttaaattaaattaattaaaatttagatatcaaatcttataagttgattttgattggctattatttttggaaattaataatgtatttcgttttttaattaatttaattaattaaattagtatttgactttttaatccttaaagagataaattaatttactttttaaaatattatttctaatggcatacctatgtaattacttacaaaaattaaggttacatttaaaatgtacttcccaaataatatagtaggatttcttggttgtgatctctctagctcattagatgtcgtttttttgcgacaataagaaattttaacttatcattggaaagtaaacatctctatatcttcggaagttgtcgaaatgatttgttatggatgatggatcaatactaatcttctttaagactgtatcgttccaaataaaatgagttgactataaatgtctttcctagggacatctcattcaatgtttgtcttagctctctcaatcgacaagactgtagaaagtaaatttcaactatcgtttactagttccgcacatgtaattttcaagttaataggcaagagtcaactttgcatcatttactatacaatctttgttgacacatataacgctttgtctctaattaatccgttcttctaaaccaatattgtaatcgatttttgagctaaaccggaatgtaatcttgaaccaagtcataagaaacaaaataaattgggttctcgagataagataataagggaaattttctcgatatcattcacaggtacgagggggtggtcggtgaaaaggcgtttctactgttggaaaaaaacaaaaataaaaatgtaagagcgttatgtcggtggcaaattttgattgaaactaattttccttctccacgttcacattatcctattttcattcacattatcatatttttcatacttcatagcgattagaaaagaacaattgttacctaaatagctatatgcgacaaaggacatggatgtgtatatatagtaataactagttatatgaaatatctatatactatttattgacaggccagctatagatcgatttgatggaattgtaatatggtaatagtgtgtaaactactcctatgcgacgcgtctaaattttatcattgatccaaataattcttatttcaagttgacaaaacttttaaactcattgaaccaaattttcttgaatatgttgactaataataaacaaccaaatgttctaaaaaaaaaacactgtgaatagaagaaaaatggttattgaaaatggcaaatgggatggtcattggtgatagcaaaaatgagttgtttcttagttatttatttgacccactggtgagttgacttggtgaggcctgctgctttgctgtttctctctttttttataaaacaaaaaaagtttcaatttttaatttttacaactttctggcaaagttctctgcttttgtctcccccaaacaaaaggataaagaaagttgcagaaaacaatctctctgttctttgagctttccctttgagctctcacacgagcggcttcttttgtcatctcaccttttccttcattctttcttccttcaaattctggtttttttcacagatcgttttctcagattttgactctttttggtgttgttgttgttcttctccttcgtgaagtggaagaagaatataacaaaactgggttttttatatctggaattctgaagaaattcttcacggatttgatctgtttaaactataaaagtcttgatttttataaatcagctaaaaataagacacggtttagggtttatggtttgactagaaacaacaatactgaaatg

SEQ ID NO: 14714 - DNA, 3000 bp, Unknown
  misc_feature (1)..( 3000): cDNA_ID_3018764_gDNA_ID_2684219_Annot_ID_191757 3000 nt of promoter + ATG
caagaaaatgtccaatccattttcaaacagaaatcctctgttaccagaatcaggccaagaaatgttctcaagaaacaagtcttcacctgttcatctacatgctcatctaaggatggaatatgaacttgggatgcctgttttcatattctcgctagacctcccggatgatgtatatatggccagtacaagaatggatgataaggaatctcggtttgtctattcgtttagctacattggaggtagaagcaataagaatgtttcaggtaaagaatcttcactaataggacagatgcaagtttcaactcaaatctgcttagagcaagaaccatatgaagaagatcttgtggcatcaactgtctctgaattcgttcttttcgacattgcacgcgcaaggagaagtggcttcaagcatgaaaacctgtcaagacaaaacagtttcagacgaggattgatattttcagaaacagagaactctgtatctgatctactacaagaaaagctgccaaggcagaacagtttcaatcgaggattgactcgtagtctatcaaaacattcagagaacactgcatctggtccttggcctgtctcagatttacatccaggacttgagattgcagcaattgttattcaagactcttcttcaaacagcaaactctcgagtcgtgagatgaaagtcatagttccaacaggaaaccacggtttgcctgataccgaaaactcgtgtcctacgccgatactgcaaagatggagatcaggtggaggttgtgactgtagcggatgggacatgggatgtcacctttttgtccttgaatctccagaactcatcaacaatcatcatggtttggaacttttcatagaggtaagaatttgttcattgtgataccaaaatgtgttttaacttgtctcccttaatcttgaaatataaaaattctatgttgcagagtgggaaagagatcacaccagcaatgacaatgacatgtatcagagaaggacattatgaggtaaaatttcacgcgaagctctcagcattacaagcattctcaatctgtgtagccgagctgcaaagaactgaagtctcaagaggagaaagaaacatatctttgtctagatgcagttcactcagagagcttattgaaatggaaactccgatgaatacaagagaagtccttccttctttcatgcctaatgtcacattctctccaatctcaagggtttaaaaacacatcacaaagtaatcaatctctagtccctcttatgtgcatatatagtcactatacataccatacaaataaatatcagccagaatctagctaccgggatattatatattagtgtttagaactttagcatcataaatgtttgttcttcttcctcatgactcaaagaacccgtttctttcaatattatctatctttcttgttcttggtttcattgtcatattcaacgcaactgagtttgagttactcggtttagtttgtaatgactgtgcttcttgtaaatgcagttacaaaattaagtagacaaaaaaaaaaaaaaaaaaaagtagatgaccaaaggaaacatagttttatttatttttgtgttggaaattccaacataaaagatgttgaatcagaaaatgtgttggggtgtttctagcaacaatgaggatttccgggtacgcattgacaagtatgatagacacagttgtggattggacctttgcaaaacttggcacaatctgcattggtattgcatgttataggcttcaatatatcgtttgtgctttcttgtatccttgcactcatcaccacacctatatacatatacatgtacaccaaactcattattttcacaacattaattagaaatgaatctacaaatatatgaggaagagatgactaaccagaggtaaagagaagagctaagaagaagatggtgaatgtgaaggagcttttcatgtttctttctactaaaagtctaaaccgtgtgtttgagaagagacaaagacttgtgaaattttgtgtgattttttatcccattgaatatatacaaatattttagggagatagtttgattagaaggaaattaacgttagctattttagtacctaagcgttttgaatttgactaaacaaatatatttttctatatagtctctgtttgtttgaaaagaaacaatgacttgtaagattttgtgtgatgtgttattccattgatatgcaaatattttagggagataatttgattaaaaagaaatttactttagctattttggtaactaagccaatttaatttgactaaacaatatggtttatgaaaaaaatcagtttttctatataaaatattttaaattttcaaaacatggccaaaatttcaaaaaatcattgtattatccatttttcttcctagcactttttttcttatcaacttgtgcctaattcatgaaattatccatttagttaaacttgacagagatttcatgaatttaaaataaaataatttaatcatagagaaagtgattagagagccttccggcttgaaaacaacgccacaagaataggaagaaaaaaacagaatgaaaaaaacaatcttccgaggaagcgttaaagagacgcaggcaaagtcaaagtcaaatctctcgtttgtttataaaatgaaacctcaaagtgctcttttccttcatcagaagatcaccatttcttttgcctcagtaagctcctctttcactatctccgtcgttgctccgcttcctactggttcaaaggttcgatttgtgattcttgaaacatttctaatactgatctctgtctttgttttgcttgatttgggttagatcatattttccttctgcaattagggctcttgagttgcttcttttgcacgctttctcatactgtttccttatcttctactttgattctctgttttcgtttgtaagtatcgattcaacagctttgtatcgattctctgtttttcttttttcttctttgttaacagtttgaaagacaaaagaagaatg

SEQ ID NO: 14715 - DNA, 3000 bp, Unknown
  misc_feature (1)..( 3000): cDNA_ID_3018719_gDNA_ID_2684219_Annot_ID_191770 3000 nt of promoter + ATG
accttatctctgaatggttcgggaatacggtaattatggctatgcatttctttccctggccaagaacttatacctaaaagtttccaagattaaaacacagtcacacttctcatttattagtcttgactttcatgaaattccaataccaaattcctctcttttttttcaaaatttttttaactcaatctttttaaccaaaatattaaattttatcatttgaaattattaataatatgcaacgaaaatgttttttttttattgtttaatattcaacaaccttttggtaaataagataatttgacaattcaaatttcttttaatgtatacgaattttcaatttgaatcaaaaagaaatatctactaaaaacacaacaaaaaatatcaatatctcacaacatttttgagaattaattaaaaatactttttttaacataaatataaatattttaataatataaaaaatgtactactatatattaccaggaatttgagcgagacgaggttcaacataatgtccattacaaacaacaacagcatcataaatctcatcacgacgaactttcttctctttctccgtcgattcaatcctccacttcccgattccttcctccgccgccggagaaaccttcacaacctccgtctcaaacctaaccatctcctcaatcccaaactccttagcgaaatctttcaaatacgccaaaacttcgccatgactcggaaacctcctccgatctctagacacaccggaacgaaccacgaacgggaaatctctgtatccggtacactctcgtgtaccgttgattcgtagagatctatagacgcttgaatgaacaacggatcgggtcgggtcaacacttaacggatccgattcgacttcatcggtgtaaatccaggttcctcccacttgtttttgtttctcgaaaacgaccactgagtgaccttctcgtcgaagctctcgtgccgctactagtccggcgggtccagcaccgataaccgccacgtggtgtgatctggttggtgataatgcaggtgccatttgtgtgttctttgattagaatctatgaatcacaatcacacacacttgttacaatttatgattacaatgtttttaataatcaatttggtgtgttagaaacttacacgaatctgttattacagacgtagattgccacgttttggttgatagagagaaatgcttttattatataacttgtgtcattgtatttcttctccaccgagacagtgaaacatcaatcaatatgagcaatcatcaaactgtgagatttcttttctctcattttgcccttccactttcttgatgattgtttgttttttttgtggacagaagcaggtattgaagcaattggagccatggtgtgaacttaaagataaagtggttcttgtgacaggtgcttcctctggtatagggagagagatctgtcttgatctatgcaaagctggttgtaagattgtagcagcagctcgtcgtgttgatcgtctcaactctctctgttctgaaatcaacagctttggtgctatcggagtccaagccgtagcacttgagctagacgtttcatcagaagcagacactattcgaaaagcggttaaagaagcttgggaaacctttggaaagatcgatgttttgatcaataatgccggaatcagaggcaatgtcaagtcgagtttggatttgtcagaagaagaatgggacaaagtctttagaaccaacttaaccggatcttggttaatatccaaatacgtctgccttttgatgcgtgacgctgagcgcgggggctcggtgattaacgtctcgtcgatctctgggcttcatcgcggtttgttgcgcggtggactagcgtatgcttgttccaaaggtggtgttgacaccatgacgaggatgatggctattgagttagctgtttataagatcagagtgaactcgatcgcaccggggattttcaggtcagagatcacacaaggtcttttccagaaagagtggctcaagaaggttacggaaaaggttgtaccattaaagatgcaacagactgtggatccggggcttacatctcttgttcgctatctcattcacgattcttctcaatatgtcaccgggaatacatacattgtcgattccggaactacactgcccggtgtgcccattttttcttctctttctccgtagattcaattctccatttcccgcttccttcttccgccgccggagcaaccttcacaaccgccgtatcaaaccgaatcatctcctcgatcgcaaactccttagcgaaatcttgtaaatacgccaaaacttcaccatgactcggaaacctcctcggatctctagattccgatacaccggaacgaaccacgaacgggaagtccctgtatcccatacactcacgggggagattagttcggagagagccataaacgctcgaatgaacaacggatcgggtcgggtcaacgcttaatggatcgggttcgatatgatcggtgtatatccaggttcctccgacttgtttttgtctctcgaagacgaccaccgagtgaccttcccgtcgaagctctcgcgccgctactaatccggcggctccggcgccgataactgccacgtggtgtgatctgattggtgataaggaaggcgccattggtttttttaacgagattcgttaacgatggtgaatatactacggcctttttataaatatgtggcccaaaaactcatgatccacacacaccacgacacaatgttaaaaaaacaaaaacaaattcctgagaaattatctaaacgctgcgttttatctagagggtaagtggaagtcccaaaacagttttatggcccgcttcaaaattcaatcgttagtaaaccggtttggtaatcagttctaaaccagaatcccaccggtttgcatatctctctctccgtgtagggtttgcgatttgcagagaggagtgagagtaagagtgagattgagaatcagctgaagccaaaacgagaagatg

SEQ ID NO: 14716 - DNA, 3000 bp, Unknown
  misc_feature (1)..( 3000): cDNA_ID_3018727_gDNA_ID_2684219_Annot_ID_191768 3000 nt of promoter + ATG
attgtttctctcgttttgaagaagagttttttcttcttttgcttttattcgtatcatattttctaaagaattaaacctgaaatcatttttattttgtgtttccattcatatactataattttaaaaatattctcagttcgtttttaattattagatatttgaggtttttctttgattttgtagaactttttatgcaaagttcaaatctattttgatattttatcaccaattgtatttttaatatctgttcttattggttgagtatttttttagttaagtcataaagaaaattttcctaggaatatatagataacgtttttaaaagttttgttacgaaatttttctaaaaatgaaaatagtgtctcgcatatgaagcttgatgaaggtttaaaccaatattctcgattgtgaatttcagaacacaagattattcaacataatagcaactgctagactagtctagtaacaagtacttgagtatcaaacttgttgttactagacgaattgtcattgccaccagtgccaaactacgtacgtatgctgttgaaacttcattcagagacaagaatgtttgagccgactcaggatcttcaacatcattttatctaaaacgaagattacatttttttaatgtttattaatggaatcgattcatgcccacaaatataatttctaatcgataattaatctttagaatgactcacgcagtcaagtacgtacacattttaataaactgagttatccttgattttttttgaaattaaagattatagagattttgtaattagtgggttacacgtttcatttcaggccacaaactaaacccgttttaaagttttaggaccaccattatacatacatacggttaaagaaaatttagcgcactcataattctataacatttttttcatcttatcattatgtacaaacgtttgttatcttacttaagtataaaataaataagatcatgcacgaccatataattaattagagagtaaaatattagaaaaaggtcacacatatttacacttattcagtttgggaccctaatgtttgacatcattgcaaattgaaacattaaaaaccttataagaaaaccgagacacaaagtttatgcatgttttgtctcttccgacctcatcattcataaataatgatgtaaatagttctatcaactttgtttcgattagaaaattatacaattgctacatcgtaccattttttgtggttcataatgaatatcaactgttcatttggctatttttttatttatgaaataaatgatgagttgcatcgcatcgcatcgaacaagttaaaacaataatataaagaagagtacagtcagctaaataatgaaacaagtgataaatgaaaaaataatattgactttagagttttgagattacgtcttttaactatttgtcggagattaattcaaaggtgattggatgatccaaatgaatccataatgcaaatatggtttccgttccataggccttcgggggattgaagtttgagttttgaaacttcacatcccatgacttggttcatatcatacaacaacagagagtgtgttaaatgatatttgcaagcatcttaggatcaagcctcaaatttccaataaactcaacaatctgctctcttgaaagtgataatgggccttatacaagagatttcgttatattttatgggatctcatctctacttaatggaccttgtatttccagtaacccaacgatttttggttatggtgactaaacttgcacaaatatcaaaaattatatattaaaatctatagtgattcgacaaattacatgcataggactataggagtgttggttagtaatttttaatattgagattaaattggtgagttttgaaatttttatatatacataacaaaatgaaaaaagtatataaatttctttgtcaaaaccccctataatgtactttatttgaaatgaatggtgttaacagcctctcttttttattccctacgaaaagcctcagcgccggtgttcttcttctatgcaccaaacaaagatcagctatctcaactcgtttttttgtgaaatggctagacaagaaaaaatctgcttaacttacactcgtaaaacatgaatttgagtgttttgggaaaaaagctgttctccaacacaatgtgtttaaattgtgtagttactaaccatcaagttaccattttcgtaatataaattcaaattttatcacacgaattaaaaacaagtcactctttccttcttcgtgaatgcgcaaggcaagaccacaagaacaacttataaagattgcttcatattcttcttttagtagtcggtaattagtataagaaattcaatagttgaatacctttcttgagccctcatgagaatgttatagagcaagtatatgatctcactaccgaagatgacaacgggccagcagaaaggtaatgaaggcttcctcctatttgcttgatttgctcgatttgctcatctattttgatataagtttaaaatttgaacaattttatttgatgaagcatagtggattaaaaaaccatagtgagatacttgaaagacaaaaaaacacttccatcgaaatcccttttaacttttatccacatatggccacgctttaaatagtagtactatatgattatcatatgttgaacagaaaaaaattattctatacgtataatctatgtaaataacgtaattgaaacgatcgagtgataaagttgactagtttaaatttccgaattccaaagtatatactagtagcaaaacaagtccactatcatcaatgtcgtgtgactcgtgtcctcatcattctctcaaacccacgaggcattttcttttctacttttttcctcaacctttttaagttcaaaaaaaaaaaaatagaaagagaaaccccccccaacttgttttcgagatatcaacaaaaatgtcaaagacaaaaaaattcccttaataatccaagaaagaaaaaatcataacgatg

SEQ ID NO: 14717 - DNA, 3000 bp, Unknown
  misc_feature (1)..( 3000): cDNA_ID_3018731_gDNA_ID_2684219_Annot_ID_191767 3000 nt of promoter + ATG
atttgcatacccggtttagatctaaacccgaatactgtacatataagctcaaaccttaatttgagataactgctgacttccaaattctgcaacattaaattattaaatccattggaaaaagggtactaatcctttggttagaaagtatgattgaacaagtgccccgtatttaaatttgatgtcatcacaaagttgtgtattcatgatggttcttatcaatttcccttagcatctactcaatgtttgcttgtaagcattgggcgtgacgacaagggaaccttcatgtccaaactgtaacagaagtgtatgtatatatttaattagaaaatattcttagtaatacgtttttatatcttgattataaaaattaaaaaaacagtagaaagtatataccatacgaattttaagtgcataagcagtcaaaacataaacataaatgatacaagagatctaatcatctaatgggatgtcgacaagtcttagaaacaaatatgtgtgtacgtttatataacgaaataaatataacacgaaaataacttagaaacaaacaaattgggacacgcatgggtaatttgtccccttctcttgtttgttgttcaattaatgaagttacgatctcttgaggccaattatataatttatataaagacttattaaaaaaaataagaaacgtagaatgtactagaaataaacgaggggttagttggattcatctaaaaatgtttatgtagattttgtaccaaacattaaaaatatatgttgtgtaactttgttgacaattaaaagaaattatttaattgatagagttgttgagcgttgtatcttttaaaccatttgattttccctactttattgtgttaatttgcataatgtttttttctaatattctgacattatgtttgatttatttccatgaaacaacaattgtttctagagaaagcttaatggagattttagcttttttttgttttttcttcatttagtcccacaacatcatagtcatgatttttcgaacttgtgaattgtgatagttaatgattctaacttccaagtggtaacaataaacctaaaatacggagagtattcgtcacgcgctccaagcataagctcgcatgattggtggcgtaactttcatgggacattttgtctctcacactaaaaataataattcttgtagcatactatatttaaatagcttattattataattgacaaatacgtattatttgaagtttgtttatagccttcacgatactattttattacaatgaaattgaatttactaacaaaatataattattttatatattagtattgcatgttaatatgttgaccgttgattaaaatacaatttaatgatcatagctgtgatctacagtagtacggtatgttgtaacaacagcttagcaaggctctagatcaccgtagtggactagtagacactagacaccgtgaccgtaccacgaaaaataaattctctttataaattaaacgcactattatttcaatgattagcaacaatattatactcttaattaggaatcttccaacgaaatttattcatttctaccattattctaatgagatgttctcttccattttacgttcgaataatagtctgtcctattattaattttttgaatatctaaaaattcactactaaaaaatttacctctttcaaaaactagatccacattaaattagtgaagaaaaatctacggcacactatttccatcagtaaaaataaggaaagtttttcaaaaaaaaatatattaatattttaatcaaaacaaatatattaattattatttaatagttgaactaataatatgatgacatctgtacaaatttgataagaatagtttctcaaagtttctcctccgaaaaatttaactctccttctctcctactttttctcacctctctcatattttttttttttgctcttactacacaaataccacattagtatctataattaataaagttaataaaaatcaggttctaaaataattttactcttacataataacgatgatattggaacattacacttgatgcacaattttttttgtataaaatttacattttattttaaaagtaaaatagcgataatatatatttgaataacaatacaacgattatcttttcaacagatcatttttttaacactaacaaatcattttttaatttactgtatattacaattaaaatctcatgcaaaaatacagttgtacatatgcccctagattcctgatatagaaagatttggatatttccttattattaatttggtgttaagctttgccacatgattgatgtatatatattattaatatagataaatatatttctcacttatataaatgaatagaaaatcgatctaaaaactaaacaaacattcatgtaaaaaaaacatccataattcagaatatttaaaaacaactcagagtcacataaagttgcccaaagtaaaagaaataaaaagataaagaggatgagaacattcttcctttctgtgatattttttatttaaattgtatattttcatagctatttttattctataaaaaaattaaagctcatttttcccctccaacaaggaaaaacaaaaacctgtctttgaatccaagtctctctctctctctctttctcgccacacttcatcatctctgctactttttttttgttctcgtctcagtgagttttctttgataggtttattgctaaatcaatcaaataatcttgtccagtttcacttctcttttaccatttccttgttccattcttcagcttctctctctctcgctctttactttactaaacttggtctcttcttgagcttatacatctcatttctgcagagagtacttgtcaaagaaagttgtcgtctttctccagattcttcttgagcttatactgttgatcatccgtgaaagaatctaggttccgcttcttttttaatgagccgaatttgaaggaatctttcaacagacgatg

SEQ ID NO: 14718 - DNA, 3000 bp, Unknown
  misc_feature (1)..( 3000): cDNA_ID_3018735_gDNA_ID_2684219_Annot_ID_191766 3000 nt of promoter + ATG
gagcatcaaaacctaaatggcttctagctcttgagatagtcacagggtcaatggttggtttgctccttctggttgcacttttctctgcagttcaccgctggaacaatagatcaactctcatcattccttggaagaaatcttcaagtgaaaaggaaaagttcacagtctacgtaggttagaatctttcctaattctttaccttccaatgtagaatccatggagcaaagaactaaaaaaacgtggcatgtttttattttaactacagattctgaaatgctgaaggatgtttcgagattaacaagacaagagctcgaagtggcgtgtgaagactttagcaacatcattggtttatcagcagatagtcagatctataaaggaacgctgaaaggtgggtctgagattgcggtgatctctctttgtgtaaaggaagaagattggactggatatcttgagctctatttccagagagaggtagcttcctctcatgttatcatcatcaccaagccacttggattgaacaatctttaaacatatcctccttttttctgagattttaaatccatctcctcactgtttcaggttgcagatttggctagattaaaccacgagaacacagcgaaattacttggatattgcaaagagatctcaccatttacaagaatgcttgtttttgagtatgcatcaaacggaacactatatgagcaccttcactgtaaatagtctaacttacctcagagctttgttgcatcatcctgtattgttttagctagataacatttttatgtgaaatattttgatgcagacggggaagcggcgttagtatcgtgggcaagacggatgaagattgttataggcatcgcacgtggtctcaagtaccttcatatggaacttgatcctccgtttacaatctctgagctgagctcaaacgcaatttatctcacagaagattttactcccaaggtaaagtaaagtgagacctgcttgttatctgagtaatacaattagctaagctaagctttatgttcacattctttcttttttctgactttctctgatgcagctggttgatttcgaatgctggaagacaattcttgcaagatcagaaaagaatttgagaaatattagtagccagggttcgatatgtgtactcccaaacggaatggagagccgatatcttgatgtgtcgggtaatatctatgcattcgggattcttttgctggaaattgtcagtggaagacctccttattgcaaagacaaaggattcttaattgaatgggtaagacaaaaacaactcagtttctctaaacacttgaaactgagttacttcctcctcctcttttttcaccatttatatcaaaaactttgttactgttagcctagtaggaatggagtcgtctgttcagggagagacgagttttcgtctggatgtggaagtcttgaccttgttcacatgtttagttatatcgcacctcaaatgtggtttttgtggcaaaagttttgaatttgaaacgtatctattgcattttgcaggcaaaggagttccttgaagcaccagaggcaatgtcgggattggtggatccagagctgaaacattttaaccaagaagatcttgagacggtatgcgaagtggctagccaatgcttgaaccgggacccaaccaacaacaacaacaatcacaacaagccctcagtgcaagagctatgcgagacattggagagcagaatcagtctgtctatttcagcggagcttagatcatcttctttggcttgggccgagctggcgcttgactcgtgatgagaatgatgaaaggaaagaaaacgagtgttgaatgatgcaatgctaactaactaaaaaccaaactctcaactctgtaaatcaatcgactgattacaacatttgatattgtttttttttgctctgatcttgacgagtgtgtctgtgttcttgattagttttgagttttgggtggttcaaagtgtttgtaaatgaagagatgaacatagtttctgaaagattttctctattatttgaaaatctatgagaggttgaagaatgttaatgtagtgtgtttggatctaacctttaatcttatattatatagagcattgtatctattgtttgacatgattagtctcattggaaaaagcttcaaggcaatcaatttgagatcaatatcagtctcagacaagtgtttgcggaccaagaagaagaagaaacgtagttgaagttcataaatcataatgcatggatcaacttaataaaaggcccacatttagcctcgtatcagtctaaatgggccacacaagtcaataggcccatttatcaatgctttgactgttttcaatcttcaattttggtatgacttcttcttacgaggttgagtgccataaaagattagacagacacgtaaaatagattccattttacctttagttaaaacagatatggattagccaagtttcgttagtatattgtcatattattttattgaaacagaaaaaaacaagtaaagattacttaatcattcttaatcaggcctgttcttaattatcaaaaaaaaaaaaagattacttcatcatgtcgtaataatatcactaatcaatccttttttttttgtcatcactaatcaatccatttttttagcgaaccttaaagtcaaaggtgttgttactttggacgattaaatttgaattatataatttaaaagaaaattggaatttaatctgttgaggttgaaattctctctttttatatatggcggttgaaatttaaaagtaaagtattgtttggtagggccctatagtttaaacatttacaaatcggcccacacatttttgtcattttagatgtcgtaaaccgctttccctcgtcttcgttccaatttaaaaagcaaaacaatttcaaaaagtctcatcatttcccataaacctaaaagctttttaaaaactcaaattcgatacgagaagaacaagattcgcgcacaagacgatcgattacatg

SEQ ID NO: 14719 - DNA, 3000 bp, Unknown
  misc_feature (1)..( 3000): cDNA_ID_3018739_gDNA_ID_2684219_Annot_ID_191763 3000 nt of promoter + ATG
ccgactttgattactgggtaattttaaaaccgccattgttgttctctttactacttttgggaattagggtttatgatttctgggtattagattagataaatttgtttcctttttttgttaatcaatttaaaaatctcttatttctgttaaagacttgtaattttggagtttttaatgcatggacggaagagaagcaatggcatttccaggctcgcattctcagtactatcttcaaagaggagcctttactaatctcgcaccttcccaagtcgcgagtgggcttcacgcgccgccgccacatacgggattgaggccaatgtctaaccctaacattcatcaccctcaggctaacaatccaggacctcctttctcggattttggacacaccattcacatgggagtggtctcctctgcttctgatgctgatgtgcaaccgccaccgccaccgccaccaccagaggaaccgatggttaagaggaaacgtggacggccaagaaagtatggagaaccgatggttagtaataagtctagggactcttctccaatgtctgatcctaatgaacctaaacgggccagaggtcgacctcctggaactggaaggaagcaacgcttggctaatcttggtgagatctcgagttttctattctgtgtactttgtcaagttaagtttttgctttagctctgttagctagtcttgaaggacatgagcttgaatcttatggatgctagaagctttgaatgattctatagttaagttaggttttgttactttgtcgttactgatactcaatattgattgttggctattagtttgacggatctatgtgtggtacaatgctaggtgagaggagtaattggttattagtagatgtggacgaaatcgacttcttgatttaagttattgatttaggtttttaagctgtgaaagagtaatcttactaatccattcatgtttaagtaattggtcatcataatgtgattaatcaaactttaagtaatagcaaactcttgactctgataatttctttaggtgagtggatgaatacttcagctggacttgcttttgcacctcatgtgatcagcattggagcaggagaagtaaactgaccaaaactcctttatatattaatgatcatttatgcagcttttcattgtatcaatttccttttatttttctttgcaggacattgctgcgaaagttttgtcattttcacaacaaagacctcgggctctttgtataatgtcaggcactggaaccatttcttcagtcactctgtgcaaacccggttcaaccgatcgtcacttaacatacgaggtttcaaagtcgttcattcagttaatcgaaaaagaaaaacctgaaaagatttcttatttaatcctctttctgtgtttcttagggaccttttgagattataagttttggtggatcttatttggtgaatgaagaaggtggatccagaagtcgaacaggcggattgagtgtctctctttctcgtcccgatggtagtattattgccggtggagttgacatgcttatcgcagccaaccttgttcaggtatattaaattcttcttcttaatggttgtaaagtgaagctaaaacgaggcgaaactaactacgaatgttagcctttgatatgtttgtgctgtcactttctttcctcttcaagatatcatgtggtagtgtttgaaaaacttgtttgttattcaggtggtggcatgtagttttgtatacggagcaagggcaaagactcataataacaataacaagaccatcagacaagaaaaggaaccaaatgaagaggacaacaatagtgaaatggagaccacaccgggtagtgcagctgaaccagcagcatctgcgggtcagcagacgccacagaacttctcttctcagggaataagggggtggcccggttcaggctcaggctctggcagatcacttgacatttgcagaaacccactcactgattttgatttgactcgtggatgatatacactattagtctttgaagcagcagcatacaaaatgtgattgctgtacatatgttattgtagatttctctctgggaatgttgaaatcagacatttaaggattgatactagatctctcagctccttctaacattgttaatgtaacagaaccctcccactttcatgctattttaggagatttttttaactcttttatgatctcattgtggtcatcaagaacttggtttctttactagttcactatttttctttcaggttctttaacatatttagtaaacttgattcctcttatttggtagacaatgtgtaattcaacacacacaagatttaggatccttaatttataggaagatgacaagctcataatttatacatgaaaagcattaaatattaatgaatatatatcctcaaattgacttaaatttctttttcagtcagaaatctaatgagacattagattttgttataaaccattgaagaaagtctatatcctttttaataaaaaaaattcttaaacaacccaatttattttttttgtaaaccaattgaatatttttttttgacaaaattaattaaagaaatagtatataaatagaaacaatggtcttcacttcctttctcttctttttttttctttccttttttttttctgagatttgctttctctaccagagagactgtaacagtagtagtagctacttttgcttgttgtcttcatttcaaatctgcaattttactttctttttgagttctaagtgaactcaacatttagcttctttttcttttctaggtttcataaaaacagtttggatcttaagctcacagctgaaaataacccgactttgattactgggtatataaaagccgccattgttgttcttttcactctttgggttattagggtttacgatttctgggtggtagataaatttgttcttcaaaaaagtttccttttttaaaaaatctcttagattcttaaagaattgtaatttagggttttaaatgc

SEQ ID NO: 14720 - DNA, 3000 bp, Unknown
  misc_feature (1)..( 3000): cDNA_ID_3018743_gDNA_ID_2684219_Annot_ID_191762 3000 nt of promoter + ATG
ggagatattagcttagatcttagatttaaagcttgtttcattctttgatgttttattcaagtttaacacatttaccattgaaatttgtattcttattcaattatagatttatagtatgtatttgttgatatctctcactttttaaactcaacaaactctaccaaaatcaaactaccagcagctattagaattttgaactattgttggaccaccaatgtgtgaagagaatcatatctcttaatccccacaaattcatgagaaggaaaataaaaaagcaacagttgagatcactttccttacaagaatcagaaagagacccacttttgatgacatcatgtttcagagacccacaatcatatctctctatatatgtatgtatcataatgtgtgtatatgtgttgtgaagtaataagtaagggactttcatagaaacagagccttattgtaccttttgagacaccatcctcaagctgaaagcttccttcaacactcttcttccatttttgaaaatctatctagtacatttattgtgaatttcacactgtccatatcttgtttatttattaaagttattaatgttacatgtagatgaaatggactgatttgtgtatgtttatagctatttatgtaagaagaacaagtaaaatattgtataagttcagtaatggtcggcctcaaatttttcctatcatgaaatttctaagtaaaaaaagacaagtcacattactttaggtaaaaagttggcaaaacaaaaagtgaaagaaggaaagtcaaaactctttattttattgtcaaaagtcaaatgtgtgcaaatgtaatattgttgacattaaacaaaacaaattaatgtaaagattattcataatggagtagcaaaacaaatctaattaaacccaaaatatataatatatgatatatctctagaaaacttttatttatatctagcaccaaattttgactatttggattttttggtcgggtactttagccaccggatattaaatgcatcatacaaactttcaaattaggtggaaacaaaatatatgtacgtatatatatatatatatatattaataaatcactttcaaaacttttaaaagaaaataaaaaaaaagaattttagataaaaagtaaaagagaaaaaggggaatataaaaatggaaaacaaataaagttaggagagagggctcactgtccgaagcaaagaaagaaatagcaaagtgagttagacatgtgagagagaagagattcaagtgtgtccccattctctttcctatcctttagtcaacaacacatctctctcatatttggatatttctaatcaagatcaaactttttacaacaagatttgattttttttgttcttttaaaatcttaatttgaattaagatgatatgaagtcatttcatactagtcttgcctcttgtcaaagtgtaactgaatgaaatttcaagattatatatttataagaaaacctaaaatttttagatatattttgaaataatcttataattatctatactaattaaaaataaattataaatatattatagagcagttgaccaaaaaaaattacagataactattgaagatatatagacatgattagttgaggtgtagaaagtttgtaaagccactaaaatagctccaaaattgaaataatcatgttgtagttttttcttttttctagcaagaataatatatttttgattattttaaaaggtttgtacatttttctctttttattttcactttatttttttagtttctttagaaacattattatacttttcatatatatatattgaatttatcttcaaattttgcatacatattttacccactaaacatgattccatataaaaacggaaaaagtgtgtcacagaagaaataatatattacatgatataataatctaaaatgtcaactgttttctttagaatatgttagaaaagattttttttttaaatctttattggtagcaatgtttatgagaataaagcacataattgtctctcaatgactaataaatttcggtttcagtcaaagatctaacgagatattagatttgtaataatcatcaaagaaagtctatcctttttattaaaaacaaatattcttaaacaaactaatactttaaataaactattcttaaacaaactaatacattaaatattcttaaacaaactaatacattaaatattcttaaacaaatattcttaaacaaactatgcttaaatctttcataataatctttctctcaattgaatttatctttcacaaaattaaataacaaatcaattaaagagatatataaatacgaaaaacaatggtcgtcactctcgttcagcttctttagttttcttctaactttcagagaaagacctctctcaattcaaaagttcacaatattaaaagtataaatcagaatcattaaactgttagtctctctctctctctctctctctctctctctctctctctctctctctctctctctctctctctctctctctttttctcttcttctccctgaattgtctcatctgtcttcttcctttgtctctcctctgatatacattgtgttctccttctcagaaaccctagatttctctcaatcaaatctagcttttctcttagggggagatttgatttttttctctgcaagactgtaacagtaggagaagctactttcctctgttttcttaatttcaaatctgcaatcgtactttttcgagttctataagtgaactcagattttagctttttttttttagggttcataagaacaaattggattttgagctcacagtataaataacccgactttgattactgggtaattttaaaaccgccattgttgttctctttactacttttgggaattagggtttatgatttctgggtattagattagataaatttgtttcctttttttgttaatcaatttaaaaatctcttatttctgttaaagacttgtaattttggagtttttaatgc

SEQ ID NO: 14721 - DNA, 3000 bp, Unknown
  misc_feature (1)..( 3000): cDNA_ID_3018747_gDNA_ID_2684219_Annot_ID_191761 3000 nt of promoter + ATG
tgtcttatttttagctgatttataaaaatcaagacttttatagtttaaacagatcaaatccgtgaagaatttcttcagaattccagatataaaaaacccagttttgttatattcttcttccacttcacgaaggagaagaacaacaacaacaccaaaaagagtcaaaatctgagaaaacgatctgtgaaaaaaaccagaatttgaaggaagaaagaatgaaggaaaaggtgagatgacaaaagaagccgctcgtgtgagagctcaaagggaaagctcaaagaacagagagattgttttctgcaactttctttatccttttgtttgggggagacaaaagcagagaactttgccagaaagttgtaaaaattaaaaattgaaactttttttgttttataaaaaaagagagaaacagcaaagcagcaggcctcaccaagtcaactcaccagtgggtcaaataaataactaagaaacaactcatttttgctatcaccaatgaccatcccatttgccattttcaataaccatttttcttctattcacagtgttttttttttagaacatttggttgtttattattagtcaacatattcaagaaaatttggttcaatgagtttaaaagttttgtcaacttgaaataagaattatttggatcaatgataaaatttagacgcgtcgcataggagtagtttacacactattaccatattacaattccatcaaatcgatctatagctggcctgtcaataaatagtatatagatatttcatataactagttattactatatatacacatccatgtcctttgtcgcatatagctatttaggtaacaattgttcttttctaatcgctatgaagtatgaaaaatatgataatgtgaatgaaaataggataatgtgaacgtggagaaggaaaattagtttcaatcaaaatttgccaccgacataacgctcttacatttttatttttgtttttttccaacagtagaaacgccttttcaccgaccaccccctcgtacctgtgaatgatatcgagaaaatttcccttattatcttatctcgagaacccaatttattttgtttcttatgacttggttcaagattacattccggtttagctcaaaaatcgattacaatattggtttagaagaacggattaattagagacaaagcgttatatgtgtcaacaaagattgtatagtaaatgatgcaaagttgactcttgcctattaacttgaaaattacatgtgcggaactagtaaacgatagttgaaatttactttctacagtcttgtcgattgagagagctaagacaaacattgaatgagatgtccctaggaaagacatttatagtcaactcattttatttggaacgatacagtcttaaagaagattagtattgatccatcatccataacaaatcatttcgacaacttccgaagatatagagatgtttactttccaatgataagttaaaatttcttattgtcgcaaaaaaacgacatctaatgagctagagagatcacaaccaagaaatcctactatattatttgggaagtacattttaaatgtaaccttaatttttgtaagtaattacataggtatgccattagaaataatattttaaaaagtaaattaatttatctctttaaggattaaaaagtcaaatactaatttaattaattaaattaattaaaaaacgaaatacattattaatttccaaaaataatagccaatcaaaatcaacttataagatttgatatctaaattttaattaatttaatttaaactataaaatataaatgtattagagaatgatacaatttgcaaaacttttatatataaaaaataattctaaaattttaaaaattactactttaaaaaaaaatcatgggccgggtaaaaaaattacagaacgtgttttattttggaattgggttatatggtggatgtatttgaatcaatatttataaaattttaaaatattattaatatgctgttttaataggggtcaaaacttcagttgtttaacaattgtctcatgaattcgtggtatagcgttacttaataacaattataaactgtaaaatataaatattttataaaaataaaatttgcaagttttaatatatattacttttaaaaacaaatcgtcccgcggtataccgcgggttaaaatctagtatcactatattctatagacctaacctcaaatccaaatttctatggaatgaatattaggaaaattatggaaatagtctcaatgttagatcatattataaaatatttaaaagttctctgaattaaggaagtctaaatgtaaatcctaaattccaaatttaatccctttaccataaaaattaaagcagtttagtctatctagatttaaaatatatatattttattttaaaaaatcctaattacaaattgtccctataatattagcttattagtgagtccattgggcaggtttattatgggccttagccttaccaatcaaaaagccttagaaatcaaagcccaaaacggttaaatagaaaactacacgtagtacctcttcgatcataacaaacgtcatgcagtgtatattcataaaaacggcacaaagtcctttctcattagacacgaacggaaaatctctacttgtctccgtcccgtaatttccgttactaaccaaacccaattttggaaattcagtaacagagcctttataaaagaattaaaatctttattgttttttccaaatcttcacaaacaaaattcgtcaaaacaaaacattcttgacacttcctcttctccgtttaactagtttcacgagctctgttctgtttcttctctttcagaatttcaaggtaaatttactaaaaaccctagaattgcaatttcactcactgttcttgaattataatttctaggttttttttatcttggcatgtataaaaattgaatctttattctcgtaggatgttatgattgtgcggttttagttgatgtgtttggta

SEQ ID NO: 14722 - DNA, 3000 bp, Unknown
  misc_feature (1)..( 3000): cDNA_ID_3018778_gDNA_ID_2684219_Annot_ID_191752 3000 nt of promoter + ATG
atccatatcctttcgactttacgttctaaaatgaaaaaaaaaaaagattttctgaattgttttgaaattatatttctgaagtgttttaatttgaaattatattaggtttaaggatcttcaactaaatgaatttataattattttatttaagttttggaatatgattatggtaatacttttttgtaaataccacaattcttccaaatgatagttcgtgctgtttgtgaacaggcacgactttgaccctagaaattttcttctttgcatcaaatctttgttttcgaattaaaattggatataacaagtccatgttttgtttcatacgcttacaaagctaataatatcaagtcaactttatgattttttcatagtttcaagaacaagtaacattaaaagatgatgtttgttgttcagatttatagattcaacttgttattgatgaaatcatctgattgttcaattctgaaacaacaacacatattatatatatatcttctccctctgaattggtatatatattaggacgttacatgtttgaatgaattaaaaaataggagaagatctttccctatataaatggctaggtttctgctcagttttaatctaccttcataaacacgaaagtaccaaaaaatggcaactttcatcagattcactgctcctttgttttgcttcttcttcttattctctctcttttctcaccaaaccatgtcccaacctcaacacatggccactttctgcgacgacagattatccgacaacttcacacaaaccagctcatacaaagcaaaccgtgaaaccctactttcttctctccgtgaccgttcctcccttggaacctattccaatgccacaatcggtcttagccccgacacagtctatggcatgtttctctgccgaggagacctcaccaaaacatcatgttcggactgtgtcaaaaccgcaaccctagaaatcactaaaaataataactgcacttccagaaaaactgctctaatattctacgaggagtgtatggttcgatactccaatgtttccttcttcacgctcgtagaactagacgggccttacgtcgctaaatactctctcgccacttttcctacttctctttttagttctttccaacaaacgttatccaataaggtagagcaactaattatcctcatagcatcaaagtcttctttgtctgcttctacgccttattacgtgaaggatatatcacgtgtaaatgaattagagggctcgtatacattagacacggtggttcagtgtagtcctgatcttgatccagcaaattgcggcgtctgtttgagacttgtggtcaaaggtctctcaggctgttgtaccaatgctcgttttgctcagttctatctttctaaatgttttttgaagtatgacacaaccggtttgccaacttctcaatcaccaagcggctcatcgtctattaacgttatgaaaggtgagcataatatatgccctcgactctaatctttttttttttacaagttacgtcaaaagataatgttttaatttcttcccgccaagacaccgcagctgtttgtgtagtaatcaaactttatttgtctatgagaactataaactcgcccatgatctaaaaatccaactatcatgaagataatcgactgaggaactaaaatgtttatgtgtttggattttcttattgtaggaaacgaaatattgaggagaattttcatcacagcaatgacaacttcggtgttagcacttgtgggtctgtgattcaatccaatgataatgaagattttttaaactttgtattctgcgattgtgtgtgacgtgtgatatgttattttcttgtctaataagaactcattccgcattgtccgcggaaaaaactattaaaaatattatgatgttttaacaaaaaaaaaattatgattgtatgatgacctaaaaaatattaatcattatgtaaatatatagatcctcttttactaattagtcggatggtaaaaatccggatcactttatccttaaattgttttttatacaaaccaatttaatttattctttagtttgtaaaaaacgtacaagaaagaaagattaattaaggagatgcatgcaagacataattgatttttttttctaaatttccattgtcctcatcatatatatattcagaatctgagtatagtatattggttaattatggtgcacttgctgctcctacatcatctaaattgcagtcaacgcaagctcctgtccaagttacttatgttacttcttgttgcttaagtaacaatcctagcacttcaagcctatcattgtttcattattctcctattcgttaccatgtctctgaagcaattttttctccgtcttccaaaattctttagggtgtcaaatatattgaaattgactcatttcattcgtgatgaagttataaaccgaacaattgccaatgcccatgtacgaccgaacccgtcattagggtcttggacgcaaacattttgaacaatttcttttcaattttgacgtttgtgatcttcactctccaacttgaaagaggatatctatatatacattaccgtatcttgcttatatttttttacttatatttgttattaaggcatataacgcatgagtcttttcggaattaggtcagcttgtaaagctatataaaggccctttagagccatatcaatgatatagtgatataaagagaaaatcctttcatacaccctaaaggtttttgacacaaattgtaggactaagtttctgttttgcttaagataaacattaaactctgatctgcgtcgactttatgattttgtcttactaataacataattatcatatatgagaaaaaaatacactagttttacatattcttcctctgaattggtattaccatatccttatttagacactattttgaaaaaatcaacaaagaaaagctcttttcattccactataaattctctatctcctctgtttcgtcgaacaatacagaacaaaatg

SEQ ID NO: 14723 - DNA, 3000 bp, Unknown
  misc_feature (1)..( 3000): cDNA_ID_3018768_gDNA_ID_2684219_Annot_ID_191755 3000 nt of promoter + ATG
acatatcttctttcaagccttatgtagataaaagccatgatgaattaaggtgggaatattacaagaaagaagctaaaggtaactatctcatcatttaaatctttggtatgtatattttctcttttatatgtctctgtaattttgactaatctcatgttcaggtgggtcgtttcctgctgctcatgcctctcccataggctcaaagccaaacgctgtgttttcaccatcaacggtatcgacatcattatttgcttctccaagcgtacctgatcatcatcagaggacaaattttagtacaacgctaggaaactttactggtcctgcttttggtttcttccctgctgctgctggtggtgctacaacattttcatctaccggtttcggtcaacctaatgcgcctttccctggtttcgattcccagtttccgagcgctttttcatctttctcgacgacatatcctgccgtaagctcgagtgttcagagaccccatgaaacaggtgctgtttcttccccagcatttggatgcacagcctgtggagcaacaagtagctcctctgcttctgatcacttcacctttaatggtgccacaactcctcccgggttgttctttcctaccactagttctggtcctatgatgtttggaacaactcttgctgctcaaggcacaactccagcacttcaaacctatcctgttcaaggtttcattcttctcccattcgccgccatgagtctgcagtaatttctttactctccagcagttcaaggctatcttgtccaaggtttcattcttctcccattcaccgccatgaatctgcacttctgcagtaatttctttactttctgcatcaaactctgtcttccaaattgtaggactaagtctttgtcttgatttaagaaaaaaaaaaaaaaaaattgtgtcaaatttatgattgtctttgtaaaaatatagctgtcatggatgaaaacagttcgtgttacatgttcttcctttgaatgtactatataaaaacatcattgttttggataaatcaaccaaaaagctctcctctgttttgtatgctatgtatgatggggagtatgtggaattctgactaatgtctaatgtctttatcctctccagtttcaagcgttaatacacatcacatagtactctctagcttcctcttatgtgcatatatatagccattatacatatcatacaaatatatctcagcgagtgttaataaataactttagcataaagaagtcggttttttgagtcatatttaatggttttatctcttggttccattaattgtcatatttaatactgctgattagcttaagttgttcggtctagttgtgtagagattttgcgtcttgtgaatgcaattagaaaatcaagagacgaacaaggaaaacataattaacaaaaaaaacacacaaggaaaacataattttattttatttttgcgcggaaataattaagccactacaaaaaaaatatatatatatatatattgaatcagaagcaaaagaattttagaaactaatgtgtggggatgtttctagcaacaatgaggatttcccggcacgcaggcacaagtatgatataggcagttctggattggacctttgcaaaacttagcacaatctgcattggtattgcatgtctttggcttcaataatataccctttttgctttcttgcatccttgcactcatcaccacacctatacacaccaaacacataattatatcaaaaagtccttcaagctatgtctttggatgaggacgaacctatcacacagtcgactccaatacttgtttttgttgaagtttggtatgatataagggcatctccatcactgagataccttcttggtttctcaaaaaaaaaaaatattagtattttaataaatattagttatataattaaattttaacaataaaataatatttgacctgatatacaagtgttcttatgggtttctcaaagtttctcacttgagaaactaattctactctctctcatactttttaattatattttatttttatattgaacagtttctcaattaagaaattattgatggagatggtctaagtataaacataccttttcgctcttattgttttttttttttgggaatcaaattttcttttctattttctcattttagtgaaatttatttaaagtgaaaaatcttaacaagttaaaaaaaatatatataattgtctggtttaaattttaaattgattgagatttccattagattgcctaaaacgtccggctagcgttaaaacaacgccacaagaaaaaatcagcaaggaaaaaacaatcttagaggaagcgttagagcgacgcaggcaaattgaagaaatcgtttcctataaattgaaaccacaaagttaactcttttttcttcttcttcacactaaccctaactttgatttcatcatcagactcggaaaccgcaccattgttgttgtctccgtaagcttctccttcaatcacttggtcggtgccctgcttcctactttgataaaggttcaatttttattaaactctgacgattttgggcgattttaatacttgcaacaattgtgaattgccgatcagtatctcttgatcttctatgtctttgttttgcttgatttgggttagatcatgttttctctttgtaattagggttcttttgttgcttcttttccacgctttctacatactgtttcctctgtggattcgagaacagtgctctgttatcggttggaactatcgattcaatgatcctgcaattactcatttgtactgattactgaataaaaatcgttactttctgatgtataacccccaaatttgagtggaaattactatcttaacggatctggatttagggtttttgttacttagtttctgcaatacgaattagtttctgaaagttatcctctaatccaaaacaaatttgcgtcctttcttatttttgtgtggttaacagtttgaaagatcaaaagaagaatg

SEQ ID NO: 14724 - DNA, 3000 bp, Unknown
  misc_feature (1)..( 3000): cDNA_ID_2724724_gDNA_ID_2684220_Annot_ID_137430 3000 nt of promoter + ATG
atttaacttcattctacaacattatattattatatattttagaaaaaaattgcagtcttgtggctcttttgggactaactttaccaaatcaataaaaaaacacatgcttttgtgcatcatatagtatttttatctactgatcacaagaaacttcatagaatcatatggaccaagaatagcataagtatatacatgcatggcagtctaatttatctatatatcaacgttaaatcttttacaattgagacttaattggtacaccatttacaaagtattttgctaatgaatgtcaacggcaaatgatcatgattgacgttattaggtcgttttgggacatcaatgtccaacgacagcttagaagtgggattcataaattcaaaactgttaacataactactgtaattttcttatttgtactctcattagcttttgataatatgaccaataacgccaattctccgtggcggggacgtaacgcgtatgtttagtttggttgccgagaggttgagatgctagttatgggttttgtatgagtttcgggatgtattatctcacacaaaaagtttgtatcgtggaagtcccttgatcgaagattaacatttctaataaagtttagcggtgtagaactgcccacgcctctgtgtatacgatttaaaaggtattgaatctaaaattttgagattttattttttactttttgtttcaaactaaaatatatattagtcatattttctaattaagaatctaataaagctcagcagtctagacccgtccacgcgtctatgtatacacaatttaaaaggtattgaatccaaaaatttgagattttatattttttactttttgtttcaaactaaaatttatgtttttttttttggtaagccaagggagacaatgtctcccaagatttatgttagtcatactttctacgtgattatctaataaatctcgtttatctaaacctgtccacacgttgacaacggtttatcatcaaatctccaaacctctaaaaacattgggggttcggagttaaaaaaaaagcaagaaaaaagagagatagtgagcgtaagtgaaaacagccatggaagaggtaaaggggaaaagaaccatcagtaacacttggaaacttgttacaaggtcccaaactgacccctttgaaggaatgcctctgcatctgaaagagaagattctcatgaaattgaaggccaaaatcatatcgacgttcatcctcctttccaagtcctggtcatcgatagtccttaacaaagatttcaccaacatgtatttgataataaagttctttgaatctttgaatcgaccacgtcttcttttggcagtcgacgatcgagaaataaatatgcagttcttccactcttgctctcgagaggatccatcttctgatcatcaaacggttggctgttaccctgattcgtatccgcgtatctggtatgacttttctccacctgttcgtggcttgatctgctgtctaaacaattctactaaagtggtaattggaaatcctactacttgtcaatttgaaactttaccgagagtcagaaccaaaatataccaagaaatatttcccttctttggatacgatcatgttaaggatgaatacaaagtcttgtgcatgacgatatcggatgagtactatagtagatcaggaaatattgtgtccaaggagcataaagttttcactctaggatgtaaacagaagaaatggagaatgatcgaatgtacgattaatcattatcttactcctggaactcaaggaatatttagcaatggggttatctattacttcgctagggtcaatgatgatcagtcgctaatgtgctttgttgtggggtctgaaaagtttagtgtcgttgagttaccgaggccggccgtcgaagttctagcgaactacggcgaaaagatagctgtaacgaatttgttatatgctagtaatgatagactttttgtatggattctagaagatgccagcaaacaagaatggtcaaacttttgtgtcttggttccttcttgggtagatatatagatttcgaccattcagcttcacgggtatacttggaaccggcgagcttatatttacaccgggcttaaagcgtggccccttctatttactgtgttacgatctcaaggaacacacagctagaaaaatctgcttcaaaagaattggttattatacttctttgaaagtctttttggatcatgtagagaatcctatggttctgccaaagataaggcaatcggttggtgatgagttctttggtgttgcatgaactaatctctcttctttcttttcttatttttcaagtttcaattaagtggtcggatattatttgtttaagactagttcttattggatttgatggtcacccattggttagtcttttgatcaatggatatttatgtctgtggaatattgtaatgcaatgttttttttctcaacatctttggaatgcaatgtttatgacttaacaagaaaaatgtttatgacttgattataataatctctggttttgtgcggagcttatacagcttcggttttcttcttatttgatttcttttggggagaacaaagagttttgtgtttggctagatggatctttatcatcattttggtcgccttttgaattttatttcataaagaaatcttatgtataagaaaataaaactaatatcgattctgaaatagcaaaaatacctcaatattttcactaaatcataaaacgaactacattcatcatacaacacattgtaacatttcaccattaatttcttaacccaagcaacaagccaataagtagatagtttttgtttgactaaacatacacacgtgttcggagtttgatgtacacgcgctgactgcgcgtggatgtaatataatcttaattcttaagtatattcgtcgacgttgccttgttccaaagttataaaccgtgtggaaccatcgagaagcgaagccagaataaattttcgaatcctccgacgatg

SEQ ID NO: 14725 - DNA, 3000 bp, Unknown
  misc_feature (1)..( 3000): cDNA_ID_2730695_gDNA_ID_2684220_Annot_ID_137433 3000 nt of promoter + ATG
aaaagtaaaaaataaaatctcaaaattttagattcaataccttttaaatcgtatacacagaggcgtgggcagttctacaccgctaaactttattagaaatgttaatcttcgatcaagggacttccacgatacaaactttttgtgtgagataatacatcccgaaactcatacaaaacccataactagcatctcaacctctcggcaaccaaactaaacatacgcgttacgtccccgccacggagaattggcgttattggtcatattatcaaaagctaatgagagtacaaataagaaaattacagtagttatgttaacagttttgaatttatgaatcccacttctaagctgtcgttggacattgatgtcccaaaacgacctaataacgtcaatcatgatcatttgccgttgacattcattagcaaaatactttgtaaatggtgtaccaattaagtctcaattgtaaaagatttaacgttgatatatagataaattagactgccatgcatgtatatacttatgctattcttggtccatatgattctatgaagtttcttgtgatcagtagataaaaatactatatgatgcacaaaagcatgtgtttttttattgatttggtaaagttagtcccaaaagagccacaagactgcaatttttttctaaaatatataataatataatgttgtagaatgaagttaaataagcttctttttgaggaagtatcgtttgagatacaaaacttgactaatcgaaacgacaatagctactcctaaagacattaagccgagctgattgaccctcgtgtttgtcttctcgtttatttccctcatatatgcttccctgcaccatttttttataagagaatcttaattaaatccttttttgcgtattccacatatatacgtaagattgatatgaaagttattaataacctgattctcaaatagagtatgttggccctaatagcacttgcgtattctgtagatcttcgaatctcaagctccacaccctggaaccatatattcaattacatgtgtttttttagattattataatcatatattagaattggaaatgaaggacttgcctcgatcttttcttttttagcaacagaatcccagtctttggctctgatacccatcttccaatcaagactgacgataacagagctattgactgagtgatgtgactggtcgtgatgcattgctaaacaagctaagaatgttccactctcgctcgttgtaaacgcagcctgaccgtgtgtcacgtttgctatcttgtacagttccttcccatatggagatgttacctatacattttaaccaaggcatatatcaacacacacaagtttatactatattttcactccaactatagacaacttataaaccaaattaacccttattttctcaatctattaatccgaaatctcttggtagaaaagttcatgtgaattttgtggttaactaattgatttttcctatacaaatctatcagcagtttaatgttgattttcgatctctaatttgagtgatcttaactcgtagtcaaattatttctatctcaaatatataacgtttgaccacacagtaacgaaattttcccggatgcatgaaatttacgaagaaaaaatggagtatatatggttgatgtacaaacccgaacatctaatgttggaccaagttgagtgaaagcatcgtcgatgcaaatgtaatcaaggacaacgaccacgttggcttggatctcttcgtagacgcatctctctcctgattctggaaccgttaaccatattgcctccacccccggaaaaagagagccaccgccggcgaggtaaatcaaaccaatgaatagtaccggtgagatcgccattttcgagagagagaggtaagtttaaggttattgaaaaccaaaaaaagagagaagaggaacaagttcaaaggctattcacgttattatgcaagagaaggttttaagacattggcgcgtggagttaaagccatcgttgtatccaatcagtaagggccatgtaggatgtggtgaagattgtctacggagccgtttttggagtatttttacttttatggaaactacgtttaattttgaccaacaatatcatcttaataaggaagtaaatccaaacaaaatatcttcacattaaatgtccttcaaataaattttattttatttctcttttctgtcaactctagataacaacaactagatttttaggcattccaatggattgattatagacgtgtttcatttggaaatttactaatgtaaaaatattagagagaattgaccacgcaacccacaaaacatagtaaaccacgcttgaaaaagtgaatagccatgaattagtagctttaagtttagaccatatcatgcatttaagatccattaagtagattacgtaacgttcgagattaactgctcctaattcagtgataagattacactgcaacatttcctacgctaattatacttggggagaagatactttgtttttcggtgcattgatatttgtttgacaaaattgttcagaacgatgcaccatggaaaaatgaaatgtgacaccaaccaaacattatacttttatgattccaccaaaatcaactttacaaaacccacttctcgattaaaaaatgtcacactgtattaacataaaatattcaaaaagtccgacaaattaactcaagaaaaaaacacagagaaaaatgaatgaataaaaaaaaacaggaaaggaagcaactttcgtattattctcttccccacttgattgcgatttgagagagataaaggtcgagaaagtcttttcatctccttcaccctcatcgtttcgcgtctcttctcttctctctcagaaaatgctcatcagaaattgtctcctttttgtttccttgatgtgttttctcttctaatctccggtgaaacaaagaacaaaggattcataagacacaaagcagagaaggagagagagatacgaggcttttcttcatcttt

SEQ ID NO: 14726 - DNA, 3000 bp, Unknown
  misc_feature (1)..( 3000): cDNA_ID_2730683_gDNA_ID_2684220_Annot_ID_137436 3000 nt of promoter + ATG
taaaaaccacagagggaaacgatggccttttcaaggcatggcatattctggatggagaaattgcctcctaaagagtcaatgatgctaaggtaatttaatcccggggaatctataaccaatgacctaccagaaccatttttttcaagtgattgcgaatcaatgaaccttgtcacattgtcactcttatttcggatcaccaacaaatatctgagaacagggcaactcaataaaagcctaacatgagaatcttggtctttatacaccacattgacaaggagcagcgattgaagggacgggaggcaagccgcggaaggaacatcaacaagaatcttgcccataagattcaatttcacaagcgttttgctggtgtaaagcctcttactggcaggatctgagagaaaactaagacttagggttagctctctaacgtaccggtcaactgcattcgagacccactttccgacatctacatcaacaggacattgtggaccaagcatgatacgcaagctttctactgaaggtgccttgtgtagttgcaatgacttttctagcaagtcccaaatactctttccgccttcgttgctttctgtgtactcgagtttaggcaacatcgtccagagaaaacgccatcgtttcgacaaaatcatggtggtcaccgcatcttttgttgggattagacacagtatatgcaacagaaatcgtcaggcaaggcactgatcctgtcagacagctcgtttaaattttttccgatagatctccgcttctgatgacatcctttaagatcttgttcgtcagaataagaaagccctagtttgattacgtagatagaggcgagttaacattcttccgtagcaagataagttagtattgggctaggccttttaaaacaagttgaaactcgaatatgtttagaaaaaggaattgtgtcattgtacattgggctttttaaacaagttgggcttaagtccatgtttggtcaacactctatttcgggtattgtctctgtcttcctttagcggcggctttactttagattcttctagggtttctagattgtataccctagataagcatcctataaagtaaacacaagtacttgcagagactttagattagagggctagcgactgcagaagaagagtaacacgtcatctctgtgcttctttgtctacaattttggaaaaagtgatgacgccattgctctttcccaaatgtagacaaagcaataccgtgatgatgtcgtggagattttgttgagatgctacgagcgtgtaaatgtttcatgtttgttgtttgattttactgactgctgatttctttttttcttggatctcgctcaaaactagatcctcactacagagcataactgttgatttttcttattccagatcttgctctgaacaagggcatctaaagtcacagatgcgtgtgattattgttctagacttgcagacttccttcttttttttttttttgcaaatccagatttgttttctgaatggtgaattcgtggtccagtaaggttttgatacctttcaaagagataaacttaacagaacaaaattttgttaaatatcgtatcaattcgaaagaacaaaaatatggtattgaagaacgaacataaatagctaatttctcgtggttaacttcgaaggaaattggacgtgattatttctcataggacaacatgttcttgacactgtttaatgtgcaaacacaacaataggttagaagccctggtgtcgaactaactagtgtttctacatctccatggattttattattttaagctgagattatgtagaaaacctttgagatagaagtttagatgtagatgtaccaaacacaatcattatagcatgtttattagtatctctcaaatgagagaatgagacattatggttatcctaacccacttaggcatttaaccacacatgtatataaaaaaattcctaaccaaattaagatccggagattagtgtggattcaatccgagatcttctgcttaaaaaaacaaaccaaacaaaaaacagttcctccgattccgttgaagacatgcaaccaaatgatttggtatggtaggtgtatgaaaaaattattatccttatccaaatttcagcaaagaattaataatagcattatccaaagtggagaaacatctttatccaaaaaagaaaaagagaaaataagcgatagatgaacaggtggaacgaggttcgttcagtagtcgtcgcttctaatcaacttccacttcttccacggaaacaagcaattcgatcaaacgtgaaagcaatatttaagatttttgtctcatactctaagcaagcaatatccaaataaacattcttatacctccactcctcctctgtctgattccttcacccaattcttgtctcgtttccatcaatccattgtctttgattccagaggtttgtttctatttcttgttgattccaattcgggtttcttcattgtgcattctcttgtttatgtcatgattcttattctttgcttatcaaagctctatactttatgaccatgatttgagagattctctgaaaagatcacacctttgcctctgaatttgagaaattttagtttctctgtatctgtctggtttagttcttgaagccatttgtgatttaatgtctgaaggttttgactttatgagttgagattgaagccactcttgatttgcaacaagatttgtcattttctatcatagccttattttatagctttggcatcatatcttaaattgagaaagactctgccttgttgcagttccaatgaggacaagaaaaacagtaatgggtcctatatattctcatgtgtttgtcttccttttggtctagacaaactgataagtttctttttgtagctggtactttcttttgaggcttttttaaaaattatccaacggcttgaactgaattggattcaatgtttctacaaatgtctcttatatgtaggttcttggtttatttggatgtggtgatt

SEQ ID NO: 14727 - DNA, 3000 bp, Unknown
  misc_feature (1)..( 3000): cDNA_ID_2730679_gDNA_ID_2684220_Annot_ID_137437 3000 nt of promoter + ATG
caaaagcgaccgatcctagtgcaagacttcagttaacaacaaccaagaaagggtcaatatggattgaccaagtctcggccatgccagtggatactcacaaggttcttttttcgctctctctgattccctgtagagccttgagatggaagattacagattgctaatagagaaaatattggaagaagaactctatcaaatactcgatctttttggttgattgcagggacatggttttagaaacgatcttttccaaatgatggccgatataaaaccccgtttcatccggttcccaggtacgtattatttaaggctagtagcatttttgttacttattctatccatagacgtacctcttagttcaatatgacaaaaagcatgacttaagatgaaataagctaaagtctattctttactctggatatttgtgaatttaggtggttgttttgtcgagggtgaatggttaagtaatgccttccgctggaaagaaaccgtaggaccttgggaagagagaccgggccattttggtgatgtttggaagtattggaccgatgatggccttggccactttgagttctttcaagtgagacttcttcttttctattgagtacataatgatccccgaagctcgttattgaatattaaatgaacattcttgcagatggcagaagacatcggtgcagccccgatatgggtgtttaacaacggtattctttcactctccaaaaacttagttgtaactgacttatatcattttgtcttccaattctgtcaaccttattttttactttgtgcagggataagtcacaatgatgaagttgaaactgccagtatcatgccctttgttcaagtatgattactaaaccttcctctgtttcactagtgaagaagccggaaaaccaaaactttctcctctttttgtttcaggaagcactcgacggtatcgagtttgcccgaggagatgccaattctacttggggatctgttcgagctaaaatgggacgccaagaaccttttgaacttaaatacgttgctattggaaatgaagattgtgggaaaacttactacagaggttttgcatttctctatgatcacatcttgacttagatttttgttgagcatctttgacactaaatgagattacaactttacaggaaactacattgtgttctatgatgctatcaagaaagcctatccagatatcaaaatcatctccaactgcgatggatcctctcatccactcgaccacccagctgattactatgactatcacgtaaaattttctatcttgacagaaactgtaaccgttgtcttgtgttctctcttccgcctgaaaaaagtgtttcctttttgtcacagatttacacttctgctagcaatttgttttccatgtatcatcaatttgatcgcacttcacgcaaaggtccaaaggtgcggtaatagattataacaaaacttaattccaacaaacacaagatgaagctttcagcgttttactcactcgtgaactttgtttacaggcttttgtcagtgaatatgctgttactggaaaagatgctggtacaggaagccttcttgcctctcttgcagaagctgcgtttctcattggtcttgaaaagaataggttccctttgaatttctcttcccaggctttgatctcaactaaaaacatcaaataagttaaacatcttatgactttttgcagtgacattgttgaaatggcaagttatgctccactctttgtgaacacaaatgatagacggtatctctcacttacttttccgttcgaatggttactcaggaagataaggcaataatctcaaattgttaaattggtttcaggtggaaccctgatgcaatagtcttcaactcctctcatctatatggaacacctagctattgggttcaacggttttttgcagagtcaagcggagcaactcttctcacttcaacactcaagggaaactctacttctcttgttgcatctgctatctcttggaaaaacaatggcaaagattacatacgcataaaggtaaaccgagtgaaagattcaaccggagctctgatattgaccctaaaaaactgtttcaaaatctgttatttgcaggctgtaaacttcggagctaactcagaaaatatgcaagtgttggtaactggattggacccgaacgtgatgagagtttcgggatcaaagaagacagtacttacctctaccaatgtgatggatgaaaattccttctcacagccagagaaggtaaaaatcaagagatggaagaaacatcattatcatcacaaattctgagtgttcccatgttcttattggtttttatttgcaggttgtaccacatgaaagcttgctagagttggcagaggaggatatgaccgttgttctcccgccacattccttttcttcattcgatttgttgaaggaatctgcaaagataagaatgccaatctctgattcttcttcccatcagaaaactaccactgtgtgaagagaaacaatgacaaggaagtatcaactttcatgtcaaaagtctctttgtggttcaaatctaattacattccataaatgcttataacgtacccttgtgtatatataataatagtctggtgaataaatttactttctttaatcatgagcttatctcgactctagatatcttgatatgcaagaatgatgaagcaacagtttcttcttagcataaaagaagatgacgaggcgtgaaagtgggctgggccattttatttccattattgggcttttaaaagcccatcataatgaattttgaaaaaaatggaggagcatcaaaacaaataaaaatggcgaaactgaagaacacacgattcagattttcaaaattgaattttgtagtgatctctctcctatataaacttcctcactcttcttccatttcaaatctctctctctgtagtcaaaattagggtttatttattcataaggaagagcatttcgaattctgtagttcaaaattgaagatc

SEQ ID NO: 14728 - DNA, 3000 bp, Unknown
  misc_feature (1)..( 3000): cDNA_ID_2686679_gDNA_ID_2684220_Annot_ID_137438 3000 nt of promoter + ATG
tatttattcataaggaagagcatttcgaattctgtagttcaaaattgaagatcatgtcggcgtcaacggtgtcaatcaccgctagtcctaggacaataaggcggacgccggttctctccggtgagaagaaatctaattttgatttcccgccgagcgaatctcatgccaatgcggcaattggagagtcgtctgctggtacgaacaaggatctgattcgcgccgaggctgccggtgagagatccaacacctacgacgtaggtccggtgacaaggaaatcaggatccaccgcgacggggactaatacaaccaccacgcagcgtcggacgcggaagtctcaggggaataagatagatagagggaaatggaagacagtggttagggtattcgcgaagcaatttggggctcttttgttacttgttggattgattcagttgattaggaaattgactttgaaggattcgtctctgtcttcttcgaatttcccaattgaaacggaaatggtgctttcggaattggagagtcggatttctgcagttgatggtttggtgaagactacgacgaagatgatgcaggttcaagttgagtttcttgataagaagatggatagtgaatcaagagcattgaggcagacgatagattccacatcttctgtgttacatagtgagttgaagaaggtagagtctaagacagagaggttacaggtttctgtagatgagttaaatgctaaacctttggtgtctagagaggagttagagagagtttacgaggagttgaagaagggtaaggtcggtgattctgatgttaacattgataaactgagggcttatgctcgtgacatagtggagaaagagatagggaaacatgttgcagatggccttggtcgagtagattatgcgttagcgtctggtggagcttttgtaatggggcattcggatccgtttcttgttggaaatgggcgtaattggtttgggacaagcaggagacgggttcatagcaaagcggttaagatgttaactccgagtttcggggagcctggacagtgttttcctctgaaaggaagcaatggatatgttctagtcaggctaagagcaccaataattccagaagctgttactttggaacatgtctctaaggtagtactaacatctcaatactaaactttcacaaaatgattgatttttatatgttaatttgagccttcaagaagggttctctgttaaatgttgttggtattgagatgccctgtacttcggattggattgctggtgacaataggttatcgaatagagggcaagaaactagttttgtgaatttgagttcttatagtttgaggtttagtttaggcactagctgtgacaatatgcattgaggaggattttacctattgttattttctgcaaatcactagctttagcagttcctttgtctaatatcaatgccactgtgttgttgtgctttgtttgggacatcgttgacagagaaaagaaccgtatgtatgggaagagcttgtaagtttacaattagtggaactgtaatattcactgtttacggatatccttaggaaacagtagctgaagggaaatagtctcaagagtgtgtaatgtgatggtcacacattgctttccatcattgttcatccttgtgatcatttgtctgataaatttcttcttgtctgaccactaaaaggcaatactaatcttacggttatgttatgcaccatttaatcgaacaggctgtagcatatgacagatcgagcgccccaaaggattgccgtgtatcaggatggctaggtgacatagatatggagactgagacaatgccccttcttacagaattcagttacgacttagacaggtccaatgcacagacattcgacattgcagactctgctcactcaggacttgtcaacactgtcaggctagacttcaattccaaccatggaagctcttcacacacttgcatctaccgcttcagggttcatggccgtgaactagactcagtctctgttgctcatgcttgatctgaaagtccacgtcaaacttttcttctctttgtaacattccctctaatagatatctctcttctttttttgtgttagtttatgtggtgggaaagcttctcttagtctgtaatcagaatcatttggttgtattcgtgattattagcttcaaatctgttttggttcggtttatttggtcagggtatgtatcctccgaattgaataatatagatcttagtttgatgtccggttttggttttgtaacagagtttcaatttaagctttcacctaaaacaaatcatacaaattctaatagagtatacatatttcattagttgaaacaaatattgaatttggattattaatggttaccttgggtacttggtattacaacgatatgtgatgaataggaagagtgtgtatatagatggaccataacttgttagtgtgaattgcgtaatcgacaaagtgacgacttcttcttctaggctgcaccgtcttgccttgtctaaaagcttcccaacacatcacatgcaaaatctacggtcaaataatagatatgaaaccctcttccaagtcaacacagcttgtttgattataaattaaattaaatacaaattcatctttgacatgtctgattaatgttaattttttacagtgtcaactggcataacaaattgagctaaacaaaattaagctctaaaaatagccattttttacggttaaatcacatgaagaaacctttcctaaccaagtcaacccatgtttggtcgtcgtgacggtggaccaccggctccaaaaaaactcttcatttgaccaaaacgagtataacccttaattattagaccaacatgcattacataaatgataaattcagtttccctcgagcccatgcattcattaaatagcagaaagctcctcgtatagtctatatatatagcagattttagatccaaaataacaaacaccatcaatacacaaacaaaacaaaaaggatgaaa

SEQ ID NO: 14729 - DNA, 1744 bp, Unknown
  misc_feature (1)..( 1744): cDNA_ID_2034898_gDNA_ID_2684220_Annot_ID_191829 3000 nt of promoter + ATG
cttagtaatccactaccttctctaatcacatttgtttcttatcatatgcagtccttatggatactgagaaacaagggaagcagaaccattaccgctaactgtagaatctcattgcgtttcctttcaccaccactaaatccttcattgacatttctgttgagaaaatcggtcttcatattcacaacttcgagttttgataccaagtggctgtagaactgcatgagccatgtgatatcagtaagacataatacatagacagttctacaattgggaccatttagcaaacaacaacaagtaagaaacagtgcaaaccaaatccaagtcatttaattcgataaggcacctggattggatcaagctctggctgaccaagctttcttttccgagcattgaatgccatattcaagaaatccatattgctaacaccagggatctcaactggggactggaaactcataaagagaccggcaagagatctatcctctggttccatatcaagtagattctgccctttaaacacaatactccctcccgtcacttcataatcgggatgaccaacaagaacctacaaataataagactctcactaagataacaaacagaaagagaacaatactctgcagcatcaatgttaatcctgagatacaagatatacaaataaaatgttcaccttcgaaaacgtgctctttcctgaaccgttcttccccatcactgcgtgaacctattagcaaccacaaaagaagccatggattacaatcggcagcaatgcaaaacaaatccacacaaatagaattcacaagttatgatatcaaactcaaaactttatcatataatgagacagcactaccaggcaaagctttctgcaaattaaatttcaagtcttaaccataaaattgcattgattaatacgcacctctccttcgtagacaaccaaattgacgcctttcagtatctcttgtctcgattcagcaatcactgctctcaaatccctaacttcaagcaacgggatcctccccacgtcatcacgatcttccaccaacgaatccgaatcgacggctgaggatacggaagacgccgaaacaataactgaacggcgagtagttcgcaggattggagcggcggcggaattagctcggagattgcataatagaacacgagagggtgaagtcccgaggcgaactcgctgagtaggaagaggaggaggagaagaaacagttggaacgaattgagctatggagtatgcgtgacggagctgtaggttaacgccggccatggagacagaaattgcggcggaagaagacggtggaggttttatccggtgaagtgatgtggttagttaggtccagggattcttttaatttcacatgttgaatgccacgtaatatatatatcggctactagcttaattaaaatggaaacaaaaaaaaaatggaaataacaaataaaacgacatcactttgtgttgatacgcatattcttcaaaaccttaaaagcttctttccttgaagtacaagaaactatttacacatatgagaccttgggatgaagaaacagacaaagtccataccctaaagcaatcctaaacccataccgtaatctcaaaatctcttcttacctctctttctatcttatatacatcattcaaacattttttatgttttcatatacagtttgattcatttatttcgtaaaggctttgaactttttgtcctgatatagtgtgatctatatataaacatatatg

SEQ ID NO: 14730 - DNA, 3000 bp, Unknown
  misc_feature (1)..( 3000): cDNA_ID_2034901_gDNA_ID_2684220_Annot_ID_191828 3000 nt of promoter + ATG
agcacgccatctccatcgaaggaaaaaagtatctggggtacttatgccagaggagcagtttatgcgttacagagcagcaaaaagaatctcaaacaggtaacaggttcaaatttggtcttctggttatagctatagataaagtttaccattaatgggaaatgaggtttagcctgcacatttgctgtgtgatcttctggggttccacatttacccttatttggttgccatacctgatcttttaggccttgatttccccataatagttgacataattgtatttaatggaaaaggtatttgaatatgtttctaagtaattgttttgatctttgaagggcattattggttacctcagtggctcaaatggactagatagctccgggcttagctcatcagctgctgtaagtaactgaatcccgcctgtttttgtacagcagaaatttctccggaaagacaatttttactgctctttaatagtaactaaacatttttagcatatgagagtggtgtttacttgtcatttttggaaaatgaatcttgtatattattttatgatcgccagaaatgtgacaggttggtgtggcatacctgctagctctagagaatgcaaacgaattgactgtatccccaacagaaaatatcgaatatgacaggtatattcccttctaatgtaaccaagaagctcttctgtattgcttcatgagcagttgtttctctgtgaaaccagcaattagtgctgcaaattggtcaatttatatgtgacttactgcgtctgcaggcttattgagaatgggtatctgggtctgcggaatggaattttggatcaatcagctattttgctttcgaattatgggtgtctaacatacatggactgcaaggtaaaattccttgatttgtaagtgatatagtgtgcaaaaaagcaagaagcttgttcatgtggcaaaaccaagactgttcaatgggatgcctaagatgtttttgatctctaaactgaaaatgactcacgatcaaatcagatctacaacattctcattgctttcacgagaaaataagtgtttaatcttttcaattgcttcgattttaatgtatttcaatgctgagttcacttcttcctaaaatgaaaatgaatggttagaatcaggaggccttgaagaaatccttcctaaccagccatagatagggaaactttattttcttccagaaactgccatctcagaaaaactgtttgaaatatgcagactttggaccacgagcttgtacaggctcctgaactggagaaaccgttcaggatattgttagcattctcaggcttgaggcaggcgttgaccaccaacccaggatataatctgcgagtttctgagtgtcaagaggcagcaaaagttcttttgacgtatgtgcaaatctgtttgattcatatttatctacattttcgcttatttagatttaaatttcagtggaaatgctgcaaagtttatttctctattgcttgtgatactcatttttctgcatcacaagattcacacccttctcttgatttactttttcttttcagtgcatctgggaacagtgagctggaacctacgttgtgcaatggtaaaaaaactttaagtgtggactttaacttattcgttgcatgctgattagtttttctttgttgccatgtctctaactgtcccactgaatagttgagcatgcggtctatgaagctcacaaggtaagaaaataagattcttaagcttttggtaaaacaggttccacctatatcaggcctatgtaaatatgtaatacaataatacttgttcgtgcagcatgagctgaaaccggttttagctaaaagagcagagcattatttctcggagaacatgcgagttatcaaaggcaaatgttcttgaattcttgtagatgtctctttatgtgcatgaatgattcattaagctctttatgatgcttaacggacttttatgaatgtttgttcttaaatttcaggacgggaagcctgggcttcagggaatcttgaagaatttggaaagctaatttcagcatccggcttgagttccattgagaattacgaatgcggtacattacactctcttttcttctctcccaaatgcaacatatcctatagtgaatacagaccactagtatgcttacagacattattctctcttagattcattattttggttttaaattctgtgagttttgtgaaggtgcggagccactgatccagctatacaagattcttctgaaggctcctggtgtatatggagctagattcagcggtgcaggtttcaggggatgttgtctagcctttgtagatgcagaaaaagctgaggcagctgcttcatatgtgaaggatgaatatgaaaaggcccaacccgagtttgctaacaatctaaatggaggaaaacctgttctcatctgtgaagcaggtgacgctgctcgtgttcttctctgatcaatcctggagtttttggtttcttccccacttaaactcgatttttttgtcccttatatctctcacgcttattgattctttgcttgtttatctctttttgatcctgtctgagaaattctctggtctctttggtcggagtttcatcattgcttgatacattttttttgctacaaatacataatgtaaatcattctctaccgttttcgagtcgatagaagaatcgcaaacttcaaaaatgtgactaacatttctccataaatttgttaaattttcaacaattggtgaatttagttctgtaattgatctaacaaagacactatacaagtatgaaattagaaattgaaatcgaaagttagttattataatcttgtttgtataaaatagtgtatatctcaaatagagatacagattagttttttgtttggacacaaagacccccgccaaagtattgaaattcgcgcctgagaaattctccggtgtggctctctagggttttagcactttaatccatttgtacttgtaaaaatccctaaaaccctctgggc

SEQ ID NO: 14731 - DNA, 3000 bp, Unknown
  misc_feature (1)..( 3000): cDNA_ID_3041159_gDNA_ID_2684220_Annot_ID_191827 3000 nt of promoter + ATG
tacgtccttgagccgtgattgtgttttgttgtcctttcattggtcggcgagggagaatccggcagctttggagaactgaagctgagttaccaaagatgaaatctactgttccgataatggtgcattcacggtagaattggcgttgtgcatgaacgtaaagcgtgtcttggtatgcgttcatcgtgcaacggtaaaatgctgtgagatctgcgcttaccattagagcaacagcttgatgtttggatggaccagctgtgttgatgaagcccatgtctcttgccataaacccttttccaaacacagctgcagaaaacagagcatgtcaaaaaccgatttcttgggttataagtaatgatattatgttcggttttctagttgatattatttcagaataacgttaccaatcataattctaaacattatatctttgatttatgagattatttagtctactttgatattattaggccataattaaattaatgaaacaaccaagtcgtgctatttcgaaatcctctgtttccaaaagtaaacaagaagaaaaacaaaaacagagagaggtttaccgaatgtggcggtcttaaaagtgggagttccatcgatgacattaagtctaccagagacaatactcttgctctcgccatctccaaccacaataacattccacatcttcttctccaccttcacattctcaaaataaactcctttcttcacatatataatcgtcctcttctcactcttctctggcacatcttgtaaagccctctttatcgttctatacttccctgaaccatccttcgccaccacaatatccgccactttcctcaaatccgtgctctgcaacaatctccgacccgcgtggaagtccacctccacgtctgcagttgttaacaaacgcctccggagtttgaaagagtcagcgatcttcccgagccatgtgatgatcgctagtgcgttactcgtcaactccgttgagttcttgagatgactttcgccgaacggcctcatatctggagccaacgtttccacgcacgtccgttgatacgtcccggctgaactcagccatgtacggagatcatcgactagctcaggaaccgtgacatcaccgtttgatgatgaggttaacgtgttgttgaggttatctatcgttaggtcaagaagctcagcgcaagcgttcatggtgatgttgttcttttcatcgcctaaggatgaagagaaagcgttgatagcttttgaaacttcggcgattgtgattttgactgcgtatctgaagagctcttctggattgagactgcttgcgtttggagctgatccgagggtttcgaagcatttttctttatgcaacgtaacgtcgcaaacggctttaacggaaacggagattgagtctccgttgttattagtctccactgtctctggtgacttcttgtgagccatggttccaaacacagctccgatcacgattccggcaagaatgactagtgatacagcgatgattgcgatgttctttctcgtcttacgacgagcttcgagccttacatgttcacgctcgtcgactttgccgtaaggagaggacatatttgtatcctccgtccctcttttctaatttttctttgtattcttttgaagtttctcgttagttatgtttggtttgtagatgttggagttggagggtccatataaagacgaaggaaaaatataatcatttgaatagacctctaacaacttacgtgcgaggcacaaagggggattataaatcttcacattaaaataccaaggatgtatttaactacaagtgctcctcatgttttagtcttttatgttaatataagcttgtcggtgaaacatatttgtttaagattgggcactatgttttctgttggatttcagcttcggcatgtttcttggtttaacgaatttattttttcaaggagttctatctctagtttacaaagtttggaagtatatattcaacttgatgttatgtttatgatttgtggttcaattcattctcggtttcttcttttaatatgattatattttgaaaaaaagaagaagaagatctttctatttatatgtttatttaatagaatctcttgaaatcctaatcagacattacaatattcatagggattataatgtcaactttggatagttagttaagtttgatataataaagctgtcaaagaatatttttactaaaaaaatttgagagcaattcatttgtttttcatctgacattgtcggcggatgtattctcctgcttccgtgagagagttttcaaaccttgttttgaccaattacatatactgatgatatacattgtacaacttcttgacccttttatttgaataatcttgacgctaagtcagaacatataaaattaaatcaagaaaaactcaaactgtaagtagaaggtcatctgatcaagaaagctcgcaaagaggtaatctggcgttggagaagagcttgcgttgtaagatcttatatatctgatgggttatatcttatatgagatcaagtcttgggtaaaaatgtaccaaggatcattgtacgtataaattgacattgatagcgagtatgagtatgagagatacctatatcacttaaagtgaacgaaattcatatggataacaaatgagatgagatcaatgttatctcgtctctttctatttgaaaatagttcaattagtataagcagacatattttttttgatttgaatcaatatatactactgtttttactaaactcaaccagtcatggaatagaaaagatggtgaaaataatcaaggcttttaactgaagggaaattaaaggtttaccaaacactaaccaaaaggatagaattagacgtgttaccaagcagcaccttatttggtcatcttcctcattcgaaggttactcgcacttcctctgcacacttcttcctctccatctaacctcagtactcctacaatcctctaagaatccatagatcaactgctgggaaaagcttcgcgaca

SEQ ID NO: 14732 - DNA, 3000 bp, Unknown
  misc_feature (1)..( 3000): cDNA_ID_2730675_gDNA_ID_2684220_Annot_ID_191826 3000 nt of promoter + ATG
tctataatttcagaacccgaaaagctattagcattatgcatagaagatcttcaattcctttaccaccatgacgagtacaaaattgaaatgcactaaggaaaacaaaaatacctttagaaaaggtaaaatagaatgcatgaaacagaaactagaaaatcatgcaagctcatccaaaacggatacttttgtatcccttacagcgctaagggtcttcaatttccaatgaattctagggaattatgagcaaacttaaaggttgaatctgataaatgtctaagacttaagtgaaagataagttcattttcatactaaaatgagatataatggaatgctggccagatcgaaatacttccacaatatccaaggtgcactttaccctatacggggcttagtaacaagcttatgcacgtctgaggatggatataaaagtttgaaaacactaacgacaagatgagagatcatgaaagatatgcacacctgaaacatacttctccttcaaattgtgcagagcgcaactggacctgcatataaattagaaagagaataaacggtacagagacttcaaggctcaagtgaaacacacagacacaaggaactttcccagctccgaaatatatgtttgtctcctgtctacaaaccacattcattttaaattatccaattctttaatgctttctcaggtcaggtgagaaacaaaaagagaccaggatactatattgtacacaattagaatctccatctactcttaagctgaaccaagcccagaatacggaatgctacttaagagaattgcattataccatcaacgagacattcatctaaaaattagaatggtgcttatttgcgcaagaatccaagcatgtcaaacatatgaatttgattgacaagttcacttataagaaacgcagaggtataccaaaacacataagaatcatgataactaatacacacctgagtatcacccgatggaacaaaaccaagaaggatccctttattaatcgtcatagctgatacagttccaccctgtgaacaccaaagatgatttgaattcacaaagaaatggtatgaatcagactaactcttgtagttgaatcaaaacaatgattacatcgctacaatcagaaaccaacctggtgatcaatgtgagctcctaaaggacatatacgataaggagcgaccaccactcgaacttctcctttatctcttccactcatctgagccactgcctcctttatggaatttaactggagacataaatgaacgatctcgtaggattaacaccaaagccaaatttcgaaaacatccaaacacaaaaaacaaacactcgcggcaatctgcagcatatacattgagctccacacatagaaactaatgaaattgttcgatcacatgtgcgattgacaattcgccggggaaatggttaaccggaaaacacatctccgtcgctaattctaacgaaaattaacacagtggaggatattggcaccgagttaaccaacgataacaagcagattcgttgcgtaaatggaaaaaaaaatgaagaataacctcagaatccgtaggccaagacattgtcgcgaagcttttcccagcagttgatctatggattcttagaggattgtaggagtactgaggttagatggagaggaagaagtgtgcagaggaagtgcgagtaaccttcgaatgaggaagatgaccaaataaggtgctgcttggtaacacgtctaattctatccttttggttagtgtttggtaaacctttaatttcccttcagttaaaagccttgattattttcaccatcttttctattccatgactggttgagtttagtaaaaacagtagtatatattgattcaaatcaaaaaaaatatgtctgcttatactaattgaactattttcaaatagaaagagacgagataacattgatctcatctcatttgttatccatatgaatttcgttcactttaagtgatataggtatctctcatactcatactcgctatcaatgtcaatttatacgtacaatgatccttggtacatttttacccaagacttgatctcatataagatataacccatcagatatataagatcttacaacgcaagctcttctccaacgccagattacctctttgcgagctttcttgatcagatgaccttctacttacagtttgagtttttcttgatttaattttatatgttctgacttagcgtcaagattattcaaataaaagggtcaagaagttgtacaatgtatatcatcagtatatgtaattggtcaaaacaaggtttgaaaactctctcacggaagcaggagaatacatccgccgacaatgtcagatgaaaaacaaatgaattgctctcaaatttttttagtaaaaatattctttgacagctttattatatcaaacttaactaactatccaaagttgacattataatccctatgaatattgtaatgtctgattaggatttcaagagattctattaaataaacatataaatagaaagatcttcttcttctttttttcaaaatataatcatattaaaagaagaaaccgagaatgaattgaaccacaaatcataaacataacatcaagttgaatatatacttccaaactttgtaaactagagatagaactccttgaaaaaataaattcgttaaaccaagaaacatgccgaagctgaaatccaacagaaaacatagtgcccaatcttaaacaaatatgtttcaccgacaagcttatattaacataaaagactaaaacatgaggagcacttgtagttaaatacatccttggtattttaatgtgaagatttataatccccctttgtgcctcgcacgtaagttgttagaggtctattcaaatgattatatttttccttcgtctttatatggaccctccaactccaacatctacaaaccaaacataactaacgagaaacttcaaaagaatacaaagaaaaattagaaaagagggacggaggatacaaatatg

SEQ ID NO: 14733 - DNA, 3000 bp, Unknown
  misc_feature (1)..( 3000): cDNA_ID_2730679_gDNA_ID_2684220_Annot_ID_191823 3000 nt of promoter + ATG
tgtcgagggtgaatggttaagtaatgccttccgctggaaagaaaccgtaggaccttgggaagagagaccgggccattttggtgatgtttggaagtattggaccgatgatggccttggccactttgagttctttcaagtgagacttcttcttttctattgagtacataatgatccccgaagctcgttattgaatattaaatgaacattcttgcagatggcagaagacatcggtgcagccccgatatgggtgtttaacaacggtattctttcactctccaaaaacttagttgtaactgacttatatcattttgtcttccaattctgtcaaccttattttttactttgtgcagggataagtcacaatgatgaagttgaaactgccagtatcatgccctttgttcaagtatgattactaaaccttcctctgtttcactagtgaagaagccggaaaaccaaaactttctcctctttttgtttcaggaagcactcgacggtatcgagtttgcccgaggagatgccaattctacttggggatctgttcgagctaaaatgggacgccaagaaccttttgaacttaaatacgttgctattggaaatgaagattgtgggaaaacttactacagaggttttgcatttctctatgatcacatcttgacttagatttttgttgagcatctttgacactaaatgagattacaactttacaggaaactacattgtgttctatgatgctatcaagaaagcctatccagatatcaaaatcatctccaactgcgatggatcctctcatccactcgaccacccagctgattactatgactatcacgtaaaattttctatcttgacagaaactgtaaccgttgtcttgtgttctctcttccgcctgaaaaaagtgtttcctttttgtcacagatttacacttctgctagcaatttgttttccatgtatcatcaatttgatcgcacttcacgcaaaggtccaaaggtgcggtaatagattataacaaaacttaattccaacaaacacaagatgaagctttcagcgttttactcactcgtgaactttgtttacaggcttttgtcagtgaatatgctgttactggaaaagatgctggtacaggaagccttcttgcctctcttgcagaagctgcgtttctcattggtcttgaaaagaataggttccctttgaatttctcttcccaggctttgatctcaactaaaaacatcaaataagttaaacatcttatgactttttgcagtgacattgttgaaatggcaagttatgctccactctttgtgaacacaaatgatagacggtatctctcacttacttttccgttcgaatggttactcaggaagataaggcaataatctcaaattgttaaattggtttcaggtggaaccctgatgcaatagtcttcaactcctctcatctatatggaacacctagctattgggttcaacggttttttgcagagtcaagcggagcaactcttctcacttcaacactcaagggaaactctacttctcttgttgcatctgctatctcttggaaaaacaatggcaaagattacatacgcataaaggtaaaccgagtgaaagattcaaccggagctctgatattgaccctaaaaaactgtttcaaaatctgttatttgcaggctgtaaacttcggagctaactcagaaaatatgcaagtgttggtaactggattggacccgaacgtgatgagagtttcgggatcaaagaagacagtacttacctctaccaatgtgatggatgaaaattccttctcacagccagagaaggtaaaaatcaagagatggaagaaacatcattatcatcacaaattctgagtgttcccatgttcttattggtttttatttgcaggttgtaccacatgaaagcttgctagagttggcagaggaggatatgaccgttgttctcccgccacattccttttcttcattcgatttgttgaaggaatctgcaaagataagaatgccaatctctgattcttcttcccatcagaaaactaccactgtgtgaagagaaacaatgacaaggaagtatcaactttcatgtcaaaagtctctttgtggttcaaatctaattacattccataaatgcttataacgtacccttgtgtatatataataatagtctggtgaataaatttactttctttaatcatgagcttatctcgactctagatatcttgatatgcaagaatgatgaagcaacagtttcttcttagcataaaagaagatgacgaggcgtgaaagtgggctgggccattttatttccattattgggcttttaaaagcccatcataatgaattttgaaaaaaatggaggagcatcaaaacaaataaaaatggcgaaactgaagaacacacgattcagattttcaaaattgaattttgtagtgatctctctcctatataaacttcctcactcttcttccatttcaaatctctctctctgtagtcaaaattagggtttatttattcataaggaagagcatttcgaattctgtagttcaaaattgaagatcatgtcggcgtcaacggtgtcaatcaccgctagtcctaggacaataaggcggacgccggttctctccggtgagaagaaatctaattttgatttcccgccgagcgaatctcatgccaatgcggcaattggagagtcgtctgctggtacgaacaaggatctgattcgcgccgaggctgccggtgagagatccaacacctacgacgtaggtccggtgacaaggaaatcaggatccaccgcgacggggactaatacaaccaccacgcagcgtcggacgcggaagtctcaggggaataagatagatagagggaaatggaagacagtggttagggtattcgcgaagcaatttggggctcttttgttacttgttggattgattcagttgattaggaaattgactttgaaggattcgtctctgtcttcttcgaatttcccaattgaaacggaa

SEQ ID NO: 14734 - DNA, 3000 bp, Unknown
  misc_feature (1)..( 3000): cDNA_ID_2730683_gDNA_ID_2684220_Annot_ID_191821 3000 nt of promoter + ATG
ccacagagggaaacgatggccttttcaaggcatggcatattctggatggagaaattgcctcctaaagagtcaatgatgctaaggtaatttaatcccggggaatctataaccaatgacctaccagaaccatttttttcaagtgattgcgaatcaatgaaccttgtcacattgtcactcttatttcggatcaccaacaaatatctgagaacagggcaactcaataaaagcctaacatgagaatcttggtctttatacaccacattgacaaggagcagcgattgaagggacgggaggcaagccgcggaaggaacatcaacaagaatcttgcccataagattcaatttcacaagcgttttgctggtgtaaagcctcttactggcaggatctgagagaaaactaagacttagggttagctctctaacgtaccggtcaactgcattcgagacccactttccgacatctacatcaacaggacattgtggaccaagcatgatacgcaagctttctactgaaggtgccttgtgtagttgcaatgacttttctagcaagtcccaaatactctttccgccttcgttgctttctgtgtactcgagtttaggcaacatcgtccagagaaaacgccatcgtttcgacaaaatcatggtggtcaccgcatcttttgttgggattagacacagtatatgcaacagaaatcgtcaggcaaggcactgatcctgtcagacagctcgtttaaattttttccgatagatctccgcttctgatgacatcctttaagatcttgttcgtcagaataagaaagccctagtttgattacgtagatagaggcgagttaacattcttccgtagcaagataagttagtattgggctaggccttttaaaacaagttgaaactcgaatatgtttagaaaaaggaattgtgtcattgtacattgggctttttaaacaagttgggcttaagtccatgtttggtcaacactctatttcgggtattgtctctgtcttcctttagcggcggctttactttagattcttctagggtttctagattgtataccctagataagcatcctataaagtaaacacaagtacttgcagagactttagattagagggctagcgactgcagaagaagagtaacacgtcatctctgtgcttctttgtctacaattttggaaaaagtgatgacgccattgctctttcccaaatgtagacaaagcaataccgtgatgatgtcgtggagattttgttgagatgctacgagcgtgtaaatgtttcatgtttgttgtttgattttactgactgctgatttctttttttcttggatctcgctcaaaactagatcctcactacagagcataactgttgatttttcttattccagatcttgctctgaacaagggcatctaaagtcacagatgcgtgtgattattgttctagacttgcagacttccttcttttttttttttttgcaaatccagatttgttttctgaatggtgaattcgtggtccagtaaggttttgatacctttcaaagagataaacttaacagaacaaaattttgttaaatatcgtatcaattcgaaagaacaaaaatatggtattgaagaacgaacataaatagctaatttctcgtggttaacttcgaaggaaattggacgtgattatttctcataggacaacatgttcttgacactgtttaatgtgcaaacacaacaataggttagaagccctggtgtcgaactaactagtgtttctacatctccatggattttattattttaagctgagattatgtagaaaacctttgagatagaagtttagatgtagatgtaccaaacacaatcattatagcatgtttattagtatctctcaaatgagagaatgagacattatggttatcctaacccacttaggcatttaaccacacatgtatataaaaaaattcctaaccaaattaagatccggagattagtgtggattcaatccgagatcttctgcttaaaaaaacaaaccaaacaaaaaacagttcctccgattccgttgaagacatgcaaccaaatgatttggtatggtaggtgtatgaaaaaattattatccttatccaaatttcagcaaagaattaataatagcattatccaaagtggagaaacatctttatccaaaaaagaaaaagagaaaataagcgatagatgaacaggtggaacgaggttcgttcagtagtcgtcgcttctaatcaacttccacttcttccacggaaacaagcaattcgatcaaacgtgaaagcaatatttaagatttttgtctcatactctaagcaagcaatatccaaataaacattcttatacctccactcctcctctgtctgattccttcacccaattcttgtctcgtttccatcaatccattgtctttgattccagaggtttgtttctatttcttgttgattccaattcgggtttcttcattgtgcattctcttgtttatgtcatgattcttattctttgcttatcaaagctctatactttatgaccatgatttgagagattctctgaaaagatcacacctttgcctctgaatttgagaaattttagtttctctgtatctgtctggtttagttcttgaagccatttgtgatttaatgtctgaaggttttgactttatgagttgagattgaagccactcttgatttgcaacaagatttgtcattttctatcatagccttattttatagctttggcatcatatcttaaattgagaaagactctgccttgttgcagttccaatgaggacaagaaaaacagtaatgggtcctatatattctcatgtgtttgtcttccttttggtctagacaaactgataagtttctttttgtagctggtactttcttttgaggcttttttaaaaattatccaacggcttgaactgaattggattcaatgtttctacaaatgtctcttatatgtaggttcttggtttatttggatgtggtgattatggat

SEQ ID NO: 14735 - DNA, 3000 bp, Unknown
  misc_feature (1)..( 3000): cDNA_ID_3018838_gDNA_ID_2684220_Annot_ID_191818 3000 nt of promoter + ATG
agatctatcggaaaaaatttaaacgagctgtctgacaggatcagtgccttgcctgacgatttctgttgcatatactgtgtctaatcccaacaaaagatgcggtgaccaccatgattttgtcgaaacgatggcgttttctctggacgatgttgcctaaactcgagtacacagaaagcaacgaaggcggaaagagtatttgggacttgctagaaaagtcattgcaactacacaaggcaccttcagtagaaagcttgcgtatcatgcttggtccacaatgtcctgttgatgtagatgtcggaaagtgggtctcgaatgcagttgaccggtacgttagagagctaaccctaagtcttagttttctctcagatcctgccagtaagaggctttacaccagcaaaacgcttgtgaaattgaatcttatgggcaagattcttgttgatgttccttccgcggcttgcctcccgtcccttcaatcgctgctccttgtcaatgtggtgtataaagaccaagattctcatgttaggcttttattgagttgccctgttctcagatatttgttggtgatccgaaataagagtgacaatgtgacaaggttcattgattcgcaatcacttgaaaaaaatggttctggtaggtcattggttatagattccccgggattaaattaccttagcatcattgactctttaggaggcaatttctccatccagaatatgccatgccttgaaaaggccatcgtttccctctgtggtttttacccgaatgacaagtttctgacatctttctcctctgtcaagtatctctatttggctcatatcaaggtaattaaccaaccattttgatacccttctctcgtaatatatcttattttcttcgtgatactatcgctgcgtttaattacttatgttgtgttctgcttcgttcaagtgcaggttgcgagttgtagcaccattaacttctctcggctcatagagtttcagttgtatccttcttcctcagagtattggatggagccacttatgcttttgcttcataatgctcctaaactaaaagctcttctaatttttctcttctactttttctcccttctctccttctcttctactttttctcccttctctcataccttttttttttaattttttttttctttttttgggtatcttattgagatacttccaatggagatgctattaggatcaactctgtaaatatctctcttgaaacgtgtttaattagaattcttccttctcagccttttattgatcatgttccactttcttggaaccaaccaagttctgtaccgcgatgcgtgttgtctcaccttgagatcttggagtggaaactctttgaaggaaggagagaagagaaacaacttctggcttacatcctcgaaaactctgaagtctttgaagacggtggaaatctcactgatacctttcacgaatgttgaagagaaaaagaagataagggaagagttagagtctatgtatagggtttcagcatcatcgcagcttctgctcaatatgcgatatatgtagaaattgaaaaatgagcactattcagccggaagaagatccactacgttccttgtaaagattcatcatattatcatgtctggtccaacctcaaaatccatttcttagatgataataatattcttcttggaaggacggctagctagctgcttgatggtaattaatattctccttctctatctcgctaatttgctagcttactaattgttttcatggtattttgccaattcttcattttacgattcttatgatatgcagacgattgatggtctgtcttttcataaatagatgcacatcttctaagcaagcaaatatgttttgacttttgagataaagaatatcaaatgactttgtttttggtatctttacaaggaatggatcaataatcagagagttaataactttttcattgttgttaaaccaaaagatgatgatattaatgactattctttttaatatgttttcagtttcatcaattttgaatattcatattatatcattgaatgttcttgtctttgcttgcaagcgaaaccaaaactgggccttcaaatttctctaaaaacataattatttattgacaatgacatgctaacagtatcacgcatttctatactatgttctaactacataaaatagactatagaagaaaactgaataaaagaaatatgttaagccaagtatacacgtttttattgccaaagattgttgatgttattatgtttccaaagtccaaaataacacaccgagtcatcataacttatacactgatcaacattagtaaatcattcttctctttatcttgatcagtgtcttaatcaaagattagtagtagattttagtttattagaatactttccattttggagtctcacatccaattaaaaaaaggcaatcaaaagaaaggatcaaaccaaaccagttgaagtggttcaggttcacttcatcgattctaaagtggacaacacgcgccaaaagttatcgtcggtcgagtcttgacatgattgaaatctcccaaaaaactatgtaataaaattgaaaaataataatcagaactctcaaataaaatgtagatttggtaaagtactctcatcataaattaaagattgaaaaagctgagagtacccaaaaaaaaaaaaaaaaaaaaagctaaagatccacctcgaacttctctccatctttctcaatcatcatctaattctcagattccgtttccttcttcctttttcctcttcctcttcaagccacaaagactcataaaaatccaacctttttctcatttcctctgttaaatttttcctgaaaagtttattcctttttctacagatcgaatttcgtagttctcacctcactgaatctgttactttctctataatctaaatcttcaaaaatgtttctggttttgtgaaatcaacacttaaaaactcgagcttttacctcctctgttttttcaaagataaaaatg

SEQ ID NO: 14736 - DNA, 3000 bp, Unknown; identical to SEQ ID NO: 14725
  misc_feature (1)..( 3000): cDNA_ID_2730695_gDNA_ID_2684220_Annot_ID_191817 3000 nt of promoter + ATG

SEQ ID NO: 14737 - DNA, 3000 bp, Unknown; identical to SEQ ID NO: 14732
  misc_feature (1)..( 3000): cDNA_ID_2730675_gDNA_ID_2684220_Annot_ID_137439 3000 nt of promoter + ATG

SEQ ID NO: 14738 - DNA, 1744 bp, Unknown; identical to SEQ ID NO: 14729
  misc_feature (1)..( 1744): cDNA_ID_2034898_gDNA_ID_2684220_Annot_ID_137442 3000 nt of promoter + ATG

SEQ ID NO: 14739 - DNA, 3000 bp, Unknown
  misc_feature (1)..( 3000): cDNA_ID_2730800_gDNA_ID_2684223_Annot_ID_137493 3000 nt of promoter + ATG
accgaatacggatcaaaccgataaggataagaaaaaaaaagatattataaaacctaatttaaaccgtttcattatagatttggattaaaatgttaatacctataattttaaaaactctaaagacaaactaaatccaatctgaaatcagattaaacgctaaatttggatcattaatactacaattataaaattagttttttagcaaaataaaataaaatagattggtttacttgctaatcagattagatgtgtttgacatttttagcacatgtaactcaattctcgttttttgtctttgaaaaggaacgggattcgaaattggaaaaattcgttccaggatggagtctacggaacgatgtgcccaatcccaccggggaagaactacacttacgctcttcaggttaaagatcagatcggaagtttctactacttcccctctctaggatttcacaaagctgccggcggattcggaggtatccgtatctccagccgtgcattgatccccgtccccttccccactccggccgatgattacactctcctagtaggcgactggtacaaaaccaaccacaaggtattaatattctcctacatctcacataacaagacaaaatgattattgactttggagaatgagacaaagtgttcgtattttgaacaaataggcaatcatgcatgaatcatgatgtatgtaagtatgtaacgttgactcttttatttgattaatctttgtaaactctccttgtaggacttgaaggcacaactcgataatggtggaaaacttcctttaccagatggaattctcataaatggtcgtagtagtggcgccactctcaacattgaaccaggtattacccttcccctttgcatgccacgtttggtccttggtgaaagaataaatttataagtttattacgtgattttttctgtaggtaagacttatagactgaggatatcaaatgttggattacagaactccctcaacttccgaatccaaaaccatacgatgaagttggttgaggtcgaagggagatacactattcagaatcttttctcttcgcttgatgttcacgttggtcaatcttactcggtccttataacagccgatcagcctgcaaaagattattacgttgtcgtctctagtaggtttacatcaaagatactcactactactggagttcttcattacagtaattctgttgcacctgtttctggacctattccagatggaccaattaagttaagctggtcttttaaccaagctcgagctatcaggtattgttttattcttcaatttagtgacaattaccacttttgtatatatatttgcatttcatcagtgctagtggttggagaaaactatttcaagatcttaaaagttatggggttcgaagcagttcatttactagtatagatgatatttttgaatttttgcgctctaggcttacatcaaaagcaaaagctttgtagtttcacttgttgttggtttgctcacttcatggtgcaaacatgtttgtttcatggatatgatcttgtaggaccaaccttacagcaagcggaccaaggccaaacccacaaggttcataccgctatggtgtgataaacatcacccgaacgatcagacttgctaacaatcttggacatattgaaggcaagcaacgatacgccgtgaacagtgcatcattttacccagcagacacccctttgaaactagtggattacttcaaaattgacggtgtatacaagcctggaagtatatctgaccagcccacaaatggagcaatattccctaccacatctgtaatgcaagctgatttcagagcctttgtggaagttattttcgagaattcggaagatattgtccagagctggcacctcgacggttactctttctacgttgttgggtaagttaagaaatattatccaaattttgtcttttcttctcttagcacttatattcttgaaccttaaacatttatgtttgcattgttaataacaatccacacggtaatcaatctaaccaataaagtgttcttaggaaaaccgaaagttatgtacattttttagatgttgattaaatgaccgttataccaaccgtgtgcaccttgtctaactatcagaatggaacttgggaagtggagtcctgccagtagaaaagtctacaatctaaacgacgcaatcttacggtgcactattcaggtgtgggttctttaaactttaattttgatcagtacttggccataaaagttcagtctagttttatgtaaaacgtacttcattggacgaattcgtgtaggtgtatccgagatcatggactgccatatacatagcactggacaatgtaggaatgtggaatatgagatcagagatatgggaaagacaatacttgggacaacagttctacatgcgtgtttacacaacctctacttctctcagagatgaatacttgatccctaagaacgctcttctgtgtggcagggccagcagcagccacagatgagcgatatgagtggaatggaatatattgatagacttgtaatgatttgctaagtttatattttttatatatttttattttgggattcatgtttaagaaagtcttgaaagagctgtacggtgtaggcttttatcctgcgtagtatcaaattgttaggaacaaaaggcttcgtctctgaatagttagtattttactatttttagtcaatattacgacttggtgaattctgaaacctagtgagagtattacttctaaaatccagtatcttttggattttcgtttgtctttgagagtattactttgggaactaacttcttatgatattgtatgttcaaagatttttcaagtcaacaaaatataggtgtgaagaaaacgaaaattgtttgactgcatctttgaacatgttattcaactttgcatttccattaatatttttttctcccaaacatgacacaacacatatataaacgttgtcacatcctcttcgtcaaacataaaaaatg

SEQ ID NO: 14740 - DNA, 3000 bp, Unknown
  misc_feature (1)..( 3000): cDNA_ID_2730796_gDNA_ID_2684223_Annot_ID_137494 3000 nt of promoter + ATG
actaattgctcatatttaaaatattagcctgtacaacacatatcttagtggcattttcttcttaaaattcgtgaccacgtttttgttacgaaaatcgtaatatgcacatgacatggtaaagaatacataccgttaacaaggaatgattacctttcactgtacataattttttaagatcattgaatttatcattggacactaaaaatctttccttttttaaaaatgaaaaataacaattccaccaaaagtatcctaaaaactcaatgcctaactaaatcacattgttatttttcatgtgatttaaatattttggcgatcatcggggtacattctttctttcaaacctatagtttttcttaaatatggtgaaagattcatcaggaacaaaaagaatacgtaatccttttgttttgtctataatttttgagttgaatacatatatatatatatataagtaggaaattatgtacatttgtttataagaaaacgtaaggaaaatatgtacttttgtttatgaataagtaagaggttctagatacatacaatacactaaggcggattagatcatttaatatgactcctcccaggtaaatatgtacatttgtaaacataattttctttcatattgtctttatcgtcattttcctccatgaaaacacaataaacttttttttcataaaatctataaattcaagactaatataatttgattgaaagtatttattttaaaaataaaatccatatttgtttaacatcttcagttttttccataaaattattaaattcaaatgcctacataattcttttttacaactctatattctcagctttctttctaaaacagttgcacttgttgtaaacatgatatatatatatatatatatatatatatatatttttgaatataatttaacattatgttcaaaaaaaattagctatacaaattatggaaacttaatgcctaactaaatcacattaacatcatatattttagttattttatttttaaactatattgtttcaactttattggcgtttataacttaaaatttgtttcataataagttttggttatgtttttcaatgtagatgtttggttaaaaatttagttttttttaatgtcttcacgaataaaaaatcatagcatattaataaaaagaaaaacagaaattaattgtaattattttaatttgtctgaaaaactttaaacaaatataatttgaaaatgagggagtattaggtataataaaattatggaagaaggatacataagtacttgaaatatggatcaatacaatgatacaaaaaaacataaatatataatatatgcataaagaaaggagacaatttttgtaatgtcgatcaattacgcgctacaaatccagctaaatgctctgcagaacctttttataggaccaccattacctcgagggacgatgtatcgctcgttgttgagaggatcacatataatcttgcaagggttgtcacatatagctggagtcgctttctttgatgctttcatgcactggttcacgacacaatttttgacacacacatctatcgagttggaatgagctgaaaacatcattgcaaataaaattacaatcatcaatacacgacaaattttctttgacacttgaactgccatgtcgtaagtattgtgagtctgcaaatcttaaattgtaatgtttttggtgaaacgagatgatttggtgagaatgttggttgatgtggatgatttatatagtaaatatagttttagctgattttagaagtaactaactattaggaggtcaactttttttcgtctctttttctttggcaaatatatcgattgatttctggacaacttataaatgtgttatactgttttggtcatctaaacaactatttgctatgcataaatatagtaacattaatagctcatattaaaaatattagccagtacaacaagtatcttagtggcattttcttctttaaattcgtaaccacgtttttgttacgaaaatggtaatgtgcacatggtaaagaatgcatacctttcaattgatggctcgatacaatacggtggtggaacttgaggtaaaagaaaaaaaaaaatggaaagagtgaatttctacgtggagagggtcaaatcgtatctagctatcatacaataaactgaagaatttaatgtccaaaatgataaatagaatgatattagtccaatctgaaagtctttatttaaaaattaaaattcatatttctttaacaactccagttttcttccataaaactattaaattcaaatacctaatcaaaattacctacacaaattatttaaaatataatgcctgactaaaccacattaacattatatatttaacgattattttcttaaacgatattgttacagttttattgggggtttataactttaaatttgtttcataataagttttgtttatgtttttcaatgtagatgtttggtaaaaattctagtctctgttttaatatcttgacgaataaaaattattgaatatattaataaaaagtaaaacagaaaatgtaactattttatattgtctgaaaattttataaacatataatttgaaaatgatgaactattaggtataatgaaatgtagctagtttcctagaaattagaagatttgtttttctttttcaaattgacttctgataattagtatctttgggattctcattatgatatgtgtccatttcgatagatctgaaattatcattttgggaaagttaacctattatattgtaatattcgtaatatttagatttgtttctttgaaaccaataaaaaaaatagttcaaaaatattatagtttcatattcgaaaaagaaaattgttttatatgcatataattagccaaatcttaacatattatttcggtttgcatgccgatttggaaaacaatccatcaatatttttctcccacagcacacacatatatgaacgtttcatgtcctcgttgtcaatcataaaatg

SEQ ID NO: 14741 - DNA, 3000 bp, Unknown
  misc_feature (1)..( 3000): cDNA_ID_2730780_gDNA_ID_2684223_Annot_ID_137499 3000 nt of promoter + ATG
atcatcaaagtctaaagaaaaatctggttttaaacctagctatatgacaacttgctattgaatttaacattttaacatcgtggctcatcgctttgtgaattgtgagtaacttacgcgttaacaaaatggagatgtcgtacaaaacagtaattagtataaatacgtttgatagtattataatcatttggtaatctttaattatacaccataacgtaacatgttacataatacatacaaatgctattcaagaagaacgatatcgccttttagcatcttgttttcttacatcattaaacaacatgaattttgttagtaatatggaatacttacgaagaaaatgtcaataggaaatagtaaatgaaaatagcgaagagtgaagtcagaagagtgtgggagaaggtgatgatgctaaattgatgagtgacttcaaattacagctgttctcactctgtctcttttgctacccaaatccaaaccgcgttttctctcgtcagactcactcgtgtatttatcttcctaaattttgtaatctttaaaaaaaattaaaaaaaaattcatactatatcgaaaatatgatccaaatttataattacatcgttttctccacatacaacttgtgttattaaaattatatatatacatatatacacaatttgtctttgagtcattctattttagaatatagaaaatcaaataaagctcaatttaactcgttttgtcgagttaggatttcgaattctaataaattttgtcttacgtaactttaatatataccaacataatttatacgaacatatgctaaagattgatataaagtataaacaattgaaaaagggggaaaatataaaaataaataaataaagcatataaaactttaggacacgcaacgagcacatgatcgtatgtaagaaaagatgggagatgacatgttctttgtggacagccttgactttctcacaaagcttaagattaatcatgggatatggtactttaatttgttgtcttcgtctttagatttcacactttggtcttaagcaaaactctccaagatgtcagttcgataaagagagcgagaaagaatatgggcggattttgtcagctttccagccaaaacatgcgtttgcatgacgagaagaagcatctcgatcgtggcttctttcaattttaacttttgagttttaacacgtagcttatttcatatttgacacttactcgaatgtaatctcctcttttgaattttgaaaatgatacactaaactagaaatgcatcaattttataggcttttatgactaattgatgtcgagtggattgaccatgttcattatattttacgataggttttaggattgtcaagatgtttcacttacacatgaatagacatattcagacatgcaagcctaaagtaaaggctaaggcaagtaaacaaacattgcagtacaaacatatttgctttaacaaacaaacaaacaaacaaaaattaaaacaaaatggatctttcttgataaatggaaaatccaataaactgtatgtattaattggtggtaccgtactctctccgtaccagttcccaacaaatgactcaacaatatcaccacgatacaatctcaacctcaatagtttcaacatttattattggtgtactatttatcgtaacaaatttggaggattacaatactacagcgcatggcaaggaaatttcgaggaagatgaaatagtatacgttgaatgttttttgtttttcatattttttttcattaaagatgtacgttgaaggttcaaccatgtataatggatccagtgaactaggttcaaccaccaaatccttttcttttgtatatctcacagatctatgatttagtcggttttgaaaatgttaaaaatgatgtggggacataaaatatgatagaccccatacatatttgttttggtttataaattcatatataatttattttccgtttacataattcacaatatttttatgaattagatttatatatgactatgagacgaaaaatgactaagctataaaccccgatcacatatttgttcactctagcagaaatatatatatacatcttctctttgcatgttctcgaagtatttaacaaaattctctgtaaatagttagttatacaaacaggagggagcagaagaaacaagtaaagatctatcaaaaggaaaacaaaaaagaaaagaagtaaaggtaacaattccttatgggaagatgacaaataacaagcccaaagattatatatcatcagccatataaatactcgttggcccatttgaaagtcattttgtaatgggggcccatttatttcaatacgaaatattttaattccttcttttgttttatgtttgcatttacaaaaatcagcaaatattaattcatctattaatatgccacaaaaatgttatataaagttgtagactaacttagtataacacaaaaatgtgttttatgaaatgatttatctaatagcagggtattgttatacacaatttgtgatttaaatgataacaaaacaaaataaacccaataatttgttttcaattcaataagcctcttggttcaataatttctcattcaatgtttatacttgtaagttgtaatctttggctcaaattcttcactctacaaactatagacgatggtaaaattaaatgcaaaatccactttgagaggaaaataacaaaaatggtaaacggaaccctctaaatcattaagcaggtaaaggtcaacataatgacgcgccacctccttaaaagacacgccacgtagacaattcctcagaatctgattggctcatcttacgttgaaacaagtcaccgaaacccatcaaaatgctcttaaaacctcccacactctcacacgcgcgcgtggagtctctcttgtcttcgtttgtgtttggtttttttggactttgaccttccttggcttggacttgagaccaaaaaaaaaaaaaggagaagaagaccatcgttgttctccgatg

SEQ ID NO: 14742 - DNA, 3000 bp, Unknown
  misc_feature (1)..( 3000): cDNA_ID_3018908_gDNA_ID_2684223_Annot_ID_137502 3000 nt of promoter + ATG
tacctcaaaacaaagaaacaagaaacaaattaacctcctcattgttataacttctaaaaatcaattaattaatttattatttaaattacgtcgatcagaaaatgatactcagtaacaaacaaaaaacaaacaaatattatttcgataagaaaaaaataccaaaaccgaaaaaatacaaagcttgatcaagcttggctcttgaatgttgaaattaaaaaatttgggagactaagaaacaaccttaatctaagtgactgggctttgattgaattgggccgaattagtctactaaattcagtctcaaaagcgttgttctgcttttcttgttggtcctatgttcgcgtggaggattcaggatataataactactgtatgttatttatacgtgagtgtaatggaagaagtacactacataacataatgagtgtgcttcatgtactcttccatgattaaacctctaataattttactgtacatgctgcgtaagatgtgatcaaatgacaacttacataataatagaaaaaaagtccacgaataaaatacgttatcaatcatatatatccacgtaatgtactcaacccgaataagatttttgttttaaatatcatacgaatcatttcattcacttataaatttcttaaagttagcaacatttatctaaattgtatcttcaacattaatccacatcgcttatacatatactacaattaaccacacttgtttttatctatttcacttacctataatcgtcgaaaagtgttgagtctcataggttctttctacttcaaattatcagttagtttgatttttaccttttctatcaatgttatgtactatagactatatagtaaaaagaaaaatcatttgttgtatatttaatagattacaatttgacaagttaattaaagaaatgacttttcggatgtgtgataatttcgaaggtaacgactaaaatgcccacgcatgactctgttaccattagccagccttatcaaaagccgaaagttaaatggatgtgaatgaaacagactttgactttagatctcattgaaagagatgtttgcttagatgataatacccttttaatccattttataatccaacgttgttagcaataaagtagtctctaattaaaaattatcaagtggaaattatatcacagaaactataccatttttgtatgatttgactagtaagacaaaaggctgttatatcaaaaccatacaacgatttatatgtaacagtgtaaagtagtttttggttaagtgatgttgtttgaaatatgactaatctcggaggctaataacatcggctgcaccaaacgtggatgtttggttaaatgggttgttcacgatttgatttagatccaacctctctctttttatttagtttcttggccataaatattttgtttgaaaaatgaaaacaaattccatgtatagtaattaatcggtttcaacaatattgctggcagatcacccaccagatttcttaccaaaaaagaaaatgaatttaacgttgttgttgaatgttgatacacacaagttattactatatccatgaatagtagaaagctggcatacgaatgatgtttacgtatgtcatactatgaatactttaaattttagatcaatgactttatataattttattttaaccggaagattcatgtataacttaatttttcaaatttttttactccaaattaaggctaatctttctaaagtacttggctaacaaaacatcttaaggttagtattactttttaatgatttatttaattaatttttatcacaacgtaaattggtcaatcactattaaaaataatggaattttcgaaaaacgacaaggaagcaattagtggtatttttgccatttcccaatatttttagtaagattttttgttagccaagtatttttagcaagattagccttaatttggagtaaaatagaattgaaaaattaagttatacataaatcttccggttaagttatactaatcttaagatgtttaggttaatgatattttgaaagagattaaacaaaaatggtatttgataaattttctcaaaaaaaaaaacaattctctcatggaaactaaattaaatttaaattaaacaaaataagaaaaattaagtttggaaaatataatttatttctaagttattctaatcaaaatctgaaatgtgatgctggcatagggtggcataatctttgtttataaataatgtttaatttagataaacctcatccgatttgaataagaaaaaaatcttatgtgaaaaaaacaaatttgtaaatttcttttgatgtccaaatcagtttaatattgagagacaaaaataaatagaaactctgccaaaatgcagagattttattgttttctgtaaatcaatttagtaataagaaaaaaaaaaaaaagacttatgtcattgtcccacaaaaaaggctaaaaacgtaaatgaatatttatctgtgactgtgtaatgtagtggcacgtgccagctttacaaacagtaaagctaaaaaaccgttcatgtttggatccgtcgaccaatatattcccgtcatcaccggtgacccctctcttcctctccatccaacggctctccttcttctcttcacttaatcaaccgtcagattttaatccaacggtctttattaaatctaattttatctctttctctctttaaattaaacccaaacccggtctaatttctcttctcctatttctctcttctctctctctttaagtgagcttcgccgttaaactttctccggtaccgggaaattaacgaagaaagcgaaaagtcactgttacactaatatcacaaatctctctctgtctctctctctctctttgtcgaagtcgtgcgtgatgctagttacggtggtgaagcagcggttagtgtactctcgccggagaaattggttatgaccggaatctcacctccgtgatcgaagaaactgttttcgtttttttatcgttacgaagaaatg

SEQ ID NO: 14743 - DNA, 3000 bp, Unknown
  misc_feature (1)..( 3000): cDNA_ID_2730766_gDNA_ID_2684223_Annot_ID_137503 3000 nt of promoter + ATG
tgcaaaacttgcttgtaccaggtggcacaggcacaaggtatctttcttgaccactttgttgttgttcagtgcaaagttttttgcaagcatcctcgcacattataggagtagcgtttttaacttctttcaagcattggtttgagacacaatgtttaatacacatatttacattattcgaatgtgagatttgtgccgaaaacatcattgcgaacaaagttgtaatgattagaagatcgcatgttttcttcaaactttgagctgccataatgtatataaatgtagtgatattgattagaacaaatgttattagaaaacaagatgaattggtgatggatattgggttttgtttagatgatttatatagtgaagataatatttcctatttttaaaaattggtttttctgtttcttgtttctttcacgacggttaagattgcatttctgtgatttagtgttatggtaatccaaacaactttattgttatgaataaacaataataatgttacaaatccttgtaatttaaccataatcagagaacgactaaaaccgtgaaattaaccgaacagaaattaacgattggctaaacgatttcggttcggttagtttccggttaacaaaattaatccgaagtcactcctaggcctttggtcaatcttcgtttctcgtttctctgttgagtaacgacaatcgacaaaggaactttgctcaatcttcgtttcttcgttaggtaatcttcgtttctaagaattggaatgttctttttcataggattcatgatagtttttggctgcaattttgaatctttattctgactatgtgaggaatttgattttgttatcgttgtcgttgtttcgtcttaggatttgtgagaatcattgaacaatttttcaactttgacaattaataacacgagaggagcttcagatttatgtgtttgagtattcaaagatatagcttttatatttgcctttctgggtttcatggagatgaatctgtatacttatagctcattaattagtcaactctgttgttgcttctggtttgacattgtattgagtagtcaaagatttgagctttctaactccacatgaagatatagcgtgtttacatttcatttgtgaaaagtacttcagtccatttgggtttctatctggtttagaagatatttctggtgaaaactttatttgggcattgcttcttttcagtgactgatcaaagatgggaagtcaggagaatgtgaaacacctcgaggaatgcactgtttccaagttagtttcttactgcatcaataatgtttgattgtttgctaatcattagaaagagtaaggaacacatattcagtctttgtttcttcactgtgatatcgaaatttatcagtaagtcattagttatgtagccacttttagttgttttcacttgttcacaccatcatgcttttcatttggaaaaaataagtaaccttggaatataaccacggttgttgtttgatacgtcttgcttgttaaaacacttgagtgttgaaaggttcagttcctctggtgtataaagtgttttcttcttgatatcgattttttgtgatctaggatcatagttttgtcattgagtcatgaggtatgtagcccactcttagtaaatttcacttgttcataccatcatgctagccactacattgcttggcataaagaagtagccgcagtatccaacatttgtatctagtatcttctaatataaaacacagtatgattgttgttctcgaaatcaaaacatcctaaagtgaaattttcgatcttttttgtgggtgcagtgcattagggacatgggtattctcagtcctaggcgcattggttgcaatcccggtaggcatcaaacgcaagtctcttgggccactcgtgttctttggcacaaccggaacaatgctcgacatcatcattggtgtaagtcaatgcgagagagaacacgcagaacaccaaatgaagttactccaagactctcaaaatgccacaacaacaaccaccaacacagagactgaagaaagctcttccatgtcctaatcttttttacatctttctcactaagactttgatgtaatttgatgccactcacaagttaaacttgttttaagatattgtgattatcccatgtatcttgagaaaacaaagaagaaagcttttcatgattacaactgattcattgacattgtcatctccaccaagaaattgcaacacacgaagcaatagaatttaatacgataatatatctgaaactgttacgagcaatgtatatgaatcgataaatcttggactccaatatcaaatggtattcaaaaactaaaaaggttcaaagtgaaaacttttatcaacaaactcttgttcaaactaatgaaacaaagaaagattattataacgataaacgatgaatctcactaaaacgacggcgttccaagtcgaaagcagagggaatgttgaaagttaaacttgattttgaataagtttaattattggatcaattatccaataattaattatggccaaatccaagttctagagttttctctagaaatatcatcatttccacctccttaaaagattctagaaattttctagaatcatcttccacctccttaaacataaaaatctagatactctaatagaataatctagataatttgaataatgtaatctaaatcttatgtaagaactctctagacttaggattaaaatattttagatattttgtagtttggaggctataaatacctcctccccctctcaaatgttgcaatgttgtgaagttatcttcaagtttaaagcaaagtaataaaagttatatttcctaaaaaactctctcaaaacacttaaacactttctccattacctctaaaagaattttactctaacagggaagattccggcgaacacaaactcatccgacgacgaagaaccgaagataagcggagaagcagagcgaaatcgctaggcagatagaacccaacgtaagtttc

SEQ ID NO: 14744 - DNA, 3000 bp, Unknown
  misc_feature (1)..( 3000): cDNA_ID_2730762_gDNA_ID_2684223_Annot_ID_137504 3000 nt of promoter + ATG
ttaaaagattctagaaattttctagaatcatcttccacctccttaaacataaaaatctagatactctaatagaataatctagataatttgaataatgtaatctaaatcttatgtaagaactctctagacttaggattaaaatattttagatattttgtagtttggaggctataaatacctcctccccctctcaaatgttgcaatgttgtgaagttatcttcaagtttaaagcaaagtaataaaagttatatttcctaaaaaactctctcaaaacacttaaacactttctccattacctctaaaagaattttactctaacagggaagattccggcgaacacaaactcatccgacgacgaagaaccgaagataagcggagaagcagagcgaaatcgctaggcagatagaacccaacgtaagtttcatgtccgtctcttctcgtagtctacgcatcaccaccggcgcaaacgtgagtccaagcatcgataaaccgattctgataatcaccaccataaagcacatatcggccatcttgttcagctctgatgcacagtataacgccacgtgtccgttcttcgtcgtctccgttagatatgaaccgtcgaaaccagaagctcgtttgcagattccggtgaaaatggcgagcgaaactgcaagaaagaaacgatcgtttacacgacgagtttcttctcttctctcacgacctccatcttcgtcatccattgcgatctcgtagtcttgcaggagaaaatggagattttgaaacgatgattgatgaaaaaatcagaatccgggaaaaagtgagaaaatttgtctctgagaggttttggagtttgttaaagagggaaagaagaagggtttataacctaaccatggttaaaattttaaccatggaccatagtttattttttaaccttgctttttctctaaccatggtttataatccgtacgtgttgaaaaagtttcaaggagagaggtgatgactgatgatattgagtggacgaaggacttacctcttttggtcactgttaaaaattggtttcttgaattactggttacaaaatttcgttcgttgctgaaccggaaattgacaattttggttacacagaattgggaccaaaaatatctgcatggtttagtatttgatcatataactacctataaaaagactagaaatattttatattgttagataattgtgaaattttgaacaaaaaaaaatgttaagggttaaatatggtcttttttactaagttttattcatcggtttttctaaaatgttactactttgggtaaacaaaagttaaagcagttgcctgattacgacacgttgaacaatggattgatcttatgtaaatttaattgataaaaaaacagttcatgactgcattttgcagctaattccttaaacattttgagctaaaatttgaaactatcatcaagaacatgaagtaattagtcttaatccgatatcataaacggttcacacacacatcgatttctttgtaaaactaattattgtattcagggatgcgatccgaaactttaacgcatttttatctatgcaaatacagtatgaagtgataaatattgcaagttgtaactacaatatcaattaatattcagaaaatcttgtttaaaccttttattcaagaaaccaaaatgttcacaacacaaatccaaagaaataaacgaaaagcagatacagagcatccgcgatggtctcactgaacgatcacaggtccaaatattcaaacctctaatcaaagaaaccataatgttcaaaacaacaaacccatcaaagaaagaaaaaaacgaaaactagattgtagatagaaagagagatgataaatgtaagcatcgtcgatggtctcactaaaagacacaggtccatagtaacggtggaagaaactcaagacacaccactcacccggtgacggagcagcgaaggtacgctaagaaagcaatcgtgaggacgacaaaaatcaaacccacgagcagctgcacgtcacactcttctcgtacttttctcatctgttccagttccaccaccatcggagcaacaatgatcttgagaatcacaagcataaaagcaagatgcgcccacaagttgaactccatcgcccaagaatacgccacgtgtccggtcatcgtcgggtttggatctgagccagcagctgctcttttgcagactcttgtggacagttcaagcaacactgcgacgacaaaacgaccgttcaatctacgaagctcttcacgtccctgtcacgattctcttcacgtggctcaacaactccttccatggcgagagattcttgcaggagaaaagaaaaacaagattttgagacgaagattgtgaaaatgaaaacagattcgggagagaaaatctatataataagggtttttggagtttataagcataaaatgtttcttttatttaaattaaccacggttaaagtttgaccgtggaccatggttaattggttatagtaatcgtacgttttctaacgggacgtgagtcttgatgactgtgttgaaagttaaacttgattttgaatcaagtttaattattggatcaattatccaataattaattatggccaaattcaagttttagaattttctctagaaatatcatcatttccacctccttaaaagattctagaaattttgtagaatcatcttccacctccttaaacataaaaatctagatactctaatagaataatctagataatttgaataatgtaatctagatcttatataagaactctctagacttacgattaaaatattttagatattttgtagtttggaggctataaatacctcctcctcctctcaaatgttgcaatgttgtgaagttgtcttcaagtttaaagcaaagtaattaaagttctatttccaaaaaaactctctcaaaacacttaaacactttctccattacctctaaaataattttactctaacaaagtggtagcagaacttgaagatcctaaag

SEQ ID NO: 14745 - DNA, 3000 bp, Unknown
  misc_feature (1)..( 3000): cDNA_ID_3442195_gDNA_ID_2684223_Annot_ID_191863 3000 nt of promoter + ATG
aggagtttgctcaaaatcaaccacgttgtaggacggctacctgattcaccggccatcatcgcttatcactcaccagtcttttctttgttctctcaattgaaaaaacaaaaatattcctgaggttaattttgtagatattctttatacatggctaacattaacaattttgatacgtcgcacgcgttcgttgcacgtgtgaactaggaggcgcaaacgacgaaaacgtaatgtttgacgccagctttgatagacacgtggacagttcagacgctaatgatgtggacacaatcttgatcgccgaaacacttttctacatgtggcaccgtctatgtcgtggatgcttcgtaaccaacgacattttgcggatgggccgtgacagcccaataagcatactttgtatgccagatcagctctagtggtccaactgtaaaaggagctgtttggcttcaccttacctgttcctactactctttgaggttgaaattagccaattaggtttattgataaggactcttattttatttatgatttattttctctttaacatcgtcatatagttatgggtctaatggccacgaattctaaaaacgataaataaaacaaattatgctgaatatatcaaatatatgtatatgtatttttttgcgttaacttagccaattaaacacgtaacattcgtgtttaatgtttttaatttgcctaaggcaatattttattttcgtcaaaaacaagtaaccgaagacacttgtttctttcgaaatcagtactcaataaaataaagttttgtgtaagactaattttagagattctcttagtagttgaccaaaaaaaaacaaagatgttttacatcagattcgaagtaccacagtttataagtatgccaatacgtgtgattgaatacatcaatataattagatcttatcttacatatttgtggacaattaagtcggtatttcgctaagaatgttttttttttttgcaaatcaaaatgtgtattctatgacaatataaaaatcatatacacaaataaatgatggctaggaatcgaaaaagatgtgtcctcgtgggtttttagaattgaaagcgtcaaaaaagaaacactagagctttcagatttcaagtatacagcgaagagtaatgagatgccttgaatatggaatgggaaagtatctcagtatggcgtagagtaccaacgcgttatggtgtatgaatgggaaaaaatacattcattcaaccatattttatactcctaatatttatatttattcgtatcgtgtgattttttcattaatgtggacaaaagttattgagtacttttaggttttaactggggatccacccccagcattaacgtcggcttcgagtaccgaaataaaataaacggtgtagtaatgacgaaataacataaataagtgtcgaatagctccaacacgtagaacaaacgcaagaaaacaaatgttaaatggtcagtttatgaagatataaaaacaaggagtatcaaacttgaattaaggttttaagaacattttgagtgattcaattgcttcttttatacaaaaagtttaaactcagattacgtacgcccacgttcccttgaagtatatttttaatttttcctaatgcggttgtaatatatttttataaagattttaattaaatggtgatcaaatgtgttagatactctaaccaccacagccgtggtaactaaccactgaccactcgtacgtataatacaattttagaaatatacatacttaatatgtggtgtattaggtatttttgtagcatttttttttgttaaaatgttacacgtttgaattatgaagtttacgtgcacggtcgcaactcgcaatatagtttttatgatgtttgtggttattcgaatgacaatcatgtcctactactagcacttcaaatcaaagtacacgaacctatagcctataggatgatgtatgtctatttatgcgaaaccaaactataaaaaatctcgattatttatcaaataaaatattagacctaatttacaaatggcggacaaaaactcaactttaaaatgtaaacctttggcactatcaatatcaacataaaaacgttaaaaaaataacgcaactttagaatttcatatactacttgcatcaaccatcttctgtatctatcactatccgtatgggaatataagtatcctttaaattaataaatcatcgcaagtaggaagagaatcaatactcgaaaagatataaaaaaaacccaccaagacaacgatcatctaatcacagaagagaacaaaattcttagaatcataaaagtaattaattaagtaagtcatcaaagacaatcacctggaaactcgcttcctaatcaagatttctcgataatcctctcaatcataatcatttctctactatcaataaaataagtaaacaaaggtagaccataaactaatcatttggtcttctactattaacgtatgaagtagcccatactatatcatatcgctttaaattatacaaagacaaattcgaaacaatctcgagtacgtatgtattattaattttatgtttacactacggtgtcgttttcaaatttttaataatattgtgggtttctttttcgggctggtgggctttttgtgtccgcttcccaatacttttattttataaattaaaaattaatcatcgtctctcttgtgtctctctgttcatcacttttcttcttttgatgttcttgtagcgtctgtacgaaatctcacaaggtttcttcttctcagatttagaaatacttgtgtgatatcttctgagtaaccaaattcttgataaagtttctagctttattcaaacccatttgaaaaatccggtggtgaatcgccggagaaatgtgtttttcgtttctccactgagttttttttgttaagaaatctgttaaaactctagatttcaaacgaatgacattttctgagattgaggaacattgtgaatcgaggactggagtgaagattctctg

SEQ ID NO: 14746 - DNA, 3000 bp, Unknown
  misc_feature (1)..( 3000): cDNA_ID_3018873_gDNA_ID_2684223_Annot_ID_191855 3000 nt of promoter + ATG
aatttgcttgtaccaggcggcacaggcaaaaggtatctttcttgaccactttgttgttgttcagtgcaaagttttttgcaagcatcctcgcacattataggagtagcgtttttaacttctttcaagcattggtttgagacacaatgtttaatacacatatttacattattcgaatgtgagatttgtgccgaaaacatcattgcgagcaaagttgtaatgatcagaagatcgcatgttttcttcaaactttgagctgccataatgtatataaatgtattgatattgattagaacaaatattattagtaaacaagatgatttggtgatgaatattgggttttgtttagatgatttatatagtgaaagtaatgtttcctatttttagaagttggttttttgttattgtttctttctctagaagttacatacatctctgtgatttagtgttacgctgatccaaacaactttattgttatgaataaaacaataactatcgtttaaatgttacaaattaaactcaaattggctacgtcatagtggaacttaattcgaggttcaagtcgttttgaacgaaaaccatgaaattaactaaacataacttaattatatgttcttacttgttccatacaaaatctatttttaacaaaaggatgcaatgtctctaaaagtatttgtcgtttgtatgtataacagtatctctcatgaaaagtaataactaagtgctaaaagactctattgcatggtttagtatctagttttggtcgcaaatgaggagaacacaatgtcaacatatacccttatttttaagctagtttctgatattttcaagtttcaacccaattggttttcgttgtttgaactgttttaatatgacatataccgcaagagggaaataaagagcacaactaagtcattgcaatttgatgaatgaaagagattaattaaaaagaaaaattgtaattttataattactttattttggtttgtttaatttttatttttgattaagaatgtgattagctcttgtgcaaatgctaaaataactctcaaaaaagattgttcttcatttttgttgctcttcgatgccaccaaagcgtctcatatcaatggatttcattgaatcgaacctgaatactgcagacaattcaatttgagaaaacacattttatcttcataaagtttttagttgtaattttggtgaaatttgatgaactcacaatttgatgtaaactaggaaatttttgatgtaaagaatcttaattgattagattgatgcacaacttcgtcgagtctagttgaacggaataagtctagactcttaaagacgttgattgcaagttgagagaatgaatatgcataaaattaatatgaagtcggtagtagattcaaaatgatataataataataatactatgtagtttaaaaatgatttgtttaatgtaattttttttaatcgtaaacaaaccaaacggtttttatttgcatttgtattttattctatgtatttgaatctattgaaatggattcaaatctaggagataatgagtttttccttttctttttttataataatgaatgtgaattaaatttatattatttaaattccttttgctggaagattaattgaaaatacgcgacaacatccatatattacttcaagacacttgacatgagaacaataaacaacatcatataagaagtggattaacatatatatggagaaacaaacaatgagagcttttgcgattataggttaaaaagaccacacgctttaggaaacatcctgcaaaacttgcttgtaccaggtggcacaggcacaaggtatctttcttgaccactttgttgttgttcagtgcaaagttttttgcaagcatcctcgcacattataggagtagcgtttttaacttctttcaagcattggtttgagacacaatgtttaatacacatatttacattattcgaatgtgagatttgtgccgaaaacatcattgcgaacaaagttgtaatgattagaagatcgcatgttttcttcaaactttgagctgccataatgtatataaatgtagtgatattgattagaacaaatgttattagaaaacaagatgaattggtgatggatattgggttttgtttagatgatttatatagtgaagataatatttcctatttttaaaaattggtttttctgtttcttgtttctttcacgacggttaagattgcatttctgtgatttagtgttatggtaatccaaacaactttattgttatgaataaacaataataatgttacaaatccttgtaatttaaccataatcagagaacgactaaaaccgtgaaattaaccgaacagaaattaacgattggctaaacgatttcggttcggttagtttccggttaacaaaattaatccgaagtcactcctaggcctttggtcaatcttcgtttctcgtttctctgttgagtaacgacaatcgacaaaggaactttgctcaatcttcgtttcttcgttaggtaatcttcgtttctaagaattggaatgttctttttcataggattcatgatagtttttggctgcaattttgaatctttattctgactatgtgaggaatttgattttgttatcgttgtcgttgtttcgtcttaggatttgtgagaatcattgaacaatttttcaactttgacaattaataacacgagaggagcttcagatttatgtgtttgagtattcaaagatatagcttttatatttgcctttctgggtttcatggagatgaatctgtatacttatagctcattaattagtcaactctgttgttgcttctggtttgacattgtattgagtagtcaaagatttgagctttctaactccacatgaagatatagcgtgtttacatttcatttgtgaaaagtacttcagtccatttgggtttctatctggtttagaagatatttctggtgaaaactttatttgggcattgcttcttttcagtgactgatcaaag

SEQ ID NO: 14747 - DNA, 3000 bp, Unknown
  misc_feature (1)..( 3000): cDNA_ID_3018908_gDNA_ID_2684223_Annot_ID_191853 3000 nt of promoter + ATG
gggagactaagaaacaaccttaatctaagtgactgggctttgattgaattgggccgaattagtctactaaattcagtctcaaaagcgttgttctgcttttcttgttggtcctatgttcgcgtggaggattcaggatataataactactgtatgttatttatacgtgagtgtaatggaagaagtacactacataacataatgagtgtgcttcatgtactcttccatgattaaacctctaataattttactgtacatgctgcgtaagatgtgatcaaatgacaacttacataataatagaaaaaaagtccacgaataaaatacgttatcaatcatatatatccacgtaatgtactcaacccgaataagatttttgttttaaatatcatacgaatcatttcattcacttataaatttcttaaagttagcaacatttatctaaattgtatcttcaacattaatccacatcgcttatacatatactacaattaaccacacttgtttttatctatttcacttacctataatcgtcgaaaagtgttgagtctcataggttctttctacttcaaattatcagttagtttgatttttaccttttctatcaatgttatgtactatagactatatagtaaaaagaaaaatcatttgttgtatatttaatagattacaatttgacaagttaattaaagaaatgacttttcggatgtgtgataatttcgaaggtaacgactaaaatgcccacgcatgactctgttaccattagccagccttatcaaaagccgaaagttaaatggatgtgaatgaaacagactttgactttagatctcattgaaagagatgtttgcttagatgataatacccttttaatccattttataatccaacgttgttagcaataaagtagtctctaattaaaaattatcaagtggaaattatatcacagaaactataccatttttgtatgatttgactagtaagacaaaaggctgttatatcaaaaccatacaacgatttatatgtaacagtgtaaagtagtttttggttaagtgatgttgtttgaaatatgactaatctcggaggctaataacatcggctgcaccaaacgtggatgtttggttaaatgggttgttcacgatttgatttagatccaacctctctctttttatttagtttcttggccataaatattttgtttgaaaaatgaaaacaaattccatgtatagtaattaatcggtttcaacaatattgctggcagatcacccaccagatttcttaccaaaaaagaaaatgaatttaacgttgttgttgaatgttgatacacacaagttattactatatccatgaatagtagaaagctggcatacgaatgatgtttacgtatgtcatactatgaatactttaaattttagatcaatgactttatataattttattttaaccggaagattcatgtataacttaatttttcaaatttttttactccaaattaaggctaatctttctaaagtacttggctaacaaaacatcttaaggttagtattactttttaatgatttatttaattaatttttatcacaacgtaaattggtcaatcactattaaaaataatggaattttcgaaaaacgacaaggaagcaattagtggtatttttgccatttcccaatatttttagtaagattttttgttagccaagtatttttagcaagattagccttaatttggagtaaaatagaattgaaaaattaagttatacataaatcttccggttaagttatactaatcttaagatgtttaggttaatgatattttgaaagagattaaacaaaaatggtatttgataaattttctcaaaaaaaaaaacaattctctcatggaaactaaattaaatttaaattaaacaaaataagaaaaattaagtttggaaaatataatttatttctaagttattctaatcaaaatctgaaatgtgatgctggcatagggtggcataatctttgtttataaataatgtttaatttagataaacctcatccgatttgaataagaaaaaaatcttatgtgaaaaaaacaaatttgtaaatttcttttgatgtccaaatcagtttaatattgagagacaaaaataaatagaaactctgccaaaatgcagagattttattgttttctgtaaatcaatttagtaataagaaaaaaaaaaaaaagacttatgtcattgtcccacaaaaaaggctaaaaacgtaaatgaatatttatctgtgactgtgtaatgtagtggcacgtgccagctttacaaacagtaaagctaaaaaaccgttcatgtttggatccgtcgaccaatatattcccgtcatcaccggtgacccctctcttcctctccatccaacggctctccttcttctcttcacttaatcaaccgtcagattttaatccaacggtctttattaaatctaattttatctctttctctctttaaattaaacccaaacccggtctaatttctcttctcctatttctctcttctctctctctttaagtgagcttcgccgttaaactttctccggtaccgggaaattaacgaagaaagcgaaaagtcactgttacactaatatcacaaatctctctctgtctctctctctctctttgtcgaagtcgtgcgtgatgctagttacggtggtgaagcagcggttagtgtactctcgccggagaaattggttatgaccggaatctcacctccgtgatcgaagaaactgttttcgtttttttatcgttacgaagaaatggaaaaacaggcgaagctaacgaggacacagtcgtcgttactccggtcatcgtcgaatctccgttcgtcatatcaaagcttatcttcaatcgtcgaaggcgagcaagatctagaagccggagagaaagaagagaaacagagaagaaaaccacctaaaccattcggttcaccaaatcctaaaaccggtttaaccagaatcaatcccggtttagctttcacaatg

SEQ ID NO: 14748 - DNA, 3000 bp, Unknown; identical to SEQ ID NO: 14741
  misc_feature (1)..( 3000): cDNA_ID_3018919_gDNA_ID_2684223_Annot_ID_191849 3000 nt of promoter + ATG

SEQ ID NO: 14749 - DNA, 3000 bp, Unknown
  misc_feature (1)..( 3000): cDNA_ID_3018921_gDNA_ID_2684223_Annot_ID_191847 3000 nt of promoter + ATG
tgcccgtatatatatatatttaggtgtaatcataagtcgcatccaacgataggtaagatatgttcgaataaaatttcgtcgattgagagggaacataataagaagcagcatccagtaacgtggaagattgatgccatgcttaattaggctaaacaagagaacatataatgtagtacctttatacgttgtgtttctttcttcattttttcttcttctatatatatatatatatatatatatactaatttgtcatatatatgtatatgtgaactaatctcaaacttaaccaagcactcatacgcattttggttgataagtgagcagaattgataactgacttaaagattttagataattactgatgacttgttggataaaattgctcaaaaattatcagattgacggttataagttgagttttttttttctatctcccatgtaggaaaaaactgatgtctgaattatatagattactaacgtttttttttttgtttgcataagtatatgtttgtttataatatttctaggaacatagaagaaaccaatcttaaaaacgatctacaaatctttaatttaatatgaatataaaaacggaacaacaaaagtaggcagccttactgatgacgaaacgaagcactagtagccgcgtcgcattagaaggacctaaccacgcttgtcgtttcatgggacgaatcacaacaaaaatgtattacaaaaatcacatttaatttgctttttgtttcataaatttagggtttttttctttctttttcttatgataattgtttaaagtagtcttgactaccgtacaaaacgtggttcagtttactcctaccagttaatatgaattatgcaaacatcatttttttttggtttaatgttaaaatttcgcaaacatcattttgtcatgagatagtctaattaggaatgtttactacttgatataagtttgtgtgccttacttcgtcgcttgaaatcaatacaatatagtttcgttgtacatagtaactagtaattaacattaaaatcagacaaagaattattggaaaacaatgagaatttttgacggtggtttgttataatgtattattaaataacatgataatggaaattactttgttttagttaaaggaaaattaatttgttgtttaataaactagtggtaggtaggaatagttaaaatgtaagtatcaaagttttttgaatttaagattaagattctcgaaattcagttattagcatacaaatgacataaattatgaaaaaataaattaaaataatgtcatacagatccagatgaaaatgtataatgtatatacatttgataaaaatgaaaatgtattttcgggttctcagtttgttttgtgaaatatcaatacacaatgttaaaaaagaatcggcttctttcagcttatgatattcattaattttccacacaccatttttcaaagggaaatagcaaaaaaaattaaaattaaaacagccagctaaattaatcagtgaaatcatccaaactgttttacaaagacattttttcggccaaatcaaataaaaaaatcgattgttattgacagtctttgtgatcttattggttacgttatactcacctgtgcactccacttttaagtactacttcgtctctaaatatggtacgaactaacttgaaattagcctattgatttgtttagaaattgataaatctttggacgagatggtgtccactctttaaatcaccacaatgtcccctatctattttccgcgacaagatgaataagaatatgcactaaacttaaccatcattcgcttatacactatatttattaaatcagctttctcatcgcctaaaattcaatatttttgggtccattatctacacgacacaatggatcattcacatacggccgcgcatcaaatgatttcgtaagtcccggcaaatgttaataaactatttgaaaaagaaagagtcatgtgtcccgtcaattcaagtacttatttattgtgattttttgcacatatatagattaacatatattcatggttaaaacttgttgatgctgcaaaaaggataattatcacccacgtacattactcatatgaatataaaaggtgcataattttttttttttttttttgtaatgttttatgtatatacacatatagtataccaattttttaacaaaacaaattacatatagataacaaagaggtgaatagtttcgatcgtgaatattcaggttgatactaattagttctccttttgtagattcgacaagtgtgatgagtggataaaaaaatggatgacgtcttgagtggattgtacatatacaaatagataatgtaagtgcatgctttttgattcttcgaaactatttggttataactttcggatatacttatgacaaaaaaaaaaaacctttcggatatacatggttcggcttggacgtacaggtctatataataatttgatatatattggtacatttcatttatatactctttattggtacgatacattttgattcgttatcaatatattaataccacattgacgagaacattctcattagtgatcgtagattaataatctagccatcttaataagcaaaatatataatccaaaaaatgcgacattattttacatacgcaagtgttcacaaccaatagtccaatatataaattaattaagtaggtatgtaatataaccaaggaaattacgatctaatccagttttgattacctagaacaagaccatagttagccacacataatggatacgtgcttgacaacaattaaaaacctatatttttaaaagtgatgcttaaatagccaatggattgaaatgtgcactcgcatatattgctttttgtgtcagcacaatttggctatataagcaagtactctcttgtagtaatcattcacagtcataactaattaagtacatttgaatacatcaaataccaagaaagagaaatttagagagaaagagaaagagataaaatg

SEQ ID NO: 14750 - DNA, 3000 bp, Unknown
  misc_feature (1)..( 3000): cDNA_ID_3594277_gDNA_ID_2684223_Annot_ID_191846 3000 nt of promoter + ATG
ctctcaacaacgagcgatacatcgtccctcgaggtaatggtggtcctataaaaaggttctgcagagcatttagctggatttgtaccgcttaattgatccacattacaaaaaatttgtctcctttctctatgcataagttatatatttatgattttttgtatcaatgtatcgatcaatatttcaagtatttatgtatccttcttccataattttttatctttaacaatatttacttgtatacggaaaatttgttaaaaatctaattatttatatttatatatgtaacaactgaaaattggtaacttgtataagcataatttatgctgcataaacatatttgcatttaactacacggaaacttactaaagagaaaaagagaattctcgcatataaaacagaaccgttactctgtttctcttggcgctttaattagggtttcttatttagcttttgcattgccacattcctaaaggtttcatcttttggatccttctctgactcacttcttaaaacccatcaatggaggaaggaagtctgtggcgtcaatggactatgttcagatctctgttatcgattcttcaatggtggggttttaacgttactgttatcatcatgaacaaatggatctttcaggtttaaaaagtctcttacttttatcattaaagacttagcctttcgtttgttttatctgatctgcgtttgaaatttggtacctttccttgtttgcagaaactggatttcaagtttccattatcagtttcatgtgttcatttcatatgttcgtcgattggagcatacattgtgattaaagtcttaaagcttaaacctttgattgtggttgatccagaagataggtggaggaggatttttccaatgtcatttgtgttctgtatcaacattgtgttggggaatattagtcttagatacattcctgtctcttttatgcagactatcaaatctttaactcctgcaacaacaggtttagggtttttttaagattgagaatttttcaaaataaagtgatttttttttattgttctgattggtttttgtgtaatggttttttgagtgcagttgtgttacagtggttggtatggaggaaatattttgattggcgtatttgggcgtcattggtgcctattgttggagggattcttcttacttctattacagaacttagctttaatgtgtttggattctgtgctgctttgtttggatgtttagctacctctacaaagaccattcttgcagaatctcttcttcatggatacaaatttgacaggtcaatgttctgtttcctgaggttttgatcttcagtttcacatgataggtgttgaatgtgtgaaacttacatttggtttcaatgacatgccatgctctcatagtccaatacttgatttgctttttcatatttcatggaactgagtgtttgtgtcctcctcattttcatgtctctctatgtagcataaacacggtatactatatggcgcctttcgcgaccatgattctcgggttacctgcatttttactagaaaggaatggaattttggattggtttgaagcacatccatctccatggtcggctctcataattcttttcaactcaggtgttctagctttctgtcttaacttctccatcttctatgtcattcaatccacaacagcagtcacattcaatgtagctggaaaccttaaggtaaatgaacaaatcccaaaccacataacattaatctttatattctagtttcaataactcagatgtttgatggatggtatgtgatttgcaggttgcagtagctgtgtttgtttcatggatgatatttcgaaacccgatatcaccgatgaatgctgttggctgcggaatcacacttgtgggctgcaccttttacggatatgtaagacacatgctttctcagcaacaacccggaactcctaggactcctcgtaccccaaggaacaagatggaactgatccctcttgttaatgataaactcgagagtaaaatttgaatatcatcggtaagtcactagactattgaacgcacacaaagaagttagatttgatcttgaacatccacaagagagttatagtttaactatatgtttatttttactcaaactagagaagttagagaagtgccattttatttgtttccattgtattaaattatctatcctcatcaaaccaactcagagatgaccacaaagatacttaaagcaggcccatttttgtattcaattatggtagtgctttcacttacctcagctttttaatttttccttccaattttgtttgtgccatagtgccatgttctaacatcagagacttaatacatgacaaaatggtgcaagtttgggaatctttgaaagaagatgaaaatagaaagttaatttgacaatatataagaaatgattattcattttcccgccttgatacatgaaagagcttaagacggtgtttaagggaaacgaatattttagctctcaaaacagctcatcaaattcgttgctttagcttctcaaaagtaaaaaatgggctttttcaagtgggcctcaacttatgttgctgaatttaccgccatatccttcccttacaaaaaatcaattttcaaaaaatcttcatgctacagtagtctgaaaccaggtcaaaggagttaaagagaaaagggcaaaacagtcaaacagcataaaaagatgtctgtgtcttggagatcgcaaagctaccgttttctgttcactctgtacaacacacttgtctccttcttcctctcttctcttctctctctccatttcaaaaagggtgaaacttttcttctctttctagaagaagaaaaccagagatacagagagattctctctctaccaaacccctggaaaaatctccagattcatcttccatagaccaaactaaactctgttcactgtactctctgtcattgtcctgtaagagaaattgaaaaccctaggagattttgaatttcgtaaaaccctaaacacaaaa

SEQ ID NO: 14751 - DNA, 3000 bp, Unknown
  misc_feature (1)..( 3000): cDNA_ID_2730796_gDNA_ID_2684223_Annot_ID_191843 3000 nt of promoter + ATG
ttaaaatattagcctgtacaacacatatcttagtggcattttcttcttaaaattcgtgaccacgtttttgttacgaaaatcgtaatatgcacatgacatggtaaagaatacataccgttaacaaggaatgattacctttcactgtacataattttttaagatcattgaatttatcattggacactaaaaatctttccttttttaaaaatgaaaaataacaattccaccaaaagtatcctaaaaactcaatgcctaactaaatcacattgttatttttcatgtgatttaaatattttggcgatcatcggggtacattctttctttcaaacctatagtttttcttaaatatggtgaaagattcatcaggaacaaaaagaatacgtaatccttttgttttgtctataatttttgagttgaatacatatatatatatatataagtaggaaattatgtacatttgtttataagaaaacgtaaggaaaatatgtacttttgtttatgaataagtaagaggttctagatacatacaatacactaaggcggattagatcatttaatatgactcctcccaggtaaatatgtacatttgtaaacataattttctttcatattgtctttatcgtcattttcctccatgaaaacacaataaacttttttttcataaaatctataaattcaagactaatataatttgattgaaagtatttattttaaaaataaaatccatatttgtttaacatcttcagttttttccataaaattattaaattcaaatgcctacataattcttttttacaactctatattctcagctttctttctaaaacagttgcacttgttgtaaacatgatatatatatatatatatatatatatatatatttttgaatataatttaacattatgttcaaaaaaaattagctatacaaattatggaaacttaatgcctaactaaatcacattaacatcatatattttagttattttatttttaaactatattgtttcaactttattggcgtttataacttaaaatttgtttcataataagttttggttatgtttttcaatgtagatgtttggttaaaaatttagttttttttaatgtcttcacgaataaaaaatcatagcatattaataaaaagaaaaacagaaattaattgtaattattttaatttgtctgaaaaactttaaacaaatataatttgaaaatgagggagtattaggtataataaaattatggaagaaggatacataagtacttgaaatatggatcaatacaatgatacaaaaaaacataaatatataatatatgcataaagaaaggagacaatttttgtaatgtcgatcaattacgcgctacaaatccagctaaatgctctgcagaacctttttataggaccaccattacctcgagggacgatgtatcgctcgttgttgagaggatcacatataatcttgcaagggttgtcacatatagctggagtcgctttctttgatgctttcatgcactggttcacgacacaatttttgacacacacatctatcgagttggaatgagctgaaaacatcattgcaaataaaattacaatcatcaatacacgacaaattttctttgacacttgaactgccatgtcgtaagtattgtgagtctgcaaatcttaaattgtaatgtttttggtgaaacgagatgatttggtgagaatgttggttgatgtggatgatttatatagtaaatatagttttagctgattttagaagtaactaactattaggaggtcaactttttttcgtctctttttctttggcaaatatatcgattgatttctggacaacttataaatgtgttatactgttttggtcatctaaacaactatttgctatgcataaatatagtaacattaatagctcatattaaaaatattagccagtacaacaagtatcttagtggcattttcttctttaaattcgtaaccacgtttttgttacgaaaatggtaatgtgcacatggtaaagaatgcatacctttcaattgatggctcgatacaatacggtggtggaacttgaggtaaaagaaaaaaaaaaatggaaagagtgaatttctacgtggagagggtcaaatcgtatctagctatcatacaataaactgaagaatttaatgtccaaaatgataaatagaatgatattagtccaatctgaaagtctttatttaaaaattaaaattcatatttctttaacaactccagttttcttccataaaactattaaattcaaatacctaatcaaaattacctacacaaattatttaaaatataatgcctgactaaaccacattaacattatatatttaacgattattttcttaaacgatattgttacagttttattgggggtttataactttaaatttgtttcataataagttttgtttatgtttttcaatgtagatgtttggtaaaaattctagtctctgttttaatatcttgacgaataaaaattattgaatatattaataaaaagtaaaacagaaaatgtaactattttatattgtctgaaaattttataaacatataatttgaaaatgatgaactattaggtataatgaaatgtagctagtttcctagaaattagaagatttgtttttctttttcaaattgacttctgataattagtatctttgggattctcattatgatatgtgtccatttcgatagatctgaaattatcattttgggaaagttaacctattatattgtaatattcgtaatatttagatttgtttctttgaaaccaataaaaaaaatagttcaaaaatattatagtttcatattcgaaaaagaaaattgttttatatgcatataattagccaaatcttaacatattatttcggtttgcatgccgatttggaaaacaatccatcaatatttttctcccacagcacacacatatatgaacgtttcatgtcctcgttgtcaatcataaaatgaaggtcaaaagcatg

SEQ ID NO: 14752 - DNA, 3000 bp, Unknown; identical to SEQ ID NO: 14739
  misc_feature (1)..( 3000): cDNA_ID_2730800_gDNA_ID_2684223_Annot_ID_191842 3000 nt of promoter + ATG

SEQ ID NO: 14753 - DNA, 3000 bp, Unknown
  misc_feature (1)..( 3000): cDNA_ID_3018933_gDNA_ID_2684223_Annot_ID_191841 3000 nt of promoter + ATG
ccttttatttttattttgtcaacaagacaagccttttagttatgattaattatggcgacttaagggatatgacatgattttaattaatatctaatccacaatcctttaaaagctcattttaattaatagattttgtttacatcattgttttcagataatgacataatctagaaaattagtgtatatagtataatagtatataccctagatttagagtttaagttttatgtgtgaagtctaagtatagaacagatctcgaacttactactgttatcatggcctacgagtattcgagatatcataaataaaagtatttataaaaaaaaaattaaaatagtttataaattgttgatcgtcagacaaatacttacatagtttacattgttaattaaccaattcaacgtagcatgttctggtcgtcttactagatatagactcgaacagatagttagagaaggatgattgatcgcttgtggatccgtggcatgtgtaatagatattatttaaaactagtaatcagattttaaaaaaaatactgtgaacagagaatctatatttgtttgttaagaaaaaatcaaattagtttttggacgtgttggccgagaaacatccacttgtagcattcgtaattaaaaagagaatgtatccgaatataagggacccattaatacaagtcatcttcctttggtatgtatgtgtgagtgagtgattttggaggtctctctccatattcgacaatatattcaattctatctcctcactttcacttcaagtttatttctttctaacaacttgatcgaaatttcggcgtatagttgtttacatttagaaacaattgtcaaaatatttaaatcaaatcctcaaactttttgtttttagaaactcaattttcatttgaacttagaattcatcatgtcgacgttcagttcaaaccaacattttttgataattaatgaatagactcatgcatgtgttagtacaaatgattttagttttcattatatttccgtgtgagaattattatgtttcttcataactttaaatggctctcacatccatcacatgggcaattctccattatcaagactatatcgcttcataagcaattctttcttctttgggcgaaacaaaagatcagatttagcttcgggtttgatgaaacttctccctatttgctaatcatctcgaaaattgctcaaattaagtcttctatttgtcttcacaaatttcaaatcacgtgcttataatccaaatgggaattgaataagtaagtaaataaatcatgattaaagcttaggagctagattgacctagtttataaaagttggggtctggatgtgaacataaaaggggtccattttatttgttggtcaaaaactttgagcgttcacgtgatcttaaaaaataaaaagaagaagacaggcttcaatatcaagagctaaagacccaaacacttagagagacattgacaggtgatttgttatgtgtagtgatgagtttcaatgtatcatcactttttcaattagaccaccatcccacatacttcctctacactatatactactactcacaatgatcaaagcttttagtgtatgacttgattaaataacaaatgcttttcaaaccaatttggaccggttccgtcggacgggtccgaacatgacaaattgaagaaaatcacattttaaacaaacttttgtcgctgttcatatatgctgattttattcaaaataagagataagagataattaactttttatattcaaggaaattacctgtctattgatttgtggtccgaatggtttgatcaattgatcagaaagaaaatgttgtaatgttgattaaaaatagttgttttgggtcttggacttatttgacgttttgagaacattttttgctaatatgtacgattatctacaattttgtccaatatacctttttctaaacataacgttatgcctgaatatagatttcaacatattgttgcatagttaattcgataaaaaaaactcttgctcagtccacttcttgatagatcttcacatggccattattcagatccgtgtaattaattatacgatcttatcaattttgaaggaataaaaggagtcctagaaggttatctataaaagaacacacaaagaaaaaggacctttttatataagaaaaagtgaagttaagaacaaaatactaaaaagaatgatcacatgggaggaatggagaatctttgggtaggattcaagtaatgttcccattatgggattttatggtatgggtatcatatttgtgggccacttctctgttttcaatttgagtcttttaccaaaaaaaatctgtaaggtttttttgtaaagtgttttcaatttaagtatttatcatcacatggggaaagacaaggaaacaataggataagagacgacagtagcgatcaagatcctacgattatgtctcttttgagcttagagatcctgtgaccaaatttaattaactgatctggatttggtatcgttacagtattcatatccacataaccatttaatagattttaatccaatagatctatgttgctttacaaagaaatatctgtaataacatgtggttacaaaaaaaccaaaattggaatatggtatatctgtaagctatgatttgttttttcacagtaatattttgtttggacaactaaaaaagtaaagtacaactaaactctacagaatttgttggctatatacagagagaaacaaaaaacatatttaaaacaattgctaaaattgacaacattagtttcactatataaatcacctagactaacccaatattacccaccaaatcatcttcttcacaattataaacaggaaatacaaaacaagttgtaatactcatttgtattaaatcatcactagtatttacgttatgacgactcaaacatgcaatgttttcatgttcgtagctatattgacgatgatgttttctgcacacattgctcaatcaaacagtctaaca

SEQ ID NO: 14754 - DNA, 3000 bp, Unknown; identical to SEQ ID NO: 14745
  misc_feature (1)..( 3000): cDNA_ID_2730747_gDNA_ID_2684223_Annot_ID_137508 3000 nt of promoter + ATG

SEQ ID NO: 14755 - DNA, 3000 bp, Unknown; identical to SEQ ID NO: 9126
  misc_feature (1)..( 3000): cDNA_ID_2730863_gDNA_ID_2684224_Annot_ID_137509 3000 nt of promoter + ATG

SEQ ID NO: 14756 - DNA, 3000 bp, Unknown; identical to SEQ ID NO: 9127
  misc_feature (1)..( 3000): cDNA_ID_2180622_gDNA_ID_2684224_Annot_ID_137511 3000 nt of promoter + ATG

SEQ ID NO: 14757 - DNA, 3000 bp, Unknown
  misc_feature (1)..( 3000): cDNA_ID_2730855_gDNA_ID_2684224_Annot_ID_137516 3000 nt of promoter + ATG
ggcgtaggtttgcgtctatctttccaaatatgtttttttatgctgaaaacatttttgaagaaaagataaatagtagtgaaaaatgggtgatggtaaaaaatggcccaccaatagtatcagtgacagtaactttatgaatttggaagaagatacaatgatgacttcaatgacaccaccagcttgtaatagtaaatacgttatttgatatgacagagcattaaatcaatcgtgagtgtccatatatacatacaccacatgcatgtacacacacatattacaaatactccaagaaatgtgtggttacagtgtcttaaaacgatatgatcgaaaatgctagtaaactgataatttccaaaatataaacaagaaataacttaaaagtaggtaaagcataggtgctacattaggtcataacattttgcaataaacatttctcttgtgatatgaattagatgtcttcgccttggattatggggttctatagtcattgtgaaactcttaatcctctaaataaccatatttgtaaagtgcgtgtatttctccttaggcatgccaattggtctctgaacaagcctttgtgcattgtatgctgcaacacaaaagcaaggttttcaattgaacctacagaaggaattaaactatccaatgttcttgacatcacttgaattctgaaagactacattgatggccttagaaataggcttgagagatagctatttttaaaaccgagttgaaggaaaagagacaaaactttactttatttaacacttcgatgcttatccaatgcgaaattgattgaagaaaccaaattaattttattaaatacataagacataggaacgaaaacaaaaacaaaatctgagctaaaactactaaagatatttgtgcaatcagctgtatcaaaagagtcattttgcactatatattaaataaattccggccaggggattatattgaattaaatatcacgactccaaacatccaagttaaatatgactttttacaatcttttagtgaataaaaattacataaacatataaatgtataaaactggtcttttacaaagatagttggaattggacccatgcaagaaattgatgtctcgatgttataggggaaactaaaaagtattgtctctttctactgataaaatacctacaactttgaccatcttttcataggccattacaataaattcctccatttgtattataagttgtaatagatttcttttccaagtttatgatactcaatttctatcatatcttgtgaagaaataatcagatcttgaattatttcacattacggtgctttttgacttgacaagtatgatttattgtatatagttgaccagatctaattatatatgtaaaaaaatgtatatataaaattcataattcttttttatatatattatttttctttttagttagtcgttttataatatttacaatatgaattaataggtttatttgaaaacactgaagaaaaatgacaaaacaaaacgtgccgaaagttctttttttcttttttgtttatacagttctctgggtatttaagttttttaataaagggtttgcaattatgtgtattcaagttttcttgtgggatcgatatgaaagttttgacctaacttctcgtataaattaaacaagcgcatttaagtatgcacctttattgacgactacataacccattaatgtaatttatgaatgctatagatagatgtaaatatcgatttttacgtacacgcgaagttactggaaaagaagccattaatgcgtcaccatgtacactgcttcgccacgaatcaatgatatgctcttttggatttatacagttttctgaatgaaatatatctagtcattttaagttacatgatacaaatattcaataaaagctatatcaatatcagtacaacaacttagagcatcatgtcttattattttgtattcatttatacaaaaatcgtaatttagtaaagtaaatgagtatatcgtatagtttgtttttgcttatttcgcgttaagtaaagcctctttttgggaaaatctgacaactgctttagaagattctatttccgtgcttagcaattttttacttcagattcgcttaaagaatctccaaacgttgtaaaaaaaaaaatgattaaagtaaattatggtattaaaagaagcacaggagtagtagttggcaaatgagatagatattaaagttacataataatgactcttttcgtatcttttattgaaatacagatcattgtttttaataaaaaaaagatgaaacgataaaaacagaggtaaggagtgaggtcgaatagtgttaaggtcatatcaagaaactttgcttaggcatatttttgtccaacagattcatcagactttgtgtgtcagtcttctcttccttgttccatttctctttctgtgacgtttttaaggacacgaagcggtgaatctctgcttccctcacgtgccgtttacagtcgcttatgtcaccgtccaatcatacgtcgcttttccttccatgcacccactctctctctgtcatcttctctcagccgcaatacttgatcgacacctctattgggccgggcccaatttaaaccatctattggacttctaaacagagcttcttctctttttgtcattctaaacagagtttactagtactaaattataggaagaaaaaaagaagagaaaacagtgtcattttctttatcatgttccatgtacagtgtttgttttacttatttgggaaaaaatcttataaaaatcaatcctatttttactaaaaagacatcaaaacattttctttttaaaatccaaacggtcactaatctcactaagaaacaactgtacacagacttaagataatgtaaaaaatccgaccgttgtgaccccaatttccactaacggtaatgttcttagccaatcacatacatataaatcaaacttacacccaaatccgtcacactcaatttcatctctttctctaatg

SEQ ID NO: 14758 - DNA, 3000 bp, Unknown
  misc_feature (1)..( 3000): cDNA_ID_2724601_gDNA_ID_2684224_Annot_ID_137519 3000 nt of promoter + ATG
tttcctgagaggccatgtaacttaaccacatacagactaggactagtgcttatgagaaatagccagtaattttcctttcttttctaacaaaatttcctttgcatctccctttgtgcagtttgcagcaaagatatgcttgctgacatcctttagagacacttgtttcattgaaattatacctcaataccaagcacctaagggtggtgagactacaaaaaaaaagtttcctttcactttcgcatatcgctttttgatatgaagtgacatctgacaaatacagttttacaagttgtgactctttatgtttgctattgtgcagtgttatggttaagtttctggtcagaggtgcattataactctttatacgatattcaaggtttgttttgtcctttggaaatgtaacgaaatggtggctttgtgcttgatgacactgattatgatcttcctttttgagtgtagctgctccagttcagcataagccaaagagaaaacattggttgttctagaaggcacgccaccatacatgtattatattaagacccttcaactatttttcagtcagtttgtgataagtctaccgtctcatacgcgaaaactcttcctttacacctctgtatactacttacgaactcgcttgagctgtaacattttaaagccgaatatgatatagtcggaccgagacaaagaaaatatgacagtttccataaccttagtggagaatctcttgaatttgatgggccctttttaaagcttatcagaagcaataagggaagtttttggttggtatgaaacctggatttccatgaattatccagtccaaaatcatattatccatataagattcagttttgtccttttgtccttcgaaatttcttcttgtgcatttgaaagatgaactgtttatctcccgcagaccatgtcgttatacgaactacaacactgtctactttcatgttagtatcatgattcatgagagttttggatggactacttcaaagtccaatgtacgttgggactggctacatcttccgccgagagcaacagagagcatcattgctagtttggaataagaaaggtcgaggctatctctaaggaaaccaaaagctagctatgatattgaagaaagatgacatctctttgcctatgaatggagagaatacaacaaagaatataatgtgatgaagatatctaatctttgcttctcttctctcaaagaaatttcggttaaaagtgaagcataaaagtgagattagtggcactaaagaaggatgaaattagcaatttagggatgaagaaaccatatcctattatccttaaatcggacgaacacaaaaatacggttgaagacataagtttcaatgtccaaagccatcgccaaaaagataaatttttgaacattatgagcgcaagtcttgagaatgaaatggtaacaattcttaaaagtaaagataaacactaaaagcacaatggcctcaaaagtagaagaagaacaaaaaagaacattaagatcttcaaggttcaactgcaatacggccagcaacctggtccaaatccctttggccactggaagtgatccttcttcctctgaaagaagaacaaaagtgatactagtattagcataaaaacatttttaaagagaaacacctctaacgtagtagtagtagtagtagtagtagtagtaatgttaccctttggtgtcgagctcaacaatgttcattgtctccagctgttggaggatgtgacgggcaataccaccactgcttttgcaaaagtgaggtgggcgactaccgttcctcttgcttccaccatagattctacggaaagcaccaacaccaagtcctcccctcaggtaaaccttccttgccatagatgctgcacaagaagtcattttgctaattgaaaactttataaacgcatagagataataagagacaaactaggatgaaagagaactaaccagctctgatgtagtaccaatcaggatcatatggtgcaagctccttcaactttccggtcttcacaatgtctgtccatgtgggaagctcgatctgaaacaaacaattatggtctcgtgaaaaccaaaacaattgtaaaaagtggagcttgacattcaagctattgtaattgctagtgtaaattaattcaacagacgtaacaaagcaaatcacaatattaatcccaagcatttgaatcttaagctgtctattaacaaatactaagagtaacacttgtgattcaataaatattagcaacatatacaaaatttcaatacattcaacagacattacacaattcaaagtattatagagaaatgccaacaatcaacagaaatatctatgaactaatggaaatcattgcaatttgagcttaatccatctttattcgagtacatacaaataaagcttggaacatttctactcaaacaaaaaagaagagactttatccactaaccttgccagatcgcttgagatgagaagcataagccttgacgaagtcatgaggcgagacgtctttcacagttttaccagttgccatggctcaagttatcaaaagactaatcactgatcttcgtctgggattttgcccaacgcagctgaatctctctccgcaaagactagggtttttattctccaataacaaaacttatatatacggccacgatatttcgattagggttttctccccatatccgggtcaaaaaatccaacccgttctcagcccacactaatgggcctaattcttcatacggccttactatctaaccagtatgaataatgttctttgatacgataatgcgcctactacggccttattatatcagttgactagtattatgtcctaaacgacaccgttcttaattagtaacattaaatgacgtcgttttataatcgcttaaccactggctattagttcgcatctcaagtcgtctctgccatttttggctttttaatcaaaccctagagagattgagagagcgaagagaagccatcatcagccatg

SEQ ID NO: 14759 - DNA, 3000 bp, Unknown
  misc_feature (1)..( 3000): cDNA_ID_1012003_gDNA_ID_2684224_Annot_ID_137520 3000 nt of promoter + ATG
actataaggaaagtcaaggtttgttatctttgaccaatgcatttataaacttataagttctaaattaagatgcttaaatgattcatcgcatacctgacgaccaatatcttcagcaattgggctggttccatccatgtgaagtaacaatgatgatttcagctgcagagaaatttaaaatcagttggcatttaaaatctatctacaaataagtaaggagttcgaagaaacaggaggaaaagaaaaaaaaaactttaaacagatcacatttgtaactagcttaaagctgaatcttgggaaagagagaaagaacagttgggcgtttacctgatttcgtgcacgtgtcacatcagcgtctgaaactcggtaggccagcttggttacctcatacataatggcatatgataaatcatccaagcaatcggcctgaaaaaagtaccttacaagatgttaaaagagatataatacgaggcattcatgagatgaaactgctaatattgacaaatacaagaaagagatgaaactaagatagctatggagttctgggttgaccttggcaactgcataaacgccgaacagtccagtatccttgtagttagtgttgaatgccattatgctttctgctatttcattaatggcaaccctctgggtcaggtcagaactgcacatagaaccataatgttcatcaacacattgcgaaatagcttttcattaaatccatcattagaaatattagccagagagtaaactcaccccacgtgttttccaccaccaacatttttgttccacgaacccaacatagtttgcataaccataagagcaacggaatctggatcagtccaagatgctccctcaaaggcaacagcaaattgtgcaaggggtaggtcgtcatcaatcattcggacctgagaagaatttcacggactaaagaatttagaaagatggaacattgcatataacaaaatcatatggttgtgtccttacctcagaaccagtaaaactagcaggttcattggcaaccagttgagaagtagttgttggatcagacgacaacttggtaaatagcttcttcacttgctcaacaacttcctcatgcttaacagctcctgcagcagcaatcacctgaaaatgttttggatgaaccaagataagaatcctaaaaaattcaataagtgattgtaggaaatgataagaagtaaccaaaatctataccatcctggaagcagtgtagtgagtcttaatgtagttctgtagatcctctctggtgatcgatttgacgttctgagcaggtcccaaaatagttcttccaaggggtgtgtattggaatgcagtggcatgtaaatggtcaagaaccacttcatcggtttgtccctccacctacgaccaaaccaattatcaaaaaactaaagcttaatgtgtattctatctttaactgattaaagaaacaaataactctaaccaacacgtagagcagagtaccaagcgctctagtatctcccttcatgcacatttcccaacaacaatacgaccaacatatgactaagccaataaaaccaaaacatgcgagagataatccaaaaacagaacaaagttttcatttttagagcaatggtttatataaacacaataacatctctctatagaacatgtgcttatgccaatacaaccttaaaaaaagggaagataacttaagaacatactaaagttttcatttttaggcaggcacacgggaaactgaaactaagggtattgatctaaaaaaacacaaactacggtccatagtaccacctcactaaaaaaaaacgaaagataaatcgaggacagaacaaaaagtttagttttttaagtacagagataacaaatacatacctcttgcatttccctgaggatgacatctcgttcgcggttaattctctgttcctcgaacttagaattctgtaggatatcagccaagacatccaaagcctggttcacattggaatccaaaaccttagcataataagtggtctgttccctcgatgtatacgcgttcaggtgaccaccaatatcttcgatctcttcctccaacgctctcactgtacgcctatccgtgcctttgaatatcatatgctccaaaaaatgagccgttccgttggtctcatcggactcaaaccgagatccagcgtcgatccagactccaacggtggcggtcttagccgagagatttgactcagtagcgactcgtagaccattgggcaaggtagtgacacgagtctccggagctgacaagatgtgattgtgggaagcgaggatcggatgtggagatgcgtatttaaggaacctcttatcaggattctcgagcttcttgatcttattttttataatctcagccgcgtggtcgtatggcataagatgcggcggcggtggagatagagccgtcggagatgcggaagccggcaccgaatcgatagctgaaaacgaagaggaagatcgtgtggcttgagtgaggaataaacgcctctgagatcggcgagctagggacagtagattcttcatcgccatggctgatgatggcttctcttcgctctctcaatctctctagggtttgattaaaaagccaaaaatggcagagacgacttgagatgcgaactaatagccagtggttaagcgattataaaacgacgtcatttaatgttactaattaagaacggtgtcgtttaggacataatactagtcaactgatataataaggccgtagtaggcgcattatcgtatcaaagaacattattcatactggttagatagtaaggccgtatgaagaattaggcccattagtgtgggctgagaacgggttggattttttgacccggatatggggagaaaaccctaatcgaaatatcgtggccgtatatataagttttgttattggagaataaaaaccctagtctttgcggagagagattcagctgcgttgggcaaaatcccagacgaagatcagtgattagtcttttgataacttgagcc

SEQ ID NO: 14760 - DNA, 3000 bp, Unknown
  misc_feature (1)..( 3000): cDNA_ID_2730847_gDNA_ID_2684224_Annot_ID_137521 3000 nt of promoter + ATG
caattgtgttgctgtgaagctttcttcacagaatagaagagaagagaggagaataatatttgcataaatatctacaagggcagcattttaatgaggtacagtacatacgtctcattctgattgcatcaacttaagtttcaacagcggtggcattttcctaatacttcctctcttcttcttttcgcagcagctacccacacttgtctacatgcttcttcttatctctgatgatgaaaaatgaaaacggaattccaaagatgcaacaggtggcataagcataacgctgggccatatttgacgttgagatcatcaaccaactacgagttgggaaagttttggaaatctatatgtgtatattgtgggaattcaatagtgtaagaaggaaatctatgaacataattgtttatggctcagtaaaaagcccatttagatgtcctatgggaatttaatagtgtaagaaggaaatctatgaacataattgtttatggcccagtaaaaagcccatttagatgtcctatatccttccgggcccaattgtcttgttcatcatcttcgtctcgccgcccacttgcgattaaccaatccacctttcgatcggaaaatccttctgtttgcgaatctattgggtatatatctctccttgatgatttgatttgattctattgcattgagattgatatcttgttgcaggggaactctggttccatgtgttaggtattttcctttcgtcgacctgattcatcttgtgcatgtcgattctgaataatgaacgaagaaggctgcgtcccgcacaactctggttagtctgtgtacctaatagtaattcgtaaccctccacagagcttactcatccgccgcttttgtattctctttgttgtagatgttgttaaacaaaagtctatagatcaaagagcccctctttccggggaacctaaatgtgttatctgcagtcgttatggtgagtacatatgtgacgagaccaatgatgacgtctgcagcctcgagtgtaagcaagcactcctgagaagggttgacagcgctagagtttttcctgccacagatgagtgcttctatgttagagacccaggatcttcttcccacgatgctcaactacttagaagaaagcttgatattcatgtccaaggacaaggatcagcagtccctccacctgtcttgactttcacttcatgtggacttcctcctaagcttcttctcaacttagaaacggctggctatgactttcctactcctatccagatgcaagcaattccagctgctttaaccggcaaaagtctgctcgcctcagccgacaccggctctgggaaaacagcttcttttcttgttcctattatttctcgttgcacaacgtatcactctgagcatccctcagaccagaggaggaaccccttggctatggttttggctccaacgagagagctctgtgtccaagttgaagatcaggcaaaaatgctcggaaagggactgccatttaagactgcactcgttgtaggtggtgatcccatgtctggacaactctaccgcattcagcaaggtgttgaattgatcattggtaccccaggccgggtggtggaccttctatcaaagcacaccattgaactagataacatcatgacgtttgtgctggatgaagttgactgcatgcttcagagaggcttcagagatcaggtgatgcagatatttcaggccttgtcacaaccacaggtcttgctgttctctgcgacgatctcaagagaggtggagaaggtgggagggtctctagccaaggaaatcattttggtatccataggtaatcccaacaagcctaacaaggctgtcaaccaattggccatctgggtagatgcaaagcaaaagaaacagaagctgtttgatatactcagaagtcaaaaccatttcaagccccccgctgttgtttatgtgagttcgagagttggagcagatctcctggctaatgccataactgttgtcacgggggtaaaagctctatcgatccatggggagaagccaatgaaggagaggagagacgtaatgggatcgtttttgggtggagaggtgccagttcttgtatcaacgggagttctaggccgaggagttgacctattggtggtaaggcaggtgatagtgtttgacatgcctagtaccatcaaggagtacatacatgtaattggcagggcctctaggatgggagagaagggcactgccattgtgtttgtgaatgaggacgacaggaacctattccctgatttagttgccgctttaaaaagtagtggagcagccatacctaaggaacttatcaatttgacatccagggaaatgcacaacaagaagagaagggttgggtactgagatgtatgacctggatccgaatgttgttgtaaattaagaaagaaaggaagacttgagagcattgacgaatagaaaaaattaagggtttaactctgcaaagaaagcataatgacttgtgatttgtcgaacgtttttggataaacataaagttacttctcttccgattaaaaagtggaatgtgccaataaaaaagaagggagttttgacttacgggtgggacaaaagaacgcggttccaactgccattgtctttaattaagtggcgaaaaaagccgaacattggaccaacctttgaagccgtcaaagaaaagatcgtatctcttcctgtctccttggccccgaaaggtttcaacttttctgctctttagaatccttaattctttccatctgttttagatccgatcgtccgatgattggcgcattcccagatccaatcgattcatttatttcgtccccttgttatgtacatatacactttgctttccgtgatattgtctggatatattaatcaatttttcctcatgaagaactcaaatattgtgttatgttcataactcaaatcattgaacaattcaattcatttgtgtcccatttgcacctcttgaagcaattagtaaggaacgagcttttaaacatg

SEQ ID NO: 14761 - DNA, 3000 bp, Unknown
  misc_feature (1)..( 3000): cDNA_ID_2730839_gDNA_ID_2684224_Annot_ID_137523 3000 nt of promoter + ATG
tgtaactctgtctaacgaatgcaggtggtcgtagactacaatgaccagataaaggttccgttggtgaaagaggtgctaaaaagagtgacagcggaaggcccggaggtgaggtaatgtgaatagaatttagtagagaatataaattgtagaactggatgagggtgggtgatgacattttgacatggttggtgatctaaaggggaagcctggaaggagaagaggggaaccaagacttccacatgccaggagtgataccaaagtgtccagggagatactattattactttgggaaggagataaagacgggagcagaagagttgagagacagagacaaggcaaaggaggtgtacgcagacgtgaagaaggaggtcgagagatgcataaagtttgtgaagcagagaagggaggaggatccttacagacctctcttgccccgtctcaaatatcacctgcagcacggcctcctctcccaagtccccactttccacttttgaatacatttacataatttgctgatggtgctttgatacctcataagtcataacccgtctgcaaacagatatattccataacatttgggctttcacctcatgaatcatgatagcagcacccacattgtcaaattttcccgatacaaaacactatcacattttgggaaactagagatcctaactaaaagagatagttttagtgttgtatcaactcgggaatgagcttgagaagaaaggagagctctctgtcagagaagttaggctttggcttagtaccatcagcatctctgttggatggcttcatcatctccctcaccgcctctgttatctcctccacatgatcaactatcactccctctatccccatcaaatgctgcatgtaaaccgcctcggctacattgtttagctttccgtatgtcatcagagagagcttggattcttttatcttgttgacaagagcggggttgcggaatactcccttcacctccgagacaatcccttggaggcctccttctaaacatactttgattgcttcctcaagcgaattccttctcgtgtcgtggtacatctcagttcctccgttggtcaagaagaatacctgtaattgaatttggatcataaattaagttgatggattaaagtggaaagagtgtacgtagcttttgggattccatcaacttacggggtaggtggtctgcaacttcctgacaagaagggctgcatcaggatggaagctggagaagatgatagttctgtcgtttccgatatcagacacgacctgcaagattgggaggagaagacgggagaggtgatcggaggaatagaagacgttgtcgtcaagcttgagttcgatgttgaaaccgaggtttggattctctactttctcaaaagcctcttggagagtacagaaagagtcgtcggttgcgacgctccacttatggatcttcccttcctttgactttctcagcaaaggctttcctgtcttgcctgtatccctctgtggcccgtaggacatgaactccgacaagcaaacctccgtgaccctcttctcgtacaccactccctgttcctcggagtagatgaagtcgtcgtggaatatgattgggcagccatctctggtgacctgcgcgatcaattaaaaaaataaagagatcagatcagatcttttttttttacatttcattaacagtttttttttttttgcgcaaaataagaaaatgtcaacgaattaggcaccccacgtggtattgccggcggtcacgtggctgaaccaaattgaaaaaaaaaaaagaagccgatcgaaactcgaatgcggcgaaccgagagcgaagagaggattgaaagaaataagtaaatacctgaacatcgaattcgataaagtcgagagggaattttgaagcggcattaaaggagaggatggagttctccttgagagcagagaaccttagatccggcgactgcgacatgttcatgccgtgtcctctatggccaaccaccacaaacttgttattcgctttgcgagaggagcaaatgagcgacgggttctcagggaagtggtcgaggcttggcacttccgagacatgaatggcttttagagacatatttctatttttagaaagaaaaaagggctcgtctttctttctttctttccttcctgtgagattgatgttgtgaggagagggatatgggtttgggggctttgcttaaaaaagaagaagaagaagaagaataaagaaggagaagatgatgggatcttggaatattctttggatcgccacgtcatcattcctaataacagtcaaaatcgaaattatcccttttggatattccctcccctctctttttcctggttgtctccctctctcttgggctcctggtgggccttagctctctctagatggaaatcgaatagagttagccatcaatgttgattgattcacaccttcgttctaatctttgttacttgtggattggttatctattataaatgcttccattaaatttccgaatattccaaagcatatacaatcttactaaactcctcctattcgacagacacatcttctctaccttgataagctttacagctcctactacatattatcacgccctttgattaaatgggccttgtactttttaagataagatatagtgtctgtatattagtgacaagatctatgatgggcttttaggagagcccataatgggcctgacgacgagccaacataggtggggccaacccgaggacgggaaaacgtgactggtgagtattattattagaagactgtcagtttcacttcacttctcgaggaaaattgctaatcggagaaacaagtgagtggaggagagagacagatataaaggttcccgcgttgagagagtatttgctaattaattaaggtggatatttgatgctaggagaggagagtgagagataagatgggtttcgtctgaagagctccaacttgattcgctcaattgatctcttttgtatcgacaacctgcgatg

SEQ ID NO: 14762 - DNA, 3000 bp, Unknown
  misc_feature (1)..( 3000): cDNA_ID_2730835_gDNA_ID_2684224_Annot_ID_137524 3000 nt of promoter + ATG
gcaagagtaaggatcatcaggatccagttgatctccgggatatagatctgtccatatatatgtttcgaagtatggactactttgatgcgtgggaagcaccctagggcatggcattgtttgattattgagaacgtagtggttatcacagcctgactgccaacaatggctgcaagtgtggcaatgacaaagacaggccagaaaacaggatctgcataaaggaccaagatcatataagattgtcattatcacaaggaaaaaagtgaatattaaaccctggtgtcaaagtaaatgaacctgggactgaatcgtaaaaactgttaggaatagacccgaggttctttgacaggaaagctgcctggcccatgtattgtaccaccagacaggggtacacgacaacggcgaaagcaacctgcacaaaaaaaaaaaaaaaagtagagtgtaagaaacaaagctgcgcaaccagcatggacttatgttgaaggataactaccaaggctgtagagaagtcacagataaaataactgatgtacaccactactagacaggaaacctctgcttactctgattgagaccgaggtgaaatggccaagatttgcaaacatggcttcagtacctgatgagacagcgataatcactttagcaacataagaccattcactaaaggattcaaaacaagcagaaaataaataatattatggttatgccttgatccagaaccagaactacctgttacagaaagaagaacccctccaagagatatccatccatcttgaccagtcactctgaagaatttgatgatatacagtggggaaactgcatgtattatctttggattccaacggatgatgttgtataaaccgatgaagaatattgaaataagccagatgatcacaattggtgcaaacatgaaagccaccctgtgagtaccacaatgttgcaaagcaaacagtccgaccaatatgacacaggcaagcaccagtagttcgcctgcagtggattaagagacaaaacatcaaaacaaaagaaagtcacaagatgtaatcaaacaacaaacaaaacttgatacaggcacatagtggaagcaacacgtattagataccatcagtcacattcttctctgtagcttgcaagcctgacaaggacgacagaactgaaaggaagcaggagttagtcagtcagatattgaccacaaacaaacaaaaaagatgctgatgaatagaaagtaaggatggtcacgaagaaggtgggtggttacaactacaagtaagagacgatgaaattaactccaactctgaatataatatgtaggaggcaggcatgctttacctgataaagctggggtcagaaccccgtctccaatgaccatagcagctccaaaaagtacaacaagcagcaaagcggtcctcagccttttgtgcttttcaagaaatgttctgaagggggatgaagttacagtatccgtggaaggaccaaacttgtaagctgagagctcctcatcagcagcttgctggttaggaagtaagctaagcttagcatgcctacaaagcagggaatagagagcaaatgttccgcctagagaggcaaaaacagaaaaagattcaatcatccggggagatataagttgaagagaggaggatctcgtttgctactgcaccttctccattgtcatcggcactcagtaatacaagaaggtatttgagaaggggaatgagcgtgagggtccagaaaatcaaagagaaagcaccaaatacggcatcctcgttgtgatgcttgtgcaactttccaataaatgtgctagggaagacataaagaggagaagtactgagatcaccgtagactacaccaaagctctggtaggccaaaatcaagttactagagagattcatccacgagagctgaaggaaacggatatcaacaattcagtaagtctgaaaacagagcaatagaagaatcccagcacaagaaagcaagggtctttatttagatagaaatgaaagcaaaagccaaacatgctatgaacagttcaagtgggcataaaggagctaacttgagaaggattccgacggggagagactccagattccgccggcgccatcgcaggttgtcgatacaaaagagatcaattgagcgaatcaagttggagctcttcagacgaaacccatcttatctctcactctcctctcctagcatcaaatatccaccttaattaattagcaaatactctctcaacgcgggaacctttatatctgtctctctcctccactcacttgtttctccgattagcaattttcctcgagaagtgaagtgaaactgacagtcttctaataataatactcaccagtcacgttttcccgtcctcgggttggccccacctatgttggctcgtcgtcaggcccattatgggctctcctaaaagcccatcatagatcttgtcactaatatacagacactatatcttatcttaaaaagtacaaggcccatttaatcaaagggcgtgataatatgtagtaggagctgtaaagcttatcaaggtagagaagatgtgtctgtcgaataggaggagtttagtaagattgtatatgctttggaatattcggaaatttaatggaagcatttataatagataaccaatccacaagtaacaaagattagaacgaaggtgtgaatcaatcaacattgatggctaactctattcgatttccatctagagagagctaaggcccaccaggagcccaagagagagggagacaaccaggaaaaagagaggggagggaatatccaaaagggataatttcgattttgactgttattaggaatgatgacgtggcgatccaaagaatattccaagatcccatcatcttctccttctttattcttcttcttcttcttcttttttaagcaaagcccccaaacccatatccctctcctcacaacatcaatctcacaggaaggaaagaaagaaagaaagacgagcccttttttctttctaaaaatagaaat

SEQ ID NO: 14763 - DNA, 3000 bp, Unknown
  misc_feature (1)..( 3000): cDNA_ID_2730831_gDNA_ID_2684224_Annot_ID_137525 3000 nt of promoter + ATG
atctttccaaacctgcatgcaccacatgacagtagagtatatatgttttgcaaaatcacatcttcattgatagacaataacccccggatataatggtacctggatctcccgcaaacctaaagccttcccgatcgttgttgcagtcaaatcgctacctcctctaccaagcgtagttacagcacaagatctccatccctgcacaaactcaaagtgaggccttttgttttcgaaattctaaaaatgtcacaacaaggcgtgcacgagactcgtaatcaatcgttattttatatacctttccaaggaagcctgtgacaacggggagtgcattttccttgctccagtcaccaagtaactttttcgaaaccgccgggtatgttgcctcaagaatatcagcattagtgaagtcatctgtggtgataatcccgatctcaaatgcatcatactgcaaaaacaaaactcatcgtcaagtcacgaaacaatctataaggtgatcaatctaggtaacatatatatacatacctgtcgtgctttgtgcccaattttgttcaggtacgcagcaaatagcctagtggacatgcattctccaaatgaaaccaagtagtctcttgagcgtaaagttaattccttcatcattgcgacgcctttaagaagctgttccagtccttctagatgttctgcaataactgctgtttccactccaagctcatgagcagtcctggacatggtagaatttgattttcttgaatcatgagaatatagcaaatttgagttggaaaactttacgtatgaaagattcaataaatctgtctgttttttcttaaaaaagaaaccttatatggagttcctttatatagctcaactcttcgatagtgtcgacgttggtgacaccgcagcaaacagccttctccccagcctaatgaaagccaccggctcaaagttttataacggaagaaacaaggtaaaaggtgcaacagacttcacttttgcttaccatcaaaagcttattggtggtctttgccattgctgatagcacaacaacaggcttctcatctgggaagctgagtatgagtttggcaacttgtatcatcctttctgctgatgccactgatgagccaccgaatttcattacacaggtcaattttttctcagttttgtttaacttgaaagtctctgaggcttttctctctagcagctccactcttcccgcttcacaagtaactctcagagcgatgttcttacaagaacgatctacgtttctagagaatacacgagcagaggacacgagtgctgagaagttgagcccctttgagctaaactcaatcctttttgagtttaaggcaagttctggtgttttaactccgtagaactgcattgaagccgccattactcaataagctctgaagaagaagattgtgatagaactcagagagactggctggctcttgtgatttcgacaaataatagagtatgcttgcttagtgcgcacacctgaaacgaagatccgtagaagcaaaacagagtcaaggctaaatgcatgaataaataaaaaaatggatcttgcagagaggagattgagaattggcttatataccagttgacagggctcacgattgcttgatacaaagccggacaagctccgagctatgtatcaagacgagtatcgtagacggtcaagatcccaagctaaaaagattagacggctgcggagtgaactcggtctcggatgttaaatgtttataggcaaaggaaagaatcgaacgatcattcgacttcagtgttcttttccaaaatatgaatctgcttaataataattcaaactcctggtttagcacatatatactagtcgttttaactaaagttttgtttttttttggttggaaaacgtgacatctacaaattccattagtgaacccttaggaggttgagggggtgttagcaaatggtaaatcgaaaaaacgtggccacctactcatagatatacatattttgtttgattaaattagcaataatatacaaactgcataatacgtggcatcaggtgtattgtcaacaatttccacatttagtgtttccttatgcaattacattcactagaggaataaacaatcgatatcagaaatactcaaatagataatggacgtccaatgtcaatgatgagatctaacaaactttgacggtaaagtcgagagacgaaaaaaaggaaagtagcaaaattttattttatatagtgattattgcatgaattaaatagtgaaggtaataatgattcatggcgatatgtatatagttagtatttaaacagcgcgggaacaacaagaggcagttggtttgtatgaattgagagacaagggctttaatgggtcattagaaaaacgcccatgggccttaatgtcatatgtgggcattatggagaatagtcaagagaattccgaataaggccgaagaagaaagaaagatctctcactcactcagctctttggatccgccatagcaactctctcctcatttctcccggccatggagtctccaaagagctatgtaaatccgttctagcttttattctctcgctaattgccaaacagagatgtactatttctttcctctctaactcctcctgaaatggtgatatttgtttctccgtctacaacaagtttcatttgtttgaagacaaatggagtcactcatgggccaaactaaaagcccattaaaggccgaaatcaattattcttgagcctctactctcttgcctaagtgtatgtatgtggtttagctatataagatagcaactgcttgctgtttgagaaagcttgaaacatcacacattcgcctcgttgaaaatgaaaacagcacgacaaggggggagaggagagaccgttaagtcatgagatcttcgtttcggctggaaaaaggaaaagaaaaagaaagcacaaaaatctttggtttaaattctttctccatggacgaaccaccacaactactactagcttctctttgcctatg

SEQ ID NO: 14764 - DNA, 3000 bp, Unknown
  misc_feature (1)..( 3000): cDNA_ID_1010265_gDNA_ID_2684224_Annot_ID_137526 3000 nt of promoter + ATG
atatttgacaacactggaaagctaacgacctacctacgataaatgagtttgtcacctacagaggttaatgtggatgttatcaccaaatcttgaaaaatgtttgcagctgtttccgtctccggaagtcctctgacccagtgagcaaccatcctttttaaagggccaccttaaaattccaatagagcttttatgcagctaggaaattaaaaaccatgtcttatatcaccaaaactcacatgttaatgcatagtagtagtaaacacttgagcttgaccagagttttgaaagatgcttttaccattgtgtggcgtgattttaaataaaggggaggggccattggcttgtcagagttccaaaatcagcgaaaagataaatcaaagctaacctggaatcaagcttagcacggaaggaaatgcaagattaagttggtctggcaaggctttaaccaggggagcaagatgttgcagcgaagaatgcccaaatgatgtagctgcaaatgcaacaatactctttagatcaaatctagacgacgtgataagactaatgttcaaacacatacaaatgagaaagtcctaggaaataagaaaggatcaacgtcacctgggttagaaagaatcaagacaagatcaatatcagggttacaggctgcaacagcgagtgcaatgcaggcgccgagagattctccaacaagatatatgggtttcccaggtgatcgttgattttcatatttgacagttgtttcaaccatggcgactagatctaaaagcatccaaagtgttagagaatcagataaaaagatctaaaagagttgaaatagaggaaatacctgtgaaagaagagcgattgctcgctggtatgtgcaagcaccagatatcaaacatccttgtaaaaacaaacatcgctcagccgaatcaacaaccaccgctataagaaaaactaaaggatagaaacgtcctttgatcactcactgtccaagtttctggtgctgccttattagcccgagtccatttccgtcgatacctaacgacagtcatttccgaattagagaaagcaattgcacatttctaactaactcaattaatcgggactaaccaggtaggaagagaaggagcggggcaccgtcacatggatccttgcttctttcgaggggagagaaccagcgagatgggccgttgtcttccggtctgatgaaatccttagccgcctcgaggtagttccagaagctcttaacgaatggctgctcgtagtccacaagcctcgagctaaaaacggtgacagaagcggagaatcggcgtgccgggggtagggttactccaagggggtgcttgtgcttctctccgttgaataatccgacggcagagagcgtgtgaaatccggtggccgccataggcaaagagaagctagtagtagttgtggtggttcgtccatggagaaagaatttaaaccaaagatttttgtgctttctttttcttttcctttttccagccgaaacgaagatctcatgacttaacggtctctcctctccccccttgtcgtgctgttttcattttcaacgaggcgaatgtgtgatgtttcaagctttctcaaacagcaagcagttgctatcttatatagctaaaccacatacatacacttaggcaagagagtagaggctcaagaataattgatttcggcctttaatgggcttttagtttggcccatgagtgactccatttgtcttcaaacaaatgaaacttgttgtagacggagaaacaaatatcaccatttcaggaggagttagagaggaaagaaatagtacatctctgtttggcaattagcgagagaataaaagctagaacggatttacatagctctttggagactccatggccgggagaaatgaggagagagttgctatggcggatccaaagagctgagtgagtgagagatctttctttcttcttcggccttattcggaattctcttgactattctccataatgcccacatatgacattaaggcccatgggcgtttttctaatgacccattaaagcccttgtctctcaattcatacaaaccaactgcctcttgttgttcccgcgctgtttaaatactaactatatacatatcgccatgaatcattattaccttcactatttaattcatgcaataatcactatataaaataaaattttgctactttcctttttttcgtctctcgactttaccgtcaaagtttgttagatctcatcattgacattggacgtccattatctatttgagtatttctgatatcgattgtttattcctctagtgaatgtaattgcataaggaaacactaaatgtggaaattgttgacaatacacctgatgccacgtattatgcagtttgtatattattgctaatttaatcaaacaaaatatgtatatctatgagtaggtggccacgttttttcgatttaccatttgctaacaccccctcaacctcctaagggttcactaatggaatttgtagatgtcacgttttccaaccaaaaaaaaacaaaactttagttaaaacgactagtatatatgtgctaaaccaggagtttgaattattattaagcagattcatattttggaaaagaacactgaagtcgaatgatcgttcgattctttcctttgcctataaacatttaacatccgagaccgagttcactccgcagccgtctaatctttttagcttgggatcttgaccgtctacgatactcgtcttgatacatagctcggagcttgtccggctttgtatcaagcaatcgtgagccctgtcaactggtatataagccaattctcaatctcctctctgcaagatccatttttttatttattcatgcatttagccttgactctgttttgcttctacggatcttcgtttcaggtgtgcgcactaagcaagcatactctattatttgtcgaaatcacaagagccagccagtctctctgagttctatcacaatcttcttcttcagagcttattgagta

SEQ ID NO: 14765 - DNA, 3000 bp, Unknown
  misc_feature (1)..( 3000): cDNA_ID_2123597_gDNA_ID_2684224_Annot_ID_137529 3000 nt of promoter + ATG
gtgatatatattgaaaatatggctacattagcggatccatcacagaaaaagagttttgtggaaacaaaaaggtgtggcggctacatcattctgatttatattattatatatgcaactccttcaaattttggttcaatggattcaaatttcaaacatatttcttggtcaagaatcaatatgcatctagatctctgaggtaatcattcttttcttatttgatttacaatttggattagcaaggtttccaagataatatccaatatcacgtgtatttgaggttcacctaccaaacttgattgaattcaataaacaatgagctcgaatgatgttgagattgttgactattttggctctttgctttcttctatacttgtcaaaagtatataatcattgattccatggattattcatccctccatagttattcaaacttgattcatattcactttttacacacaacatagaattataataatactaggcattgatcacatgtaggatttgagacggggtcgcgtaagggactgcgctccatccaccaagacagtggtgcctgtcatgaagcgtgagccatcgctgatcaagtagataacagtggagtagaggtctgtgtccgggttgagccactggccgaggggtgcagcgtccttgaccagcttctgcgctcggtctcttcccacagaagctgtatactcatcatccagatgcagccctctagagatcatgttgacccgtatcttgtgcttcccgagactcatggctgatgcctgaaacccaatcatcaacaaacatattcaagttacgaacgcgatgtgtctaattaggagctaggatgcatacccggacgagctggtgaatagcggcagaagttgaagcgtaggcatcagcgccagggtaaagcgccctctctccgctggcgatagtggccatgaagacaatggagcctcctgatccatggtccttcatccttgtggctacagccttcaagagaaaccatggagcggtgagattgatctttgtgattctgtggaactcatcttgagagacttgaagaatgtcctgcacctttcctgcaagaaagaaagattgttgaataaaggaatgatcaacacacaagagcatcaaaggcagggtagtgaaaaacaagaagcaaattaaaccttggtaggtataagagttgagaaaagcatcgaaatggccggaaagttcccatgccttttggacagcggcatgaaaagcaacttcagagtcagattccatgtcgagtgctataacatcggcagggaaggctccctcaatggaatctctaatcttgtctacaatgctccttagggaaccctcatttcccatcattaccaacctagcaacagtacattgcattttttgaaggttaactatagacaccaaagtcaaccacaacacaaatcggggctagaagaagaaacacaggataggaggaaagaagacaaaatgagagactcacttgcaaccgtgtttggctagatggaaagcgatgtttcgggacacctcgtcgccgttggatgtcatcaacactctcttcgccggattttccattttgccaaagtaactctttataaaacaattcagcagattcaacaagacttaagggagggagggagtgagattgattcgatcgccaattctaaataactataaagagtggctgcaaaagctcttaccggaactgtgtctgtgtgttaccaaaacggcgaaacaaagcaaataattaatgcctaaccacatgatccaccacgttctgttgttaccttctttaatttgtagatagaagaagatggtgattgataacggagatgtatttttttctttaataaaaagcccacttcaaggcccagatccatttctgtactttgtaggttttccaactttcccggcgccggaagcaagcgtaagttatcactgttccccaaccaaattccatcatatcctattatcctactactaatggatccatctccaagattcctaatttcactttgctacaaacttatttcgtgtttttggtttataattaatagccgttgttggttatgaatatgtaagcataaaaggcatttgggagctccagacagacaatgaatcatcaacatcaggtactctgtctttcgtttatgtttctgttccattcttttgaaatatatagaggaggaacttgttattagctagtccattgatcaacacacaaagagtgagaatgaaagcaattcctccaaccaaaaggatgctttcccttattgatttagttggaccaatatataaagagaacaaaggagggtgttggtaggtaacaaaagattctaggtggtgggagggtagtggatttttgaaaaccgtgtgttgacttaatgaaagaggtgtagagtaatgggattgtgagagtgttaaataataaaagactaggatacgaaatcattgtgacatgtcaatttttcaagtgggtggtggaatccgcaacaaaatataaaataagaaaaatgctttgcttgcttgcttgctctactttgccttctttttgcaaccaacatgacgttatgctggaaaggaatcaaattgttacttggtcatgcacctgtgaacgttacggagaggtctacctcaagataacgaatgatctattatactagtaaataccacatcttgcttgagaaggagaatataatcccctttatgatcatcaaattgaccccaaatcttcacccgacttttggtagtattcgaacaattataacagaatctaaaagttgctgtgcccgtgccacgtcatctctaagaatctttagtggcacgtgctcgatcaactaatgaaaacaaggttcggttccggtggcctaccatttttatcctccttcaacttccctctccctctctcttttaggaattttcctcagaaattggaggactcacactcttctgggtttctgctgcagccaaatcaccaaggagatacatactacaaccatg

SEQ ID NO: 14766 - DNA, 3000 bp, Unknown; identical to SEQ ID NO: 6877
  misc_feature (1)..( 3000): cDNA_ID_3040948_gDNA_ID_2684224_Annot_ID_137530 3000 nt of promoter + ATG

SEQ ID NO: 14767 - DNA, 3000 bp, Unknown; identical to SEQ ID NO: 6885
  misc_feature (1)..( 3000): cDNA_ID_2027099_gDNA_ID_2684224_Annot_ID_137531 3000 nt of promoter + ATG

SEQ ID NO: 14768 - DNA, 3000 bp, Unknown
  misc_feature (1)..( 3000): cDNA_ID_2730827_gDNA_ID_2684224_Annot_ID_137536 3000 nt of promoter + ATG
gatgcaataactcggattaaaataaaatgtaaaacgtttttccgtcaaatatgatttaaaaaaaaaaaaaaattgttactaacggctagtttacccccaaaaaaaaatgattttactaacggaggagaagtgtttcgaaaattcgacaatgattaagaagaaagttagatcaaacgaacaggatcacaggaagaaggtacaacgtgaagcaatcaatgaggctaaaataaaatattgagaaatttgctcaaccatatgatttcattaatatataataatgaataacagttctatcatataaataaataatttataatccaccacatgacaacagatgggttttcccattttatttaactataaacagtattttgctctcacagatccacaaggacaagcatattcaaggatgttttagttcttaaagaaaagataaagagagaccagacgcatagtggtaacttggtctacaagttagagtggccaagccggagaaggacacggtgccacgaagtgttgagaacccctcttaggttccacaccgactccacattttccggttgaacattcgccgccgaatcaacctgcacatttccacagttttctattaactcttgtcagaagccatttatattagctgagcaagatgttgaggctttaccgctttggcgatgacctctgtagtctgtgaaacatcaatggtggcttcaaacaacacccatgcccatttgtcactggagctgtgttctgagatgtactgctttcctggttcctgcgttctagaagcttccacccagtttttgcctccatccagggatatgtccactctttctatcccgcgtccacctcctgaaaccgcatatcctttgatacttacctgcaattttttttttttaattgaattagctcttgctttcctacattggtcagatcagattaggtagtgaattccgcgttctaacctttccaggcttcaccatttgcacatcctccacagagcagattgcactctgttaacaatgataaacgagtatggggtcaagactcaagacaaactaatgttcatttacaaattctactatctgatcaaattcataaggcaactggtccaaacaagtaaaattttcagtataccagtagaaaatatgatcagtcgattcatcaccatcatcaactgttttcatggaagaatacagaattacgaacttcgcaagaaaattggaaaatcttaattttgtagcgcatataaacgaaaaacgtcattacaaagtcaagtattctgtaagaaagaagggaaagttgtatttacctgaacagggaaatccatttgcggtctcctagaggaccagttgatattatcccaattgacagagggtggaaacattttgtaatctttttgcatgaagaatccctacatcacattttgatccaagtcccttacaatgttagaacagtttctgattgctaaaaagagggtaaaagccggacactttagttgagacctggctttcttcagcgatgacattgatggaatcaagccatttgaccgaacgagcaccaatcacaccagggacaaccacccttaacggaaatccgtgatccctgttcagggtcttcacagaagaaacacgttttccaacaaataagcacatttccgagtactcactcatactcacatgtcaaacaagtgatgatttaaacacaagtgagactaatttaggagagcgatatcaaacctctccattcatctcataagcgagtagaacatccgcttcaggatttgtggcttgacttagagtgattgacgccttataagggcccccattttcctcctagagatatagaaagagcatagacttttcatgggaattcataacaaagcataaaaaggtggaatttattaatatatatctaccttacagcgatcaacactaacgaactcaacatgtctggctcctaaattggtagaagcagtcagctttggtatccccacaagctcaagaacatcggccagtttcgccccaccccagacagctgaaaggcaaattctttcaagacaagtatgtattgaaagcatgggaatgggagaaagagagacgaaccgttgccaatagcagaaacatcccatccaacacctctaacattcctaactttgctcatggcagtccttctgttaccggcacactgcattgaaacaaaagtgatgttaaattaaatgtggagaaaaactaaaggtagaagatttactcaaaggaagaatgaacctgaagagtagcagtaacattgtactttgggagggacctgcaattttgaggaggaaacaagagtggtgcttgatggagagatacaagatcaaagttggagaatgtaaagagaggcaaataaataaaggtacctgatgtctttgataaagagctttctcgggttctggatcaatccagtaagggtgacggagtagctggtttggcaaaagaaatagcagaaatgagcggaggaggcaaaattgaagatgaatgagagtgagagagagacctttgaaggtgatcaacaatggggatgggaccatgatttcgcttgtagaaaaggtcgacgggagtgacataagatgagactaaggccgagcggggaggctcggcgttgaaaggttcctgcggatcacccaaatttagatgccatgaagaaaaaggctatatcagactagtgactgattcgattggaaagagagaagaagaagaagaagaagcttaccttggcgttgaccttgagagaagggtgacgaggtggttcctgcgagtattccgaaggacctctaattccaggcattcttctttcgaggaggagataccgaggaaatgacgattgagtgctttcctttgtgacgtctctctcttcttcaaaggaaaactatggaacggcgtcgttttaggtttgcgtctcttaatttgtggataacagacagagcccaaattgagcccaaacaaaaacaaattgtgagagatg

SEQ ID NO: 14769 - DNA, 3000 bp, Unknown
  misc_feature (1)..( 3000): cDNA_ID_3040952_gDNA_ID_2684224_Annot_ID_191901 3000 nt of promoter + ATG
ttccgtcaaatatgatttaaaaaaaaaaaaaaattgttactaacggctagtttacccccaaaaaaaaatgattttactaacggaggagaagtgtttcgaaaattcgacaatgattaagaagaaagttagatcaaacgaacaggatcacaggaagaaggtacaacgtgaagcaatcaatgaggctaaaataaaatattgagaaatttgctcaaccatatgatttcattaatatataataatgaataacagttctatcatataaataaataatttataatccaccacatgacaacagatgggttttcccattttatttaactataaacagtattttgctctcacagatccacaaggacaagcatattcaaggatgttttagttcttaaagaaaagataaagagagaccagacgcatagtggtaacttggtctacaagttagagtggccaagccggagaaggacacggtgccacgaagtgttgagaacccctcttaggttccacaccgactccacattttccggttgaacattcgccgccgaatcaacctgcacatttccacagttttctattaactcttgtcagaagccatttatattagctgagcaagatgttgaggctttaccgctttggcgatgacctctgtagtctgtgaaacatcaatggtggcttcaaacaacacccatgcccatttgtcactggagctgtgttctgagatgtactgctttcctggttcctgcgttctagaagcttccacccagtttttgcctccatccagggatatgtccactctttctatcccgcgtccacctcctgaaaccgcatatcctttgatacttacctgcaattttttttttttaattgaattagctcttgctttcctacattggtcagatcagattaggtagtgaattccgcgttctaacctttccaggcttcaccatttgcacatcctccacagagcagattgcactctgttaacaatgataaacgagtatggggtcaagactcaagacaaactaatgttcatttacaaattctactatctgatcaaattcataaggcaactggtccaaacaagtaaaattttcagtataccagtagaaaatatgatcagtcgattcatcaccatcatcaactgttttcatggaagaatacagaattacgaacttcgcaagaaaattggaaaatcttaattttgtagcgcatataaacgaaaaacgtcattacaaagtcaagtattctgtaagaaagaagggaaagttgtatttacctgaacagggaaatccatttgcggtctcctagaggaccagttgatattatcccaattgacagagggtggaaacattttgtaatctttttgcatgaagaatccctacatcacattttgatccaagtcccttacaatgttagaacagtttctgattgctaaaaagagggtaaaagccggacactttagttgagacctggctttcttcagcgatgacattgatggaatcaagccatttgaccgaacgagcaccaatcacaccagggacaaccacccttaacggaaatccgtgatccctgttcagggtcttcacagaagaaacacgttttccaacaaataagcacatttccgagtactcactcatactcacatgtcaaacaagtgatgatttaaacacaagtgagactaatttaggagagcgatatcaaacctctccattcatctcataagcgagtagaacatccgcttcaggatttgtggcttgacttagagtgattgacgccttataagggcccccattttcctcctagagatatagaaagagcatagacttttcatgggaattcataacaaagcataaaaaggtggaatttattaatatatatctaccttacagcgatcaacactaacgaactcaacatgtctggctcctaaattggtagaagcagtcagctttggtatccccacaagctcaagaacatcggccagtttcgccccaccccagacagctgaaaggcaaattctttcaagacaagtatgtattgaaagcatgggaatgggagaaagagagacgaaccgttgccaatagcagaaacatcccatccaacacctctaacattcctaactttgctcatggcagtccttctgttaccggcacactgcattgaaacaaaagtgatgttaaattaaatgtggagaaaaactaaaggtagaagatttactcaaaggaagaatgaacctgaagagtagcagtaacattgtactttgggagggacctgcaattttgaggaggaaacaagagtggtgcttgatggagagatacaagatcaaagttggagaatgtaaagagaggcaaataaataaaggtacctgatgtctttgataaagagctttctcgggttctggatcaatccagtaagggtgacggagtagctggtttggcaaaagaaatagcagaaatgagcggaggaggcaaaattgaagatgaatgagagtgagagagagacctttgaaggtgatcaacaatggggatgggaccatgatttcgcttgtagaaaaggtcgacgggagtgacataagatgagactaaggccgagcggggaggctcggcgttgaaaggttcctgcggatcacccaaatttagatgccatgaagaaaaaggctatatcagactagtgactgattcgattggaaagagagaagaagaagaagaagaagcttaccttggcgttgaccttgagagaagggtgacgaggtggttcctgcgagtattccgaaggacctctaattccaggcattcttctttcgaggaggagataccgaggaaatgacgattgagtgctttcctttgtgacgtctctctcttcttcaaaggaaaactatggaacggcgtcgttttaggtttgcgtctcttaatttgtggataacagacagagcccaaattgagcccaaacaaaaacaaattgtgagagatggcggtggccaaacttcacggcggaggtatggcggcgatg

SEQ ID NO: 14770 - DNA, 3000 bp, Unknown; identical to SEQ ID NO: 6885
  misc_feature (1)..( 3000): cDNA_ID_2027099_gDNA_ID_2684224_Annot_ID_191896 3000 nt of promoter + ATG

SEQ ID NO: 14771 - DNA, 3000 bp, Unknown; identical to SEQ ID NO: 6877
  misc_feature (1)..( 3000): cDNA_ID_3040948_gDNA_ID_2684224_Annot_ID_191895 3000 nt of promoter + ATG

SEQ ID NO: 14772 - DNA, 3000 bp, Unknown; identical to SEQ ID NO: 6887
  misc_feature (1)..( 3000): cDNA_ID_2123597_gDNA_ID_2684224_Annot_ID_191894 3000 nt of promoter + ATG

SEQ ID NO: 14773 - DNA, 3000 bp, Unknown; identical to SEQ ID NO: 14764
  misc_feature (1)..( 3000): cDNA_ID_1010265_gDNA_ID_2684224_Annot_ID_191890 3000 nt of promoter + ATG

SEQ ID NO: 14774 - DNA, 3000 bp, Unknown; identical to SEQ ID NO: 14762
  misc_feature (1)..( 3000): cDNA_ID_2730835_gDNA_ID_2684224_Annot_ID_191888 3000 nt of promoter + ATG

SEQ ID NO: 14775 - DNA, 3000 bp, Unknown; identical to SEQ ID NO: 14761
  misc_feature (1)..( 3000): cDNA_ID_3018975_gDNA_ID_2684224_Annot_ID_191887 3000 nt of promoter + ATG

SEQ ID NO: 14776 - DNA, 3000 bp, Unknown
  misc_feature (1)..( 3000): cDNA_ID_2995189_gDNA_ID_2684224_Annot_ID_191886 3000 nt of promoter + ATG
gaggagctctcagcttacaagtttggtccttccacggatactgtaacttcatcccccttcagaacatttcttgaaaagcacaaaaggctgaggaccgctttgctgcttgttgtactttttggagctgctatggtcattggagacggggttctgaccccagctttatcaggtaaagcatgcctgcctcctacatattatattcagagttggagttaatttcatcgtctcttacttgtagttgtaaccacccaccttcttcgtgaccatccttactttctattcatcagcatcttttttgtttgtttgtggtcaatatctgactgactaactcctgcttcctttcagttctgtcgtccttgtcaggcttgcaagctacagagaagaatgtgactgatggtatctaatacgtgttgcttccactatgtgcctgtatcaagttttgtttgttgtttgattacatcttgtgactttcttttgttttgatgttttgtctcttaatccactgcaggcgaactactggtgcttgcctgtgtcatattggtcggactgtttgctttgcaacattgtggtactcacagggtggctttcatgtttgcaccaattgtgatcatctggcttatttcaatattcttcatcggtttatacaacatcatccgttggaatccaaagataatacatgcagtttccccactgtatatcatcaaattcttcagagtgactggtcaagatggatggatatctcttggaggggttcttctttctgtaacaggtagttctggttctggatcaaggcataaccataatattatttattttctgcttgttttgaatcctttagtgaatggtcttatgttgctaaagtgattatcgctgtctcatcaggtactgaagccatgtttgcaaatcttggccatttcacctcggtctcaatcagagtaagcagaggtttcctgtctagtagtggtgtacatcagttattttatctgtgacttctctacagccttggtagttatccttcaacataagtccatgctggttgcgcagctttgtttcttacactctacttttttttttttttttgtgcaggttgctttcgccgttgtcgtgtacccctgtctggtggtacaatacatgggccaggcagctttcctgtcaaagaacctcgggtctattcctaacagtttttacgattcagtcccaggttcatttactttgacaccagggtttaatattcacttttttccttgtgataatgacaatcttatatgatcttggtcctttatgcagatcctgttttctggcctgtctttgtcattgccacacttgcagccattgttggcagtcaggctgtgataaccactacgttctcaataatcaaacaatgccatgccctagggtgcttcccacgcatcaaagtagtccatacttcgaaacatatatatggacagatctatatcccggagatcaactggatcctgatgatccttactcttgcaatggctataggctttcgagacacaactttgattggaaatgcctacggtaaactttatatcattgcaaactatatttccctctccaggatctgattgtttgatggtggttctctcattactcacaggaatcgcatgcatggtagtaatgttcatcacaacgtttttcatggctcttgtcatagtcgtggtttggcaaaagagttgttttctggcggctttgtttcttggaactctatggataattgaaggtgtctacctctcagcagcgctaatgaaagttaccgagggaggttgggtgccttttgtgctcacgttcatatttatgatcgccatgtatgtgtggcactatggcacccgtaggaaatacagctttgatcttcataacaaagtttcattgaagtggttgctgggattaggacctagtctaggtattgtccgcgttcctggaataggactcgtttactcagaacttgcaactggagttcctgcaattttctctcactttgtgaccaacctgcctgcattccataaagtcgtggtgtttgtttgtgtgaaatcagttccagtgcctcatgtttcccctgaggaacgcttcctcattggtcgagtttgcccgaagccttatcgtatgtacaggtgcatagtgaggtacggttacaaggacattcaacgggaagacggggactttgagaatcagcttgtacagagcatagcggagttcatccagatggaagcaagcgacctccaatcctcggcttctgagtctcaatctaatgatgggagaatggccgttctaagcagccagaagagtctctctaactcaatcctgacggtttcagaggtagaggagattgattatgctgaccccacgatacaaagcagtaaatccatgactctgcagagtttgcgttcagtgtacgaggatgagtatccgcaagggcaagtgaggaggaggcatgtgaggttccagttaacggcgtcaagtggtgggatggggtcctcagtgagggaagagctaatggatctgatacgggcgaaagaggcgggtgttgcatatataatgggccactcgtatgtgaaatcgaggaaatcctcgtcttggttgaagaagatggcgatagacatcggttattctttcttgaggaagaactgcagagggccagccgtagcactcaacattcctcacatcagcctcattgaagttggcatgatttactatgtttaagccactaatatgagtagcattcataattcatggggggaataatgggaacaatctattcaagtttcaagtgtccccaaggcaaaaattgtatacttaaatattcttctggttgggaatgtagtctgcgaaacattatatcttaatcctgaaatgtgtgcttggaagtgtaaaatgtaaaccactcttaataagctaaagacttcactctctctctctctctcttcattatcccctacacttctctttctaaaacctctggggttcttgttaaagatgatg

SEQ ID NO: 14777 - DNA, 3000 bp, Unknown; identical to SEQ ID NO: 14760
  misc_feature (1)..( 3000): cDNA_ID_2730847_gDNA_ID_2684224_Annot_ID_191885 3000 nt of promoter + ATG

SEQ ID NO: 14778 - DNA, 3000 bp, Unknown; identical to SEQ ID NO: 14759
  misc_feature (1)..( 3000): cDNA_ID_1012003_gDNA_ID_2684224_Annot_ID_191884 3000 nt of promoter + ATG

SEQ ID NO: 14779 - DNA, 3000 bp, Unknown; identical to SEQ ID NO: 14758
  misc_feature (1)..( 3000): cDNA_ID_2724601_gDNA_ID_2684224_Annot_ID_191883 3000 nt of promoter + ATG

SEQ ID NO: 14780 - DNA, 3000 bp, Unknown; identical to SEQ ID NO: 14757
  misc_feature (1)..( 3000): cDNA_ID_1397255_gDNA_ID_2684224_Annot_ID_191880 3000 nt of promoter + ATG

SEQ ID NO: 14781 - DNA, 3000 bp, Unknown; identical to SEQ ID NO: 9127
  misc_feature (1)..( 3000): cDNA_ID_2180622_gDNA_ID_2684224_Annot_ID_191875 3000 nt of promoter + ATG

SEQ ID NO: 14782 - DNA, 2997 bp, Unknown
  misc_feature (1)..( 2997): cDNA_ID_1398573_gDNA_ID_2684224_Annot_ID_191873 3000 nt of promoter + ATG
gaattcttctgctgcagtttttcgaactgatataacccatcaagagagagttggtagcttagttttttgtgttctctcttgtctgtcctcttcctgtacaacgctttaatattagatggttaactagatccccttgaaaatggctaccacttctttgttctctatctccatgttgggaagtaaaagatattcagtataaacttttgaaatagtgtgtagcatcaagttaagaaacattactagcaaaaaataatgtataggaaaagtctccgcatatgtttcagggacaaaaaaaagattcaaagatcaaaaaaaccctgcagccaaatacacagagaaaaagctttaaggaagacaaaagattcgttatagaattgagcttctctggggatgaaacggtttttcttgatagctttttcaacgaacactcaagccttgaatagctgcagcagatgatgatgatgcctgagaaccttcctccgttaccttattcgattcgatggtagttatgatacttgaaatgttgtcctacacaaccacacataagaatcagattcaggagatgttttgtaataaaattctgtaataagtgaaagcttttgtagttaccttccaagtcgcaagctttgttcggagagattgccattgctttgtcccaaattcacgttcggaagagcggctgtaagatatgaatcaaaccatcaaataatgaatgttgcgtttagataagtgcagagtttcaatagatgtgtgacttgcctgacaattaaaacttggttcatctgatccatcttacactcaatcagttttgcagttattgccttcacgatccataactcgacatcctgttcatttacctgaaaacgaaaagaaaaatgagaaactaaaagggtctcaatatttcatgttaagtgcaagcagaggagagtttttacctgaagagtgtctttaatcgaggtgtaaggtattttgccagattcatctgaggccaaatccactagtgacaacaacctcatcttcgtaacacaatcttcattggaaagtcctagaaacaccacaggattcatcaggagatcatatttcagcaaaaacagttagtgagttaacaatgtagtaccatagctttgcagaaatcccgaatttgcattttggaattccgtgtaggcatttaacctctgagtaagaaaaatcttcagaagttggtaaacaggtgcatatttagcatccttttccaattgtgctacggctggcaagtccaataaatcacactgcaagatttaagattgccatcgttgaaattccaatcaaatataaaagagcagtgtcaggacaagaaagacaaatccaattcacattatgatacctggaaaatactggaagctttgacaaattcgataactgcacgcacagcctcctccttggcttcatccaggacctgagcatcctcattggagaaagttgctaggtacttcgtcaagaacttaagggattcattcaccaagctggagtattaatagaaaaaaccatgaggctattgttatacccaaacggaaacaaaaaaagaaagagacagagaatgactgatgagcatagttataaagtataaattatgtttcaataccttttgttttctttcagcacattagcaatggcaagaaagagttccctctgatctttaatgtcaatattccactctttcagaaagttatcgatcttcttaaaagaagaaactatgtactcagtaaccttcccatcaacagctagtgtaagagctttcatgtatacttgaaatcgagcatacgggtggtcaaccaggttatagagattgaagaggctacacaaagattaagacaaaaaaaaaatgagaagtgtgataaatgagcaaagcattcagaaataagcagaaacgattcatacatcttcaaacgaagtgaagctttgtcactgggttgttgagcaaccttggaagctatagctttcaccatttcaaggacttgctcagggcttttcgcattcttgacaatgctgcaaatgatggtgtaggtacactcaagatctgaattaaaaaaagatgcaaatcactgagaattgaatactcgaaagacatacaaaataaacaggtataagtaagaataggaacacaaacctttctcagatatcttagaagataccaattcagctgaagtgaccattaacgaagacaattcaagccacttctctgctaccattgactcctcagcctccctacagagcctggtaatttctggctctgctgcctaaaatttgaaacgataactagttaagtacaggcaagccttgaaaacttaagaagtcgcttaatgaaactaatcttagatggttgaactaatcggatgcatcagaatcctcaaagattacaaactattctagtccagaaactatcaacaaacccttccataaccaatcagattcttcgaacgaaacaacatataccagatcaaatttcccatctcacttaagatagacattcttaaattcccactataaattcacaaccaaggtgtggaggttacctcgggaccagcatcggcccaggcgagctgggaagtgaatcggacaacagcgagaaagggattttcttcggaggtgggaacaatcgtcgtcatagcttagctccggtttcgaatcttctcggctgcgctgaagaacaaatgcaccacaattacaacttgtttcagcagccgaccagcagagacaagagagagagaagaaaatgaaaccctaaatctctatatttttttcttttccggttaaaggtaaccggaaccgaatacgattcctaaattaacggtttacctatctgacggctaataaattatgagaaaactccaacggtcaggattgagctctagtccacaacccttataaaaatcgatttcttcctcagttaacatttgagaagattagggtttaaacgctgccgtgttccgccggatcgccaccgttgaagtcaagatg

SEQ ID NO: 14783 - DNA, 3000 bp, Unknown; identical to SEQ ID NO: 9126
  misc_feature (1)..( 3000): cDNA_ID_2730863_gDNA_ID_2684224_Annot_ID_191872 3000 nt of promoter + ATG

SEQ ID NO: 14784 - DNA, 3000 bp, Unknown
  misc_feature (1)..( 3000): cDNA_ID_2730950_gDNA_ID_2684225_Annot_ID_137543 3000 nt of promoter + ATG
tcatcactatgctcttcccttaattaaacctaattaattaatacacttgtttttgtttgttttcttgtactcctctcctttattcgtacttgtctttttttaaacgaatctcgcatctaatctcaccccctaaatcttgcttttacattatcacgtccatatcactcaaatctcgtggaatacctctatttcgatcttactaaattatcttatgtagatgatagctttcttttgcataataatagttcaagttttgcagaagtataaaaaagtttggtataattgatgacaaaaaattgttggacatataaacatctacttagcatcattttgttggttagacttaaatctcaaaaatttattgcagttttaccttaaaacagccaacaaaattggaaatataaattaaaacattttgaaaagctaatgatgttaaatcgtatatataagacaaaacataatcgtcgtattatctcatttaaagactttattttttattcgctaaaaaaaagcatttaaaatcacctccaaattttattttagcgattttgttcttgatattgaattgtgtatatatatcaacaaaacgaattgaagtgttgttttggacgagtgtatatatatctactttattaaagaaaattgtttgtagaagacaacatcacctgcaatgctttataattctagtgttcttgtttttcttttacagggattaatttccaaaacttttctttcgttcgccagtttagtttcttttatttggaattttgtattttactttggttcctataggctacgcgtaacattggcacatactactttttcatgtatgtaagtaatttctgtaaaaggctacattaaagtcaatactctccgttttgggtttcagtgaaatctaaaaaatgtcaattttacttttgaagttgcaactttcagatagcaacaagagcgaacgagacaaatgcctcaggtttcagtgtacagctccactaaatggttttcgggtgctattatttgtttcatataaatacataaatactactccattttttctaatttaatgagtagtattaacaaaaaaaagagttatagataatgctaagtctaaagaccggggtaaattcaaggtaatacaagtcaacaactaaaaaaaactaattaaggtagtgaattgagttcacgcaattaaataaactagttaaacgagtaatttggacgagggtgaagttgctacatgatcatagtggagtttaatttacaaaagaataggataacaaaactatatatatatatatatatataacgtagtgtcaaataaattaattagtgtgttattttcaaatatacccataaaatccttttattttctaaagaaaacacaaaataaataatcgaatttaagtatgatttttatccattatttttgccaaatagagggttctttactgcatatattccttaaataaaggaaagaggtgactattatcctaatttcttaagtaagaatgcgattgtgaaagttttgatatatccaactttacaaaaaaagaaaaaaaagcattgcatgtgatgagaatccatctcccccatcctcccacccattctttccaactcaaccatctcctttctcttcctattaataaagtatcatcttctttttgtttctctttttattttttaatgaaaaataaaacttttaaaaaaatttgtatttacttcaattttcttacagttccacttggatagacaaatgccctttaatgagatggtggtggactttaagtatatgttatacgcacaacacacacacacacacacacttttatagacatgttttttaataaagaaaattctttcgaacatattccagatctctaatttttcttttgtttgagatgttatatagaattggtctcagctgacactcaaaaaccagatctgactctagggttttgtgtttgttttttgtttttcttgtaagaaaaactatatattggaaattttctgattcgtctcacttgtgggcacagtattcatatttgattaaaacctatttcttatataaaaaggcatgagatgatggcaccacattgtatatttgtatatatacggaaacataaattgggtatatgcatgtgtcttatattcaaaacaaatattctcaagtcccttccctttttaatttacaccagccctatagctaaaggctacacatatatacatttgtcaccattaaaaaacatgtactgttaaacatcaaatttccaagattccgtttatatttttcacctatccttttttttatttatctttgaaaaacaaaacttactcactctgatcgaatattttatgatatgaaataataatgacttgtaattgttgtgtagtggaaggggatgtttttttgtttcttgtcctgatgctaatgtgggctccaagctccttgtcccactctctttatatgtataaacatctctctccatagatatgttttgtgtttgtaaacaaacagtgtacagatagagaagagagaggttcataactactctgaagaagattgaagcaccaaagaccatacaatgcatttctccatctaaggtgagaggtcaatgaaacaattaacaaaaagttgaaagtttcatttatttttttcttttccaagaaaattataaaaagttggatagtaaaagggaacagaaaagctattatccctttatgtgagaaaaaaaataaagatgatttcagaaaaacaaagccctttgtttctctctcttaactcatcttatactttcttcttctattagtaaagatgagtactctctctaccaaataaataaggaaacataaaaaacaatctctccttctttctctacatgaaaaacaaaagattcctcaattttgttcttatttttcatttagtcacagtacctctctcactataaaccacactgtcttgagataaaatacaaaaagagaagagattaaaaacctcatccgatg

SEQ ID NO: 14785 - DNA, 3000 bp, Unknown
  misc_feature (1)..( 3000): cDNA_ID_2730934_gDNA_ID_2684225_Annot_ID_137547 3000 nt of promoter + ATG
tcaacgatgattgtcctggttcatttccccagaccaaaacctgtggcagatagaaaacatcaccgttcagttttcaatattttagagaactgctaggctttaatatagaaaagacttaccaatgcagttccggcaagtgcgacgagtgcagagaggaagttgaagaagagtgcttttgttactgtgaagcctgatcttactagaatcccaaaatcacctatctgcatgtaagtttccgtggagttgtttaaggggtgatacttgttgctatgcacatttttaggtttgtttaggaaatagagtagagacctcttggggaagctcgtgggcaagtaaaaacatagttcttgaccaaccaccaactgatccatagatgagaaacgcacttcctaatgccattccatcagtgaaattgtgctgcacaacaaaaagagcaaaaaaaaatcttcattttctcagacgaatcatctcttggcaatctttcatcatcccgatcgaagctatctctttaatatttcaaaagggaacacgtacttacaacaccatcagagaacaagttgaggtaaccaaagactaggctcgaagaacgcgtctccacctgttctggtttgtccgattttccatcggaagtaatttctgttcctgaatctgatttatcagtagcgtcactagcagaagtctttctctgcaaatagataagtttactcagaaaccataacaagatgaatcctactcgggcttcaagtagaagctcaaagaatagatgtttgcatataacagaagaaatagaagctcgtagctgaaaaggtaccacatttaagtatgctaaacctctcattcacgcaagagactgataaacagaaattctaccaaaactaatgtgttccttgtttttgtactctgcttgcttcttgagttcaactcaaaactcatctgctgcaggtagaaatatttacatagaagtgtgttctcaccttacggagagatttatctgtagagccgccagagactttctctgatgaatttacaattgcatcagaagaagattgttggtccaagttgttatgatcgccttcatccttcagtttcttactgcctgcatggtggtggtggtgatgatgaccccaagtattggacccagatgagttttcttcgacataccgcaccaacttctccacaagaaggaagaccacaatcccagctggataattaagaatgatgattgaaagtgtcaattctgtcaaaatattttgttcaataaacacaagaggaagtgttatgatacttaccaagaacagacaatccaacagacaaatcttgtatagaatgtgagtgtgaaggcgaatccgaatgagaatgatcatgatggtcatggttctcatggtgatcattagagtgagagtggccaccacctgccaaaccataaatatattttgcacttcaggaagatataaaagcaaacaaaatgagaaggcataaaagccaaattatgaaacaatgcagatactaaaaaagagatcagaaacttgtgtccattactgtaccaaaagcatggggcagttggtgaagaaaagcatctcccaacatagctcctgcctggtaaacaaattaactgaatcaacagatcatatattattaacatttccaactcatccaagtgataaagttgcgacgaaacacagtgtatagatattgctaaaatatttttcttgcattcagaaccaccaccgccaaagaaaaagctactgtagtcagtctaatgacttaccccaaagagagccaaagaatcaacgaaccattttgatggcttcccttgaactgttagttgcaacataagacttgaaacagttactctcatgaacacattatagcacatgaataaacgaaagagagcattttctccaggacaattaaaagcaatgctttttggttttcataggtatacaaaaaattgcttaccaaacataatgggaagcaaaacaaggcagatgagtgaggccaagctaactaaaagagagcatcccaatgcattaagccacagagctacaaaaaccaacaagaagaagagattctaatcatcaagtaatgatttgtaaaacccaatgaagaatgtagctaaaggaaccaaatttaccaaaccccgtaagagtggaacttgattcgtgatcgtgatcatgaagacaaggcccaaacccacataatctcatatcctcctcttcagcaagctcctccggcaacttcatctccaccttcgccgtcgtcttcttcacatgatgatcatgatcgtggtcgtggtcgtggtcatgagaatgactacacccaccaccgtgatgatgcacgtgatcgtcacgcgccggcgttgactgagagaatccggattcaacgcacagatccagaaacagtaccaaaaccagaatcggaaccagtagctttctcagcgagaacgacatctctgagtgagctaagaagagcgacggttgaagcgagtgccttcaatagtgatgaagcagacgatgcagaagaagagaatgataattccgattatgattccgaaagtgacaacatccatttggggaaagtaataaaccttaggagatctttttataatttgtagttttggcccattgtttcgaaattaagtcgaaaacccccttttactaggctacagactctacacaactcttataaaagtctttatgttgatgataatcatgaaacatagagatatctatcggatcctaaaaaatgttatccgttaaattttatgcatcaaagcatccatcgttacacgaatgaaacagaggattcaactcctaaaatcaaggtctaatgtccatttcctttgcatatttcaacccaaaacccaatcgccacaaatcacaccacaccaacaaaacaaaagaaaaaacaaaatcaagagaatacaacaaaaaaaagaaagaagaaaggtatagagttttacaatatcttcttcggaatctttagaggaagaaagaaaaa

SEQ ID NO: 14786 - DNA, 3000 bp, Unknown
  misc_feature (1)..( 3000): cDNA_ID_2730931_gDNA_ID_2684225_Annot_ID_137548 3000 nt of promoter + ATG
agtgatgtgattagcgtagaaaagatgtgattagtcaaagagatgctttgcgcgtgagaggagggaacgtgtaatatgtctttttttttttttttttttgttgttgttaactaaatacgtgtacactaatctaatcactgtaatctgttgagatctctttgtttttctttttgagggacaatcaattatgtatgttttctcttttaacaaatttgattgattctctactaataaaagtccttttaaattgttatgagaaacaaaaaaaatctatttaaattgaatgtaaatcaatataatgtttcgttttttgaatatcactgccatttgcgaccgaagttttatagattaacttgttgtattacctttagctcttggtcttgatttgttttagatatatcttttgggtttatgttggtcttgatttgttttagatatatctttggggtttatgtttgtttacatgaacaacaaacataatgtcacaaatgaggattatttttgtcttacgcgattagctacatgatgaatatatctattattatttgataaaaaaaaaagagaattgacaacaaatttcaacaaagaaacaaactgtcttatgacttacaaacaacacaatcattttcttttttctctactctatatacaacaaaaagaaacacaacataaaaagaagaaaagtttcctctacattacttcattcttgttcattacctttgaggatattgaacttgcatagtggacatgtcgcattcattttcagccatttcacaatgcacgtagaatgaaagtggtggttgcaaggaagtgagaccagctctgctccatcttcatatgaactcaaacatatacaacagtcctacacataccaacccaattcaaaagaaagctctaagcttcatataaaacatccacaagataactttcaaaacaaaaacttacagcatcctcgggaagaagcacacgctcgtttcctaaattctcactcgctgcatccacaggtatcattttcccaccaccgtcactttgcttttcatcattgttcatcgtgtgaaacctgtacttgggaaggatgctgagatctgcttctgatgcaccctcctaaacacacacacacacatatcaaaaggcagtttattgctttcatttcttccaaaagggttactgttatagtccatacctgccccgcgacggcgtaaagaagagcaataatacaaggtaggcaacaacagagggcgattccaataagacatgccagcacaacgcaaaagatggcaaagaacacatcaaatgcaaggaaaacaaaggttaacctgcaaacattaataaacataatgatgtcattaccattcaactagaagaaataaacattgagcaaaccaacacataccaatacaaatgcgtcgcgttttgcagaaggatatcaccaccagaaacaagccagtagaatccaacaatccaccagacaaatgatattatagtgttcattgattcacaagtcttagtgctgaaaataattgattctcataaatcattagtaaatcatttggctaaagaacaaaacagcacagataattgaatcgagagctaacctcagaaacctctcatcgttgtcttcatcttcactatcctgattcgtagcttgagcagcttctaaatctccaggtctgcttctagcattcctctttctaaactcaagccaaacaaggacaacatgaacaagacactgaatcgcataaccacagatccaaatcctaataggaacatttggcttctcttctttaaaaaccaaaagcataacaatcgcaacaagaacaaaagcagtgttccaaagcatatccaaagcaacaacaggtttcgagtaaccccaatcagctcgtcgctcttcaagctcttgtgcagctgtttctctaaccaccatcgaagctcctcgtcgtcctgaagctcgatttaatagaaccgcgattacaggttgacgacgtggtgatgattgccgtgaacggagaagtggtgtggatgagtcggaaccggaaggtgattcaggtgaagacatcgttgaatccgtctttgcttgatacagaattgagagagatgaagataaatctagggtttgttgtgtttcttgtacctatcagtaccactcaaaagtcaaaatagagacaagagaaagtactttaataagtgtatcggtgattcataattgtcttaattcttaatttgctctttaaacaatatgtgttaagagttagagattagaggattacagacgttttagtagtcaacaattagactggtggttaggaaattgagatttttaacacttgtcttctcggttatgtttaagagcaaatgtggtggtgataatgttgaactagaaatatgtaaataatgaacaaaaatcgatggttggtagaggatttcatgatagcaaaagttgaacaacattagaagtttagtaagaacttaaattcgattgtagtggtaagcacttagtataatctcattttacctcagtttgatactttgattagttattttcaaaagtttttgtaacatttgtcttctaaaattccggtttaagttaattggaacttaccgacttaacatttcttacataataatttttttttaacatcatataattaattattctaatgaacaaaagaaaaaaaagattaacaaactaatttcagtttaattccaaaagcggtggtacaccgaaatagacaagacaagtaagaacaggattaactgaaaccctaaacaaccacaatcgatctgggttcattggattcattacacaaaccggagagacatgtcggagaaagagcaccctcggctaattctacacaatttcctgtcgccggcagaatgcaaggttgtcccttttttgcttaattttgtgtctaatcatgtgggtttggttaattttgaggtaaaaacaggaacttgagcttatacacaagagtagcagtacaattgggtacagaccaaatg

SEQ ID NO: 14787 - DNA, 3000 bp, Unknown
  misc_feature (1)..( 3000): cDNA_ID_2730923_gDNA_ID_2684225_Annot_ID_137550 3000 nt of promoter + ATG
gaggtaaaatgagattatactaagtgcttaccactacaatcgaatttaagttcttactaaacttctaatgttgttcaacttttgctatcatgaaatcctctaccaaccatcgatttttgttcattatttacatatttctagttcaacattatcaccaccacatttgctcttaaacataaccgagaagacaagtgttaaaaatctcaatttcctaaccaccagtctaattgttgactactaaaacgtctgtaatcctctaatctctaactcttaacacatattgtttaaagagcaaattaagaattaagacaattatgaatcaccgatacacttattaaagtactttctcttgtctctattttgacttttgagtggtactgataggtacaagaaacacaacaaaccctagatttatcttcatctctctcaattctgtatcaagcaaagacggattcaacgatgtcttcacctgaatcaccttccggttccgactcatccacaccacttctccgttcacggcaatcatcaccacgtcgtcaacctgtaatcgcggttctattaaatcgagcttcaggacgacgaggagcttcgatggtggttagagaaacagctgcacaagagcttgaagagcgacgagctgattggggttactcgaaacctgttgttgctttggatatgctttggaacactgcttttgttcttgttgcgattgttatgcttttggtttttaaagaagagaagccaaatgttcctattaggatttggatctgtggttatgcgattcagtgtcttgttcatgttgtccttgtttggcttgagtttagaaagaggaatgctagaagcagacctggagatttagaagctgctcaagctacgaatcaggatagtgaagatgaagacaacgatgagaggtttctgaggttagctctcgattcaattatctgtgctgttttgttctttagccaaatgatttactaatgatttatgagaatcaattattttcagcactaagacttgtgaatcaatgaacactataatatcatttgtctggtggattgttggattctactggcttgtttctggtggtgatatccttctgcaaaacgcgacgcatttgtattggtatgtgttggtttgctcaatgtttatttcttctagttgaatggtaatgacatcattatgtttattaatgtttgcaggttaacctttgttttccttgcatttgatgtgttctttgccatcttttgcgttgtgctggcatgtcttattggaatcgccctctgttgttgcctaccttgtattattgctcttctttacgccgtcgcggggcaggtatggactataacagtaacccttttggaagaaatgaaagcaataaactgccttttgatatgtgtgtgtgtgtgtttaggagggtgcatcagaagcagatctcagcatccttcccaagtacaggtttcacacgatgaacaatgatgaaaagcaaagtgacggtggtgggaaaatgatacctgtggatgcagcgagtgagaatttaggaaacgagcgtgtgcttcttcccgaggatgctgtaagtttttgttttgaaagttatcttgtggatgttttatatgaagcttagagctttcttttgaattgggttggtatgtgtaggactgttgtatatgtttgagttcatatgaagatggagcagagctggtctcacttccttgcaaccaccactttcattctacgtgcattgtgaaatggctgaaaatgaatgcgacatgtccactatgcaagttcaatatcctcaaaggtaatgaacaagaatgaagtaatgtagaggaaacttttcttctttttatgttgtgtttctttttgttgtatatagagtagagaaaaaagaaaatgattgtgttgtttgtaagtcataagacagtttgtttctttgttgaaatttgttgtcaattctcttttttttttatcaaataataatagatatattcatcatgtagctaatcgcgtaagacaaaaataatcctcatttgtgacattatgtttgttgttcatgtaaacaaacataaaccccaaagatatatctaaaacaaatcaagaccaacataaacccaaaagatatatctaaaacaaatcaagaccaagagctaaaggtaatacaacaagttaatctataaaacttcggtcgcaaatggcagtgatattcaaaaaacgaaacattatattgatttacattcaatttaaatagattttttttgtttctcataacaatttaaaaggacttttattagtagagaatcaatcaaatttgttaaaagagaaaacatacataattgattgtccctcaaaaagaaaaacaaagagatctcaacagattacagtgattagattagtgtacacgtatttagttaacaacaacaaaaaaaaaaaaaaaaaaagacatattacacgttccctcctctcacgcgcaaagcatctctttgactaatcacatcttttctacgctaatcacatcactaaccaaaataattaaccatccacctaaattatatacatacaatattgccatttactatattataattactaacctctatatttcatacttaagtgcttgatcaagtgaacgttgattaattaacaacctaatctaatctttgttttttttccctcttcttgtcttgtcacacttgctattagagaagacgactagagaaagaaagataaacaacaacactgtgacagcatttaaatctcactctctctcttgtttccatcactacaaaaaaaaaaaaaaaaacgaacgatctctctgaaactatctctttctctctagatatgttgttgagactctgatttgaaatcccagagaaaagcatttggatcctctctagaaatctgcattttgaagctacttttttgtttgcatctgagtgtgtatagatcctgaggaattttgatgtgttgttgaatcggaaggaatttagatcggagtagtcggag

SEQ ID NO: 14788 - DNA, 3000 bp, Unknown
  misc_feature (1)..( 3000): cDNA_ID_2730915_gDNA_ID_2684225_Annot_ID_137553 3000 nt of promoter + ATG
gtgaaccttgcctttattccacgccttggagcttttgtccaacacctcttttggtacactcgatagccagtgtgtggcccccatcgtcactacaatatgaacggaggattgaggaaggacacggccgtagaacgaacccgggactccgaccgccaagtaactccggtcttgagggagagatgtgaagagagtgttgaagtcgttttgtgggaggtcgttgaagaagacaagaaactctggttttgacgagtttgattttcttaagctggtttcaatggatttgatgatgttgtcaacgagaaagaatgtatttggtccagttgcacaaccaagatcggctatccggaatgtgttggagtcagatgagattagggtttttgcattgagtttctctaataccagtttgtctattttctctttcaacaaacttgttgtttttctctgttcacaccaaaagaagtcaaaagcttaatataattttatgctactccaattgaaaacgattaaaagacagaactaaatcacaaagtttttttttcttttgataagaaaaatcaaaaacttttttaaaattaattttatacttttatgactgaacaaaccatatgaaatttacgtataaagtaactttgatgcactatgtctatataggagatgagatgagatccaaaccatattaaccaacatattaaaaaaatagaaaccatcatttaaaaaaaaatgtaagtactttaagaacgtagattgagtaaaactgaaatagtctcttgactcccttcaatccctgctagatttagcttattcagcttttcgtaagacaatgaagccgtttagtgatcctcggtgtttttttgtgtggctcgatgagttctcgacattttaatatcgttattgaagtttcctttcttttttgaagtacataacaaggaaccaaattttgattaaaaaaagtcatatatatatatataagagatgataaaatgaattcatgagcttccaattgatccgaaaagccagcaaagtaacatgtgtgtattcgaaaatcaactgatcataatcttaatttgtctctatgaaaattacgaaccaaggtttattagtttttgacaaatattatattattttacaaaatcatcataatatcctaaattcaactcatcattttaatgaaattaaaaaaaaaaagaaatcttcaaaactatgttattaatatccaaataaccgaactcaattataatatgatgaacctgaaaagttataactctacaattttcgtttctttcaattctactatttattcatattgaaaaacatgattccatttatctttctttagtatttagaacatttatcagatattttgtaattattccgtaatctcataccgcttctttactatctcttatctctttaaaattattcagtaatcatacacttttttttctacctgcaagttttttttttttttttgcatcactaattgggaaccatgaaaaaaagaacaaacaatagtggaagaaaaaaaaaaataaagataagaaaaaaaatatagaaaaatggaataaaagctctgaaaatagacctgcaaatgagaattcttagagtagctgttcggaccatctcccccactcataggaagtgagttacgaacaatctccacttttcccattatactttttttgatttgcgtctatactttggctatgtctcgcctatcatttatataggccatgcacttaccacgtagtgcttgatattatatttactttaacaataattgaaaccctcttgaattgaactatacaacacatacacacacgcgattatatgcgtataaaaacaagaaattaatacaagaatttgctatcacacatacacaaatcaaagtacaatgtagaaaaatattttttgaaaagaataagttcgaatatatagtacaatttttttaattgtaatcaataaatttgttcttcaaatcacttaagatggccaattatctaataagtaagaatcttattactataagttatagactagctactactctactagctagggagaatcatcattggagtggaattcattgttttcttttttggtgcaactataatagatgggttttaagccaataaaattcttacaaaccaatatagtacactagtcattggtttcattcactgagcttagacgatcccatatccatatccaatgaactactactacatatgtttttaattaaatagagaagctaatactgaattatcatcagtggttattatgactgtggtcctaatacattacgtacaagacgaccacaatacatatattattttcttttaaaaaattgagtattatttctgaactaaactataggtcttgcgtgggaaaactacgtaatcgtaggggcatcaaactaataattaaatcataggttaaactacgataatatacccattcatcttcaaaggagatgctctgtactaatatatccaagaatgaatcaaaagatgccaaaatatatgtttataaacataaatctctgtttatatctctatcaatgcgtttcttgattctttcataattaataagagatatgttattgttatataaacaaaaataatagaacaagcagataactgaaccaaataaaattttggtaaaataaaacgctattctgcctaacttaagaacatatcagaaaacgctatgggcctattattgggcttgggcctaggatctttctgggaaagaaaacgctcatctttctcaacacaagtgaaatttctccagtgcttgcttgaattctgcaaatttggcggtctccagcgagagagagctattcagtcttcaaattctctccgttgagaaaaaagaggtacacttgtgtttcatttttctcggaaagtacgattttatttctattttttttggttctcttcacgaatctgaagactgatttttccgtctctgtcaacagctgctattttattcgtgtcgatg

SEQ ID NO: 14789 - DNA, 3000 bp, Unknown
  misc_feature (1)..( 3000): cDNA_ID_2730911_gDNA_ID_2684225_Annot_ID_137554 3000 nt of promoter + ATG
gtatgtaacaggttctacactatgtagtctttctctttcatcttcatgttcaagtttatgtatttgagataatggtgattggcagcttatggacagttcttgaaagcaaatggagaacaacctgtgacatggaaacgagcttcgtccatggaggaggtgctgcgtgaggctgatctggtatatggaattcacgcagacacaaactattcttcgtttgttaaacatttctagtgtatctcttatgaactggttgtgatctgaaacagataagtcttcacccggtgctggacaaaaccacttaccatcttgtcaacaaggagaggcttgccatgatgaaaaaggtggtttcacttttcatttggtctcctcttattattattgatcttgttctgattggatttgattgcttcaggaagcaatccttgtgaactgcagcagaggtcctgtgatcgatgaggcagctttggtcgaacatctcaaagagaacccgatgttccgagttggtctcgatgtgttcgaggtactgtcatatacgctatgatgaacccaaaacatactagtttatctctgggagcttagtaagtgttgttaaatcacattgtttcaggaagagccattcatgaaaccagggcttgctgatacgaaaaacgctattgttgttcctcacattgcttctgcttccaaggttacaaactgaagaaacgtttctttgtgtctaaatagataattaacagaactgaccttaacttaacttcttctgatgatgacagtggactcgtgaaggaatggctacgcttgcagctctcaacgtcctcgtatgtattttcattccaagaaaactcattcttataagattcaaaatgactaaattctgatcagcctctgaaaatgtttaacagggaagagtcaaagggtacccgatttggcatgacccgaaccgagtcgatccattcttgaacgaaaacgcttcaccgcccaatgccagtccaagcatcgtcaactcaaaggccttaggtactacacaacacttacactcatgcctcagattgtttcaaacgctaatttatgcttgcatttcctgttaacaaaatatttaaacataaacagaaacaaaagaacattgactaatccacttaaacaaatttgttcccattctctctattaaaattactctcatatatatattctttgggttttttcaggattgcctgtttcgaagctatgagttaagtatgaagaaggggagatttggaagaatccttttagtgaatatatgatggtgtcaagttgtgtttatgtattgtatatgaaacaaccatgttggatcatataaatcactcctttaaagtgttacattgttgatgagtctattagacgattacccactctctttatttcataaatttgctaagaatacaatttctaagtcatcaagaatttcatctctagttgtaggatttgtactcatgaatctaccatccattcccgtttgtaaacttcacagaacagttttgaaactttaaaaaatctgatttatgacacaaaacggtaatagaatttttacggaaaaaatataaactactggaacagttaaaagcaaaaatagtggtagagcatagtaatatacacagagataagcagaaaaaatcggataaaaccgccgattaatttttatttgacgatttaatatctgttatattaaatttggaataaaaaaattatttaattttgattgttttttaaagtcctcgttttttaaattttagtagattagtatctcaacaatggtaataaaatcgcgataaaattaatatagaataattcatttcataatttaaaagttatattctctctcttttttaaattaattcaatttctgagtttttactaatattagataagattataatccataattttttgaaattgacaattctttcaaactttaaacctatagttttcaatttaattttaaatttacaatttatcgtcaataactaataaaaaaatagaaacattttagcaaaacaaatatttttattttgtataatgttttgttttctaaaattgtgtttaataagtaaccgaaggaatatattatattgaatttttttaaaataaagtaatgctaaatataaaataaatgacactctatctttagttgacaaaagcactgagatctcgccacgtagcatgctgagcaacggacaccacgtggtgttttgctgagaccaaaaccccatgtgacagctgcttagaggtcccacttcggtctacgacactaacggataagatcaaaccacacatttctctttggtgtgaccaaacttgacgtgctcttctctttttccacccttcgatatatcttcatcggacgattcaaattctcaaatatatactcatgctctcgttggatacattaattgttataagttgggttttaacttttaaaatgaacagtttttcatatttgggtgtgtatttttcagatatataaattccaactcctgttataaatttatgtaaacatcgttattaacactaagagacgcacaagctctgtctgagaaaaaaaacaaaaagctaaactattttcattataattccaatctcacacgcaaaaaccttagaaacagaaaatatatctgtctgaagaaaaagtgccggtaataagaaagaaagaatcacctttctctactttgtttttaatttcaaaagcattttctcatgaagacagtcaaaaaatctctttttgtcttctcaaatttaaacctcacctttaatatttctccttacttttgaagctgtaataatattcttgaatctattcctttctttctctttctcatgtttaatcggtgaaggctttactctgtttctttcatcatgtttcaatcaaaagccttaactttttctttagctctttccattacaagagacctctagcttcatactttttataaaaattctctctttttctcagtttaatctcaagaaatg

SEQ ID NO: 14790 - DNA, 3000 bp, Unknown
  misc_feature (1)..( 3000): cDNA_ID_2730907_gDNA_ID_2684225_Annot_ID_137555 3000 nt of promoter + ATG
aactgactactaacctaatcaataaattttggataatggtcaaggagaaacaagagtatgattttgcatttgtggatgctgacaagacgaactacgtttacttccttgagaagctccttaagttagtgaaggttggaggaatcattgccttcgacaacactttatggtttggtactctaattcagaaggaaaacgaagttccaggccatatgagagcttatagagaggcacttttagagttcaataagatattggctcgggatcctcgagtcgaaatcgctcaaatatccatcggagatggtctcacgctatgtagacgtcttatatgataaacctatagtaaataatgttatatgcttcaataataactttggcctttgtttgtaatgttatatgctactataatgactcttcatcttcctaataaaactcctctttcaatttcaatttgcaaagagggttcaaatttggatgcgaatataacagtttattactttgcggcaaaatgtttataatttttaaactttgagggttaattgataaattaaagataaacatcgacatttctaaatcagaaatctcgattttattttgaatgttcaaaagctgccagattgagaatatttcgtccgtcgttgaaacttgagaatagaggcgaatctggttcgagttagggttccaattgaaaagtttgaagctccttttgactctctctctcttctagatctcgacaactctaacctcttcgatttggtaaattttcgctctttctactgaaatcggatgaatttgtgattttccggggatgggttcgtgtctctatgcattttccgatgatgggttatgagaaaaagtttttttttttttttaatctttgctttgtgtaggtggatcttgagaaattgattttagttcaaagcttctgatggctaaaaaggagagacctagacctgagaagttgtctgtgtatctttatatacctaatattgttggtgggtctttatttctctttagcttttttttcttagcattaaagattgttgttgtgatgatgattttattgattgctttcagggtatatgagagttctcttgaactgtgttgcttttgctgtgtgtttctccaacaagccacttttctctgtcctttatttcttcaggtattgcaactttcttctttgatggtcattaagattttttcatgttttgggtgatggtattaacagtcttctttttgatcaatgtggctgtctctagcttttgttgtgatgctgtggatggctgggtggctcgtagattcaaccaaggttcaacaactctctcttgttttataaaacctcatttttattccgtatggttggtcaaaagatcctactactgatcaagattagtacaatatgttgctagtgtttagtttcatgtgatagacatgcatcacatgccatgactagaatatgtaggaagctagaaacttgactcacttctctttctttcttcttcagtttcaacatttggagctgttcttgacatggtcacagataggtgaatcctcttctacatatatgcaaggatcaacctacttatctgtttagtaaattctgacattttgttggtggtcattttgggttatagagttagcacggcttgtcttctcgtgattctctctcaaatctacaggtgagaatacctctctatatctttttccgtagcatctctggagttctacattattacagtatatgtaattttatttcatctttaaaataggcctagtttggtcttcctctcattgctggctttagatattgctagtcattggctgcagatgtacaggtacgctaattaactctttcttgtttcaccttgaattcttctctatactattcaaatcttcagtttctaactagggacttcatattctactcgcagtacgtttctagcagggaagagcagccataaggatgtgaaagacagcacaagctggctttttagactctactatggaaaccggatatttatgtgttactgctgtgtttcttgcgaggtgactcaaattgtcacttcatttccatgttaatcctttgagacgatgtcttcttagacacaaatcttttcaaacttgcaggttctgtatatcatccttcttctcattgcaaagaaccaatctgaaaatctcctgaatgtcagtttctcatttctttcaattagtctagctcttagtcttactatgctcaactactaaagcatggttatcattgcaggtcgtagttgctacattaacacagatttcaccactctcttttctcctggctttgacattgttcggttggtcgatgaagcagaccattaatgtcattcaggtaaagctaaacattttaccaaatctgcaactaatccctctattcgaagctgtttttggtttctaattatataattcgttgtggcgtacagatgaaaactgctgcagacgtttgtgtactgtatgatatagagaagcagcagaagccttgatcatcttcctttgtctcaacctgaaactcttttttttctttcattgtttgttctcttttcactgtggatgtagataattgtttttaatgaaatgaagaaatattgatttgccttttgacataattttgttaataatcttgattacaaattttagtcagtgtttgatgcatagttgcatactgcagagttgagtttggatatggccacgtcagcattatctcgttaccaaaacgtaaggtccaaactcagataatacaaacgaagcagttctttgtcactctatcatcaacatatgaaccacaccaaaaaagaacaaaatcgtagataatgatcatgcaaaaccgaccgttggatcttactttcgatttcaaaccacataaatcttagtgactgagctaaaaaactgaaattttttaaaaggcaagacctcctctgtttccatattctcaccacagaagaactcttgaggctttctcttttctctaccatg

SEQ ID NO: 14791 - DNA, 3000 bp, Unknown
  misc_feature (1)..( 3000): cDNA_ID_2730899_gDNA_ID_2684225_Annot_ID_137557 3000 nt of promoter + ATG
aggaagaagaagtcacggttttagatatttttaagtctttggcccaacagatatttttatttaaaaaaataacattttacgacgttaataaaacatatttacaactttaatggaaatagaaaagtaaaacattttacgacaataaaaaaatattttacaatttttaatgaaaatagagaagttaatataaaaatttaaattaaatcaaatgaatgttgtgtattttcgaatgttaggacttaataagggtttaaggatgtgaaatcttaggaattattattttaaaatcatttcgtcatttagggatcttgatgatgaggatgcccaatctcctatgccacatcatgttgcctaagattagttacatggacatcacattgagcttggggtgagagttcaccataaactaaaagattccagattagacaatccaaaaggtcaacttatcatatctctggaacacttattcaacaaactttgcttaacttacaatgacagattacaaaaacccaaaagatcttttcttaggaggtttgaggaatcctctcctcaagacattctgtaacttttgtttttgctttttatcgacaaccttcttacttagttgtgaatttttgcgctttgatgattcactaaactttaaatacatatcttggaattttttaagtgatttcttcatgcatacttgaaaaattgttagaacatgttgaatattattattgtttcatccgttgaagcggattgagggattgaaactgcaaaatttgaatcatctttggagatttatgctggtattcgttatgttagcattcgaattcaaatccgtttttttagtaccttcaatttgatatattctttaaataattctatactatatactttttttgcattttaaatctcacataccaaatttatattagtcaataaaactacattgcaaactgttcgcctgcttgcatatttcaacatttgtatgcaaccttaagagagaaaaaaaatccttaagaaacataaacgttaatatattcgcatcaagtactgtctagataattgattttctagtcccatggttgaaaagtcatggataagatcaattggtgtgttagtccttaatttgggtcttattagtagctcaattagtttgaccagaagccaatatatatattgacatacatctctcgtttataacaacgaacaatttgcacacaaccacgagactcaagagacatggccaatgaaattcctaccaaagggattctcaagagcgaagctctaaaacaggtaaaattttctctgttataaagtttgctgatctttaaaactttggttttgtctagttttaaaaaggaactttgatgtataaatctgtgttttgttttggtcgtgttcgtcacagtacatcatggaaacgtcagcgtatccaagagagcatgaattgctcaaggaacttcgaaaagctactgtccaaaaatacggaaatttgtaagtcttaatatatgactttcttttttaggtgcaacaaaatctataggactatataacaacttttttaaattaagaaattttatctttatatagtttaagaagtggaataaacaaaattttgccaatagtttgtgattattttagagatagctatatagttgcttaattttgtagaatttaaaaataaaaacgcagaagcgagatggaggttccggttgatgagggtcatttcctatcgatgcttgtaaagatcatgaatgcgaaaaacactatcgagatcggtgttttcaccggttactcgcttctcactacagctcttgctttacctgaagatggccgtgtaatgcttcttgttatatataatcatattgttggggttacaaaattatttgtttgttttaactaagaaacatagttatcaaaatggatgctctttggatgtagattaccgcgatagacattgataaagaagcttacgaagttggactagagtttattaagaaggctggtgttgatcacaagattaattttatccattccgatggtcttaaggccttagaccaattggtgaacgacgtacgtgaaaatatgtgttcttatattattattaactttaagcttaattaactatatttttttagctaatggtcatacattaaaaaacattgcagaaatgtgagtttgattttgcatttgcggatgctgacaaatcaagctacgtcaacttccatgagaggcttctaaaattggtgaaggttgggggaatcattgcgttcgacaacaccttgtggtttggttttgtggcggaggatgaagatggagttccggagcatatgagagaatatagagcagctcttatagaattcaataagaaattggctttggatccccgagtcgaggtctctcagatttccattggagatggtatcacgctctgtagacgtcttgtttgatcaaaagactacttgaagagtacgtagcagaaccaaagtcggagagtttggaataaaagtgttagatggttcaataacgacttcgtcttttgtcacaactttgcttgtaatggtgtgtttgattgatgctcactctttatcttctttctatgttgtggtttcgtcgatgttgttctgtctggcaacaaaactattagtacactaaattacttttaataataattgttgtaacattataatttttttttttctggtcgacacattattattactgttttttttctttttaagtgtttgtaaactattaaaaagagttgtgtaaagattaaataaacacctttcagctttttggggacatctaatatgtgtgtttcaattttacatgcatatgcacactagtgttttccaattccattttttctgccaaaattacatatccacccaaatgatatgaccaaagttttattttatttctcagttaggtattactatttaaagccaacatagacacacatttgctaacactcaaaagagattctcacgatcgagcaagagagagatg

SEQ ID NO: 14792 - DNA, 3000 bp, Unknown
  misc_feature (1)..( 3000): cDNA_ID_2730895_gDNA_ID_2684225_Annot_ID_137558 3000 nt of promoter + ATG
gctataacacatcattgagaattgcaccggtgaaagtaatatatccggtgcatacttcgttgtttgttatagagttacataacaaaagttttgaggctgatatgttcaaaaaatcaactattcatttgaagccagcaattccatctgctctgtcaaaatctcaaggttcctagacctctcaggagtaagctgtccaaattcaaagtcatctggtttctccatctcttctgatatcagcttaagcatatagctcttgtctaattccattgttccatcctcctcctcctcctccaatgtcaaatcatcctttcctttcttcacaatgttctcctgcttcttcgtcttcttccttgaagggctcaacaacaaaagcttttcccatgctccatcatcgtatagatcaggtatgatcaatggcacatggttttcatctaagcagaacttcaacatatcggcgtttctcaagaaatcatttacgtcgttcgagtttgactttgcagttccattgttgtccgatggtggctggtatgttactaaaggaagaccatatgagtttgattctccttcatcagtcacttcttccacaatcttcgctccttcccccgcttttcgccaagtgtttttctcctttggctgaagtaactgaactaaaagacttggattcttcataaccataaccaaaaacgaaagcatctcctgctgactctcttccattccttgaactctgtcttctaaatgtaacatcttagtatccgtcacctcctgatactgcctaactttgatcaactcctgcgccaatacctgcttatcacctttcaaaatatcaacttccttccacaatccactcttttcctgagcatatgttgtacttgtactctcatgtttgctctgctcactactttgaacattcttcctcctgataacattcttcagcaaatccttttgacctctcacaaacccgtcattcgcaaactcccatcgatctgcatcaacttttctaaaaccctgtaaacaaacacatccacgaatcaggcacaagtctactcaaagatccaatgagccagatttaccctagatcaaccaacttatactatcatagagtcttcaagattgtgactagtactagttctaaacactgttccagataatagaagttgaacaaaacatctttcttcatgcttcataaaccaaattcataatcaatcttctctaaaacctatccacacgttgtaaaagcagagaaaaaatgaaactttgctaaatacaatcacaccatgtaagagtaagagacataacaaagaagatccaattgtacaaaattgaaaagagagaggagaagagaggactaacgtagatattgagctgacgaatgaagctagagaaattgctgtgtttaaagtatttaggcaagagttgaacagagaagacggtggtgtccaagataacgaagctattatctgcacttggactccatgagattatagagtcagtagtagaatcatcaaccatatcgtaacattttctcaagaacggcgccactgaagaagaagaagaagacccaccaccaccgtccgtcgatttcaccataatcgagaaatctctaaactttagatgaaattttgaattctgaaatttgggattgaatcgattagtcgcaagaataaggaaaaatgaagagaatttgggattggggtttatgtgggaaggagatgaaacttgtgcgttgggcaagggatcgtcgttcacatcaaaggaaatttcaaggaagagaggaagaagaagtcacggttttagatatttttaagtctttggcccaacagatatttttatttaaaaaaataacattttacgacgttaataaaacatatttacaactttaatggaaatagaaaagtaaaacattttacgacaataaaaaaatattttacaatttttaatgaaaatagagaagttaatataaaaatttaaattaaatcaaatgaatgttgtgtattttcgaatgttaggacttaataagggtttaaggatgtgaaatcttaggaattattattttaaaatcatttcgtcatttagggatcttgatgatgaggatgcccaatctcctatgccacatcatgttgcctaagattagttacatggacatcacattgagcttggggtgagagttcaccataaactaaaagattccagattagacaatccaaaaggtcaacttatcatatctctggaacacttattcaacaaactttgcttaacttacaatgacagattacaaaaacccaaaagatcttttcttaggaggtttgaggaatcctctcctcaagacattctgtaacttttgtttttgctttttatcgacaaccttcttacttagttgtgaatttttgcgctttgatgattcactaaactttaaatacatatcttggaattttttaagtgatttcttcatgcatacttgaaaaattgttagaacatgttgaatattattattgtttcatccgttgaagcggattgagggattgaaactgcaaaatttgaatcatctttggagatttatgctggtattcgttatgttagcattcgaattcaaatccgtttttttagtaccttcaatttgatatattctttaaataattctatactatatactttttttgcattttaaatctcacataccaaatttatattagtcaataaaactacattgcaaactgttcgcctgcttgcatatttcaacatttgtatgcaaccttaagagagaaaaaaaatccttaagaaacataaacgttaatatattcgcatcaagtactgtctagataattgattttctagtcccatggttgaaaagtcatggataagatcaattggtgtgttagtccttaatttgggtcttattagtagctcaattagtttgaccagaagccaatatatatattgacatacatctctcgtttataacaacgaacaatttgcacacaaccacgagactcaagagacatg

SEQ ID NO: 14793 - DNA, 3000 bp, Unknown
  misc_feature (1)..( 3000): cDNA_ID_2685667_gDNA_ID_2684225_Annot_ID_137559 3000 nt of promoter + ATG
aaattgaaacacacatattagatgtccccaaaaagctgaaaggtgtttatttaatctttacacaactctttttaatagtttacaaacacttaaaaagaaaaaaaacagtaataataatgtgtcgaccagaaaaaaaaaaattataatgttacaacaattattattaaaagtaatttagtgtactaatagttttgttgccagacagaacaacatcgacgaaaccacaacatagaaagaagataaagagtgagcatcaatcaaacacaccattacaagcaaagttgtgacaaaagacgaagtcgttattgaaccatctaacacttttattccaaactctccgactttggttctgctacgtactcttcaagtagtcttttgatcaaacaagacgtctacagagcgtgataccatctccaatggaaatctgagagacctcgactcggggatccaaagccaatttcttattgaattctataagagctgctctatattctctcatatgctccggaactccatcttcatcctccgccacaaaaccaaaccacaaggtgttgtcgaacgcaatgattcccccaaccttcaccaattttagaagcctctcatggaagttgacgtagcttgatttgtcagcatccgcaaatgcaaaatcaaactcacatttctgcaatgttttttaatgtatgaccattagctaaaaaaatatagttaattaagcttaaagttaataataatataagaacacatattttcacgtacgtcgttcaccaattggtctaaggccttaagaccatcggaatggataaaattaatcttgtgatcaacaccagccttcttaataaactctagtccaacttcgtaagcttctttatcaatgtctatcgcggtaatctacatccaaagagcatccattttgataactatgtttcttagttaaaacaaacaaataattttgtaaccccaacaatatgattatatataacaagaagcattacacggccatcttcaggtaaagcaagagctgtagtgagaagcgagtaaccggtgaaaacaccgatctcgatagtgtttttcgcattcatgatctttacaagcatcgataggaaatgaccctcatcaaccggaacctccatctcgcttctgcgtttttatttttaaattctacaaaattaagcaactatatagctatctctaaaataatcacaaactattggcaaaattttgtttattccacttcttaaactatataaagataaaatttcttaatttaaaaaagttgttatatagtcctatagattttgttgcacctaaaaaagaaagtcatatattaagacttacaaatttccgtatttttggacagtagcttttcgaagttccttgagcaattcatgctctcttggatacgctgacgtttccatgatgtactgtgacgaacacgaccaaaacaaaacacagatttatacatcaaagttcctttttaaaactagacaaaaccaaagttttaaagatcagcaaactttataacagagaaaattttacctgttttagagcttcgctcttgagaatccctttggtaggaatttcattggccatgtctcttgagtctcgtggttgtgtgcaaattgttcgttgttataaacgagagatgtatgtcaatatatatattggcttctggtcaaactaattgagctactaataagacccaaattaaggactaacacaccaattgatcttatccatgacttttcaaccatgggactagaaaatcaattatctagacagtacttgatgcgaatatattaacgtttatgtttcttaaggattttttttctctcttaaggttgcatacaaatgttgaaatatgcaagcaggcgaacagtttgcaatgtagttttattgactaatataaatttggtatgtgagatttaaaatgcaaaaaaagtatatagtatagaattatttaaagaatatatcaaattgaaggtactaaaaaaacggatttgaattcgaatgctaacataacgaataccagcataaatctccaaagatgattcaaattttgcagtttcaatccctcaatccgcttcaacggatgaaacaataataatattcaacatgttctaacaatttttcaagtatgcatgaagaaatcacttaaaaaattccaagatatgtatttaaagtttagtgaatcatcaaagcgcaaaaattcacaactaagtaagaaggttgtcgataaaaagcaaaaacaaaagttacagaatgtcttgaggagaggattcctcaaacctcctaagaaaagatcttttgggtttttgtaatctgtcattgtaagttaagcaaagtttgttgaataagtgttccagagatatgataagttgaccttttggattgtctaatctggaatcttttagtttatggtgaactctcaccccaagctcaatgtgatgtccatgtaactaatcttaggcaacatgatgtggcataggagattgggcatcctcatcatcaagatccctaaatgacgaaatgattttaaaataataattcctaagatttcacatccttaaacccttattaagtcctaacattcgaaaatacacaacattcatttgatttaatttaaatttttatattaacttctctattttcattaaaaattgtaaaatatttttttattgtcgtaaaatgttttacttttctatttccattaaagttgtaaatatgttttattaacgtcgtaaaatgttatttttttaaataaaaatatctgttgggccaaagacttaaaaatatctaaaaccgtgacttcttcttcctctcttccttgaaatttcctttgatgtgaacgacgatcccttgcccaacgcacaagtttcatctccttcccacataaaccccaatcccaaattctcttcatttttccttattcttgcgactaatcgattcaatcccaaatttcagaattcaaaatttcatctaaagtttagagatttctcgatt

SEQ ID NO: 14794 - DNA, 3000 bp, Unknown
  misc_feature (1)..( 3000): cDNA_ID_2730891_gDNA_ID_2684225_Annot_ID_137560 3000 nt of promoter + ATG
catgaagaaatcacttaaaaaattccaagatatgtatttaaagtttagtgaatcatcaaagcgcaaaaattcacaactaagtaagaaggttgtcgataaaaagcaaaaacaaaagttacagaatgtcttgaggagaggattcctcaaacctcctaagaaaagatcttttgggtttttgtaatctgtcattgtaagttaagcaaagtttgttgaataagtgttccagagatatgataagttgaccttttggattgtctaatctggaatcttttagtttatggtgaactctcaccccaagctcaatgtgatgtccatgtaactaatcttaggcaacatgatgtggcataggagattgggcatcctcatcatcaagatccctaaatgacgaaatgattttaaaataataattcctaagatttcacatccttaaacccttattaagtcctaacattcgaaaatacacaacattcatttgatttaatttaaatttttatattaacttctctattttcattaaaaattgtaaaatatttttttattgtcgtaaaatgttttacttttctatttccattaaagttgtaaatatgttttattaacgtcgtaaaatgttatttttttaaataaaaatatctgttgggccaaagacttaaaaatatctaaaaccgtgacttcttcttcctctcttccttgaaatttcctttgatgtgaacgacgatcccttgcccaacgcacaagtttcatctccttcccacataaaccccaatcccaaattctcttcatttttccttattcttgcgactaatcgattcaatcccaaatttcagaattcaaaatttcatctaaagtttagagatttctcgattatggtgaaatcgacggacggtggtggtgggtcttcttcttcttcttcagtggcgccgttcttgagaaaatgttacgatatggttgatgattctactactgactctataatctcatggagtccaagtgcagataatagcttcgttatcttggacaccaccgtcttctctgttcaactcttgcctaaatactttaaacacagcaatttctctagcttcattcgtcagctcaatatctacgttagtcctctcttctcctctctcttttcaattttgtacaattggatcttctttgttatgtctcttactcttacatggtgtgattgtatttagcaaagtttcattttttctctgcttttacaacgtgtggataggttttagagaagattgattatgaatttggtttatgaagcatgaagaaagatgttttgttcaacttctattatctggaacagtgtttagaactagtactagtcacaatcttgaagactctatgatagtataagttggttgatctagggtaaatctggctcattggatctttgagtagacttgtgcctgattcgtggatgtgtttgtttacagggttttagaaaagttgatgcagatcgatgggagtttgcgaatgacgggtttgtgagaggtcaaaaggatttgctgaagaatgttatcaggaggaagaatgttcaaagtagtgagcagagcaaacatgagagtacaagtacaacatatgctcaggaaaagagtggattgtggaaggaagttgatattttgaaaggtgataagcaggtattggcgcaggagttgatcaaagttaggcagtatcaggaggtgacggatactaagatgttacatttagaagacagagttcaaggaatggaagagagtcagcaggagatgctttcgtttttggttatggttatgaagaatccaagtcttttagttcagttacttcagccaaaggagaaaaacacttggcgaaaagcgggggaaggagcgaagattgtggaagaagtgactgatgaaggagaatcaaactcatatggtcttcctttagtaacataccagccaccatcggacaacaatggaactgcaaagtcaaactcgaacgacgtaaatgatttcttgagaaacgccgatatgttgaagttctgcttagatgaaaaccatgtgccattgatcatacctgatctatacgatgatggagcatgggaaaagcttttgttgttgagcccttcaaggaagaagacgaagaagcaggagaacattgtgaagaaaggaaaggatgatttgacattggaggaggaggaggaggatggaacaatggaattagacaagagctatatgcttaagctgatatcagaagagatggagaaaccagatgactttgaatttggacagcttactcctgagaggtctaggaaccttgagattttgacagagcagatggaattgctggcttcaaatgaatagttgattttttgaacatatcagcctcaaaacttttgttatgtaactctataacaaacaacgaagtatgcaccggatatattactttcaccggtgcaattctcaatgatgtgttatagcagcttactacaaaaacatggttgaaactttttgacaataaccatgagagcaaaccagtatagtaaacctcttaggattcctatatcggttcgattttgtgggttttaaatcgaatcaaaccataaccgaatgcattataaaacccgtttccgagtcaaaaccaaactaatcacttgatttttctgtcattgtttattggcctatcggattggttttactgcggttcggttatccctaaaccgaaccgaaccgactaattattttctcagtcactctaaactaatcgcttaaatttaagaggctttttaagaacacgtggcagcatataattgggttgctttgtcagacttttttatagcgttacacgacgacgcatgtcacgcatctaaacgccgtttccaaaacagcgttttgcgtctcgacaaacaacaatcaaaatctccttactctgtctccgtctctctggttttcgatttcgtgaatccaatttttgtgtgtatgtattcgcttcgtctctccatttttcttcgtcttacgtttacgtaatcca

SEQ ID NO: 14795 - DNA, 3000 bp, Unknown
  misc_feature (1)..( 3000): cDNA_ID_4265552_gDNA_ID_2684225_Annot_ID_137562 3000 nt of promoter + ATG
gaatcgatctctgcaactcctccatgtatgaggaagcgttgttgtccatgtcagcgtcatcagcaccaaagttttgatcatggatttgaagaatgcatgactcgagcttgtctcgcattgctttaaacaaaggtgtaactggctcacatgccgcatcatagattgcagccagataaggagacaatacatcagtagcaatactgggaaggtccgctaccatggatgagatatgtgtgtggattccttgcagatgctgacataatgtgaagttcctgatctgtgttgaagtcgcaggacctgatatctgccgcgtctcagggcctgtagaaatctgcaatataagtgtagctgtgttacatttcaaacataaacgcataagtagcagaataacttctttacactgttaactctaattatgtcaggtagttaacacgtatatatttgcatagtagaggtagatgtagctctaattctcttcatttctgtctggaagaaattataattgccccacgaattattactttgtactcaatctctcctatacaactgtatgcaactttaagaatttctatataatacaagcacaaattgataccatactaagggagctatcgcacataacaagaggacaataaccaacaagaggtctatcatacctggcactcagctcgttgagctaggttactaagggccttgcctatctcacgcaaaactagaagagtcaaacgagcatctggatgaacagcctcaatctcatcttgaatgtgtgataatacctgtgaaatctgttctttcgaaggtaaactcccacggctcgacatagggaatatcgagtttacaaggtctgacaagcggccaaagcatagggataagaaagcagtctggaatatagcaatgcatgcaaccatttgttctttcctttctaaattaatggcaggtaacactcctttaacatctgtatcacgagaaatcctttcaagaagattttctatcatagacacaagcttcggatatcccatggtgaatatttcttttacaaaactcgaagctgtgtatgcagacttcatttggctagtaaaagccttcacaagtgcatcccagactctatcggttaacatagaatcgccttcctgtgcatataaacacttcatgtaagcaataaaaccaattaaaaagttggaatctaaactaatcaacagccctgacaccacagaaacccatcccaaaacttccttttgatgcaaaaacattgaaggatcatctacttaaattgttcaaacatcatcgagctcgctaaaagtgacaagaaactctgatcctctcaatgatctaatgcagcttattcctcaggacattgacaatatctttaactaacgaataaacaaactcagggagcctaaaattccagttaaattccgcaccttgatgacttcgtcaagaagaaggacatgagtaaatggatccctcttcttagacagtacacgctgcaaatgccacacagcaactacaagtgaacacaactgttccatacaactagccatcctctgccacaacgcctccctaactttagcaccaccaccaatatgcggtgatccgctagacctaatcccaccaggcccgaagccaccacctgagccagaagtaatagctttcatatccatagcaacactcacactcttcacagccattcccttatacttattcaccaattgatccaccgtagacttaagctctccaaggttatagaaaacttgcaaaccagtcccaacttcagcttgattcaacccttccatgcctctctccaacaccttcatagcttcagatctcaatttctctccaatctcagtaacaaacttgatttcctcatcaatcacatcaatgccaaagagatcatactctttacacattgttaagatctcgaaatggaactgtgcagctttagtgagatcgatcttatctggatcaggaaaatccgctagatctcgaagcttcttagagagacgaagcgtacgaacggagtgagatagtaactcagtagctgtatggagattagatagctgaacagatttagatcggatcgatttgatcggttcagagaggtcggatctgacacggcgaattgaagattggagtgaagagacggaggatcggagagaagagagagatacatcggcgtgtgagagagaagagagctgagcgagcaattcagggtgacgagagatgacgtcattacggagctgtgaatcgaggaggcggattgcttggtggagacgttcggcggtggaggccggagatccagaagcgagagcggcggaggagaatgatgcggaggagaaggaagatgagaggaatggggagaggattggatcggtggcaaaagaatcgagcggcgaagaagaggaagatgacggtgtttgtggtggtggtgcgccggaggagagtgaagaaggaggagggtttttgaaggtggagagacgttgaagagatggagatgatggtgaaggagacgatggaggtagtgccatttttttacagtttcaatctctacaggttttgaattttgcaatggcgattttagcaggagatcaaagcgatactcatttttcaaagttaatctctgaaacaccaaaaaaaaaaaaaaaaaactcaaagcgaagttatacgatagtgaaccggtctactttaatttctgtgtctgaattttgttggttatctacgaaccggaattatcatttctggcatagtcaagtgatagatgtagtcatgtagggaatttgtatctggatgtgaaaaaaaaaaaaaacaattcctcctctaaatctcgtgatgtcataaattatgtaaatgtcagagattggtcctaaaagttggccactaagtggtgtaagaataataaattgtcaatatcaattgactgattcttattgttcatatacggacacaaatcttttcgttaagtgagtgttttgatcaaaaaaagttgaaaactttaaagccatg

SEQ ID NO: 14796 - DNA, 3000 bp, Unknown
  misc_feature (1)..( 3000): cDNA_ID_2730887_gDNA_ID_2684225_Annot_ID_137563 3000 nt of promoter + ATG
tttttagatctaatcagaaaggagttacatgctacgattttgtggataaaaccactgttctcttgttctgtgatgaagtctgagatctctctttactgtgtcggtgttattaaaaaaaaaacagaactttttttgtttctcgagttttttttttttgaatccagattctgttccacagatgctaatttcaatcatagtatcaatctcaattgaaagtttctggctttggatgaattaattcaaaataaatttgagtattgatgatctctccacaggctgctttcattgattcggatcaaactcagcacaacattcttatggattcccaatcaactgtctccggtgtaagcaaccaacatttctcaaactttcatcttcgctgtgttatgggattatctttgtattgttgttgtaaagctgtctgttcaaaggctttgtattgattcattgttgtgcaggtgaaaactgtcaagattagcaatgtttcactaattgtttctaagaaagatgtcaaagagttcttttctttctctggtgacattcaatacgtcgagatgcgaaggtatgaaaaataacttgttgtaaattatcatcttcttgttaaagatgatctttaccaatatctctaatgtttactctaatgatctcagtgagacacaagagagtcaggtcgcatatgttacttttaaggattcacaaggagctgaaactgcaatgctcttaacggtattttgctttccgcgtatgcatcattccgtatatttcatgaattagtgcttacagcgaaaaacatttccttccagggagctgtcattgcagatcttcgtgttagtataactcctgctgttaactatcagctaccaccagaagcccttgcacttgactcggtaaagaccggaaactctttgatttattcgttactctctcggtgttcatgttgtttcctctgtgtagcaggaacattcgtttaatggtttttctgtcaagaaagctgaagatgtggtgaacatcatggtgggaagaggttatgctcttggaaaagacgccatggagaaagccaaagcatttgatgacagacacaacttgatctcaaacgcttctgcaaccattgcatcgcttgacgataagatgggtctgagcgaaaagctaagcataggaacaactgtggttaatgagaagttgagagatatcgatgagcgatatcaggtgagggagataacgaaatctgctttagcagctgctgaagagacagcaatcagtgcaagaacggctttaatggcaaacccttatgtatcaagtggagcttcgtggttttcaaacgcgtttggcgcagtgacaaaggcggttaaagagaaagttgagaatggaggagaaggaagaaaggagatcatcacacttgatccctcttcacccaaagttcctgctgtagttcctgttaagctcggttgatgcagatctcatcaaaccaatcggatctcgactaaattctttgataggtttgttgttcatatatatgctttcgtatgctaaagagaagataaaaagacataaaccatgaaaggtgttgttacattcaaccagcatttgttcctctcttgaaagagattattaagattcaagcaaaatagcaaataacttgcaggaaccatcaatgagaaaatggtctcaagaactgagttgaagaaacctctgtgccattggatgcgtagcgtgcgaaagctcacttggtttaagaacttcaacaatctctccgtcgacaacaaggcaaacgatatcagcaactttctgaatctgcttgatactgtgagaaacaatcacagtagtaatccctctctgcttcttcagtttcactataacatcctcaatgttctctgtcgatatcggatcaagagcacttgttggttcatcgagcagcaacacctcaggctcgttggctagagtccttgcaagtgctactcgttgagcttgacccacagataactctgcaccagtcttcttagcaaaggaagcatcaaggtctgcaagacttagcagcttataaacctcttcgtcacttagtttctcccctctcaaattcggaccatatctcacattatccgcaacagtccctgtaaccaaccacacattatcaagacctatgaaactagaggctaagcaaatcccaaaatttgattattaccttgaaaaagaacaggaagctgaaaaagcattccaactctacgacgaagagcaataacatcaacgttggttatatcttcaccgtccaagaacacagttgactccggtggttcccaaagacgattcagagatctcaaaaacgttgactttccacttccactaggtccaatcacaccaacgatcataccttttggtatatctatcgtaactcctttcaagatccgagatccatcatcggcgactcgggtcagatcatgtacccgaatctttggttctgaaccagacacaacaacatccacaagatgctctcgtaatgatccatcggattcgttagaccaaagtgatggcatggctttaaagttttcaactttttttgatcaaaacactcacttaacgaaaagatttgtgtccgtatatgaacaataagaatcagtcaattgatattgacaatttattattcttacaccacttagtggccaacttttaggaccaatctctgacatttacataatttatgacatcacgagatttagaggaggaattgttttttttttttttcacatccagatacaaattccctacatgactacatctatcacttgactatgccagaaatgataattccggttcgtagataaccaacaaaattcagacacagaaattaaagtagaccggttcactatcgtataacttcgctttgagttttttttttttttttttggtgtttcagagattaactttgaaaaatgagtatcgctttgatctcctgctaaaatcgccattgcaaaattcaaaacctgtagagattgaaactgtaaaaaa

SEQ ID NO: 14797 - DNA, 3000 bp, Unknown
  misc_feature (1)..( 3000): cDNA_ID_2730879_gDNA_ID_2684225_Annot_ID_137567 3000 nt of promoter + ATG
ctcgcttatacgtctaaaacagaaactgcaatgccaccctgaatccgccaagataacatcagactgtcgataatgcgcataccttgttttacccgtctggtatctatgcaccgatgctctccagctcttatcatcaacagggaactcaaaagagtacaagtaattcttcagtctaagatgaagaatttgtggtatgtcatcgcaccaacggagaagatttatcgtatgtctactcggaatctcatcaacatcagacataatcaacaagtcatcatcagtgataccagctattctcaatagctgatccaatgcgattctttgataagcctcttcgtaaaaaggattcttctcacctttcttaaaccttcctcctatcgacccgtaagtcaaccgtggctcgataaacttaaactcatccctatgccccgcgaaaacaagcggttttggtaatccggtgaaagtcgagttagattcaagtagaacaaactgagtaacatatgggtacagttctttccaccgtatcgtgaggagttcaacttcagtactgaacaaaacagcgtcgtagacacgacgagggtactcacgggttctccaaccgtggagtttacagagagattccatagaagcgttctcgtggtgataatgcggtatctcatggaatggttttggtggtgattcccataaaggtctcaagaaatatgaaatcttgagagcgttaatgtatacaccaagaacacacattggcatgattactaacagaaacagaaccgattttaaatccacaccacgcaagatacaacagagtcttgaaataccaaagcctcgatctgattcctgattccaaaccaaagagaaaaattgtcgattcgctgactaaaaccaaacaagagatgttgaccaatctaagcaagtgcagagagatcaatctaattcaagagaataagattccgcaagatctatgatatagatccaaaagggttctttgagcattgactaaagatcttgtttttatcaagaagaagaaaatcacaaacctgagttccgcataaatcatcggactttttagaacagtagtgaccaccgttttctcccatcatccaccacatctttcttcgaacaagaactcgatttgagatataaagaaccaaactttaccacaaataaacagaatcttagagattggtttcaacaagagatagaaaaaacacacgaattaaagaatccaagcctaaaaaggggagattttgaaagaattaaagaataaacagagcaaaaacagaggtttttttttttatgtgattgtgtctatgatgataaatggatattgtctcgaggaactaacaagagagaaaaggggtaattaggtcaatgaggaaagtttcaacgttagttccgttgcttggctttgattgatgaagtattatcatttatcattctctccacaccacgcgttgtgtgactcagtcccccacttccagcttttgtcgtgtctttttagttgaaaaagctcagaatcacttatgtactctttcttttctcttcaaccaccacgtggcttccactctaaaatatacacaaataatactatctaatttaatcataaacttagacaatctgtatataatatactctgatgtcaacagttttttagtataagctaagtattcatattagggagagttttggaaagtactaagtaattgcataaagttctgaaaaaaagcactcaccaagtttgagacctagaaaaatgcatatctgacactgttggtttcctgggtctatttgttgcttttatctattgatttttctttaaaaaaaaataaaaatgatacaagccgaaaagagaaattaaaagcccaaaaggcccaataccgaatggtgaaacataggtttgctgctggagtaataaaacctatccggaggaggagaaattccggcatagttgctccctcttctgtgttatttgtgttgatctatgcccatgcattttctcatgcgagggaccaaaacattttatgtggcacctcccaaagtatttgaaaattgttgtcaatacttcatttactttgatggttaatctttttttttttcctctgatggttgagagtcttgagacttacgagtagacaattcgttttatgtgtgtttttgtttaattatgtgtcataaactcatactaaaatagaatctcatactaacaataacaacaaattcgggaagagtaatcaaaattttcatcgcttcatataactcctttaatttcaccgctatggttgagtcgatagaccaaaattctatttatgatttacttcgatttttttttttttaactctaatcattgattataaacctaaaccgttttcatttttataaaatacatatatatttttagtcaaaaaaatccattctttaccatttatttttatttttttgaatagaatataaattttatttaaaaactcattttacattaaatgtaacggtaacttaaacattttgactaaacattactaaatggttgaattttttttttaagatctttcttatctcatagcaaactaaatcgccatatatcctccctcgtatcttccgtctccttcttctctaccacttgtatttctccatatatctatattctttttacttggtcaaatccataaatttgtatcactcaggtgttattgaacacaagttgaagaaggaaaaaaaaacaagttgaaagaaaagtagcaaaaccgaaactaaaaaaaagaaagaaaatagtaagaacaaaatgaaaacgctaaaatcagaaataaaagaatcaaagaagcaaagataagcaaaacaagttttccaaaattgttgactctcttttacaactacacaaaaacctttcttcaaaatattctcagattctcttcttcttccttcgagctttcacagttgattcaattcccgatttcaaactcaatcaccttcagattccgatctccattctctacatcaatcacaatg

SEQ ID NO: 14798 - DNA, 3000 bp, Unknown
  misc_feature (1)..( 3000): cDNA_ID_2730875_gDNA_ID_2684225_Annot_ID_137568 3000 nt of promoter + ATG
taaaatttagactacacttgtcaaaagatgcaacaatataccaaaaggtcagaatatgtaacctacagttagactaaccaaatctgagatcttagatgctatagcagcttgaataggctgctgagaatcaaggccaagtttcgacacaacagcttctttggaatcaaaaccaagcctagaagcaacaccattagtcccccggcaaaagcttgaatccccttcttgccacctgtttttagcgggaggaactctcggccgttgaaaaagtgccgaatcattcgtgatacatataatcccaataagcaaaccatcatcatcataaaaaggagaaatcgtagtcacaaccgaaaacctctctcccattttattcttaacaggaaactctccagtccaactctctccactgctgcaacgctgaaagatattttttgcaacagcagcatcttgaccatctacgagtatattaatcgagtccttccctaacgcttctgcagctgagaatccataaagcttctccgccatcgagttcctaaaacaaccattccaacaaaatttgaactgtgaacataacttagctaacatatcagatactaaatcctatactacaaacgataccaacactctctaatcaatcgattccaagagctcctatatgaatccaaatcacaatcctagcatttgactactaattatgaagaaacaatgggaaccaaaaaagttctacctactcaccaaaagataatttggccattaagatcgaagacatgaacagcttgagccatagactgcaaaatattcaaatactgtttatcggtgaacttgcctgccgatggtccatcaccaccaccagctactccgtctttagaatgactctctttccgtaacggagaagcgtgacggaacgatgcggcgccggtttttctccataacggagttccttctccactgtttctccttgaaggtcgtttaggtgatgaagaatgcgaacgccttttaatctctgctgatactttgagttttgacatctctcgctttagatcttcttggctttcttctagctctcgtatcttcttcaatagcttctctgctggtggattcggattctccattgtgattgatgtagagaatggagatcggaatctgaaggtgattgagtttgaaatcgggaattgaatcaactgtgaaagctcgaaggaagaagaagagaatctgagaatattttgaagaaaggtttttgtgtagttgtaaaagagagtcaacaattttggaaaacttgttttgcttatctttgcttctttgattcttttatttctgattttagcgttttcattttgttcttactattttctttcttttttttagtttcggttttgctacttttctttcaacttgtttttttttccttcttcaacttgtgttcaataacacctgagtgatacaaatttatggatttgaccaagtaaaaagaatatagatatatggagaaatacaagtggtagagaagaaggagacggaagatacgagggaggatatatggcgatttagtttgctatgagataagaaagatcttaaaaaaaaaattcaaccatttagtaatgtttagtcaaaatgtttaagttaccgttacatttaatgtaaaatgagtttttaaataaaatttatattctattcaaaaaaataaaaataaatggtaaagaatggatttttttgactaaaaatatatatgtattttataaaaatgaaaacggtttaggtttataatcaatgattagagttaaaaaaaaaaaaatcgaagtaaatcataaatagaattttggtctatcgactcaaccatagcggtgaaattaaaggagttatatgaagcgatgaaaattttgattactcttcccgaatttgttgttattgttagtatgagattctattttagtatgagtttatgacacataattaaacaaaaacacacataaaacgaattgtctactcgtaagtctcaagactctcaaccatcagaggaaaaaaaaaaagattaaccatcaaagtaaatgaagtattgacaacaattttcaaatactttgggaggtgccacataaaatgttttggtccctcgcatgagaaaatgcatgggcatagatcaacacaaataacacagaagagggagcaactatgccggaatttctcctcctccggataggttttattactccagcagcaaacctatgtttcaccattcggtattgggccttttgggcttttaatttctcttttcggcttgtatcatttttatttttttttaaagaaaaatcaatagataaaagcaacaaatagacccaggaaaccaacagtgtcagatatgcatttttctaggtctcaaacttggtgagtgctttttttcagaactttatgcaattacttagtactttccaaaactctccctaatatgaatacttagcttatactaaaaaactgttgacatcagagtatattatatacagattgtctaagtttatgattaaattagatagtattatttgtgtatattttagagtggaagccacgtggtggttgaagagaaaagaaagagtacataagtgattctgagctttttcaactaaaaagacacgacaaaagctggaagtgggggactgagtcacacaacgcgtggtgtggagagaatgataaatgataatacttcatcaatcaaagccaagcaacggaactaacgttgaaactttcctcattgacctaattaccccttttctctcttgttagttcctcgagacaatatccatttatcatcatagacacaatcacataaaaaaaaaaacctctgtttttgctctgtttattctttaattctttcaaaatctcccctttttaggcttggattctttaattcgtgtgttttttctatctcttgttgaaaccaatctctaagattctgtttatttgtggtaaagtttggttctttatatctcaaatcgagttcttgttcgaagaaag

SEQ ID NO: 14799 - DNA, 3000 bp, Unknown
  misc_feature (1)..( 3000): cDNA_ID_4265548_gDNA_ID_2684225_Annot_ID_191958 3000 nt of promoter + ATG
ttatatttttatctctttgggattttttctaagacaagtttttgttattcggcacaaatcgaagatggtgagtgtggtatagtccacgttatggcatatgcttgcacgacgagcaagccagtgaacaaaatatgtcatgtcaatgtattttctattgctgaaactatacaaaaatggacactaaccagaccggccagtgtcacatggctatgttactggggaaagagtatgcggaaaataaattaaagtatataagagaagatgatagaaatatttaacgaagtattgattgattctttattggggaaaaaaaagaaaagagtataggttgttgatctatcaaaccgacttttagtgttaggctgcaaatgattgatacctctcagaaacatgtatacatgcatgttttctttttgtcgacgaaaaatgtgtacatgttaattataaatatatatgtgtacacaacataatttacgatataaaaaaaacgaatccttaataatcacttcaatcgttttatggatgttttatgtataccattattagaatatgaatttctaactcaaaactaattagtaataagtgaaaaagtttatatttatatatgtcatttaaagttttactcaatttctactgtgagatattattaaccctaatattatattaatttaaagtaaaaactagatcatacttagtcaattattatccaatcgcaagaaatccctccaattaaaatgcgtgtagccaatgttggcgaggttatctacaattgaccaaggattgtagacatgcaatatgttgtagttcctttctttcaggttttgaagtctccaagtaaaaccacgatcgccactgataagcatcacattcgccaatgtgcgactggtgcaagtccaaaacacaatcctcctttgaatttctttgtcactggcttgtttttctttattctcaagataatggtactcgaccccattgtcttcctatgttcgttgaatttcaggggaagaacacgtttataatttgccgcaactggaacaatctttataggtcttatgtatccttatccctcaacacagctttaaccgtaggaccaaaagtggtgggatcactatcatgtggaaccccacaaaattctatgtacaacattgtcaaggtccaagctctcgcatagattggagtgtgcatgcagtactcgtcgacaacatcggcactatttatctgtaaaaaaaacaaattttgtgacatttactaagttcagagcaaagattaacaaagtaagttgttcagttctaatttcaatgcctcaaattaaaaatctccgatagaaaagtggtcttagtgttttagtctagtcttaaaggactcattcaagtgattacatgttcaaaaacatatgtctaagactgatatatgaacatcaagcaagaagtcatggggacaaatctagtacacaagatcataaggattgaatcgaagatacaatgagtaaggatctcaactcgaaattgatgaagctaagacttgaaggacataagcaagaatggagaaaacaacgttccagtgatgtcatcaagactagatgaattgcattgcagttctaatgtgaataagattattcacgtattagtaataaacacatcagaagttgactaataagattattcacgtattagtaataaacatatgctatgctaactttaagctttatgttcttaggaaatttgagaaaaatgacccaaaaaaaaacaataatgaactcaatgaccatataacttatacggcaggatcctgcatataattaacccaaataataatcccttaaattggtaaaatgtggatttcaccccatcctcccacctccctcctctttctaatgttaaattgttggggcaaaattgatatgtaagttcgtctatgggagggaattaagtttccgctgagtaataaacaaacaagtgcaaacctaggaattcaacaccaatgtaattttttataattttgtaggactctttaatagtcaagtcagtatttaaaccacaagagtcggtcagaaaccagaaaaactagaaacaagttatgtcagttctaagaagagagatgtgcaatgtattcggcaatcgggtatatcatctaacattttagccagtgaaaaaagagaaagatatgaggatttttccattgttcagtaagctaagagaagacagtttcattaaagagtcgaatagaatggatattctcatgaaactgagaaggttaagtttttttggggaatactttgcatgcctttatataggtgaagagtcatgttgcatagctccgaggcatttcagcttataagtatccatgtctcgactcatatgatgaatggacttgatgaagggactaggcaatcgatcgtcagtgcgggtgaattttgacgtcttgagtccatccgaccattcaaaagaaagtattcttcttaccacgtagcatgtgactttacctagagttcgtggagcacaagtagaacaaataggattatgcctaaacacctttagaactagaccaaaggtcaaaaactatcaaaacaagttttttacgctacatggtttacataaaaaaattaagtgatacactcaatgatgaataacaatattaacccaaacaaatttgatatcaaaacacagtataaccaaaatcaaaaccgtagtggaactaaactagattatataatatgcctccataaatactcggattttccacgtgaattggactaatcattaattaggaagaacggaatcagaataaatatgtctactcaactttcggtatggtggtggtagaaaagagaataagattcaaagcatattacgaattattgccatatgggatcatatctaacacaaatttaaaagaacactctactactacagtacaaaattgtatatatataaacacctgaaagattttaattacttatccctatcaaagaaactaacacaagtataaatttacagaaaa

SEQ ID NO: 14800 - DNA, 3000 bp, Unknown; identical to SEQ ID NO: 14798
  misc_feature (1)..( 3000): cDNA_ID_2730875_gDNA_ID_2684225_Annot_ID_191957 3000 nt of promoter + ATG

SEQ ID NO: 14801 - DNA, 3000 bp, Unknown; identical to SEQ ID NO: 14796
  misc_feature (1)..( 3000): cDNA_ID_3019044_gDNA_ID_2684225_Annot_ID_191950 3000 nt of promoter + ATG

SEQ ID NO: 14802 - DNA, 3000 bp, Unknown; identical to SEQ ID NO: 14795
  misc_feature (1)..( 3000): cDNA_ID_4265552_gDNA_ID_2684225_Annot_ID_191949 3000 nt of promoter + ATG

SEQ ID NO: 14803 - DNA, 3000 bp, Unknown; identical to SEQ ID NO: 14794
  misc_feature (1)..( 3000): cDNA_ID_3019048_gDNA_ID_2684225_Annot_ID_191947 3000 nt of promoter + ATG

SEQ ID NO: 14804 - DNA, 3000 bp, Unknown; identical to SEQ ID NO: 14793
  misc_feature (1)..( 3000): cDNA_ID_2685667_gDNA_ID_2684225_Annot_ID_191946 3000 nt of promoter + ATG

SEQ ID NO: 14805 - DNA, 3000 bp, Unknown; identical to SEQ ID NO: 14792
  misc_feature (1)..( 3000): cDNA_ID_2730895_gDNA_ID_2684225_Annot_ID_191945 3000 nt of promoter + ATG

SEQ ID NO: 14806 - DNA, 3000 bp, Unknown; identical to SEQ ID NO: 14791
  misc_feature (1)..( 3000): cDNA_ID_2994211_gDNA_ID_2684225_Annot_ID_191944 3000 nt of promoter + ATG

SEQ ID NO: 14807 - DNA, 3000 bp, Unknown; identical to SEQ ID NO: 14790
  misc_feature (1)..( 3000): cDNA_ID_2730907_gDNA_ID_2684225_Annot_ID_191942 3000 nt of promoter + ATG

SEQ ID NO: 14808 - DNA, 3000 bp, Unknown; identical to SEQ ID NO: 14789
  misc_feature (1)..( 3000): cDNA_ID_3019052_gDNA_ID_2684225_Annot_ID_191941 3000 nt of promoter + ATG

SEQ ID NO: 14809 - DNA, 3000 bp, Unknown; identical to SEQ ID NO: 14787
  misc_feature (1)..( 3000): cDNA_ID_2730923_gDNA_ID_2684225_Annot_ID_191937 3000 nt of promoter + ATG

SEQ ID NO: 14810 - DNA, 3000 bp, Unknown; identical to SEQ ID NO: 14784
  misc_feature (1)..( 3000): cDNA_ID_2730950_gDNA_ID_2684225_Annot_ID_191929 3000 nt of promoter + ATG

SEQ ID NO: 14811 - DNA, 3000 bp, Unknown; identical to SEQ ID NO: 14799
  misc_feature (1)..( 3000): cDNA_ID_2730871_gDNA_ID_2684225_Annot_ID_137569 3000 nt of promoter + ATG

SEQ ID NO: 14812 - DNA, 3000 bp, Unknown; identical to SEQ ID NO: 10550
  misc_feature (1)..( 3000): cDNA_ID_2715851_gDNA_ID_2684226_Annot_ID_137575 3000 nt of promoter + ATG

SEQ ID NO: 14813 - DNA, 3000 bp, Unknown; identical to SEQ ID NO: 10549
  misc_feature (1)..( 3000): cDNA_ID_2730998_gDNA_ID_2684226_Annot_ID_137576 3000 nt of promoter + ATG

SEQ ID NO: 14814 - DNA, 3000 bp, Unknown; identical to SEQ ID NO: 10548
  misc_feature (1)..( 3000): cDNA_ID_2730994_gDNA_ID_2684226_Annot_ID_137579 3000 nt of promoter + ATG

SEQ ID NO: 14815 - DNA, 3000 bp, Unknown
  misc_feature (1)..( 3000): cDNA_ID_2730990_gDNA_ID_2684226_Annot_ID_137580 3000 nt of promoter + ATG
cttggctttgagctgtagcaaagaaaagaaaaaacatataaatcggactttttcctgcataaatccaatggttcagctgcaaaacaaatcacgcttaatctattatacaatcctacaacaagtaccatagaatgctatagagagtattcaggcttaaatctccaggaggctgtgtcagtcatacaggaagagttaaccacagaaatagaaaaagacttacttgttagttgcattggcatcacaataacctcgtaattcaggaggaaccctgaattccattctctgatatctgaaacacaattattcaatggagatataagtgaaaactagtcattatgcacccatctgtgtgtattaccatttcacctaaaaaatgtcacaaaccatacaataagaatatacaaatcaatgtcttaaaagagaacttacacacgagactcaggatcattccgtggatcatagcctcttttaatccagaacctaagaaacggaccactggagaaataatatgcagctctgagcagaaacctgcagagagaccaaattgatcaatatagtactaaaaacacctcagtataagaaccccgtattagaaagctatatcacctgtttaacatatgatgtgtacatttaagacctttatcaagtagtcgttgaacaacagaatcccttgtccatataggccgctcctcaaacaatgcagacactgctacctgccattgccagtggttggagctgcgagaaacaaagtcttcccacttcagtttctttgggatctgtattgaaagctaaggacagaccaagcaaatacagctctttctactcgccagataagaaaatgtcaaagaatattggaagaagaactagcatataagaaaaaggatatctttgacgctgaaatcaattgcaaacactgggccaacatcaatctgcacataaaagaaaatagtcatgacatagatcaattaggatatggcaaccgaaaataaactataaggaagctgtcatggcatctttgaaatccaaaaatgaacagaacgcattcttgacggttcattagagtgaaaccaagagtttttacatgcttcaaatcttttactactgcatttgaaggattgagatataagttctctaatttcatgccaaacctctctaatttccgcaagatgaaggttagatatttaaagtcatgagttcctaactgtctattccgcaagatgttttgtttatttagaaagctcatatgcttcaatttctttatttttacctcataaaagttctgagtcgctgcatcatctttcttcttgggaccagatgtcgccggaggtttcaacctgtaatcacacaagaaaattgaaatcagcactgtaatcaactataagtaaatggcttatgccaccgaataagaaatagaaaaaggcagtgtaatcttacgccacattgtccggtatatctttgggtgcaaagaactgtggcaataacatcattacatcttcatcagccaggcccatcaaatcactttttcctgcatatatatccgatctagtttaggtgagcacaccacaagaaatctggaataaattggaaaaaaagagaaaatcaatatccgaagttgatcttgtacctgtaaggggatccacatccatccactttctctttttctgctgcgcaatgtccgcgtgaataggaataacatgctgatagtcagccatgcctagacaacgaagaagagggaaaaatcttgaaacacttttagaggcataagaaccaagcaaaaggagaggtaagtttttaccatcaaagtgaaacgattcagacaaacgagctacgatatctgcacatagaactggactagcttcctctaaacatacatccctactagtgtcaagaacagactgactttcaggtttcttgatatcctgcttagaaattcttaacaaaaaaccactacaaggacgttgttctcccaatgcaggatgtgcataaggatcttcaggccgaaaccgtagctcaagcttatttgaaattgattcccttgcctaccatataaaaataaaagactcaaactgaataaatcgtgcaacaaatttaacaaaagctggtggatgcatataccaagactgtaacaacatataggctttaaaaccactctatgaactagcatatgaagacaatctcagtaaaaggaagagactttaaaaccaaaattgaaagattttacttgtgtaattccttggatacctccaagtgtttcaatagctcgagaaatagaagatgggtaaccagggaagtgtactacaaacgcctccttgcttggcaaggtacctgagattgttccttcttctataattcccattgattctttccagagattactctcttctgtaaaacaaagagataaatccaatgccaatgcaattagagaattataatgtgtatatatattcctatagattttcagttttatatgtgcttcattgtgtcgccttttgccgacggagagttaggaaaacgaatggtgaatttaacaaagatcggaaatttataattcaggaacttcagactcaccggaaatacgaattttttttgcctcaaattcttcggtttcccgacatcggcgacggcgaatattttcaaaacccttaatttgaactttttacttatttgggcctattgcttaagcaaaaacgacatcgttttattaaataaagagattataaagccgtcacttgcgcttcgaactctggtctccgtatttggactcaaaaggatttgggcttagcccatcatctaaccgacaccgttttaaaaaacgagcacgttgactttttgttaaactcgggaagaaataaataattgaggatctgatctgcgtcactgcgattcgaactagggtttccgtactgaatcaacttcatcagttcgtttcgttgtcaaaagcaaagcagagcaagttttattttccctccaaaattctaagttgatcttcactttttgatg

SEQ ID NO: 14816 - DNA, 3000 bp, Unknown
  misc_feature (1)..( 3000): cDNA_ID_2730986_gDNA_ID_2684226_Annot_ID_137581 3000 nt of promoter + ATG
gctatgggtctgaactatagcagtaagttccaccatgggagatacattgctgcgttcaatgtgatagcattcaggtgcatgaactttccatatggaaacgctcccggactttgaaccaattgccaaaagagagaatcttaacatattcccacaagaactttctgatgagaatcttagaagagatgaccaggcaacggaatgggaggataataatgcctcacgagacacatacgtttgcggacttatctcttgactgcatttttttagagctttaggcaaggaacgacgatcttggccattgcttgcctgtttatatacttcaatctcaagtacctgggaatataaggaatcgagttagatatgagtacaatgcgacgatttgattcttactagatgacacttgagagtgggagtgtcaaacttctaagaaccatatggtgtgaacgatgcattaaaggattcaggtggaattcaaaagcatgacaagattcgaaatgcatcaaatcaatgacaagacaatataaaaaccacacacatgttctttctataagaacactggagggaggtacaaaatgtcaaaatctactcaagatactaatttacttgatgaaatgacctagtttcttattaattactaatcctaacaaaaagagtttccacaaaaacaacggataagatacaatctgcaggaacagagttagaatctgaaacttgttacagaatacactacaaagtgaggaacagaaataagttggaggaatcatgatagtattttttcaaagcaatgcactacaacagaaagaagttaagagatatgaggacttacattatgctctgctttactgtcttgcttggaacatgatgctcgatctgtataattcttttcatgcaagttgctaaaacaaagaaagtaagttagtcaagtgatcaaaacagaaaaaagaatatggaaaacaatttctcaaaccactggtatgcatctgacgaaattgaagagtgaaagaaatgctctttacatgttatttgcacttgtttttcttcgcttgcgtgccttcagacttgaaatcctttcatcctcctcatggtcatgttctaccacttgatcctgttataaaagagcacaaatcatttcaataatatagtttggataaaaatattatgcagacaaacatcaacaattccatcaaaacgcaataccttccacaacaacatttgtccattaataaaggataactaaagatataaacgatttgtttagatgcgtctttatctaaatgtgaagagtacgaagtataaactatctacatatcccttataggaaacacatacatatagtttgcgggagtagtaagtcatccttcatggttatcaaacttccactgaaaacactttagagatacaagttaccttagataatgaagtagaaggatttttggactctccaaagttcatgcttgatagattctcataaagcattttagatatatcaacaatctgcgaaagagaggagaaagcaactttaaatgcataggttagttataaaaggcgaaagagaatttacgacctacctcaatccactcagcacagaaatcagaatatggaggtcggtatagcttaacccttccttccgctgtgcaaacagccagtaagcacctgagcagagttatttgaatcacgaatttaggaaatagagaaacaaaacaaaactgaacatgttacaagaaatacagtacccgtggtttggagacattcctatctcagaccatgagagagatcgaacacatggacttctttcccgcttcaaactcgaaggcaagagtccaccagttagcaaatctacaatcacatcatcactcacattgttatccgaaacttctgaatgatcgaaaacacagaaaccaacagaaatttggtctacaaacacacaacttcatgaagaactaaacagttgcaaaagattgaatttttatcttcaaatctgaattggcaaacatacaggcaggattttgaaatttgatctgaattttcataaaacaggtacaccaaaattctgtatttatcaataaaaaaaacagaccttgagagcgaacacgaccaatctgataaagctcggcgtcagagattgtgatcaatccacgagggccagtaggcaaagccggattctgacaattacaaaagtcatcaatacaatttaaaaagactcaaactttaacctcaaaaaacgaagcagaagaaaacttacaatgatgatgactagatgaccagcagcgacggcgatgagattttccgatgaccaagcgacggcgttaggatacgacggtgaagtaaccagtgaagcttcctgaaaccgcgacgccatcaaaaagtgaagatcaacttagaattttggagggaaaataaaacttgctctgctttgcttttgacaacgaaacgaactgatgaagttgattcagtacggaaaccctagttcgaatcgcagtgacgcagatcagatcctcaattatttatttcttcccgagtttaacaaaaagtcaacgtgctcgttttttaaaacggtgtcggttagatgatgggctaagcccaaatccttttgagtccaaatacggagaccagagttcgaagcgcaagtgacggctttataatctctttatttaataaaacgatgtcgtttttgcttaagcaataggcccaaataagtaaaaagttcaaattaagggttttgaaaatattcgccgtcgccgatgtcgggaaaccgaagaatttgaggcaaaaaaaattcgtatttccggtgagtctgaagttcctgaattataaatttccgatctttgttaaattcaccattcgttttcctaactctccgtcggcaaaaggcgacacaatgaagcacatataaaactgaaaatctataggaatatatatacacattataattctctaattgcattggcattggatttatctctttgttttacagaagagagtaatctctggaaagaatca

SEQ ID NO: 14817 - DNA, 3000 bp, Unknown; identical to SEQ ID NO: 14504
  misc_feature (1)..( 3000): cDNA_ID_3017649_gDNA_ID_2684226_Annot_ID_137586 3000 nt of promoter + ATG

SEQ ID NO: 14818 - DNA, 3000 bp, Unknown; identical to SEQ ID NO: 14506
  misc_feature (1)..( 3000): cDNA_ID_2730144_gDNA_ID_2684226_Annot_ID_192002 3000 nt of promoter + ATG

SEQ ID NO: 14819 - DNA, 3000 bp, Unknown; identical to SEQ ID NO: 14505
  misc_feature (1)..( 3000): cDNA_ID_2730148_gDNA_ID_2684226_Annot_ID_192001 3000 nt of promoter + ATG

SEQ ID NO: 14820 - DNA, 3000 bp, Unknown; identical to SEQ ID NO: 14504
  misc_feature (1)..( 3000): cDNA_ID_3017649_gDNA_ID_2684226_Annot_ID_191999 3000 nt of promoter + ATG

SEQ ID NO: 14821 - DNA, 3000 bp, Unknown; identical to SEQ ID NO: 14816
  misc_feature (1)..( 3000): cDNA_ID_3019126_gDNA_ID_2684226_Annot_ID_191993 3000 nt of promoter + ATG

SEQ ID NO: 14822 - DNA, 3000 bp, Unknown; identical to SEQ ID NO: 10548
  misc_feature (1)..( 3000): cDNA_ID_2730994_gDNA_ID_2684226_Annot_ID_191991 3000 nt of promoter + ATG

SEQ ID NO: 14823 - DNA, 3000 bp, Unknown; identical to SEQ ID NO: 10549
  misc_feature (1)..( 3000): cDNA_ID_2730998_gDNA_ID_2684226_Annot_ID_191987 3000 nt of promoter + ATG

SEQ ID NO: 14824 - DNA, 3000 bp, Unknown; identical to SEQ ID NO: 14505
  misc_feature (1)..( 3000): cDNA_ID_2730961_gDNA_ID_2684226_Annot_ID_137588 3000 nt of promoter + ATG

SEQ ID NO: 14825 - DNA, 3000 bp, Unknown; identical to SEQ ID NO: 14506
  misc_feature (1)..( 3000): cDNA_ID_2730144_gDNA_ID_2684226_Annot_ID_137589 3000 nt of promoter + ATG

SEQ ID NO: 14826 - DNA, 3000 bp, Unknown
  misc_feature (1)..( 3000): cDNA_ID_2731031_gDNA_ID_2684227_Annot_ID_137594 3000 nt of promoter + ATG
atacatacgtatagataaatacagatacatgaaatatatatgtatagaagtaggtatgatatgtgcctagtgataggctcagaactacactaaaaatgttgcagctaactgttaaatagcaatcaatctacactgccatcgattcaaacactctgcaccgtcgtgcagtccaagaagcagaagaatgtttaaagttgctgccttaatatttgttttctcatttgcatttccatttacattacatgcatgctcttaactcttcatttaccattctctcatttcttatgttaattaatgtctctattgacttaattaattacgaaaatctcttgatggaaacttgtgtagaagttttatattgtcacgtgggggggacatgatcttaacttgcagtttcaaatattttaaccaatttaaaatatttttttcacaaatatctttgagtttaagttgaaattttaaaaagaccgagttgttgttatcattgtgagtaaaatagttttgttgtaactcaaagttttgtatctttctgcttctactgaagctaggaatagaagtctagtagctaggttatatagtttcatatatatacgctcttgccaaatagtacagtatatacgtataagtatataacttttctatgaataaattagtgatcccttgattgtgagaataatataaaatcaaaatatatatgatgatacgtctgaatccaaaaatttatgaataaaccatgtttttttagattcgttgaaatatcttcatattaccgaaatcaataaacaaatagacaaaatcctaatcatagagctatagaaaaataattcatattaataaacataactgacatgtttgagaaaacataagtagattatctataagaactttaaaatccatatataatccgtgcaaaaccctaaaacactatcctacctaaaatagaaaaactattaaaatacaccaatacaaaaataattcatattaatcctaatcatagagctatgtaaaaatgttatattaatctatagataaagcgactccatacaaatttaaattaacgtatacgaattaatatcagttgcattaacatatacagtaaatgttatttacctgtacctattgatgaaaataggaaagaagagattttcctttttgatatctgaaacagttataataatagacctatagtagccttgccgcatgcaaccatgctactctatttaccattaattagcctcattgttttttattctctctcatttgttttcttttgaaccacacacaagagaactctcattaaacaattgcagatgaaatcaagtacgaactctaagattcataaatcaaataaactatttgttgtgatcagttcgatccgaaaagttaaatagattttcataggcttaggtttatttcattataccatatcacaagtacttttactctgatctggttatgtttagcataatatcatcattaagcttaagttagcattagcatacgagatatttgtatataaggcaacattgtatagttttacacttcattgagaaaatagtcagtttcatacgatctctctctcttactttactctttcactctcagaggtttgttacgaagaaatcttgaccttgttgaaacccttcggatattatttaatcagttttattttccttttgctattcagtgtatatgttctatattttccataaaatctaaaagttctctgttctttcttttttttcggtgcaaatatattcaaatgatgtatatattgtaatcattgtgggccttatcaacttactgaactctatcttcattcttttgaagtaacaaggcctcaatatttggaagcccagaagaatgggctttattaagtaagacaaatgcatctcttccttggtgtttttctactcgtcgtggacgtggacctaacgtcgacagatattttgtgtgttacccgattgatttagtgctttagtttgacgaaacaatagtatgtgtggcatcttacatgtctttttattcttccaaatacgtatggtgtttgaggcttaatttgttttgaaaagtttctactgctccacttgtttgcttgaaaattaattcaagatttcgaattttgtcctaattaagttttgttacgtaagaccttttgtttctataaatttgttaattatgtagactagactatattagcttctttatgaccagactatatatactttaaaactttaggttgttgtatatgtttagtctctttgcttaaaatgcccttcatcaaattttgtaggaatgttaatgtaacaagaagctataggatgcttaacgtcagccacttcaacatatttttactatgactactgtatttgttaagtgttctaatatgcggtttaagcgttttgatttgagcaaaaaaaaacgttttaccaatagctaaagaagaacagaggaaacaatggtttgaaaaaccccatgtcacttcatacccctttaaggctaaaccaatgtgaaaacaattaaacttcttcatttttgtttcattagagcaaaaatataatattacagctctaaacaattgtcatcaacaaaggttacttaaaaccaaattataattatgagatttctccatatatcactaagacaagttgttaccgacaaaatttatttaaagatagaacaaaaagcagtttaaaccacttttggaaagaaatactggtatatgattattttttgtttttctcattatatgcaagataaagttaaaaataaataaaaatagagattaagagtttgattcaaataaaagtcaacagaattcataagtcataactaatggatacaattttgaatatatcacattagaaaacaaaaaaaaataccctgggtttcatgttccaccaaacgtgaaagtaaaagtaataaaacctcattgtctcattctttaaatatctcacgacttctcacctcatatttctctctctctctccatttaccatg

SEQ ID NO: 14827 - DNA, 3000 bp, Unknown
  misc_feature (1)..( 3000): cDNA_ID_4266623_gDNA_ID_2684227_Annot_ID_137599 3000 nt of promoter + ATG
aaagatctcatggccatcgccggtgaagccctcaaggcaaacatcaccacaataggtaataaacacacatcattttatttcacctacatatatacactaacaatgatatacacggtgaaaactatatcaaggggtgggcattaaatattattggtcggctccgttttgacttcaattcggttttaaataacagaataattactctatctctatatatgttttgttattatggttaaatgtactttcttggtatatgtctcacttctatggaaatttaggttactctattcggttgcattcaattcggtttgttcgatataaattttattatgatttaaagcaaagtttggtttggcttaggtttaaggaattatggtacgtttttggttttgatagatgaatttgtttgaacaggtcctttggtcctaccggcgtcagaacaacttctcttcctcacgtccctaatcggacgtaaaatcttcaacccgaaatggaaaccatacataccggatttcaagctggccttcgaacacttttgcattcacgcaggaggcagagcggtgatcgacgagctccaaaagaatctacaactatcaggagaacacgttgaggcctcaagaatgacactacatcgttttggtaacacgtcatcttcatcgttatggtacgagcttagctacatcgagtctaaagggagaatgaggagaggcgatcgcgtttggcaaatcgcgtttgggagtggtttcaagtgtaactctgccgtgtggaaatgtaaccgtacgattaagacacctaaggacggaccatggtccgattgtatcgaccgttaccctgtctttattcccgaagttgtcaaactctaaactgaaaacgtctttgaacggtttagtaacggtttgattttgtgttacggtttaggtttatttggtctcgggatttggtttaaaggggattgagaaatgggaagttagagagaagaaaaagcaaagcataaatgtttgtatttaattgctctgcatatacttaaatctctgcttttcatttggggtattttttagtttctcgtgctgtaattaataacttgtggtgtactcaaataagaatatttctctctgttttattatttttaaattggagaataaacttctttgttttcatcgctgccttatatatattgcttctgatttgggttgaccatccatccagtttgcaggatccgatagcagtaaatatgtccactatgaatgtggtgcatggacagtcatctcttacagacttttgcatgtaaaattatatgttgcatgcatgatggtatgtaatgaatggattggatgatgtcatgactcatgatgattaaaaaatacgtgagtccatatatttctccaatagtattaaaatacgagtacatcaaacatgttttccaacactgccacaaaatgtattggacctatatcaataagtgggccttgatttcccagcttatgatggcttaggtttcattgtaaatggtgaaacaggccttcctagtgaggatgcaggtcatcaatagcaaggtttaccaacggaggtttaatcctcatgaagtgatgaagaagatgtcgaagagttggagtttgagaagagatgtttggaaaggtattctaagaaggatgcagaggatgataatgagattgatgatgttaacgacgttgatcaacaagcgcttttgccatcagtccgtacgtgaccctaaactgtggctggtgaaatgtggcgttatgagtttttgttctctatgaattccaagtattaaggatatctcaacagacaggacaaaagtttaaggttaatgatcttttatcaaattcaatcaataatcagtctccgaaatcttagtgtatacaaatggcgaaaaaaatataaacatcattttccaagtacacgaataatgccaagagtggtaaatgatatccatcaagcctcttatcttctcaagaaaaaggttgatgcctttgtttttgaagttttctgcatattgatgtggtccagcacaaaccattgttatccactttatcttttatttttctttaaccccaacgttttctactttagcacttctacttatctctagtaattctccatttatcacttctacttattgtccacttgattcttgagcttcatattgttgaattcgtttctacttttctgccatcttctctttatatgcttaaattgtatatttttacgcttgctgtatagttttttaatgattatctttagtcctaataattggggatttaattgatttttttcctttgtataaaaatatacagtaaagatattaatacaatttcattgtctctaaagttttaagataactatgtagaaaataaagatgtagacatatcatactataattaatgtcattactcattatctttaaacgtaaaccgacacaaccaatcaaaacctcgctttccacataatcacgagaataagccacactaatcgactttttccatggaaaataatgaaatctaccaaaaatgaatgaatggtaacaaaatccaaaaataaggagtgattgggtcagtgaaaacgacaagtggaccataaagatatccatctgattaagaagctgaccaatcacaacattaagaataggatcaacttgaagaactcgaccaatcagaatcgagataagatctcttcatggccctcatggggtataagcaaccaaaaaggtgcatcaaattttcactttaaattatacaagaagaaaaaagctcacatcgtgtgggacatgtactagccaacaacgcctctacacttaacccttcaatgcctcataaaatgaaaatgtagtctctctttttataaccacttctcgaaaactgaaacctttgtagagagaacccatagttcgataaaacattctttttgcaactgagacttggcaacttggttttactcaaagtaagatttcttcttgttgatggtgataagttcaatatgatg

SEQ ID NO: 14828 - DNA, 3000 bp, Unknown
  misc_feature (1)..( 3000): cDNA_ID_4266627_gDNA_ID_2684227_Annot_ID_137600 3000 nt of promoter + ATG
aaaaattaagggaacttgtctttgatattttatttactagttatatatagtccttaccgaacctcgtcggcaacatcatcagtgcgatcaagaatcgatcaccattaaaatgctttattgagcacgatcagtgttcaccatgtaagaagattattgtctcacaattcaaatcaaacctagcctaggcaacaaaaattaaatttctttaaacaatagaacaaaactcgtccgccccaaccatcctcttcacaacattccttaatcttacaatatctatataactaacgcatcatttggatttcactatgtaactaagtcgaactggtgtgaaataattataaatttaaataaataaaaaggtgaaaatatggttgtacacgaaggtatgtgaaataattatgaataactaaaatgtactgaattatttattttattttaatagcaatggaatctaaattaaatcaggatataatgaaaattttgtaaaattgtgattaaattgtcattccaaagaaatcagagaactgtctttaaaaatttggaagcgagtttaatgatatagcctatatgaatggtacagtgtgaatgtctctgagaaaaattacaattccacatttttattacagactagatgagaaaaaaacattgatgagtaggtcaaattaaaaaactatattcacgttttcggtgatacattggaaaaccatataaaacgatcatttttcaaaggaagaatagaaactttatttacatatttaattattatggaagatgaaggaagaactttatcatagactacgaaatcggtgtggctaatgaaatacagacaccttatatattacatattaaatgtacatttcaatctggtggatagttccaaactaatcttcttcatcaaatattgttggcattaatgatctcactatggaacacgaaaattcagcaatgttcatttttagttaagaaacaaatcctcttacgaactctgtaagatcttgaaggatcaaaagcctttgatctcaatttctgtatagtttttattagcctagtgctttatatatgtttgatacttctgtttggcaatatcaatcatagtagaaaagatatggacttcatttgaggtttttggtggattgtgtctatatgtgaaatcatgggatctcaagatttgtctgcattcagtttccaagtcaaacatcgtaactactgtttgattttccctcatgcttgcagttttcatggatatctcaagatttgtcttcttgcactttccaagtcaaacataaagtaactactgattgatattccctcgtgtattaccctctttcaaatgacacaattgggcccaagtagaggaatttcatagtgaattcaaaagattaactgtattccaccgtcgtattttgataacatttagttattccttttcttttttttcttctgcaacagtttttttttaatacatttagtgttggtttggttcaatgaaatattatatgttacttctttttttggaaataaattattcattctttctactataaaaggaattgttcatgcttttttgatacaatagtataccatttcaaaagataccatagaccagttattacatgaatcgccaaaacaacactaaaatcagaaaatcagtatattttggtatagtctccaacatacaatcataaaacctctgtgaaatttaaaatctatatttgacatttcaaagtttaacaacatagttctaaataattacctaaattttaagtcaaatgtgaattatattttactcttcgatatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaataccctaatcacattttgtaacaataatacaattatacattaaaactctccgacgatg

SEQ ID NO: 14829 - DNA, 3000 bp, Unknown
  misc_feature (1)..( 3000): cDNA_ID_4266623_gDNA_ID_2684227_Annot_ID_192027 3000 nt of promoter + ATG
tccaaagatctcatggccatcgccggtgaagccctcaaggcaaacatcaccacaataggtaataaacacacatcattttatttcacctacatatatacactaacaatgatatacacggtgaaaactatatcaaggggtgggcattaaatattattggtcggctccgttttgacttcaattcggttttaaataacagaataattactctatctctatatatgttttgttattatggttaaatgtactttcttggtatatgtctcacttctatggaaatttaggttactctattcggttgcattcaattcggtttgttcgatataaattttattatgatttaaagcaaagtttggtttggcttaggtttaaggaattatggtacgtttttggttttgatagatgaatttgtttgaacaggtcctttggtcctaccggcgtcagaacaacttctcttcctcacgtccctaatcggacgtaaaatcttcaacccgaaatggaaaccatacataccggatttcaagctggccttcgaacacttttgcattcacgcaggaggcagagcggtgatcgacgagctccaaaagaatctacaactatcaggagaacacgttgaggcctcaagaatgacactacatcgttttggtaacacgtcatcttcatcgttatggtacgagcttagctacatcgagtctaaagggagaatgaggagaggcgatcgcgtttggcaaatcgcgtttgggagtggtttcaagtgtaactctgccgtgtggaaatgtaaccgtacgattaagacacctaaggacggaccatggtccgattgtatcgaccgttaccctgtctttattcccgaagttgtcaaactctaaactgaaaacgtctttgaacggtttagtaacggtttgattttgtgttacggtttaggtttatttggtctcgggatttggtttaaaggggattgagaaatgggaagttagagagaagaaaaagcaaagcataaatgtttgtatttaattgctctgcatatacttaaatctctgcttttcatttggggtattttttagtttctcgtgctgtaattaataacttgtggtgtactcaaataagaatatttctctctgttttattatttttaaattggagaataaacttctttgttttcatcgctgccttatatatattgcttctgatttgggttgaccatccatccagtttgcaggatccgatagcagtaaatatgtccactatgaatgtggtgcatggacagtcatctcttacagacttttgcatgtaaaattatatgttgcatgcatgatggtatgtaatgaatggattggatgatgtcatgactcatgatgattaaaaaatacgtgagtccatatatttctccaatagtattaaaatacgagtacatcaaacatgttttccaacactgccacaaaatgtattggacctatatcaataagtgggccttgatttcccagcttatgatggcttaggtttcattgtaaatggtgaaacaggccttcctagtgaggatgcaggtcatcaatagcaaggtttaccaacggaggtttaatcctcatgaagtgatgaagaagatgtcgaagagttggagtttgagaagagatgtttggaaaggtattctaagaaggatgcagaggatgataatgagattgatgatgttaacgacgttgatcaacaagcgcttttgccatcagtccgtacgtgaccctaaactgtggctggtgaaatgtggcgttatgagtttttgttctctatgaattccaagtattaaggatatctcaacagacaggacaaaagtttaaggttaatgatcttttatcaaattcaatcaataatcagtctccgaaatcttagtgtatacaaatggcgaaaaaaatataaacatcattttccaagtacacgaataatgccaagagtggtaaatgatatccatcaagcctcttatcttctcaagaaaaaggttgatgcctttgtttttgaagttttctgcatattgatgtggtccagcacaaaccattgttatccactttatcttttatttttctttaaccccaacgttttctactttagcacttctacttatctctagtaattctccatttatcacttctacttattgtccacttgattcttgagcttcatattgttgaattcgtttctacttttctgccatcttctctttatatgcttaaattgtatatttttacgcttgctgtatagttttttaatgattatctttagtcctaataattggggatttaattgatttttttcctttgtataaaaatatacagtaaagatattaatacaatttcattgtctctaaagttttaagataactatgtagaaaataaagatgtagacatatcatactataattaatgtcattactcattatctttaaacgtaaaccgacacaaccaatcaaaacctcgctttccacataatcacgagaataagccacactaatcgactttttccatggaaaataatgaaatctaccaaaaatgaatgaatggtaacaaaatccaaaaataaggagtgattgggtcagtgaaaacgacaagtggaccataaagatatccatctgattaagaagctgaccaatcacaacattaagaataggatcaacttgaagaactcgaccaatcagaatcgagataagatctcttcatggccctcatggggtataagcaaccaaaaaggtgcatcaaattttcactttaaattatacaagaagaaaaaagctcacatcgtgtgggacatgtactagccaacaacgcctctacacttaacccttcaatgcctcataaaatgaaaatgtagtctctctttttataaccacttctcgaaaactgaaacctttgtagagagaacccatagttcgataaaacattctttttgcaactgagacttggcaacttggttttactcaaagtaagatttcttcttgttgatggtgataagttcaatatg

SEQ ID NO: 14830 - DNA, 3000 bp, Unknown; identical to SEQ ID NO: 14828
  misc_feature (1)..( 3000): cDNA_ID_4266627_gDNA_ID_2684227_Annot_ID_192029 3000 nt of promoter + ATG

SEQ ID NO: 14831 - DNA, 3000 bp, Unknown; identical to SEQ ID NO: 14826
  misc_feature (1)..( 3000): cDNA_ID_3019189_gDNA_ID_2684227_Annot_ID_192020 3000 nt of promoter + ATG

SEQ ID NO: 14832 - DNA, 3000 bp, Unknown
  misc_feature (1)..( 3000): cDNA_ID_2717080_gDNA_ID_2684228_Annot_ID_192123 3000 nt of promoter + ATG
ccattaaaagagctaaaaaaaaaagtaaatgaactttaaacttgaggctgattttttttccgttgagttttgggaaataagaattaatagttgaaagtttggaattactttggattaaaatatgaaagtttagttggtttcttattgtaagatccatatattcgaagaaataattggttagaatgtctaacaatactagttagatttttctagcatatatcaattaattcatatattaatgttatctaaagaaacccactttctcagatcgcaatgcacataagctcatagttaaattaaaagcatgcattaggataaataatatacaaagaaataaataaattttagggagtggagaatcaaaagaaactttatgcccctaaaagacatgaaaatcaaacaagtgtcaatcatagatacgatcttgatcgagccaatgagcgcaaagatgcgaggaaaaagaagcaacagatcgatcacacactttttgcgttttgcatgtttgatgcattttgatttgacaaagattctttatttacttccttcttccttacttaagctgaccctctttcttaaagtttaaactgtttttagaacgatcaatcatttcaattttggaagcatcgaaatcaaaatgtccaaaatacatattttgacagcgaaatattttgactagatttcaatagtttagaactttggttccacaccagtttatgttgtaatggcaaatgtaaattatttatagaggaatcccattctaatactattttgaatactaaccttggccttttcaacaaaaaaaataaatcgaaatgtgtacaatcaccacgaaattatcatattttttagttatggattctgtaaagatggattaaattagttaaagggaatatactcttacattagctatattaaaaaaaaaaaaaattagctgctaaggggatttagtccatggaaaatgttatttaattctagtttgattaaaccttactttcttcatggtgaaatttaaatttgatgatataatccacgctaaaaaataccatcgtaaaaaacgttgctaaaagctgtgtctttttttttttttttggtaaaagaagctgtgagtcttttgttatatgatgagttaaaccgctcacagaataccagttagtgaccttaaccaaaaaagttccatcgttacagagtatcaatctatgtttcaatgtattatgtatttctttgaaatattgatgtcgaatataaggtggattttctactcagaaataagagaaaaatcccatattccaagaaaaaagtgagttgaaaaaccccgtaatgttgaagaagaataagattcaggagtttgttatgtagaccaaaggcaaagcaagatggtcaaaaaaatatttagaaaggagaaaaacgacctacttaatcaattaacaagcaaaaaggtgaaattcaataaattaatacacctaacaaaaaaaaaaggctacattggcacctaacatgggcaggtcattggttctccaccacgatgagatgcacatgatacccgctttaatatgggctaagtatgcttaatgaccatcacttaattgttctttttagttgttaaaatgggttaagaattccacgtcgttaaatgtgagaaatgtataattcaatacagaataaaaagctcggacgaaaaaaaaaaaaaaaatacagaataaaaagctcaccatggatttttaacatgacataataatgatgagcagttctatatataccacaatgaaaattctttgtaaacttctttctattagtctgctttatattttctagtaatcgaatttcatatttagacactaaatagagatcatgtgagtttcaactctagatcaaatatggttcgttttaataataacaaaaatatatacatataatatattttgttattattcggacggtaattcgatagtgtaaatacattaaacttttgcttaatcaatagagcaaaaacctcccacttttttttttttttttgataacttcttgtttattattagttgattttaagatgaaattttatgtatttttaatgatttacatcaagtcatcaacccaaaataaatatattcgatctttggatccagttaaagtaaataagatatgagaggtacgtgcagagatatattcagaactatacattagtaaatataagaggcaaaataaatgatgctatgaataaagatgctatgaatgtttaactaggaacagaactagtttttgtttcattgttgaactcttatttactctaaatccttcacataataacgctttgtttataaaaaataaaacaaagaattctttttttaagaaagtgaatcgcatgccatttgggaactcaatctttttttatatatatagtcttgcacatatcaaatccagcctccatctcttggtgtagaatgtaaattgtaccaaattagattgttaaatatatttggatattgtaacaatagtgcatgtcaggtcatatgtcacatcagatgtaacatcaatcaatcaaaaagaaacctaggaaattatactacaagctagaggaggaagggatagtacaatacaaaccccttataataacaaagaaagacggagctttcgcatgtaaagctatatactattgtatgaatgcatacttaacatataacgtatatgagcgcatacatatataagggaaaatgaggctgatgtggaaaaggtgctttaagaagcagtgaagttagtgggagaatatgataatggagattatatataaagacaagaaggtggcatgagattggtaataacttcacagttgtctccgaagaaacagagaaaccaaagagttaagtggggaacctcgaagctagttcaaactagtgggaggttgtttcacgtttcaactttcaagtcataaaaccaaatccaactctaaacgtaaacccaaacgtcaaatcatcagatagaaggaaatattctgattgagagatg

SEQ ID NO: 14833 - DNA, 3000 bp, Unknown
  misc_feature (1)..( 3000): cDNA_ID_3019226_gDNA_ID_2684228_Annot_ID_192141 3000 nt of promoter + ATG
aaagaatccctagccgcagcagcttcaacagaaattgacatcataccttctacatccttgaaaaaagagaatgaggtaaaaataagttgacaaaaacttggaaagcatttaaacatctgagacgaccatgcagagctatatatatttgcgttcaagaataagttagaaggacaacactgaaccaaatactgtaagcaatacaatcagtgctcatcggcatatctacctttagagttttgtttagattattcctggcgttactcagcagctttatttggtcatgattgtcaatcaaagtttgacattcctgacaaagcctgtggcacaagaagagaagttagagggagagaaatgcaaaagttggtaactcagcttcaagaatctctagtcaagcaaaaacatacttgtcgatagaaatgaaattatcccgcagttcataaatggttttctcagatgatgaaagtgactctaacccagcttgagcttgttcaacctgaagtttgtcaacagctattacttaagaacaacaaaaaagtcgaaatacattaaagtacaaagaaggccagattaaagctgtacctgctcagcaaccatagtactgagctgtgcatcatttgcctgattgaaacagcaagcatcactagtcaggtcattaaaaatttccagaaaatcgaaaataaaagataacaatagcatatcaaaacctaacaactcaaatctagcattgctcaggaatcactaatactcagtgcaaatgatacttcaaaagccaattcagttccaattgcaattcaaaagcaagatgtcaaacctgttgacgagcgatgtaatcggccttgattgaagaaatagactgcaaaagttcaggtaagggtaagagcttcgccacttctcgcacagccgcttccttcgcttccacaccaagatcttcgaccatcatcttcgctaaatcaccttatttacgaactccgatcctaaattgaaggctacctctgcaaagttattcaaaattccagcacaattacgataacgcagaggagaatcaagagatctggaaacagaaacgtagaggaaaaatggacgcaaccgaataagaagtcattgagcaaatatcgagagccaaatgtgcgattctccaacttcaattacttcgtcgtcctcttatcttcttccttcgctgattctgaagatcctggaaacagtgatgttggacgcagatcagctgggaagagaagcaacgattaaatttctggaacgagtctcatctatcgtctcgcgactctaatggaaagttcggaaacgctgaaattttccgtctcgccggttttgatttttctttttcttttttgccagctgttgatgcaaacctattttttttttttttttttttgcaaacgctaacgctaattcgttgagcaaaacgcaaatcttaaccccatgctcgggttcgtgttattttttattttttgttatatgtttaatcatttgaaatgtcactaaaatatcatcgattttaaatcttaccataacgtatcgaattcgaaaatattagtcgtaggggtctgattggttatctagcgatgttacatacgtttgatattaatggggttgcatatgttttgataagtttataatttgacgacatgctttgcaaaacttggatgtgatatattagttgtgatatcatcaaagttttgcacataacgtagtacatgtaatatataagaaataaatcgatgagatggatggaatattgaactcgacgaaaaagaaaaacaaagcctaagaaaatgacagcttccaagtacaaactatttgaaaagaaatttgtaaaatctcataaatatcaatagaatagagttacaatattttgaaacaaataattattcatctagagtccgtttagcgtagaggataaacggacgcacaattttcgacaatacatttatataaatataatcagtagcaaaatgataatagttaggcattagagtcactaggtagtctaggttcacaacatggacataccatgcgacgtaggtaatggccatacaagcacgaagcaagagctaccataaggacgcccgataccacgccgatgtattctgtcaaatgatacatgtccatcttcttgttcaccacaccaccaatctctaatctttcttaaccttttttttcgtgtactgattatatttatatacatgtatcgtcgacactaactttacatttttgtaaatatatcagcaacatttggtaagtttacattttttcattaagaacatactagagaaaattcgaaagtttacatttaggaaaaaatcgaaaatatattatgttcgaattctttctaaaatactccacaaactgatattatgatatttactaattactactactagtaaaaatatattttaagatatgtgtatttcattattcagcttgtttcagattttgatggtttacataaaaagaagagtcattggtatctaaaaggaataagatctacagagttatatatcaattaccaaatatgtggatgtgatatattctttatctcttttatatatacactaaatttctttttcttcaaaggaagcatccaaggacagataaataaacagacaatctacaaactttttcatatgtttttcttaagttttaaacgtaattattatgaatagtttggaatgatacagttttagtcactaaccaaaaaatatgattagtagctaaataaagtacatttatatgacatataaatacttaaaaaacgtacaaaaagattggtgccatttgtgtgacacagaaaatcccagcaaatgtcgagagagagagaaagtataaagaatgtgaccggcaaaaaagagataaaacagtagagaaccatattatttgccatttcttagaagaatccactgcatgatattcaaaatctcaccaacaaccattggcgaagaagaaaagaaaaagaagataactctgtagattttgaaagagatg

SEQ ID NO: 14834 - DNA, 3000 bp, Unknown
  misc_feature (1)..( 3000): cDNA_ID_3019230_gDNA_ID_2684228_Annot_ID_192140 3000 nt of promoter + ATG
tctctccttctccttctccgtcatcgatgacatgactaacaattcaccgtccgatggaaaaaaagatttataatcccaggaaagcaaaaaataaatattctgttcataacgacgtcgcttagtaaaaggcctcgtaatgtttgggccttatgatgggcctaaagggtataatagacaataagagattggttattcggttgttaccttttagttcgtcttctcagaggagaagtgttttttttctccggcgaggttggaaaaaaatggaggcagctttgggacttctccggagaatgccgccgaagcagtcggagacggctctatctgctcttctaagcctcattcctcaacattcttccgatcttctctctcaagtcgatctccctcttcaggtattttctatctttatcgagatttgaaaatgtgattttgttgccttagtcgtgcttatctcccaatgtttggtttggtgatgtaatgacaggtgttacgtgatattgaaagtgggaaagatttcatcttgtgtgagtataatagagatgcagattcctacaggtacttttttgctctatttcattgtgtagagagaaaattcaaaatattggatcgctttggtttgggatgatacagtacttcgtgttcatagctaaattgctatttgttggttcttgtaatctttacttttgcaggtcaccttggtcaaataagtatcttcctccgctagaggatgctctttacccatcttctgaattaagaaagcttgaagttgaagccaacgatatctttgcgatctatcgtgaccagtgaggttctttacctacctcgttcaacatgaaaaccatgtagtgaaagtaatttgagttatctaagacggagacatagttagcatctgatctgaaaaaaaggcttgcctagtcgtgagatttatctcatggtttaacaatatatgatatgtgtttcattcttctaatgtatccattagactggagactgaaaaaagcttgcaaagttaccaaaagaacacctgtgttgatcagttttcttttccaggtattatgaaggtggtatatcttcagtctacatgtgggaggatgataatgaaggctttgtggcatgtttccttatcaagaaaggtacattctttctgtagagttcaataacactgaatgttaggcaataaaaactctttacctgagctgttctggtttttatttttcgaagatgggtcaaagtcaggtcatggtcggaggggatgcctggaggaaggagcgtgggatgccatacatgttatacaggtgactctcttaacataccattaccaagcgtgccttatgtgttttaaaatgttgcccattttgtaacacataccaccctcaattgcaactttatcatagtttcctaagcagctctttaatgagacttcatattttgcttctaatgcctgaggttctcaactaggttggttcagaggaggaggaaatggcacaatattgcttaacaagtaccatcatgctttctctgacaactgatgatgagtcttcgggcaaattcggcttatctggatcaattagaagacaagtaagtattagcttctatttagcccatgccttcatagataaatagttcctggtatgaattgtgattcaatggaggaaaaccaaatatctgtaaaagaataacattattctgctactgttgaaattagatgaaaatggagctagcagtagctgacggacacctgtgcaatatggggagaatgattgaagaattggaaggcaaactgaggaactcacttgatcaggttctacctccaatccctgcaccaattccacaaactccgtctacttgtgtaaccgccatatatgctgaaaatggtttcttaattaccggcattcggattgcttagttagttaaagctcatgctacagttgttctgtggtgcttggcagaccccaaaataagtaaacgagaattgtaggataagttttagatcaaatcactttctaacatctcatgaattaatctagaccaagagaaaagaataacgtaatgtgcgtagcttcaagggtttgagaattgtttggtgaaaagcgcaggtttactttgggaagacaagagaaatggtttgcacattgcgtccaccagctgagattgtacaaatgagattgcctgacacctgacctgatgctcctccgatcacgctttatgtaagaaggtctcgatatttgtttgttttggttggtctgatcttaaacgcttctccgagtgttttgtgtggatgtctcttactcccatgtttttctctgacttcaccatcatgtgaccatcttttcccataaatataacgaatgatgcagttttaaaagtcgtataaatattatggaaatgcttggttttctccaaaagtatagaatagcagaatcagtggtggctgcgacatgttgtgaacttaggacctaaagcatcaaacctcatttagtgatatcgcactgccttcgacatgcataccgaatggacaaagaaagtaagaatccttgatgtaatcgccatatgagtccgtttagcgcctaggtgccatctagacggtcagtaactaataacaacctaatcaataactatacaaatatttttgtccaacatataaaaaaagatattaaaataaatttccttttaaccaaaatatcagtttcctttttcggctttcttttttttattcttgttgtagagagagatataaataaatatcgacgacgacggtactaatcgttttgctaaataatttcattcgtcttctcttcttaactctttaaaaccaaaaactgaaaaataaagacaaaaagtctcctatcgacgacgaatacgaaagatctctctcttcagaagaatttaacgaaactcaactgtttcgaattcgatttgaatctcgacccgttacttagcaggaagaagatgaagcagcgcttcaccttcttcttcgttatcttctcttaataatcccca

SEQ ID NO: 14835 - DNA, 3000 bp, Unknown
  misc_feature (1)..( 3000): cDNA_ID_3019210_gDNA_ID_2684228_Annot_ID_192145 3000 nt of promoter + ATG
tctaactttttcataatcataccaacaggttgtgagctccttgaattctcatacagattcagttgaatgtgtgaagttttcaccaagctccgcaaccatccctttggctgcaacaggtggaatggacaagaagcttataatctgggatctgcagcattccactcccaggttcatctgcgagcacgaggtataaacccttatagtttctctgagatagcatcaaaacagatattgaaactaaaacaactcctctcttcttcttttttcgattacaggaaggtgtgacatctctgacttggataggaacctccaagtacttagccactggctgtgccaatggtacagtgagcatttgggacagcttattaggcaactgcgtccatacctaccatggtcaccaagatgcggtccaggccatctcagtctctaccaacacggacttcattgtttcggtatctgtcgataacactgctagagtctttgagtcatctgagttccaaaacaaagtgacataggcaagtgaggagaatacttgcagatactatccagacatgttgctatctgtgttcgttgttgtggtcttaattctatgctttgtgggggaaaattttgacaagaaagttatcaatgtctaaaattccatatgtacacggcttaatttattgataaatgtagtctctgtttggaatttgtccttcattttacagttcttatggttcgaatgagattgataaatgttactccttacattgatatcgttaatgaatgagattcatgctaatgttccactagcaattgaactacttgatatcatgagtctgccaaatcgactggagaagtcagatttagggtctgagcatcaccatggaattataaccgaactctttataaaaactcttctcccttgagaagtaagaatgaaacgggcaagctatagagtgagattactacacaggagaagaaacgaatctgctgaaaatgcagccaccggtaaagttggattaagtctctaatacatccgactcctcttcttctcagtctttaaactgatcttgctccgcctcgattgtgccttatctcttgaacctgagtttccaaaactcctcctaccagatcttggacttgaatttctacgaccacgctccagatcctggttttgatccacttcatcatcgtcctcgtcatcatcaacaaagtctccttgacgatcatcctcgacatcagaaccagaaatgtcatcattctcagccttcgcatcagtatcacaaacttccccttccactttccccttatcttctttcttgctgctcgaagaaactgccttgttatctttcttaactgtattcatgagtttcatgtaacggttcctgcttgtcaccaattcattactctctatcaacatccccctcttgtaaccatctctaagaaccacagtgtgagtcctaagcttactagacaagtaaaagataccaggatgattatggagaactctcttaaacctcgatctcaatcccataaactcaccaagatgcaaaatagcatctttctcaaccttcttcgacacaaaaaggttcatgatctcgtgcaaaacagccgccgcccacttatcagactcatcgctagtcgcagacagatgaagtgcattctcataaggagaaatatacggcaacttctgccaatcatcaatccatttcttcatcttcttatcaaccacaaaaccattcgaaaacttcatcggaaaagcaatcgccgatcctttcgtatactctcctttacgtaatgttctagctttcttctccaacacagatacagcatgctcattgctccaacaaaccagctctagctcaccactacatcctcttaacttcgatttgataactctaaagtaatcaggaaactcaggtaccatagtttcaacataatccttaggtaaacctaaatcccatttcaacaaatctagaatctctaatggaattttgttaatcctattaatcatcagcaatttcaaaagcctatcagctaatccttgcttataagtctcactaccgtaaaccaattgctcatcggcatcgtggtttagaatctccggcgtgaggctgatgtgaggatgaataccaattcctccggggagaaactcttggaaaacggaagggaagctacgtatgaactcgattggacgaagaggaactcgtagtgaatctttctgtgaggtgataactgagatcggaactgattttgctggctccgatctgattaggtctttgatactgagaagtggtctgagattcttctctctttctaccgcgtggtcgagtcctctgtctcttacgaatttgtaggtatcttccaccgccgacgtatcggcgaaggttcggtggccggaatgacggcggatagaaatggaacggaaaatggatttcatcggcgatttgattttttagggtttaagagggttttggctcatcaatggtgtttcgaagacattgatgtggagctgtgtgtgtcactcgagactcggaagtgaagagtttttattattggttatgggcttttaagttgggcgttttaggcccactgtagttttttctgtgacgttgcccatctttttttttataatgatgagcccatctaaaatgttattctacaaaacaataaaagaaagaccaggattcctttgcttaaaagaccagggtcctttgctaaaactatattataatgaccaatgaaatcataattaataatgaccaattaaaatgatgacaaaaaaaaaaaaaacccaattaaaatagtaaatttatattatagtcatcaactttaatactttgttgcaaaataaaaggaaacagtcgcataataatccactaatcacaaacctttaccctttcttctcggggccaatcaaaaacttcaattaaccagaaaaggtcagattctccgccgcctcacacgacgggcaacttcagttcctgccgtcgcgttagatcccgccgtcaatcggtc

SEQ ID NO: 14836 - DNA, 3000 bp, Unknown
  misc_feature (1)..( 3000): cDNA_ID_3019218_gDNA_ID_2684228_Annot_ID_192143 3000 nt of promoter + ATG
ttaagatatggtcttctgtccaacttaattctcagtgagatcactaattttacttgatacgtgttcttgacttgttcctcctatggtaatgtaaataacctagctattttactttatagaatggtgcgagggacaggttaccgagtacctcgtggcaactttcggtgattatttcacagatgtgaaaatgtaagtttttctttcccccttttgtttaacaagagccaaaaatgctacaagtctattgaagatgtcgtggtgaatactggatgcaggtatgtcgaagaaagatcatttagaagatttgtcgaagcatgtttggaagaaacagtcgttgtctatgttgaccatctcctaactcaggttcccccatttattctcaagcatttttaccttttatatttcatcagcatacacaaacactgaacctttggggttgacgtgtgtaattccagaaaaactacatcaaggaagaaactattgaacggatgaggctagatgaagaggttctcatggatttctttagggagtatataagtgcatctgtaagttggtttcagcacttaactcatttttaacctgaataattttatatttctttgaagtattgcttaatatttccactggaactgtgttacagaaagtggagagcagaatcagaataatgagcgatctgagagaacttgcatctgcagagagtctagatgcatttacactcgtgtactcgaatattctagagcaccagcctgactgcccggtaaatattatctaaacaaagcctgctctggctttttacaatatcagtatacacagaatctctaatatatggtatgcaggccgaggtcgtagagaagcttgttagtctgcgtgaaggcataccacggaaggacacaaaagaggtaaacataccaaactctcttttttggaaaatgctgggttataattgtagcgaatcacatggatttttaaactatggttacgagacttcaaatggcgaagaattcttaaattgacgaaatggttatggtgatgaaaacaggtggtacaagagtgcaaagagatatatgagaacacactggtagatggtaatcctccaaagacaggatttgtattcccgagagtcaagtgcttaactgcttccaaaggatctatgtggcgaaaactcacttaatctgtaaaacagcgttcagcgtttgcgtccgtaactgcttttctagttgagatgatgttctttctccaaattatggcgtttgcgtccatgtcttctttttctttgcatggtatctttcctctgtaaattctgtgttttctcttgttttgttctttttcttacctttattcctggatttgaaagttgaaacgctcggtggccacttgcactaggatattatcccgttgtatttaggaggcgtatttttttgtcgcaaattttaattctactgtttcatttaattttgataaaatcttcttaaagttcgtttctctttcataacaaggtagctcttattgtttttagaattatttctgatttgtgaaattttgaatttgaagcatatttttatcatgaatataaaaaatgttggggattataaaaaagtttgtaaattcactcattggcagctgatttagccactcacaatatctaaataaataattgtaagcattatcttgaaatattttctgaaatgactgtttcttttttactttaattaaattttgttctagaaaccttttgatcataatgaaaataaagagtccatccaccacatggggtaagcataatgtgtgatatttaaagggtaacaaatgtaatctgctttttattttactttttacctctactcaaattgtatgggcagttttttttttttttttaaatgataagacaagtatctgtttaatggtattgtgatgaaacagtagtaaagtcatatcgggcacgccatactacttccacagtggaacttggccaaattttgtctttgccgtctctacagtttcttccaccaaattttttgttgacaaaactcaaatctttcaatctcatctctgccaaagttgggtttagaaagaatatcagcaaacactaatatctttattgttgcatggtttatcaatcacaaaattcacaaccattgtaaaaaaaaattcacatttttggtatgagattgctcacatgatagtgaacctctttaacattttaactttactttcataaatacgggattacgaatcttacttgcattaaaaatttagaaaaggtttttctacttaaagaaaaaagggacccaacagagagaggtttgaccaggagaaacgggtgcatagccttaagagctttcaactactttaccccaaacccaaagcgatgtcactttcaaccatctcttctctcccccgaacccgtttttttgaccggtcagttcgggcagcagcaccgttacgggcagcttatattcctcgtcttcctcctctacaccactgcatgcccataaataaagcccgttgagatctttaaaaatattaaataatatatcaacgaaaaagctattttattcataagaagaaaaagagaggaacaacaacaacacactaatcatagtttctctggcaggcttgttgttgcggcttaataaaaagctcttttgttattattacttcacgtagattttccccaaaaagctcttatttttttgtttaaaaaaaaaagtttcatctttattcaacttttgttttacagtgtgtgtgtgagagagagagtgtggtttgattgaggaaagacgacgacgagaacgccggagaattaggattttgattttattttttactctttgtttgttttaatgctaatgggtttttaaaagggttatcgaaaaaatgagtgagtttgtgttgaggttgtctctgtaaagtgttaatggtggtgattttcggaagttagggttttctcggatctgaagagatcaaatcaagattcgaaatttagcattgttgtttgaa

SEQ ID NO: 14837 - DNA, 3000 bp, Unknown
  misc_feature (1)..( 3000): cDNA_ID_3019222_gDNA_ID_2684228_Annot_ID_192142 3000 nt of promoter + ATG
taggatcagctttagaccatcaagaacatgctttcccacgtacctgtccaagggacgctgcagcaacaggctcaggagaaatctcagagaaaagctcatctataggaagaccaagttcatcctcaatcatattgaaagcaacttcggttgaaaacggagttatttgatcttgtagcagggagagttcatccaagtatataggaggtatcaaatcctagtttcgtgaataaagctagttcagaaaccataatcttcatagcaataacaatcacaaagctccagaaaataagaatcaaacatgttaagaaagacgcttacaggacgagatgaaacagcttgagcgattttgacgtacgcctaaaaacaaggtcaagacatgataagaacactagcattgagcaaattgatggactgatgatgaaatctcaaagaacacgtgagagataaccataccggacctagctccacaagcaatttcctaagctccgctgctcgtacctaatgataccaattcgtgaaatcgaaaacgaagcatgagaacacaaaatcatcattatcattgaagagcaaatcacgaaattggaaaaaagaccttgaacatttgatcagagcgttccaaagcctcatcagctaagcgaagcccaaaccaataactaaacgtagttccgatctgagctaatctacgaagcagaatcagaggtttcttcttatacatcccatcaatcctgggaaaattgtactccgacaaagaatcagcctcatcggcactgagactgaacaaataaccggatttactagtgaaactatctacatctctagacgcagcggagacaacaacggcggagtttcctcttcgcgacggccaagatggttgtggattaatcagcagattgggattggcgggaaaagaaacgattggcatagaagaaggaagccgaagcatctctttcaaaatctacagagttatcttctttttcttttcttcttcgccaatggttgttggtgagattttgaatatcatgcagtggattcttctaagaaatggcaaataatatggttctctactgttttatctcttttttgccggtcacattctttatactttctctctctctcgacatttgctgggattttctgtgtcacacaaatggcaccaatctttttgtacgttttttaagtatttatatgtcatataaatgtactttatttagctactaatcatattttttggttagtgactaaaactgtatcattccaaactattcataataattacgtttaaaacttaagaaaaacatatgaaaaagtttgtagattgtctgtttatttatctgtccttggatgcttcctttgaagaaaaagaaatttagtgtatatataaaagagataaagaatatatcacatccacatatttggtaattgatatataactctgtagatcttattccttttagataccaatgactcttctttttatgtaaaccatcaaaatctgaaacaagctgaataatgaaatacacatatcttaaaatatatttttactagtagtagtaattagtaaatatcataatatcagtttgtggagtattttagaaagaattcgaacataatatattttcgattttttcctaaatgtaaactttcgaattttctctagtatgttcttaatgaaaaaatgtaaacttaccaaatgttgctgatatatttacaaaaatgtaaagttagtgtcgacgatacatgtatataaatataatcagtacacgaaaaaaaaggttaagaaagattagagattggtggtgtggtgaacaagaagatggacatgtatcatttgacagaatacatcggcgtggtatcgggcgtccttatggtagctcttgcttcgtgcttgtatggccattacctacgtcgcatggtatgtccatgttgtgaacctagactacctagtgactctaatgcctaactattatcattttgctactgattatatttatataaatgtattgtcgaaaattgtgcgtccgtttatcctctacgctaaacggactctagatgaataattatttgtttcaaaatattgtaactctattctattgatatttatgagattttacaaatttcttttcaaatagtttgtacttggaagctgtcattttcttaggctttgtttttctttttcgtcgagttcaatattccatccatctcatcgatttatttcttatatattacatgtactacgttatgtgcaaaactttgatgatatcacaactaatatatcacatccaagttttgcaaagcatgtcgtcaaattataaacttatcaaaacatatgcaaccccattaatatcaaacgtatgtaacatcgctagataaccaatcagacccctacgactaatattttcgaattcgatacgttatggtaagatttaaaatcgatgatattttagtgacatttcaaatgattaaacatataacaaaaaataaaaaataacacgaacccgagcatggggttaagatttgcgttttgctcaacgaattagcgttagcgtttgcaaaaaaaaaaaaaaaaaaaataggtttgcatcaacagctggcaaaaaagaaaaagaaaaatcaaaaccggcgagacggaaaatttcagcgtttccgaactttccattagagtcgcgagacgatagatgagactcgttccagaaatttaatcgttgcttctcttcccagctgatctgcgtccaacatcactgtttccaggatcttcagaatcagcgaaggaagaagataagaggacgacgaagtaattgaagttggagaatcgcacatttggctctcgatatttgctcaatgacttcttattcggttgcgtccatttttcctctacgtttctgtttccagatctcttgattctcctctgcgttatcgtaattgtgctggaattttgaataactttgcagaggtagccttcaatttaggatcggagttcgtaaataaggtgatttagcgaag

SEQ ID NO: 14838 - DNA, 3000 bp, Unknown
  misc_feature (1)..( 3000): cDNA_ID_3019256_gDNA_ID_2684228_Annot_ID_192130 3000 nt of promoter + ATG
tcttatcttataaaatcttgtcaaatataaataatatatatgacgggatacaaatttgggtatcgaccattgcattttgcctataacattgtggattgtggtcaagaatcaaaattgatgtgatgccaaaggggaccaaacatgttttcttttccttatgatctctttatctctattctcttttattttgttttcttttgctctcttaattcatttttctttcgttactgatccatcctcgtgatatttttttcccttttaatacatctagttaaaaatatattctatctacttgtttatctatatattggctaaagggctagcataagcattcgatacttgatgatatattatgccatcttcatgctaacttccacaccaaaaaatagatgtttccgtaacaatgttttgttgtttggggttataagataattatagaataggatagggtactctcaaattggtgtaaaaaaaaaaggaaacaaaaaaagagagtagggtctcaaataaataaaaatactgaagtacaaaaacatcatccaagaatgtagtatggagcttcatgtgacttgcacccttatttttccaaatcttaggcgtgtgatgttttcaacgaattgaatctaaatctactcagttaaatacaatgcacttgttaggtcgtaataattatgacaaactaattaaaattttcacttactaactctatttttaaataaaatttgtattcaaagaaaatattatgcattttttttgctcttaacattatgttaaattaaagagaagtaaaaccatagattatagacaagaaacgactaaaaatatatattatcttgctagatgtaggattaacttttactttcatatatttaaaatataaaatccttatagacgtgatgtacatttgttgaattttcttatattaaattgtaaagtaaacaataaaaaggaaaacttaagtaaatttaattcgttgatttaactgatttggattttaggtgagaaatcgaagcaatgaaacaaataggttgggtacaacaacacatagatccaagtctagttaaaagtgggtggacccaatagagtccaaaactccttcgtaggcttcttccatggtccgtgtatttcgtggggtctcgcaccacagaccacaccacaccacaccgacccaaacaccttatccattaaccggactctaaccggacttctggaccggatctcttctcgaccaaatttgcggcggcacaacgtacttgcctctaattttttttcctcttttcggtagtccgaatataaacttgcttagtgacattttcctcgccctacgttcatcaaaatatctatcgcatgatgtaatccccatgatttactttttttttggtcaaagaaatgcccatgatttactgcatgggtaccttttcttttcttttttgttaaagagctatggttacttttatttttgtttttgttttatgaaaagattaacgaactatcaaacctttttttttctttctcttgtttcagttttcaaccccttttaggttatcgaagcccacttaacattgacttcttttggggtaaatttgataagttttctttttaaaaaattgaaaagagttttttcttaattgcatgataaagaaaagttttataaaacatttaattagtcacatactttcagtattttcccggtgctttggccgattccggcgctgtaacactctttccgattccccattttaatggtttggttttatatatcaattttttttttatatgtcttataaacccattgagatatgtactgatacaccgtagggttaggatactatatgtataatttaaagtatcatgtattacttgtgaattgtgattatattttaggaattttgtgttttcatgatttcttataaatatgtgatttagatttatattcttttatattttgtttttatttttttatttttttattttttttgacactgtcatatcctaattttattttattttatgttgaattacaaaacaaaaaggttttcgtattattcacgtttaaataatctggttgatagacgtaaaaaaaaaagatctggttgatatgttagtgcacctttctcgctcggttattattatatacccactatgcaaatgagccacgccacaatcacctgcgtggccagtggccaccacttctgattttcctttaacatgtccgattaactttttatttgttaattaaaacacctgaataatgtgaaacctacactatacaataataaaaagaacctctaaaatacattaacccagtttaatatctatagaagcagttgttgaatgttgagttggggtccaaaagttaaagtccaaaatggctgagaccactagtttatgttaaaaaggttcagataacttaaaagtaagatcccatcagagttgttataccaagtccaatatttcataattttttacacttctttactaatcttattatatatgtaatctcgttttagtggcctttgatgatcactcaccataacgtaacaaaactaatttgtgcggatattcctgaaagttatttttaatcataattaatcattgtagatattttcaaaaaatatctttaagcttccaaaaataagcctaaacattggtttgaaaatctagattattaaaatacaaaaattgaccatatcgtaagagaaaaaatcaatattgctttgctacgccattattaaaatagaaaaacaactattaaaaaaaaaaaagttttttcttacataaaatgatgaaaagaaagacgaggactgactcacgcgttgtttcggaactcttcaagtaaaattttggatttatggtctggcaaaattaaaaaatatccagatttataaaaaagcttcgtcactttcctctttgtataaaataaaataaattctctctttctggtctgaagaaaattacgattattttcttatgtctccagttgaacccgccggtataatg

SEQ ID NO: 14839 - DNA, 3000 bp, Unknown
  misc_feature (1)..( 3000): cDNA_ID_1533468_gDNA_ID_2684228_Annot_ID_192135 3000 nt of promoter + ATG
aattaaaatgttttgtttgtggtcataattaggttatgatgaattcacaaggtttaagcagaggttttggttttgttgcttactccaatcctgaagaagctttattagctgtaagtttcaactgaattgacaatctttttacatatacataaatgttttataaaattggtactaaaatgttcattggggttgatgattacgcagatgaaagaaatgaatgggaagatgataggaaggaaacctctttacgttgctttggcacaacgtaaggaagaaagacaggctcaccttcaggttctttttagccctctcactctttgaacatcaaactctgtactgtgttgtgttgtgacactgagttcttaaactgtcttgatgttttcacgtgtttcagagtctatttactcaaatcagatcacctggaacaatgtcaccagttccatcaccgatgtctgggttccatcatcacccaccaggtgggccaatgtcaggaccacaccatccaatgttcataggccataacggtcaaggtttggtaccttcacagcctatggggtatgggtaccaagttcagttcatgcctgggatgcgtccaggtgcaggcccgcctaacttcatgatgcctttccctcttcaaaggcaaactcagcctggccctcgtgttgggttcaggcgtggtgctaataacatgcagcagcagtttcagcaacaacaagtaaagtttttatcattagttcttatgtcttttagcaagtttattatctttaacacaatcatacgaatatgaatttgttggggcttgttattatcttggaactgtcagatgctgcagcaaaatgcaagcagattcatgggaggcgcaggcaacaggaggaatggaatggaagcatctgctccacaaggcatcatccctttgccattgaatgcatctgcaaactctcacaatgctccgcaacgctctcacaagccaactcccctcaccatttctaagctcgcatctgatttggctttggctagccccgacaaacacccacgggttagtgatctcctgtgttttcttctcttatctcatttagtacttgcattataacctatatttgttaacaatatcattgcattgtgaattgatgacagatgcttggggatcatctttacccacttgtggagcagcaggagccagcaaatgctgctaaagttaccgggatgttgctggagatggatcaagctgagattttgcaccttcttgagtcacctgaagctcttaaggctaaagtgtccgaggctctggatgttctcagacgctctgctgatccagcagctgtgtcatctgttgatgaccagtttgctctatcctcatccgagtgaacatactgtttactcaagactatgtttctctcgctttcttagacagttgctttaataccttttaggacctttaaaactagctttttcttttctacatctctttgatagattgttttgagtttttcccttagcattgagacttttactctttagcactttctctagtttcgttaggagtctatttaatgtgtcaactcttttgcaactccaaattcgtttcagaaactttacatttagcattttatctaataatcggcattctggttaaacattctgatcacatgaaatctggatgtacctcgtcgtctactatctgatattccgtatttatctccattactgctctgtcccatcctcctacttcgtcatccttcaaggcctttttaacaccaaatcgcggtggtgcttggtgttctccttcgtcatcgattaagtaggcgtcccatttcgaagctggcttagtaactctttctgactctagattcctctcttccatatccttcttcctcgtcactacttcatctgcaacacatttgaaggataggagaatattgttttagtaaaaccattcaggcctttaataaacaacattcgcaacggctttacttgaactaaacgctgatatatggccaacatatgtagcagaactcctcttaccggatcgaaaatccggctttttgatgctgcgtctggagaaagaaggcttgaagatctcattactgtctttattctcacctcctgtatttgatgatgatccaccagcattagactctttgttcagctttggccttttgaacatattgcttggcatctcagtgacaatcttcacatctgcaacaaaatcgcaaaaccaagtacatatttatctattttgtctcataagatgcttgattctcgaattagactcaccgtcttcttctccagctaatctccggcgatcatttactgaatcgaaatcgaggtattgactccaatcagatcgcttcttcgttccattaacctcctcattaacctctccttcaacataaacctctggaaacgaatctccaacagcatgtgcctcttcatcggcaactttgcgagacatattaaacgattggacaaagaaacgaagctccttagccttataaccttgagcaaacacctttttcactgattgcttctgattgcatatcacacaaacccacttgttactacttttcttcttctgcttcacctgcgaattcgaaccccaaaacaaaatccctaaaaactaaccaatatataaattgacagagatagaagaggagggagcgagagagtttaatacctgcatagttgaacactcgtaacattggagagcgatgaagagagtactcgccattttttctccttctccttcttcgtcttcgtcgtctgctctctagggatttcgattttgtgttttcgatttcgttctagcgccaatttgatatacttcaaaaaatttggcaattccaaattattttgtaccgggtctgtttaacagaagacggtaaatagtttcggttagtttcggttaagctcccgcgtttttttacaatagcaattagaatcaaaccctaaaaacccaaatcaaaaagcttcgttgtggaggtaagtaggaggaagacgatg

SEQ ID NO: 14840 - DNA, 3000 bp, Unknown
  misc_feature (1)..( 3000): cDNA_ID_1023335_gDNA_ID_2684228_Annot_ID_192138 3000 nt of promoter + ATG
gcagcgtcgttgggatgatgatgaagccattggggattattaagagaagataacgaagaagaaggtgaagcgctgcttcatcttcttcctgctaagtaacgggtcgagattcaaatcgaattcgaaacagttgagtttcgttaaattcttctgaagagagagatctttcgtattcgtcgtcgataggagactttttgtctttatttttcagtttttggttttaaagagttaagaagagaagacgaatgaaattatttagcaaaacgattagtaccgtcgtcgtcgatatttatttatatctctctctacaacaagaataaaaaaaagaaagccgaaaaaggaaactgatattttggttaaaaggaaatttattttaatatctttttttatatgttggacaaaaatatttgtatagttattgattaggttgttattagttactgaccgtctagatggcacctaggcgctaaacggactcatatggcgattacatcaaggattcttactttctttgtccattcggtatgcatgtcgaaggcagtgcgatatcactaaatgaggtttgatgctttaggtcctaagttcacaacatgtcgcagccaccactgattctgctattctatacttttggagaaaaccaagcatttccataatatttatacgacttttaaaactgcatcattcgttatatttatgggaaaagatggtcacatgatggtgaagtcagagaaaaacatgggagtaagagacatccacacaaaacactcggagaagcgtttaagatcagaccaaccaaaacaaacaaatatcgagaccttcttacataaagcgtgatcggaggagcatcaggtcaggtgtcaggcaatctcatttgtacaatctcagctggtggacgcaatgtgcaaaccatttctcttgtcttcccaaagtaaacctgcgcttttcaccaaacaattctcaaacccttgaagctacgcacattacgttattcttttctcttggtctagattaattcatgagatgttagaaagtgatttgatctaaaacttatcctacaattctcgtttacttattttggggtctgccaagcaccacagaacaactgtagcatgagctttaactaactaagcaatccgaatgccggtaattaagaaaccattttcagcatatatggcggttacacaagtagacggagtttgtggaattggtgcagggattggaggtagaacctgatcaagtgagttcctcagtttgccttccaattcttcaatcattctccccatattgcacaggtgtccgtcagctactgctagctccattttcatctaatttcaacagtagcagaataatgttattcttttacagatatttggttttcctccattgaatcacaattcataccaggaactatttatctatgaaggcatgggctaaatagaagctaatacttacttgtcttctaattgatccagataagccgaatttgcccgaagactcatcatcagttgtcagagaaagcatgatggtacttgttaagcaatattgtgccatttcctcctcctctgaaccaacctagttgagaacctcaggcattagaagcaaaatatgaagtctcattaaagagctgcttaggaaactatgataaagttgcaattgagggtggtatgtgttacaaaatgggcaacattttaaaacacataaggcacgcttggtaatggtatgttaagagagtcacctgtataacatgtatggcatcccacgctccttcctccaggcatcccctccgaccatgacctgactttgacccatcttcgaaaaataaaaaccagaacagctcaggtaaagagtttttattgcctaacattcagtgttattgaactctacagaaagaatgtacctttcttgataaggaaacatgccacaaagccttcattatcatcctcccacatgtagactgaagatataccaccttcataatacctggaaaagaaaactgatcaacacaggtgttcttttggtaactttgcaagcttttttcagtctccagtctaatggatacattagaagaatgaaacacatatcatatattgttaaaccatgagataaatctcacgactaggcaagcctttttttcagatcagatgctaactatgtctccgtcttagataactcaaattactttcactacatggttttcatgttgaacgaggtaggtaaagaacctcactggtcacgatagatcgcaaagatatcgttggcttcaacttcaagctttcttaattcagaagatgggtaaagagcatcctctagcggaggaagatacttatttgaccaaggtgacctgcaaaagtaaagattacaagaaccaacaaatagcaatttagctatgaacacgaagtactgtatcatcccaaaccaaagcgatccaatattttgaattttctctctacacaatgaaatagagcaaaaaagtacctgtaggaatctgcatctctattatactcacacaagatgaaatctttcccactttcaatatcacgtaacacctgtcattacatcaccaaaccaaacattgggagataagcacgactaaggcaacaaaatcacattttcaaatctcgataaagatagaaaatacctgaagagggagatcgacttgagagagaagatcggaagaatgttgaggaatgaggcttagaagagcagatagagccgtctccgactgcttcggcggcattctccggagaagtcccaaagctgcctccatttttttccaacctcgccggagaaaaaaaacacttctcctctgagaagacgaactaaaaggtaacaaccgaataaccaatctcttattgtctattataccctttaggcccatcataaggcccaaacattacgaggccttttactaagcgacgtcgttatgaacagaatatttattttttgctttcctgggattataaatctttttttccatcggacggtgaattgttagtcatg

SEQ ID NO: 14841 - DNA, 3000 bp, Unknown
  misc_feature (1)..( 3000): cDNA_ID_3019234_gDNA_ID_2684228_Annot_ID_192139 3000 nt of promoter + ATG
ttatatgatatataaccatccaaatacaacaatcattaaaacaaataaagaaaactgaacacaattttgacgaagaagtagaagggatcatgcgttctaaacggaagccgcaaccgaatgaatctgttaagtctgctcttcatatactcgcaaaaaactacgactaacgtcttatagatgagatctagtgccacatagatatttatgttttttcttaacatcttattactctactttttttttttttttttccgtctacttctccttcttaattattttgttgttatcgtcatgtctgttttttttgttaaaagaggctttattggttcataatttacacgaaattttgatgactttaataatatcatagaaagtaaataaatgaaagattataaactattgctagagagttttttataatcttgttgatttgtttttcacaatctcgtaaaaaaatttaaacaatctctcgattttgatgatactttcatgattttattttgtgaagaaaaatgtaaaaaatcataaaccattaacagaataatttaattcattaacaatcatagattattttgttttaattgaataacgcaaaatatttaataattttataaaaatataaatcaaataacttcagatttatgaagattttatattactttttacaaattctaaactaataacatctacaatagtttagaatctttcatttattcactttcaataatattattaaaatcatcaaaattcttagtaaattaggaattccagatagtgtcaagcaggatgttatcagcaacgtcaacgcagccgcgataaactcaattttatacattaaatcaatatcaacatatttccatagaattgtttaaaacatgagacagatttttggtatgccacaaggctaatctatagaattcatggacaatattttgtggatgagacaattttgatctttaaaaaattccatcatcaataaatacaacagttgaaatctattgaacagagattgctaagtactcgtgattaatagagtaaaatgtcagactctagtcgactaaatattttctaccaccaaaaagtaagttcgatatgggtgatgttgtcattcattttagatatttctgaaacactatctgacatatgtacgaaactgagcatgtcatgcgttacaagactaaattttcatattatcagggaggaatgtagagattaaatatggacaggcttgttgccaaactattgggttttagaaaataagtatcagtttccatcaaaatggcaaaaaccaaatcgcattacacatggaaatgcataaaactataaacttcaacaaaatgcaaatgaagaaaatgattgctctctcttagttctgaaagcaagcaatttggcgcctcaaggcgtatcaaagacgaagagtcttgccaaggaagggaacttgttgggttaaggcaagagaacctctatatatatggtcgatgaaagactacaaatttcgaccacattttaagcgagacgagtgttagggtctgcgaaactaccagccatacttcttgaagaagtccctggttctctttctagctcgagtgaaaactataactatgcatgcgagcacccatggaggaaaggtcccaatggagatgttgttcttgatccaagctggagggtctttcaatagaaatgttattaagagcgtaacaatcacaactccgagaatgattctggtgatgggtttgagcagggaatcctgaaaacaaaaggtgttcaaattaatagtgttatcagatgaatcacccaattaaagctgcatgttttaatgctttttttttctgttcttgcaacaatattatccaaagactttttacgccccaacgaagtcagaataccatgacatccattctagtttctacatgcgtattctaaatctatgagccataggagtgattccaagaaattgtttactttaagtaagaatacaagctttgacctaaacctaaggttccatgagacaccgaatccacgttaattgatattccagggcaattgaagagtaaagaagcctagaaagtctagagacatgtatgaggtttatgagcacaatcaaaagaaaaccatcaacttatctaaatgcagaacgccaatgtagagtaattctacaatccaagggtatgaagaacatgtaaaggagacaagaagcagattgggtcctatcctattccttaatcatgcgttcagagaaggtccaacagatgcaatgcaacaatattcaccgtgagtttattcattcaagcatcagtagggaactataactaagctaaggagatcgttctctgtccttttttcctattgcgtaagtgaaaactcaaaatcaaaacaatcagattacctgaggttcaccgtcgatgtaaatgacggcaccatccctataaggcaacacagaccgaccattcctagggtgaaatctgatcggaacagcacgacctttctcaacgttgaaagcgaagattgctttcaagccatatttctcaagaatagatcgaacctcgagctgatcctgctcataaccgccgagatttgacttgaacacatcgatcggaccttttccacacttatacagatgaatctccacctcaggaaccttcgccgccgcggtcgtcgatctcaattcactttccggttgagaattttcgagcaacggagtagtctcttcaatctcttgatgtggtggtggtggatctctctccttctccttctccgtcatcgatgacatgactaacaattcaccgtccgatggaaaaaaagatttataatcccaggaaagcaaaaaataaatattctgttcataacgacgtcgcttagtaaaaggcctcgtaatgtttgggccttatgatgggcctaaagggtataatagacaataagagattggttattcggttgttaccttttagttcgtcttctcagaggagaagtgttttttttctccggcgaggttggaaaaaa

SEQ ID NO: 14842 - DNA, 3000 bp, Unknown
  misc_feature (1)..( 3000): cDNA_ID_3019400_gDNA_ID_2684229_Annot_ID_192161 3000 nt of promoter + ATG
tgttgatatcatcagaacgatatcatatttaccaacttttccacaatagttgtgacggtcttgtttgcctctttgattaccaaaccttaaacaacattgtttataatcccgccactcgatggcatcgacgtttccctgtttccaggttgcaacaaatctgtcttgagcagccaagttattttagtcacgttaaatttggatttggcaaagacaaaatcagtggcatatacaaaccggtttggttatgtataactcttccgaacttggcctagaaaacgctactacatgtgaagtttttgattttagcaccaacacttggaggtatatcaatccttcttctccttatcggattaatacttcctcgtctcgggggcatgctctgtatgtagatggatcgctttattggttaaccgggaagaaagaaattaaagttttagcgttagatctccacaccgaaacttttcaagttatctctaaagctccttttgcggaagcagatcatagaaacattatcacacgcagcctgaataaccgtttgtgcttatcggttagtaaacctctccaacaaatgataatatggtcgttcaattcagagaacaagacctgggaacaaatatattcgatagtgaatcgtagtgttacgcaatcattaccagtagccattttggagaagaataagcttttgtgttgtcctagatcaaatagtagacagctgatgatatatgatatcaaaaccaaatctgttgattcagtttccataggcacctatcgttgcggagatagtgttttttgttatttcgagagtttaatctctatattgtaactttcaccattttcttctttttgtttgcttctcgtggatccatctatttgatttaaattttagattcttgttgtccaagtttgcagctttttcattattaattaaatttttaaagagacagattacagtgttgattgagtaagtgtgtacagggtctgaaaaatattgcagaacaaaatctttgaagcttagagttctgaaaccaagatccgcttttgtatgtccgaaaatgtctgcacatcttctccccacaacctaaattttcaaagaaaacagataaacaaaaagcactatgtgttatgatggatgagaatttaaaaacctcggaaaaaacaagatgaaaagtatatttggcgcaccaacaagcaataccgatggcgtttgctccgcctttatcagctccttcatcatctccgacatgcactgctctgtttacatctacgctgatttgttctgcgcttgacacaaaatgttaacgttaatttgttctccgcttgacacaaaatgttaactctgaaacctttcttataatttaaacgaaacaacacttcagtttagaatgcaatatgccaatacctaacgcagatttgaagattcgttcatcaggcttctcgtatccgacttctgcggatacaatcacagcatcgaacctgcaagagatgcaagcattataaacgattaccattcatggtgttaactttggtactcagacttctggtttatataacaaaacatgacaaagcttacatatctatgacattaagatccttcaatagctttcttagcctggtatcgaaattagacacaacagccatcttaactgcaatcatctaacaccaattttacaaatccgccataaagaatacaaaaagttatctaagttaacaaggagagagtaataataacctccagcatctttcagtagtgacattgtctcataagctccttctgggagatgccatgcctcgccattcgcataatacttaagagataaaacaatgtgatggattgttaatggaaccgaaagactagtcaaaagcctcaaagaaagagtctttcactcgatactcacttggtagacgtcttcgaagtagtcattatcagaacaaccagtagcttccgaaacaacaagcttccagaatggtcttccatctccctaacaatgaaagaatgttctcttttaatacgtttgcttacagtaacgagcaaagatagaatctattacaaagagagattcacacatgcatttagggacctggtaacgtaacttctcaggccaaggggcagaaaaaactctcttgaaaccttccttgatctcagctggagttgtcttgagacctgaactagaaacaaatgccaacatgagaacatctgaaattggttttggaacagatcaaagacaaagagtgtaagaaagtgaccatatttttggcccaaggaagcgtaggtttcatgaacaggtttcgacaattgcaaaagagttcctccagcatcaagcaacaatccatcataagctctcttgattggcttgccttcacaatgaccaaataattgaagtaaaaaaaaaggtcagattttgacagacatacaataagaaccctaatttacagaatacccaattccaaaatcaaaatgcaactcacagactctaattcaattttggtcattttaattgagaaacagagaaggattagaaagtagaaactaaccggtgctaaaagagacagaagaagaaggccggagagagctggagagtggtctcatggcttcaattagatagcttcctcgtgaacatctcaaacaagcttccatctttgtcaaatccgaaaatgtcaagatttcttccacggacaaatttttgtctcaaagatgaaactggttttattttaggtaaaattttaaaacaatcctcaaactaactaaaattttgacaaaataacccaaaacgtattactattaattggaaggtgattatgaaaactttgattagtctgtgggttgttttgcaatattactgaatttggggtttttttaaaccttctgaacaatttagagtgtttagtttagttgtacaacaaaaaccctgaggatttttcgtgttcgccggcggtgacatttacgcgcagaaacgttgatactctctctctctcgacggaaaattcttcctcggagatatg

SEQ ID NO: 14843 - DNA, 3000 bp, Unknown; identical to SEQ ID NO: 9418
  misc_feature (1)..( 3000): cDNA_ID_2182365_gDNA_ID_2684229_Annot_ID_192190 3000 nt of promoter + ATG

SEQ ID NO: 14844 - DNA, 3000 bp, Unknown; identical to SEQ ID NO: 9416
  misc_feature (1)..( 3000): cDNA_ID_2105933_gDNA_ID_2684229_Annot_ID_192186 3000 nt of promoter + ATG

SEQ ID NO: 14845 - DNA, 3000 bp, Unknown; identical to SEQ ID NO: 9408
  misc_feature (1)..( 3000): cDNA_ID_1012357_gDNA_ID_2684229_Annot_ID_192185 3000 nt of promoter + ATG

SEQ ID NO: 14846 - DNA, 3000 bp, Unknown
  misc_feature (1)..( 3000): cDNA_ID_3019345_gDNA_ID_2684229_Annot_ID_192182 3000 nt of promoter + ATG
ttaaaagagttttgcttttgcttttttttcctctttatgatcgtgttaatatatagtacacacaaatatgtgtatttacatgcatatgaacaaagctcttgggtccttatagttttgtgttcttttaatcatgcattataataattcatacatgcaaaaacaaactaacggtgaatatgcacatgcccactattttgtatgttttcgaagttttctttctggctctcaaattgattcattagtcttgtaagcaaacgttgtctccatgttattttggataatataacatgtagtcatgtagagaatacccaaggaggaatcaaagtcaagcgacagattaataatatcatagatggtcctgttcttttttgtaattagaaggaaagagtatgtacatatcctatgaaaatatcatgattaactattagtgatactttattaattcaataattaatactacctttttcttaatgattaaccaattgattaatgtgcttaatgttgttgttacattaaccaatcgtcctacatttaatgggcctaatactaaataatgggccttaacgagcttatcatgttcagttataaactcaaatattttttaaaaaaatcttcttccacttgaatacgaaacacggaaacactaacgaggaagagaacgtgaagctatatatatatgtctcgagagctcactgtatctcttgccgccatagcttcacaagctctaacatttcctcaattaaaccaaatccatgctcagctcattgtattcaattctcttcctcgacaaagctactgggcttcgcgtataatcagctgctgcacgcgcctccgtgcgccgtcttactacacgcggctcattttcgattcagtgacattccctaatgtcttcgttgtcaattccatgtttaaatacttctcgaagatggatatggcgaatgatgttcttcgtctgtatgaacaaagatctcgttgtgggattatgcctgacgctttttctttccctgttgtgatcaaatcggctgggagattcgggattttgtttcaggcccttgttgagaagttgggattttttaaggacccttatgtgaggaatgtgataatggatatgtatgtgaagcatgagtcagtggagagtgcacgcaaagtgttcgatcaaatttctcagagaaagggttctgactggaatgtgatgatttctgggtattggaaatggggaaacaaggaggaagcttgtaagttgttcgatatgatgccagagaatgatgtggtttcttggacggtgatgattactggttttgcaaaggttaaggatttggaaaatgcgaggaagtattttgatcggatgccggagaagagtgttgtttcttggaacgctatgctttcaggttatgctcaaaatggttttacagaggatgctctgagattgtttaacgatatgttgagacttggagttaggccaaatgagaccacatgggtcattgttatttccgcatgttctttccgtgctgatccttccctcactcgttcactagtaaaactgattgatgagaagagagtccgtttgaattgctttgtgaagacagcattgcttgatatgcatgctaagtgcagagatattcaatctgctagaagaattttcaacgagttaggtacgcagaggaatcttgtgacttggaatgctatgatatctggatacactagaatcggggatatgagttcggctaggcagctttttgatacaatgcctaagcgaaatgttgtttcttggaattctctgatagctgggtatgctcacaacgggcaagctgcactagccattgagtttttcgaagatatgattgattatggagattccaaaccggatgaagtaacaatgattagtgttctctcggcttgtggacacatggctgatctagaattgggtgattgcattgtagattacattcgtaagaaccaaatcaagcttaatgattcaggatacaggtctttgatcttcatgtatgctaggggtggaaacctgtgggaagcaaaacgggtgtttgacgaaatgaaggaaagagatgttgtctcttataacactttattcacagcttttgcagctaacggagacggggttgaaacgctgaatttactctcaaagatgaaagacgaaggtattgagcctgaccgtgtgacttacactagtgtcttgacggcttgtaaccgtgcaggattactcaaagaaggccagagaatattcaaatcaataagaaatccactggcggatcattatgcttgtatggatttgttgcgctgagttgataagcaaatagattaatcagccaaaggtagaatgtacagtccctaagaaattgccaatggatgcacgctcctcaatgccagtcttacatcaggtgagcataatctgtatttgaattgatttaatataaagttcaaaaaaatttccttacaacctaggaaaaggatagaacccaaaattaaaactaatactaaagtcccactcttgtcaatgtaataatatggtcgtctggttagaccccactttttgcctttttttgtttctttagttgcttcttctcccatttaacattccgtgtgaataggatatccttaaagtggtttctatgtgatttcttgggtcttttctttgttatttcttacatgtgagtgcttccctaaagttcacttttgttttgtctaccattctgtgtgggttcacttatttactggtttttgcttcgaagcttcctcctgaaactcccaagcttgccactttattttgtttaagaatgtgtatataatctgaattgtgggttagggcaacgaaaccacagtagaaaaccaacatctgcagaaaggaaactatctcctgaaaagaaaaacaaacttctttgttcctgtttatattgttctctttctcaattatatcagttttgcggagtttctattatataactgtgtcttgatcactgagtttctgcctaaatttttttttct

SEQ ID NO: 14847 - DNA, 3000 bp, Unknown
  misc_feature (1)..( 3000): cDNA_ID_3019355_gDNA_ID_2684229_Annot_ID_192179 3000 nt of promoter + ATG
actgtacattctacctttggctgattaatctatttgcttatcaactcagcgcaacaaatccatacaagcataatgatccgccagtggatttcttattgatttgaatattctctggccttctttgagtaatcctgcacggttacaagccgtcaagacactagtgtaagtcacacggtcaggctcaataccttcgtctttcatctttgagagtaaattcagcgtttcaaccccgtctccgttagctgcaaaagctgtgaataaagtgttataagagacaacatctctttccttcatttcgtcaaacacccgttttgcttcccacaggtttccacccctagcatacatgaagatcaaagacctgtatcctgaatcattaagcttgatttggttcttacgaatgtaatctacaatgcaatcacccaattctagatcagccatgtgtccacaagccgagagaacactaatcattgttacttcatccggtttggaatctccataatcaatcatatcttcgaaaaactcaatggctagtgcagcttgcccgttgtgagcatacccagctatcagagaattccaagaaacaacatttcgcttaggcattgtatcaaaaagctgcctagccgaactcatatccccgattctagtgtatccagatatcatagcattccaagtcacaagattcctctgcgtacctaactcgttgaaaattcttctagcagattgaatatctctgcacttagcatgcatatcaagcaatgctgtcttcacaaagcaattcaaacggactctcttctcatcaatcagttttactagtgaacgagtgagggaaggatcagcacggaaagaacatgcggaaataacaatgacccatgtggtctcatttggcctaactccaagtctcaacatatcgttaaacaatctcagagcatcctctgtaaaaccattttgagcataacctgaaagcatagcgttccaagaaacaacactcttctccggcatccgatcaaaatacttcctcgcattttccaaatccttaacctttgcaaaaccagtaatcatcaccgtccaagaaaccacatcattctctggcatcatatcgaacaacttacaagcttcctccttgtttccccatttccaatacccagaaatcatcacattccagtcagaaccctttctctgagaaatttgatcgaacactttgcgtgcactctccactgactcatgcttcacatacatatccattatcacattcctcacataagggtccttaaaaaatcccaacttctcaacaagggcctgaaacaaaatcccgaatctcccagccgatttgatcacaacagggaaagaaaaagcgtcaggcataatcccacaacgagatctttgttcatacagacgaagaacatcattcgccatatccatcttcgagaagtatttaaacatggaattgacaacgaagacattagggaatgtcactgaatcgaaaatgagccgcgtgtagtaagacggcgcacggaggcgcgtgcagcagctgattatacgcgaagcccagtagctttgtcgaggaagagaattgaatacaatgagctgagcatggatttggtttaattgaggaaatgttagagcttgtgaagctatggcggcaagagatacagtgagctctcgagacatatatatatagcttcacgttctcttcctcgttagtgtttccgtgtttcgtattcaagtggaagaagatttttttaaaaaatatttgagtttataactgaacatgataagctcgttaaggcccattatttagtattaggcccattaaatgtaggacgattggttaatgtaacaacaacattaagcacattaatcaattggttaatcattaagaaaaaggtagtattaattattgaattaataaagtatcactaatagttaatcatgatattttcataggatatgtacatactctttccttctaattacaaaaaagaacaggaccatctatgatattattaatctgtcgcttgactttgattcctccttgggtattctctacatgactacatgttatattatccaaaataacatggagacaacgtttgcttacaagactaatgaatcaatttgagagccagaaagaaaacttcgaaaacatacaaaatagtgggcatgtgcatattcaccgttagtttgtttttgcatgtatgaattattataatgcatgattaaaagaacacaaaactataaggacccaagagctttgttcatatgcatgtaaatacacatatttgtgtgtactatatattaacacgatcataaagaggaaaaaaaagcaaaagcaaaactcttttaataatgtaagaaaatataagtattctaagaaaaacaatggcagtaaaataggcatgtgatgtttaattcgtttttgttggacgacatttcaaacggaccaaacaataaaacagatcagacgtgagatctaaagactgaagacatttgtcacagaaaagataatactcctatatctatattttgttatgaatgcaactaaaagaaaaaattatttgttctccaatttattttgggcaacaaaaagaaaaaagacagtgaagactgaagaggcgtgagaagagtgaagacttgttttagatctgacacagagagaccagaagaaggagaatcccgagcgtcaccgctccttccgacccatttttcactttttcacatttcttttcgtgtctttttttaattattttattcattcttttatttttgtttgataaaaagcaaatcaatcagccaatcaccgtgaattttttgaatttcttcagtaatctctttcttcatctctcccactctcatcctttcgctctcacatcttctgtttcttcttaaaaagattcttggtatcacctgcgcaatttccggtgtgactatactaaatagttcggagaagattagtctaaaactatgtaagatttgttttctggagagaaagaaagaaaaatg

SEQ ID NO: 14848 - DNA, 3000 bp, Unknown
  misc_feature (1)..( 3000): cDNA_ID_3019359_gDNA_ID_2684229_Annot_ID_192176 3000 nt of promoter + ATG
gctttctggaataaatccatatctactggatttgttctctgttatttcccaagtttggtctctattcagtaatttgattattgtcaatgcatattgtaatatttgcttcttccatcaacagtttgttggtcaaattttgcaactcttcaagatattgttttggtccatatagctaataacattcgagacaagataagagagctaattgatgaaagtattacgaggagattgtataattagtataaagatctaaggtattttgattttctcatttttccgtagaaaaaggaacctggatcctattaagaataataatccgaaaactgcgcattatatatgcagtcttagttacaaaacaccattcatagaaaaacattctctttcgttttctctcctctctctccatattgtttttcttgaacaacaagcaaaaacagggcaaaagctttggctgtttgttggaagggggcaaaatggttatgtaatcagcaagcttcaccaagtttgcagccaagtactcctgcatccatggtaagtttccggaccatcgttcccggtttaggtcgaattgtaaacttgtttgggagcggggttttcggtttagagctccacgcatttgcttttccggattgcacaaaataagctccgttgagaaagtaatctccttctgattgccaattccaagatttccattcaccgtatggtgtgtactctctttttgtaatctgtttggcttcttcattaggaggagcaatgaaacgattgccttgactaataattgtagggttcatgttcccaccaattgcatacatttcccaatgtgtgtagtcattgttcaccacatgtatcgttccgtatctgcaacgaggcattctctgttccaatcgcttaccgaagtggttaaacgcaaccgttatctgcattttcttgtcgatcacgtgttcgtccctcgccccaaacaacatcacctgttctctcacaaaatttaaaacaagactctaaattagaggtcttgattgtttcatatgcaacttcacatgagcgaaaacaaaggaatctttttacctcttggtggtcggtgaaatgactgttggaaatagttacagcagtggagccgtcaatagcatcgatcataccatctgcacatcttgtcattgagacatggtcgatccaaatattggttgctccaaacaaactgattccatcaccatcactttttgtcctaagccctatgtgagcctcagagtctctgatcaacccaccgttcccaggaacaatgtgcttgacataaatattgtgaatgatcacattattcacaaattgcaacgttaatccagcaccttccatgatgtaaaccctagctcctcttccatcgattgttttgtcgctcgttatcatcagttcttgttgcagttttatgatcatgcttcttgcgaatatgatccaaagcggtccgtctcgagtcactgcatgccttaacgttcctggtttagggttgataagatcgttgtcagacgcgtctttgacgacgtatatcggtccgtcttttcctccggtggttctccggccgaatccgagcacacagtcggctagtttcttccggttattagcccagttacgatcgcatcgccagcagttgtctatcgggttataagctaggcattttccgctgcttttgtgcgttttacgaccacttctcacctgagtaagctctctccttgtatcgttccttgattccgatgcatccactgctctgttaaaaaaaataaaaagtgtttaattagtacttgtttaggaagttaggttaaacatttgacctaacaaagacaaaaactcacatattgacatggtaattaaaatggttggtgacgttaagtggatgaggatcgtaagagccgatggtttgtttcaatgcatcactttgtcgttgcgtccagtagctatcaaagacagcaacattgcctcgaacctgtggggccactatagctaagaacgaagagaagaaaacgaaaacatagccgccaagattcaagaaagctgctgccattttaaatatattgcaaatgcagagaccaaagcctgtgaactttatattttcccggcaaaacctcaaacggaggttgttgtttcagataggcctgccgggattaaaagattaaagatttgaatcacctgattgctttaataaccaggaactggggagagagaaaaggagatgagaagagtcaatagaggattgagaattaacatagattagacaaccattgatttaaatctctatggtcatttctccaaaaaacccaattatagattttggatgcctttgtttaatccttcttttctggatattttcagttatttttgccttgatctaatattatttttactgagataattacccaatagcacctttaaaacttgaggtaactatttttgtatttacttaattaatcatacatactacatatgattattaaacgtagtatatatcaagtctctaggtctattgaaaataattatcatacaagtaattaaaaaaattccccatggggtcagaagctaattaatggcgggactctctgttcccccaaaagaatttgaagacatgactataaaaaaaaaagaatgaaacaattttattttggactcctgatctgtgaaagactgaaacagttcatacgcaaactgatataaaatccaaaatgttatctctaagaatatggtccgtgatcaataatacagatctaaaattcaccaacttatatgcaaattgcaaaatgcaataaataaatcttgaccatatgttacaaatctaccagatcattatgtacagagagcactgcgagtcttgatcacacatttcaccagaaaagtaaaacaatacaacaccataaatgtttcttctcctaccgatttcaagaaagacactaataattactcaaagaagctttaaatgttaaatctctttcaccggagaaagaagattcttagctgaaaata

SEQ ID NO: 14849 - DNA, 3000 bp, Unknown
  misc_feature (1)..( 3000): cDNA_ID_2991381_gDNA_ID_2684229_Annot_ID_192175 3000 nt of promoter + ATG
ccattgatgatgtctttgccgaatccaagcaaaggcaaaggaaagacactactatattcactagaagatttgtcgagaatgacttgtttatacctaggtggaggaaaacttcgatgccatctagtggctggattgactacaatacccgatttataaagattgtagaagcatatcaaaccatcacaactactaggacaaacaaaatcaaatatcttctcccgaggagtaggggtcttaaccgaaatttcctttttttttattaactaactttcaccaattttttattttttttaactacaattcttcaaaaaatcaatcaaaaaactaatgaaataataaaaggattgctttaaatcttaacccaaacagctacactcggaattccacggtgaaccacgaacatcatataatacccaggtggtgccacgtaggagttagtaggcccgtccacgtcagctttataagcgaaaacagataactgactcacgcgcctgacgcgcaaaaccaacaacctctggttcatcgccgttgagtgagtgctgaacgacggcgccacgagcctcaccgatacccctccgtcgaacattccgaatgccggaatcgcgaacgttacggcaaaagcctgaccgtacaacatattcccggcgagctccaccgtgatgatcgtcggtctcacacgtgcgtactgtggatccaggtaacgcgggagataagcctcgaggctgagctccgttgggtacggcctcgccgtgaaattgtaatttcgatgaggattgcttcctccgactaagactctgccgtctgacagaagaagagacgccgaatggtacattctagggattcgagtcggggtgagaatttcgaatctccgggtctggtcaggctcctcgggtaagtataaaatcgggttgagaacagcgttcgtcgcgtcttcccaaccagcggttccgttagcagcaccgttaatgatcaaaacgtcaccgtttggtaacagtaacatatcagacatgacacgtggcgatggcatttgctccatgacccatttcggatccgggtcggtcactttcaatctcccacacgtgcgtgatcccgcgacgaagattttaggaatcgtcctcgccgctttgaagaacgctcccggcggagcaccgccgcataccataacctcagcagttatcttcgttctgttaatgtctccggtgagaaagagagggaggagcacggaggagccagtgctgggataattccgtttatcgccgccgggaatctgtggaaactccttgatgattcggtgattgacgaaatcgaacaaaatcgatctccgattggcgaagatgaagagattaccgtcggggagaagatgaagaaacggataaagattgttttcttcattcggatctctcgtctccgccaagaatctgagattgaaaacggattctcccggatccttggggtaaaactcgtagttgaaagctcttcttccgccgacgatgataatccgaccatcgggaagaatctgattggtggaataccaccggcgagaggagagatacgctctgttctcaatccaatcacacgaaacgcttccaactcctccgtcgcaaggtgtgaaaacccgtacagttctttcgccgttgccataaccgccggtttggattaaagaaccggaagcgtttaaagaaccggaagagcaccacgtgtcgtaacgtagtgtaagtgggcgaaaggtatttgaagcgacgtcgtatagtattgaatgagcagagcagtcaaaaacggtggcgttttggcaggtttgagaagggagagaaacattcgaaggtccataatccgtacggtcaaagatgacgactttgttgttgtgtagaagctgcatgtgcattgcggatatacctacactcggctgcagaagatcccacctcccgccggtgagaatagctaacggtgaacgtggaaggagcaaatccgacgtggaacagaggaagaagaagaagaatgatatcacgacggcgttaaggttgttcttgaatctttcttgcgtcattattttcagctaagaatcttctttctccggtgaaagagatttaacatttaaagcttctttgagtaattattagtgtctttcttgaaatcggtaggagaagaaacatttatggtgttgtattgttttacttttctggtgaaatgtgtgatcaagactcgcagtgctctctgtacataatgatctggtagatttgtaacatatggtcaagatttatttattgcattttgcaatttgcatataagttggtgaattttagatctgtattattgatcacggaccatattcttagagataacattttggattttatatcagtttgcgtatgaactgtttcagtctttcacagatcaggagtccaaaataaaattgtttcattcttttttttttatagtcatgtcttcaaattcttttgggggaacagagagtcccgccattaattagcttctgaccccatggggaatttttttaattacttgtatgataattattttcaatagacctagagacttgatatatactacgtttaataatcatatgtagtatgtatgattaattaagtaaatacaaaaatagttacctcaagttttaaaggtgctattgggtaattatctcagtaaaaataatattagatcaaggcaaaaataactgaaaatatccagaaaagaaggattaaacaaaggcatccaaaatctataattgggttttttggagaaatgaccatagagatttaaatcaatggttgtctaatctatgttaattctcaatcctctattgactcttctcatctccttttctctctccccagttcctggttattaaagcaatcaggtgattcaaatctttaatcttttaatcccggcaggcctatctgaaacaacaacctccgtttgaggttttgccgggaaaatataaagttcacaggctttggtctctgcatttgcaatatatttaaaatg

SEQ ID NO: 14850 - DNA, 3000 bp, Unknown
  misc_feature (1)..( 3000): cDNA_ID_3019363_gDNA_ID_2684229_Annot_ID_192174 3000 nt of promoter + ATG
aattaagtaaatacaaaaatagttacctcaagttttaaaggtgctattgggtaattatctcagtaaaaataatattagatcaaggcaaaaataactgaaaatatccagaaaagaaggattaaacaaaggcatccaaaatctataattgggttttttggagaaatgaccatagagatttaaatcaatggttgtctaatctatgttaattctcaatcctctattgactcttctcatctccttttctctctccccagttcctggttattaaagcaatcaggtgattcaaatctttaatcttttaatcccggcaggcctatctgaaacaacaacctccgtttgaggttttgccgggaaaatataaagttcacaggctttggtctctgcatttgcaatatatttaaaatggcagcagctttcttgaatcttggcggctatgttttcgttttcttctcttcgttcttagctatagtggccccacaggttcgaggcaatgttgctgtctttgatagctactggacgcaacgacaaagtgatgcattgaaacaaaccatcggctcttacgatcctcatccacttaacgtcaccaaccattttaattaccatgtcaatatgtgagtttttgtctttgttaggtcaaatgtttaacctaacttcctaaacaagtactaattaaacactttttattttttttaacagagcagtggatgcatcggaatcaaggaacgatacaaggagagagcttactcaggtgagaagtggtcgtaaaacgcacaaaagcagcggaaaatgcctagcttataacccgatagacaactgctggcgatgcgatcgtaactgggctaataaccggaagaaactagccgactgtgtgctcggattcggccggagaaccaccggaggaaaagacggaccgatatacgtcgtcaaagacgcgtctgacaacgatcttatcaaccctaaaccaggaacgttaaggcatgcagtgactcgagacggaccgctttggatcatattcgcaagaagcatgatcataaaactgcaacaagaactgatgataacgagcgacaaaacaatcgatggaagaggagctagggtttacatcatggaaggtgctggattaacgttgcaatttgtgaataatgtgatcattcacaatatttatgtcaagcacattgttcctgggaacggtgggttgatcagagactctgaggctcacatagggcttaggacaaaaagtgatggtgatggaatcagtttgtttggagcaaccaatatttggatcgaccatgtctcaatgacaagatgtgcagatggtatgatcgatgctattgacggctccactgctgtaactatttccaacagtcatttcaccgaccaccaagaggtaaaaagattcctttgttttcgctcatgtgaagttgcatatgaaacaatcaagacctctaatttagagtcttgttttaaattttgtgagagaacaggtgatgttgtttggggcgagggacgaacacgtgatcgacaagaaaatgcagataacggttgcgtttaaccacttcggtaagcgattggaacagagaatgcctcgttgcagatacggaacgatacatgtggtgaacaatgactacacacattgggaaatgtatgcaattggtgggaacatgaaccctacaattattagtcaaggcaatcgtttcattgctcctcctaatgaagaagccaaacagattacaaaaagagagtacacaccatacggtgaatggaaatcttggaattggcaatcagaaggagattactttctcaacggagcttattttgtgcaatccggaaaagcaaatgcgtggagctctaaaccgaaaaccccgctcccaaacaagtttacaattcgacctaaaccgggaacgatggtccggaaacttaccatggatgcaggagtacttggctgcaaacttggtgaagcttgctgattacataaccattttgcccccttccaacaaacagccaaagcttttgccctgtttttgcttgttgttcaagaaaaacaatatggagagagaggagagaaaacgaaagagaatgtttttctatgaatggtgttttgtaactaagactgcatatataatgcgcagttttcggattattattcttaataggatccaggttcctttttctacggaaaaatgagaaaatcaaaataccttagatctttatactaattatacaatctcctcgtaatactttcatcaattagctctcttatcttgtctcgaatgttattagctatatggaccaaaacaatatcttgaagagttgcaaaatttgaccaacaaactgttgatggaagaagcaaatattacaatatgcattgacaataatcaaattactgaatagagaccaaacttgggaaataacagagaacaaatccagtagatatggatttattccagaaagcataatcatatgaattggtttcgaagtcaagtgtcaacagtgttcttgttgagacagcatagccaagtccaattgtatatagatctatggaacatattttgtctcatgtcttatcacttggtcgggccaatcgttggtcctaaaatcgaaaacttcgcatgtagtagcgttttctagacctattaatgcagaggtacatagacaaacgaccttgtatgtgcctgcagatgtatatagacaagtttcagttcaataaaagtttctctttcgttcttttgtcttctctaaggagaagagatattatctcttactctgtttcttctttctctcaatattccaacaaaatttataaaatttgggtctatttgtaatttttgaagaaataaagctgtagaaacgaattaacgaaaagttatcactttctttgtctcgtcatctctctcgagtctcgagtctctgagtgtgtaaaggaagcgcctttttctctcctccatcgtaattcgcagagaagacacactacattgactgagagggaacaaacacaaagcgatg

SEQ ID NO: 14851 - DNA, 3000 bp, Unknown
  misc_feature (1)..( 3000): cDNA_ID_1027959_gDNA_ID_2684229_Annot_ID_192173 3000 nt of promoter + ATG
gatgtatatagacaagtttcagttcaataaaagtttctctttcgttcttttgtcttctctaaggagaagagatattatctcttactctgtttcttctttctctcaatattccaacaaaatttataaaatttgggtctatttgtaatttttgaagaaataaagctgtagaaacgaattaacgaaaagttatcactttctttgtctcgtcatctctctcgagtctcgagtctctgagtgtgtaaaggaagcgcctttttctctcctccatcgtaattcgcagagaagacacactacattgactgagagggaacaaacacaaagcgatgtcgcaactcttatcgactcctctaatggcggtcaactccaatcctcgctttctctcttcgtcttcagtactcgtcaccggaggttttgcagtgaaacggcatggattcgccttgaaaccgacgacgaagacggtgaagctcttctcggttaagtctcgccagacggattacttcgagaagcagaggttcggtgactcttcttcttctccttcacctggtaagccatctcacttggttactttagggttttagcttgcttaattaagaaattggaagcttaaaaacacaaaagggtactcttaattacgagaaatttgtaaccttgaagcttgaaatccaaaaagagaactctttttatatctatagatggagctcgtaggtgatgtttacttgtgttctttgtttcgatttgatagctgaaggattgcctgctagattttacgtgggtcattcgatatacaaagggaaagctgcgttaacagtggacccaagagcaccagagtttgtggctttagacgtaagtctctatcccaaaattaaagatcaaagagctctaactgaataatcatgctttgagttttccatttgatttctgttgtttttctgcagtctggagctttcaagttgtcaaaagatggtttcttattgctccagtttgctccttctgctggtgtacgacaatatgattggagcaagaaacaggtttggttttatctctttaacttcagatgatccttgagctgtaactttgttaagaccatttgactggatttggtgttaaaaggcagtcttttttctattatgaatttggtaaagcttcatgtcaaaattgcaggtgttctcattgtctgttacagaaattggaactctagttagcctaggcccgagggaatcttgtgaattcttccatgatccattcaaggggaaaaggtaaaaagcatcattacactgataatattggttgtattcttattatattgctcctgatcggtttgtttgttgtatgtagtgatgagggaaaagtaaggaaagtgttgaaagttgagcctctcccagatggttctggtcatttcttcaacctaagtaagtaaatttaatcttcttcttgattcttgtcaaaaaggatagtctctaacgatctccgtgtatatattaggtgttcaaaacaagcttgtgaatgtggatgagagcatttacataccaattactcgagcagagtttgctgttcttatctctgcattcaatgtaagatcagaaaatatctcatctttaacattaccggcatgaactttcaaagaaacattactaaactcctttttttcttctatattgcaagtttgtcttgccttaccttataggctggcatgcatttgcaaactccatcaaaccagaagagacaagccgtgtgaacaacgcttcgcctaactatggaggagactatgaatggaatagatgatgaatcttagggccataacaggaacatatatcagagatcatcctaccctttttgttttgctgataggtttcgtcaggattgatatatgttcgtaggtagcagaagagactaaaagtagtttattttttcgtccttttgaccaaatgttcaaaagccacatatcatttcgtggtaagcggttgtatctcaaaacatcagtctgatcttagttgtttttgatttaagagcaaatctcaatttgaagtctgagtacgagctagtatgatccaaatgcctaggctttgagacgaggcttgaagatgaattggtttgtctagagagattggagaaacaagacataccacaaaaacatttctctctagtaacaaaaacatcactctactctactcttgtggtttgggtctggattttagtccggttagtggtacaatggtttatattggtttattagaaatatatagtttacgctacattaagaaaagtactctaatttgtcatctgaagatttacataaaaaagattacatgtcatcgttgtatgttaactaacactaatctcccggttaaagtgtagattgccctaaacggtttaattccggttaggaacaaaccaaccactcgctcggtcgtccaaagggcaaagcgaatccaactttacagatatgtcagagaggagccaagcttctagaagatcattcattcatcacttatacgatctcttcccaaattattgattttttttacccatttctctcatcgcacggtgatattgagaatcgccgacctgaatcgatcggaaaactttctctgattaccggcggtcaacaccgctgaacacatatgtttgtttgacgacctcttctctccgcgatctttacctcaacaacgagatctgtttccacggtaccattttcatccgatctctgttcttctatgtttgtttactggatccgttgattttactttcatcttatcatttgtgtgtggctattttggtgaattgatgcgatcttaagctgtttctaggttcaagccttatatgtttcttctaagctaatcataggtcgtagacttgttaggaagattcgaatctagtacaaagttagcaactttagcatacgtaaatcgttagtagtaatttctagattgatagaggttcgagaccttaaaaggtgatgaatatttggtgggttttgtttattagaaagaaaggaggatg

SEQ ID NO: 14852 - DNA, 3000 bp, Unknown
  misc_feature (1)..( 3000): cDNA_ID_3019366_gDNA_ID_2684229_Annot_ID_192172 3000 nt of promoter + ATG
ccaaagtaaaaatcaaacctttctatcaaattcagagctgaggaagtgatataaagataaatctaacgatcagagattaatcagatctgggtataaatcaaaagcagacaattttagcaaaaatggtgaaaaaggaaattaaaacgtcaacctcagagaattgaattgatgagtagtagtaccaaacttactgtggttgttcttcgaatgttgtccttccttctaaaagtcggaaacaagatcaatgacctaaaaggcttaaaggcatagtggtagctcactgtgaacaaatagtcttccccaacggttccactgatagcgaaagaagaagatgacagatattaccacttttaattagaaagaaaaaattaattaaggaatagacaaaaacaaaagaaatttcggttcaaagcgacgtcgtttggaatgatgtgtaggcaaagtctaaaactaggcctttctgggcccaattaaaggagtcaaagggagttatttacagaaataccctcctttttcttggatcatgatcatgacattgatgataagtgataaccttttttctaaaacaatactaacaatcaagaatgatgggtgtcattatccaagtggttagttcgcttaatccaaacatctaatctagtattcctaatcaattatttaaatcgtaaccactaaccagctcatgataggaatgtattgtattctaactagatattttttgacgtttcataaacgaatgtgaaagaaacatgattaaattatcactataataaagtttagatttgattctgttcgaagttgaatcctggttttaagaaatgaatatcttaaaatgtttgaattttttttgtggataactttacattagcaaattttatgtcacaactaaactacagtgtaaactttatgatatttttttttttctgaatttattcaactatatgctatataatttgggtaatttattttgaacatgcctaatttatatggacctaaagatgcatattttgggccttaaattagttggatacatatatgggtttaaattctaacctttaataagcctataagcccaaaaaataacagtttgtaagttatctgacaaaggattttaataataaagctgcatataaaattgaaaagaaatgcatgttgtataatattaattgatactttggcagtgtcgcttattacaaaggcagttgcatgtgatgtgcttgcaaactcgcattttatcttcccttacctttttgtttttagaaaatagtatattttttcatcatgattacttggaaacttggaagctgtgacaaaatattggttttgagtgcttctgataaaaccttgtattttgaacttgaaaacttttgttttcagccatttttttaacttactacgatgacggtcacttgttttgggatgaaactttttactacttggtgttggtgatgcatggtttctataattcctcttatacaacaaaacttttttggtttttgtcaaaaattgtatataaccaaccttctttttattaggatcgcacgtcaggccacttaaaaagaagtaaagaacaatgagagatcgatgtaaaaagaataaaggaacaaaagagaaagtaatggacagttcatcacaattcacacaccaaaaagaaaacagctgaacatttgttagaatctcaacactttccaaacacacgaaaacaaaatgacactcatttctcaccgacaatagtgatgaaaatatatcatggccgaactaattggtagtattattagtttgagattggtattttttgtaacagtttgatattgaattgttgattgatgaccacgagaaaaaagaagtacgatttatatcatttgttggtttactgtatatagatgatcatttggtgtccttctggtttcgagaaaaacaacaagtggttaaaagtgtagttcgagaaaaagatttggttaggacatgtaattctttatttgagcttttaatccaacgaacggggttagattttccttgcgacggtggctttggatgatccttaacggcacgatctgatcattacatatttacattgacgaaagagcacgtgtaaaaaaactcgttcactggtctggttgacttttattacatactgtctggtcgctatatatctatcaaatctctatgcattaacaattaatgcaacgttgctcattaattaagtatgtattttttgttattttacaagtagtattgatattacaggagttaaaatgttataaaagaaactacaaacatttattcgtaagtttattcatttatattttttaaaaaattggtaaagatgaaagaatttaccttggggaagagatcaacggatttcgagagaagtactactacacaacatttattcgtcaaacatgtatgtatttgtatgtttatgcatgtattatgtatcaaataaatgcatgttatatgagtaataaagaaaggtcttctgaccataacagagaaattaattaagaaccagttgaagtaaataaataactctaaattgtggaaattttagatcaaaagtagataaatagtcagatatttcatgtggattttacgtattttaaggatctaattcattttatgcttttaaaaaatttcattcactttcttcgaagcagtaaaacagtctgtcaatgtgaaacttatgaacaatcaacataagaaacaaaaattaaacaaaatttgtatttattgtcttcttctcagcagaacttctctccacttaattttgtttcttgctctgtcccaaaaacattgtttcatttttttatctcccaatttccctagaaaatctgcttccgatctaaaaaaatctctagaatttatgtacaaaacaccatttttttagactactaaacaaatactaacactaatctcggctacaataacagaaagaccttctgttccttaagccacaataacatctttctttctaatttctctgtaattcttcctgagaga

SEQ ID NO: 14853 - DNA, 3000 bp, Unknown
  misc_feature (1)..( 3000): cDNA_ID_3019368_gDNA_ID_2684229_Annot_ID_192171 3000 nt of promoter + ATG
cagaagacctttctttattactcatataacatgcatttatttgatacataatacatgcataaacatacaaatacatacatgtttgacgaataaatgttgtgtagtagtacttctctcgaaatccgttgatctcttccccaaggtaaattctttcatctttaccaattttttaaaaaatataaatgaataaacttacgaataaatgtttgtagtttcttttataacattttaactcctgtaatatcaatactacttgtaaaataacaaaaaatacatacttaattaatgagcaacgttgcattaattgttaatgcatagagatttgatagatatatagcgaccagacagtatgtaataaaagtcaaccagaccagtgaacgagtttttttacacgtgctctttcgtcaatgtaaatatgtaatgatcagatcgtgccgttaaggatcatccaaagccaccgtcgcaaggaaaatctaaccccgttcgttggattaaaagctcaaataaagaattacatgtcctaaccaaatctttttctcgaactacacttttaaccacttgttgtttttctcgaaaccagaaggacaccaaatgatcatctatatacagtaaaccaacaaatgatataaatcgtacttcttttttctcgtggtcatcaatcaacaattcaatatcaaactgttacaaaaaataccaatctcaaactaataatactaccaattagttcggccatgatatattttcatcactattgtcggtgagaaatgagtgtcattttgttttcgtgtgtttggaaagtgttgagattctaacaaatgttcagctgttttctttttggtgtgtgaattgtgatgaactgtccattactttctcttttgttcctttattctttttacatcgatctctcattgttctttacttctttttaagtggcctgacgtgcgatcctaataaaaagaaggttggttatatacaatttttgacaaaaaccaaaaaagttttgttgtataagaggaattatagaaaccatgcatcaccaacaccaagtagtaaaaagtttcatcccaaaacaagtgaccgtcatcgtagtaagttaaaaaaatggctgaaaacaaaagttttcaagttcaaaatacaaggttttatcagaagcactcaaaaccaatattttgtcacagcttccaagtttccaagtaatcatgatgaaaaaatatactattttctaaaaacaaaaaggtaagggaagataaaatgcgagtttgcaagcacatcacatgcaactgcctttgtaataagcgacactgccaaagtatcaattaatattatacaacatgcatttcttttcaattttatatgcagctttattattaaaatcctttgtcagataacttacaaactgttattttttgggcttataggcttattaaaggttagaatttaaacccatatatgtatccaactaatttaaggcccaaaatatgcatctttaggtccatataaattaggcatgttcaaaataaattacccaaattatatagcatatagttgaataaattcagaaaaaaaaaaatatcataaagtttacactgtagtttagttgtgacataaaatttgctaatgtaaagttatccacaaaaaaaattcaaacattttaagatattcatttcttaaaaccaggattcaacttcgaacagaatcaaatctaaactttattatagtgataatttaatcatgtttctttcacattcgtttatgaaacgtcaaaaaatatctagttagaatacaatacattcctatcatgagctggttagtggttacgatttaaataattgattaggaatactagattagatgtttggattaagcgaactaaccacttggataatgacacccatcattcttgattgttagtattgttttagaaaaaaggttatcacttatcatcaatgtcatgatcatgatccaagaaaaaggagggtatttctgtaaataactccctttgactcctttaattgggcccagaaaggcctagttttagactttgcctacacatcattccaaacgacgtcgctttgaaccgaaatttcttttgtttttgtctattccttaattaattttttctttctaattaaaagtggtaatatctgtcatcttcttctttcgctatcagtggaaccgttggggaagactatttgttcacagtgagctaccactatgcctttaagccttttaggtcattgatcttgtttccgacttttagaaggaaggacaacattcgaagaacaaccacagtaagtttggtactactactcatcaattcaattctctgaggttgacgttttaatttcctttttcaccatttttgctaaaattgtctgcttttgatttatacccagatctgattaatctctgatcgttagatttatctttatatcacttcctcagctctgaatttgatagaaaggtttgatttttactttggtatcttgctcaattggaactttttttctttttctttctcaattggaactttaccagcttaatttttggatattggtttatctgctggatcttcatgattttggtttgctgtcttcaagatctctgcttttgttcacttcatttaatgccatctgttttatttctggcttccgttactttttttattttatgccttgattcatgctacttttttatgttattatattactgaaccattgtctttagctgatggattgtggtactgtatgttcctgttaaatacttttcagctgcaacttcttcatgttcgttggctatgttgctgtgttaaaagtgaacattcacaaatttagctactttctttgcttgtaaaagttcacagaattggcttgtttctttgctggtgaaattcactggatgagcttgtttactttgtttgtgagaatttacagacttggcttgttcttctgcaggtttctacgtttagcaactcattatttttaggcgccatcaagaatg

SEQ ID NO: 14854 - DNA, 3000 bp, Unknown
  misc_feature (1)..( 3000): cDNA_ID_3019397_gDNA_ID_2684229_Annot_ID_192162 3000 nt of promoter + ATG
atggtcaaggcgccaactggtttcaattttaatgtgtgctaattaattacaatctctacatattaaaaatttaatatacgaatggtgaaaatatgattagaaacacatgccaaaaaacataaaagtctaaaaacaaaatcattgatttgattttgcctctctgttctcttatctgtacaattgtggacacatttggtggctacctcgtggggttggcaataatgtggtgtttatcgtttattaattgatatttctataaaatatgtaaaaaacattaactcattagtagtttaattagatcttctctgcttgatttccgattcagattcaaaacaattagagaagtagcaaaaaatgtgtgtaagaatacacaaatatattgtctaacgaagataacatactataatgtctaatataaaataaaattacaaccaaaaatagaaaatggagcactaataagatcgcgtaagtcaataacgaatctagtgttacaactagtagtgcacaagatgtagtagtaactctttcataacaggataagtaacttactttgcgagggcagccaataatggggactagagtcggagaacaacaaataatgaacttcaagactctgcttttgttggctccaacgactcttccggacctccagcttcctcaacaagctggttaaaaacggcacagcaaataacggttaatagtgagaaagatgctatcttaagtcctgtagagttagtcagtgagtgagattagagggagtgaacataccaaagaaccgacttgctcataggctctcattgctttcggatcttcttcatattcgtatcccaattgtagaatccgtgggccgttgactgaccaaaatgcccttcgacctgcctcctgcaacatcaaaagtagttttgacataacagaggaccttttgtaagttttgggtttgattggtccttcacaagagttcacaagaagggaaagcgagacagagaaatgttttacctctaagatgatcaaatatatagcttcgagtgtctgaacgcgaatgtcaggatcagtaactggttctcgctcaatggacagtgcacttccaagctcaggtggcatttttgcgacatcttgctcactgtatgtctaaggaaagtaaaacccaataatcagaaactattttctcataaaagaagaaaacctttgtaagcaacaacgtagcagctataaagcaaaatcaacaaaccttgctgcctgcaactggtaggagcagagcgggccaaagaaactctgatatcaagagtatattctggagttggtttttggcttcaaaacaacagttacgaatagtcccagcaacctgaaagccgataagcataatccatgttaaattgttcaaagggtatagactaagcaacatgttcattaaagagtaatctgccaaactccttttaaacgtacccctttctttcgcaattgatttgttgaatcaaactgcctaatgatctgttttaatagtcgtctctttggctccagtaacaatttcctcccatcttctgtttttgatatgttgacaaggatcgaaccaacatgctcaaactgatcatctggtgcgcaaataagaacaatattcagtaattcattcctctttttatacagtagctatgaaacttgattgcaaactaaaaaaactaccagtaagtaactacgcataatattcaatggtgccaatgcaaacattaaaattctagactgtcctaccgaggattagatttagatatatgaaacaaaaacgtgatatatgaaaaggaaattccaaactatcatatctagaagtagatatatatatatataaacttggacaaattatattacaatactaaagtgggaagtacataccagcagtttcaccagaagacctgcaaaatgacctaacaagcttcatgatatgtagtccatgcatcttctcatcgtcaatctaacaaaggcataaagttttacacgattagctacgtcaccattagactaccaaaagataatccccactatatattacacaaatttaacttatgataaacgacctgaagcaaagaagaaaccccatcatccaactgagtaagattcactagaagcataacaagtaatctggtaatacaagactctggcttatacaacatgtccatggccactttaatcaaacccatttgaatcatcttctttgccaattcacacttctgagaaagattaacaagagcttgagctgctggctctgatacctcctgcaaaattgaattcaaaacaacatttcaatatctctcaatccaaattcaggaaacaattagtgcttcttaagagttgattcaatgaccttgctttcatttagaagctgagacaatgatggaagaagaatctcggaatactttgatagagattgtaaaccttcctcggaaccagttaaaccactaacaatttccaccgcagctttcttcacctacaagtttgtttcttcattcaatcagactcatcggtaacaaaaaccctagaatctaaaattatcaatgcatccccatagctcagaaacagatgaaaccaaaaagcttacaggcggtgaaggagatgacaaaaattcgacaagctcttccagctccgtcaccatatctccgaggaagaattttccgtcgagagagagagagtatcaacgtttctgcgcgtaaatgtcaccgccggcgaacacgaaaaatcctcagggtttttgttgtacaactaaactaaacactctaaattgttcagaaggtttaaaaaaaccccaaattcagtaatattgcaaaacaacccacagactaatcaaagttttcataatcaccttccaattaatagtaatacgttttgggttattttgtcaaaattttagttagtttgaggattgttttaaaattttacctaaaataaaaccagtttcatctttgagacaaaaatttgtccgtggaagaaatcttgacattttcggatttgacaaag

SEQ ID NO: 14855 - DNA, 3000 bp, Unknown
  misc_feature (1)..( 3000): cDNA_ID_3019395_gDNA_ID_2684229_Annot_ID_192163 3000 nt of promoter + ATG
taactccgagcttcagacttggactacacttccgaagatgaataaaccaaggaagatgtgttcaggtgttttcatggatgggaagttctatgtgattggaggaattggtggaaatgattcgaaagtgcttacttgtggtgaggagtttgatttagagacgaagaaatggactgagataccggaaatgtcgcctccaaggagccgggaaatgccggcagcagcagaggcgccgcctcttgttgcggttgtgaataacgaattgtatgctgctgatcatgctgatatggaagtgaggaagtatgataaggagagtaagaaatggtttactttagggagattgcccgaaagagctgactcggttaacggttggggattagcgtttagagcttgcggtgagaggttgattgtgattggtggtcctaggagttcaggtggagggtacattgaactgaattcatggataccatctagtgatcgaagtccgcctctatggacattgctcggtaggaaacattcatcgaattttgtttacaattgcgcggtgatgggttgctgataaaagggtttcaacaataactttcagatgatttttatgattctcctgccgttggagatgtcgaaagttgcagtcttttttttcttattaattttggttataaaagaaatttatttgaattcaattggatacaatcatcttggtggtattgttagtttcttggaaagaacagaaacaggtcttgtaataagtttggtggagaaagttcagaatctagagtttttcagttctgctatactatttgttaaaatttttgtttatattcgtttcattcattttttcgcaaagagactatattatgtgttttgtgtgttcttctttcaattctctgataagagaagaaaaagagcttttaatcttatagttgttgtttgcaagataacttgatcttttgcttgcaagtaataccataaacttttcaatttttctcctttctcttggttctctgttttgggatttttgcttccttcttcagaaattatggcaattaattctttgaaaagtaaaaaaaacaaagatagacttaatcaggaaaatggcagtttgcatctgattttgacgtgtaggtaggtctctgtcattttctctttgaactctcagccttgcatgacaatacctaagatgggcttgctatgctaatttcaaatcttttatgcatactaaatgatccaacaaggcaatcacccatctctatctaaaacttcaacgattttcaagcaaatcttcaattaaaatatttaaagctaaagccatgataaaacttgcaaatgaaagatatatggccaagaacgaaggaacaaaatcatttcagagcttaaacaaaagagtcacaaaaagattcagaatactgattgtgtccaactaaaaacttaaaacaacaccagagataacgataagtaaaaagattcaggctgattataattcttcttcaccggaatgagaaggatacttcagttctgatactcttcagtagtgggctggcaaaaaggcacttcccggctgacggttagccaaaggtccatggcatgagaggaactgaaaaaaaaacgaaaacattgttcaattcaacaacaaatgatatttccaatgataactatcactgctataggatcaaagagtgacaattctgatgtaaagccaataataccttagcgttgacaccatcagggacaacacgcttctcttgcctcaacttggtgaagtcagctctgttaaacttcgtgaagcccctgaaaaaaaagtcaaagacttgatgagttagcttacttgtatccataaaacaatcaaacaacaaaatgattcaaggatcaatctttgaacataccatttcctgctgacaataatcttttgacgaccagggaacttgaacttagcacgacgaagagcctcttgagcatggtgaccatgggcatccttgcaacgaacagacaaaagaacctgtccaatagcaacacgagcacaagtacccaaagctttaccaaaagcacctctcataccagtctgaagcctatcagctccagcacacgaaagcatcttgttaatcctgagaacatggaaaggatgaaccctaatcctcaaatgaaaagcatcttttccagcagacttcaccatgtacttgttgcaagcaatacgggcagcttcaagtgcttcacttgacacattctccttctcccatgacaccaaatggacacagaatggaaactcatcaacacccttcctcttcataccaacatcgtagatcctgatttttggatctggcacaccacgacagtagcgagactttgggtatggcttacccttgatctgacggtaacacctcgcaggtcctaaatcaatattcagattattcagatttcagctcagaccaaactcatatagctcaaaatcatcacagtatataaaaacctaatcaatcaattggtatctaaagagaaactatataaacctaatcatttatccgatgaatagaaaaactgaatcgcagaatctcaaaatcgcaacaaagagagaacatttggttaattaaatccatggaggaatcggaagaacacagaaatcctgacagagaagtcacaagagatcgagagaaacttacttcttcccatggcgtctctctttatccttcctcggccaaaaagcgcggctgctcgacgaaaaaactaatgacctagaaaatggcttcaatttatagatccgaaatttgctaggtcaacaatatagctctgggtttttaactaatgggctttaactattaaagcgcattacatattaaagagatttgttagggatagggttagggcccatcgattgtatatacgtttttttttttttatcttcctcctcaaggaaaaaatcaacattggattgaattgatacaaataagcatatctttcatgttatccatcactcagaacaaaatcctctcaatagacagagaaataatg

SEQ ID NO: 14856 - DNA, 3000 bp, Unknown
  misc_feature (1)..( 3000): cDNA_ID_3019302_gDNA_ID_2684229_Annot_ID_192164 3000 nt of promoter + ATG
ttgtatgtctgtcaaaatctgacctttttttttacttcaattatttggtcattgtgaaggcaagccaatcaagagagcttatgatggattgttgcttgatgctggaggaactcttttgcaattgtcgaaacctgttcatgaaacctacgcttccttgggccaaaaatatggtcactttcttacactctttgtctttgatctgttccaaaaccaatttcagatgttctcatgttggcatttgtttctagttcaggtctcaagacaactccagctgagatcaaggaaggtttcaagagagttttttctgccccttggcctgagaagttacgttaccaggtccctaaatgcatgtgtgaatctctctttgtaatagattctatctttgctcgttactgtaagcaaacgtattaaaagagaacattctttcattgttagggagatggaagaccattctggaagcttgttgtttcggaagctactggttgttctgataatgactacttcgaagacgtctaccaagtgagtatcgagtgaaagactctttctttgaggcttttgactagtctttcggttccattaacaatccatcacattgttttatctcttaagtattatgcgaatggcgaggcatggcatctcccagaaggagcttatgagacaatgtcactactgaaagatgctggaggttattattactctctccttgttaacttagataactttttgtattctttatggcggatttgtaaaattggtgttagatgattgcagttaagatggctgttgtgtctaatttcgataccaggctaagaaagctattgaaggatcttaatgtcatagatatgtaagctttgtcatgttttgttatataaaccagaagtctgagtaccaaagttaacaccatgaatggtaatcgtttataatgcttgcatctcttgcaggttcgatgctgtgattgtatccgcagaagtcggatacgagaagcctgatgaacgaatcttcaaatctgcgttaggtattggcatattgcattctaaactgaagtgttgtttcgtttaaattataagaaaggtttcagagttaacattttgtgtcaagcggagaacaaattaacgttaacattttgtgtcaagcgcagaacaaatcagcgtagatgtaaacagagcagtgcatgtcggagatgatgaaggagctgataaaggcggagcaaacgccatcggtattgcttgttggtgcgccaaatatacttttcatcttgttttttccgaggtttttaaattctcatccatcataacacatagtgctttttgtttatctgttttctttgaaaatttaggttgtggggagaagatgtgcagacattttcggacatacaaaagcggatcttggtttcagaactctaagcttcaaagattttgttctgcaatatttttcagaccctgtacacacttactcaatcaacactgtaatctgtctctttaaaaatttaattaataatgaaaaagctgcaaacttggacaacaagaatctaaaatttaaatcaaatagatggatccacgagaagcaaacaaaaagaagaaaatggtgaaagttacaatatagagattaaactctcgaaataacaaaaaacactatctccgcaacgataggtgcctatggaaactgaatcaacagatttggttttgatatcatatatcatcagctgtctactatttgatctaggacaacacaaaagcttattcttctccaaaatggctactggtaatgattgcgtaacactacgattcactatcgaatatatttgttcccaggtcttgttctctgaattgaacgaccatattatcatttgttggagaggtttactaaccgataagcacaaacggttattcaggctgcgtgtgataatgtttctatgatctgcttccgcaaaaggagctttagagataacttgaaaagtttcggtgtggagatctaacgctaaaactttaatttctttcttcccggttaaccaataaagcgatccatctacatacagagcatgcccccgagacgaggaagtattaatccgataaggagaagaaggattgatatacctccaagtgttggtgctaaaatcaaaaacttcacatgtagtagcgttttctaggccaagttcggaagagttatacataaccaaaccggtttgtatatgccactgattttgtctttgccaaatccaaatttaacgtgactaaaataacttggctgctcaagacagatttgttgcaacctggaaacagggaaacgtcgatgccatcgagtggcgggattataaacaatgttgtttaaggtttggtaatcaaagaggcaaacaagaccgtcacaactattgtggaaaagttggtaaatatgatatcgttctgatgatatcaacaacacgttagttttaagtggaggagaatcagcagtaacatgatggggcaacaccaacgtactgggtacttcagacaccaatacaagatttagatctttcccgccagctgagcagatcaactgtttcgcctggaaatattgagattcgattgtcaacttccattgtttgcaagcagacttgaatctgagcagagatttcaccggaactctctcaagaatatcctcaacggtgtcgtggggaagcaattgcattatttctctgtctattgagaggattttgttctgagtgatggataacatgaaagatatgcttatttgtatcaattcaatccaatgttgattttttccttgaggaggaagataaaaaaaaaaaaacgtatatacaatcgatgggccctaaccctatccctaacaaatctctttaatatgtaatgcgctttaatagttaaagcccattagttaaaaacccagagctatattgttgacctagcaaatttcggatctataaattgaagccattttctaggtcattagttttttcgtcgagcagccgcgctttttggccgaggaaggataaagagagacgcc

SEQ ID NO: 14857 - DNA, 3000 bp, Unknown
  misc_feature (1)..( 3000): cDNA_ID_3019372_gDNA_ID_2684229_Annot_ID_192170 3000 nt of promoter + ATG
tcgagagaaaataatcaacgagctaaaataagattgatcgatttcgaccctaacgagttttacttacaaggtctcttgaagaatgccttggtatatgtaagctgcccagatcccagcgacacagaacgacaataacagaactcgccggagaccggaaccgtgagattccatcgccgcacgtcgcttattgttttatccgacggagctccggcgaaaatttgaatttcaattttacgctatttgatcagttttgcgatcaaattatgagatcggtctgaagtggaaacgaaagttattagagagagtgtaggaggcgcgagaaagacgtagattttccacgtgtaactgtgtcattggcttaataatctgacatgacacttctgattggctataggacgtggatttatttctggaatccaagtcatatgcacattcatgtctgagataggaatgggaactatgtgccgttttattgtcatgaaaacgtcacgcagtttcctagaacttgtaaacggatgttctttttacagcttgggccttaatttgattaagcaaacttgcacacagctaatcatgtcagtttgactaactgatgaattcatacaaatctaagatcacttgtggtaagaaaatgaaagaaaaaggcgtatatacacaaatggaggaaagttgccaacatgatttaattgattaaaatttagtgatgacccattgttaagattactaaaacaaaatatgatatatcttaaagtaaatgtgacaataacgtcaacatagcgagaaaagtttgaaatatcgaatttccattatattaaaacaaggtatcacatgcatgcactcatgcatagttcattatgatttgagtaattttctatacgaataatattatactatatctcaatgaaaatagaagttatatatattgggaaacggaatttatatgacatacttaatcctcatgggagaaccaattatacattttgaagagtcaaaagtcaaaactcaaaagagtgactcttaccggatacaaaatgaaaatagaagtcttggtgagataacaaattaatgtgtaacataacaatataatatcataaaagattccaaatggggcttttgtccacacgtgatatgcaatatgcaaaagaaaaaagaactctctttcgatctgccggtcaataacaatgtgaatatagattaactgattaataagtagtttcttgggtcaatgcatgggatattatatttaagaaatacaccaaaaatgtattcgacgttagccaccacgttccattaaaaattcaaatctaaatgatgattaccgtcgtctacatctatgattacaaattttttgtctactatgcgtttagttatttaccatggtttgacgattatatatataacacacataaattatgacggtttaacgttgtctcttaactcaaaacttaattttacaaaaatattatttaagagttgaatctcatactttaattattcatttggtcaactagaatgcgaaaaatccacaatacttcgtaactaatttcgggtcctttaaatcttgatcacctgttgatcaacaaaagatctacacataaagattgattcatccattgactaaacttttatttatcgaagaaagactatatatatctaatgcatgcatgccatatgcacaataatctaatagtaaatccaatacgtctcagaaagataaaatcgtccataataccaaattttattctaaggttttgatatctctcataatttggaagtgtatgtaaaagtttcttaaacataaatataacatccaaagaaaagttgtaaacacttaacatcttgattgaaggggaatctcgctaataattgtgactgaacgatagtaagtattattgtaaaatatcgatcaaaatttcaacgatatgggcgatccagacccaccactttgttgtcccttagcagacgtcaaccatgaccataattagttaaaaaaaacaccaaacaaaaaccacaacttccttttaattctttttaaattctaaatttcagactaacaaaaagtattcataagctgtttcatgtatgaatttaatatcatgaatactaataacttgagccattaactttaaccaaaaaaaaaaacttgaacaatctaatataattccctgtaacatttaaaagatggagatgggaaaacaagaattctaaagaaacattgtaaaaatgaaacagagacaaatattttcaagcaagtcttgtttcatttcatttctgtttgaaaaatgacaagtttaaagtcatgtctcatatgtgtaatattattaactttaaaatataacaaaataaatatctttgattactttttgaaatgttttttatctcaagaatttggaaattttcgttgattgatacattataaaatctgaaaattagatgtgaaacacgactttttgtccaccaccaatcctcctagaaattatcagtttatcactcgattactgaatgaatgaatgagttatctctgaaaagttgtcgtaccatttattatcccacgcggatttactgccgtgagcatgacgttaccgtatctatctcaaattactaaaattgtcctttccgatggccgtctaaaggaactaactcgagggcattttgtcattttgagaaattgttatgagtttgagtacaaaacaaaaggacacgacgactttgtattatttgcttcaaatcctctgttcttcaccttccttgttccttcttctctccttcttttttatatagattttcctttcatgttgtaatacttttattctattagcgttcatattcagctaaacagacattgcgccgccgttaagtcgaaaggatagaaagaaattaaagaaagaagaagcttgttgtctttgcttcttgaggctctcttcttgtcttgatcatctgttacgttgttccacgaaaagaacagtagctttgtctctccatatagggttattatctgaa

SEQ ID NO: 14858 - DNA, 3000 bp, Unknown
  misc_feature (1)..( 3000): cDNA_ID_3019376_gDNA_ID_2684229_Annot_ID_192169 3000 nt of promoter + ATG
ttacttattcgaaaaacccattttgagaataagaagaaatatccaagaaactgtaacatagaacccaattaagcaataaagacttgagaggaaatagttaccagaattagcatgtgggctatggttgctattatccactttagctgatgaatctaaacaattacccatttcagataataaccctatatggagagacaaagctactgttcttttcgtggaacaacgtaacagatgatcaagacaagaagagagcctcaagaagcaaagacaacaagcttcttctttctttaatttctttctatcctttcgacttaacggcggcgcaatgtctgtttagctgaatatgaacgctaatagaataaaagtattacaacatgaaaggaaaatctatataaaaaagaaggagagaagaaggaacaaggaaggtgaagaacagaggatttgaagcaaataatacaaagtcgtcgtgtccttttgttttgtactcaaactcataacaatttctcaaaatgacaaaatgccctcgagttagttcctttagacggccatcggaaaggacaattttagtaatttgagatagatacggtaacgtcatgctcacggcagtaaatccgcgtgggataataaatggtacgacaacttttcagagataactcattcattcattcagtaatcgagtgataaactgataatttctaggaggattggtggtggacaaaaagtcgtgtttcacatctaattttcagattttataatgtatcaatcaacgaaaatttccaaattcttgagataaaaaacatttcaaaaagtaatcaaagatatttattttgttatattttaaagttaataatattacacatatgagacatgactttaaacttgtcatttttcaaacagaaatgaaatgaaacaagacttgcttgaaaatatttgtctctgtttcatttttacaatgtttctttagaattcttgttttcccatctccatcttttaaatgttacagggaattatattagattgttcaagtttttttttttggttaaagttaatggctcaagttattagtattcatgatattaaattcatacatgaaacagcttatgaatactttttgttagtctgaaatttagaatttaaaaagaattaaaaggaagttgtggtttttgtttggtgttttttttaactaattatggtcatggttgacgtctgctaagggacaacaaagtggtgggtctggatcgcccatatcgttgaaattttgatcgatattttacaataatacttactatcgttcagtcacaattattagcgagattccccttcaatcaagatgttaagtgtttacaacttttctttggatgttatatttatgtttaagaaacttttacatacacttccaaattatgagagatatcaaaaccttagaataaaatttggtattatggacgattttatctttctgagacgtattggatttactattagattattgtgcatatggcatgcatgcattagatatatatagtctttcttcgataaataaaagtttagtcaatggatgaatcaatctttatgtgtagatcttttgttgatcaacaggtgatcaagatttaaaggacccgaaattagttacgaagtattgtggatttttcgcattctagttgaccaaatgaataattaaagtatgagattcaactcttaaataatatttttgtaaaattaagttttgagttaagagacaacgttaaaccgtcataatttatgtgtgttatatatataatcgtcaaaccatggtaaataactaaacgcatagtagacaaaaaatttgtaatcatagatgtagacgacggtaatcatcatttagatttgaatttttaatggaacgtggtggctaacgtcgaatacatttttggtgtatttcttaaatataatatcccatgcattgacccaagaaactacttattaatcagttaatctatattcacattgttattgaccggcagatcgaaagagagttcttttttcttttgcatattgcatatcacgtgtggacaaaagccccatttggaatcttttatgatattatattgttatgttacacattaatttgttatctcaccaagacttctattttcattttgtatccggtaagagtcactcttttgagttttgacttttgactcttcaaaatgtataattggttctcccatgaggattaagtatgtcatataaattccgtttcccaatatatataacttctattttcattgagatatagtataatattattcgtatagaaaattactcaaatcataatgaactatgcatgagtgcatgcatgtgataccttgttttaatataatggaaattcgatatttcaaacttttctcgctatgttgacgttattgtcacatttactttaagatatatcatattttgttttagtaatcttaacaatgggtcatcactaaattttaatcaattaaatcatgttggcaactttcctccatttgtgtatatacgcctttttctttcattttcttaccacaagtgatcttagatttgtatgaattcatcagttagtcaaactgacatgattagctgtgtgcaagtttgcttaatcaaattaaggcccaagctgtaaaaagaacatccgtttacaagttctaggaaactgcgtgacgttttcatgacaataaaacggcacatagttcccattcctatctcagacatgaatgtgcatatgacttggattccagaaataaatccacgtcctatagccaatcagaagtgtcatgtcagattattaagccaatgacacagttacacgtggaaaatctacgtctttctcgcgcctcctacactctctctaataactttcgtttccacttcagaccgatctcataatttgatcgcaaaactgatcaaatagcgtaaaattgaaattcaaattttcgccggagctccgtcggataaaacaataagcgacgtgcggcgatg

SEQ ID NO: 14859 - DNA, 3000 bp, Unknown
  misc_feature (1)..( 3000): cDNA_ID_2731082_gDNA_ID_2684231_Annot_ID_137603 3000 nt of promoter + ATG
aagctttcacatcaaacctaacaacaaaacaagaatcacacaataacttagtctcagcttgtggggagacaaaaaaaatcacaattgaagattgagaaagtttcaagaacactaacatgttatcgtggcagagacaaggcaaaccatttaccaagactacaagacataatagtaagtagcagagtgtcctgtttaatggaaaatacgattcttttctgattccaatcttgtaatcagcaaccctgaaatcgtagattccaacaagtacaatcgattttaggctccacagtaccttacaccaatgagaaccaaagcaaactaagatacagattctttaattacgtcgtacgagaaaacatcctagtggacagacaggaccacattattgcttagaccttggccctaatgaaacctgttattcagtagctgtttcaaaattagatccaacatatcatcaagcttatcgacatagcccggtttagcctaatttggttacttgaaacttttttttttttttttttaacttgaaacttttatcttctaaacatttttcatttttttttaataaataaaatgaaggatttgtgcgtttgtgtgaaggaatctgaaaacataaaaccaaaagaatataattggaggagcaattcaatcaatcaatgggttttttaatagttaatttacttaaggggaggtaggttttatttgtctgcttacttcgagtaaggtcgagatccaccagaacgtgacaatgtgacttccactgcttcaggacaaatcaaatatgaacctacgtcacaaaattactattataacaatttatccttatttattctttcttacgactatcttgtcttttgctatcatttacatttgtaaaaaacatcgtgatattattatttactagtatataatatcaaacttttcacgtttaataaaaattattaatttgaaattattcatttttgaatttgattgatatagttgacgaaaaagagttgttagtgtaggaagtttgtccggatatgcaattttttttttgtaacgtgtatcatctcgttaagaactcatatgtattatatgaacaaaatcaatcatgtatattaaaaatggtttgccctaaagatattctatgtttttttcgtgaataggtgttaaggatattaaacaaaaatacccttatttattcttacgactatcttgtgtctatagcactctagcttctacgttggtatcatttatattttaaaaagattttgtgatattattatttactggtataaattttaaaatttctcacgtttaataaaactaaacatattaataatttaaaattattttacttttgatttttattgatatggttgacgaaaaagagtgattagtaatggaagtttgtctggatatgcatttttttttcttcgtaacgtgtatctcgttataagaactcatatgtattatatgagccaaatcaaatcgtgtgtattaaaattggttgccctaagaaaattcaatgtttctttcgtgaaagaaagtctattttttttatagatttgattctcttcttgggatttccacattaaaattattatcttagaggctcagtttgatacatacactatattttttatatattgttcaacgtatagtgactgaatggtagttgtttaaaaggattgtgtaaacgagttggatagccaaaactatgttaacttgatccttgtaaagtaaacaaagccatgcatcctctaattcaacaatttggtcccattaccccaagaaaatgttataaagaggttatctttatcaattacttgtaaacaggacattatctttataaagaaaatgatatacatgctgcatttttttggtttggtagttttacatgctgcattttgtacttgcaaccacttctatactaattgttttagataagatagtaccttcttgtttgatcacatcgtaaaaggatcggatatgttaaccgtctttttccaaacgttatatactcttcaacactcatcataatgtatggagatgtatcaagtatctcttacgaccattggtctttgcggcctaatttgcaacagaaagtcagaaatatccatactataactatgctatttgaaaattattcattttgactcatatataaagtagagttaattaggtgtatagccaaattatggatgaaaattagacaaatgatcatgacattcttttttcttaatttcccaaaagaattgtaatatcagaagggaaaaatacattccacacatagttagaacttagaagaggtccaatcaataggcggtaaaaattaatttgtaacggtaaacaaaaacgataaaggataatagtacaaactaattggcaattaatactgtttttggtcaaatatatatgtcacgacagtagatgaaaataccgtttttggttgaatcgttttattttttactttgtcttgaatcttgtctactcttcaataccgtttttcgttgaatcattcaaaaaaaaacagatctcctagtgatatgaatcaaagtttatcaataaaaatcttagtatacatttgcaaaccataacttcataattttgaataaacgataatgtaagacaggttggctcattagaaagcatatcaaattaattgtaaggacacaaatatctataattaatgcaggcttttatgaatcaatcatcatcattcacatcctcgtataattgtctaatttcgtacctcaaaaaaaaaacaacaacgtgaaaacctaaaattagatgagttacgaaaattaggcaaaaataaataaactaaatcatagtattacaaaacaaaatgaaaacgaaaaaatgaagaaaaagcaagctggtccccaacagacatgcgagttcgtctcctataaaactttgttaatctctccttcacacttatcacgccacctcaccacctctctcctctctcctctctctcccccctggagagattattcattccctccaatg

SEQ ID NO: 14860 - DNA, 3000 bp, Unknown
  misc_feature (1)..( 3000): cDNA_ID_2730520_gDNA_ID_2684231_Annot_ID_137606 3000 nt of promoter + ATG
ttaaaatcagatgagacttgtgtataaatactttgagatctgtgttctctttcgttcactccaaagagcatcctattaagttgctaaagagagagacgccaatggctgtaaagcaaaaggtctgtgttactggtgcaggagggtttattgcttcatggctcgtcaagtttcttctctctcgtggctacactgtccatggaaccgttcgagatccttgtaagggataagatagaaaacaaatcctctcttttttgtgaacttttgaatattctctgtttcttgagtttgaaaaagttgcatgcattgatcccattgttctcaggtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagttcctctcacagaggcaagttcttacatagattcttcttttgtttgtttcttgaatcactaacaaagtctttaaaacattcaggaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgaggtaatattgtatctttgaagctaccatgttggtcagttgtctctgtgttatacatatacaccaagacagtaatagaattgagtgtttaatgtgatgcaaaaaatctgaggatctcagggttattggcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtgatgtaaacatataatgtgtgttctcttacctcctattgcatattttggttaagtgattgattcattcttgataatttgatgaattggtgtgtctcttcttaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaaggtaagaagagtaagaacaaacgcttgatttcaaactttgagatttcggtctgatctgatggaatgtttattggcagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataagcttacagagtcgtcacagtgactgtttcttcacttttatcactcctgaaataaagtggtttttgttagaatcatttcattctcaaatccattatctattactatcatattagtgttgttctttgtaacagtcagttatttgtcactttcaccaacatgaataatttgatggaacatgtcagattctcacggtttctttttcacaaaacaaaactggttttgaatccgaccactagactaaagtgtccatagtccgcggcaaaatgaaaaccaatttaaatgtcgttatacaagctttgtagtctagtagagatatacaaatttaattgtcgttgttagttttgtagtctagtagatatgattagtcattagttacggtttcttaataacattgacatttagaccacaatgtggacttgtggggttaaatgagtcacgagctcatgaacccctagccatttatttgggattttccgaggacgaggcttaatctacaccgtccgaattcgttaatgacggcaaattgcttccatgagtagatttttctttgtctcattagtcattatacaatttcaattctaaggataaaataatcaacaaagtttgatttcagttttttacattatttgtgtaacgttactacaacggatagatttgattcagacaaaacaaaaagatcgatgattacgacgttaattacagaattagaggtataaatatatgggtcccacgtcatttacaatggccagaaacaaaagtatctctttctctctctcttcatcttcaacaaatcacgcaccatcataatcatcatcatcttcatcgtcatcaccaacttcttcatcatcaccatcaatggaattccccaaaccaaaccacccttcaccctaaaaatcgtttcatcttttttccttcttctaattttttttaggtttttaattaacttttgcttcaagttttcttctatagatttcttactcagaaaagtttcgaattcgaccctgtagcttagttgttgtttataatttcttgtgatcattcacagtacaaaaaaactaattcacccaccgacttcttcttcttcttctcttctctgtggcccatccttaaacccacactgcttttgcttttcctttttttttccgggaaatttgatctctttacctttcgtcattattagtagggaatgatcttttagttttttttttgtttcccccaaatctcactttttctcacttcctctccatctcaaatttcacacaaccgagtaaaccctagaatctccgcttctcattcaattggtttcatcactggtcttaatcattgctagggtttactcggttacctttatcatcatcaattgatccttgttcataattcatcctcttttctttctgtctttggcataaagtttcaatttttcttcttcttctctttctcactcaatc

SEQ ID NO: 14861 - DNA, 3000 bp, Unknown
  misc_feature (1)..( 3000): cDNA_ID_2730524_gDNA_ID_2684231_Annot_ID_137607 3000 nt of promoter + ATG
tcacctaagtaaccaaagatgagctgacctaacgcggtgccaagaagagcgattgcgtaagaagttgagagaagagcggttccgattgagtctttgtggtaatatatttgacttatcattttcatgatcggagctatacagaaaagatcgtatgcgtcggtgaaaagtcccattccggcgactattatcgctttgaaatggtaccactgtatcctcgctgcgtctaacgccgataataaacttaactccggcatcgtttcgtcgattttttaagaattttttcaagatacggagaatgagaacaatagaagtctttgtatttttcatttgaatgtgtttttggagattttttcttattggagacaaatatggaatatgctttggtttgactgtgaggaacacaacacctccctggatcgagtccacttctttagttgactttgacaactttatttataaaatttggattataagttttaaatttccctctttggtacaaagagttttagttgtaagatgtgattgccaaaatcttggttaaaacagttccgtttcacatcaaggtgctttttttcagagtctaagaacatcttaaggaaccggatcattggacatggttctacacaaaagaaactagaacattcttgagtctctaacctctgctaaatccgaccaaagacttacaggtcggccactgcaactaaatgctgattaagcatggaggatatcgtggttgaatgaaaaccggaactatgaagttgggatgcgcactccgagcttgactacgacgacttcaaagatcccatcagatctaaaattaggagaaaacaagcgaggatccacttgtcccggaagattaaacgtgattgagaatggaccaggcggacagagctgttgcacttgcattctgtataagcatcccgtgtcacttggaatcgcaatctcaggtataactccttggatgcaaactctcccctccctctgaatttcacatttgatcttatctattaacagaacagaagatagcattttgggtcaaagttgctttcatacacggatagcgtaaaagaaagcagctttcttttcacgtcattggtcattatctaacccaaaacatgaggaatccattccggtattaacaggttgttattttcattatccaacaacaggacataaggagaaaagaaatgtgaaggcttaccttgatttttctcaatgccaggaagagagactcggaagatgtaagcaacttcgctgacgccaatatcaacaagaccaatgggtggcccaacagagcctagcttagcagtaccagtgcagaatacatgtgagatcactttcgagtgagtagtagtagtctgattattctcagcgttcatctttgtgtttctgtttttttcacaagagatagaatccaaacctacctgttaataatatcacaattaagaaagcaaaagaagaagacaacaatcaaatcacaagcacaagtcaagtttgaagatgtaaaagcaaagagacctataagatttttctatacaaacagagcaaaggttaaaactttatgagtaaaaggatctaatctctctgaaggaagattccaagaacatcaaattgaaagtacaagggaagaaacaaactaagctagatcatgaccaaattcttaattttgatgaacaaaagttctgaaactcgaatcgtttgagctagatttctcaaatgatttgagaaactaaatgtggaagatgagtttcatagtacgaatcagtcgaaatcatttgaaatctaagctcaatcaggtttatgaaattagttcttctttgcattcaaaaccctagaataagtggcgatgaagcgataattttcgtcttcctagggttaaagaaacagattcgtaggaaaatggagttaaaggagacagaggagacccaaaacagaaaaaaaaaaactaatttcgattccacaatgccgaaacccagaaaaattctcaaaacgaagtcactcaagaagataatcaacaaagcgaaaacggagaagggtttgggtttaaggtaccgtaacgaactccggtaagttccgatgatggtgttgacagcgaagcttcgtggaacagcgtgaccgtcgttactcactggatttgccggtgaatttgatgagtcaaaaatataactagcagctggtcaaagtaaccactctgaataagacacgtgtcagaaactttgttgaccattctgactaaagaaaccttgtaaccaaaaacatccacatttttacatgctctgtcatatttcaactgtatactaaagttgaaatatgactatggtaacttatgtttttttagttgaaaactaaggtaaactattctatgccagcaggtaaaagatgtggatgaccaactactgctggcataatttattctatgactaaggtaaaactaaaagttaatatcactcgaaatatttacaaaagtattagataaagtactaaaaattttaagttagaaatgatgaaattaaaagatatatgtggcttatttaggaaaatagatacttttaatatgatggttgggtagttttattattgtttgggattgaaaaaaactatgaaagtgtctccaagtacagtaatatttaacaactaactaggaaggtgtacattgttcagtattcatcattctaattaatacaaataattttaaaaatttggggtcgtcaattgctcaaagatattcattattttataattttctacattttatcaaaaacagaattgtgtaaatgttgtgtcattatgtgtcgacttggatgtatgcattacataattttattttatatatgtttttaattgttagagcatttattcgaaaattataaatattgaattttaatcctcagtcacttaataaaaacattattttaggactaaaaaataataaaagttgaaacagcaaagtagcgatagatttcgtgaaaacagagaagcggacatatcttgaaacacatg

SEQ ID NO: 14862 - DNA, 3000 bp, Unknown
  misc_feature (1)..( 3000): cDNA_ID_3019525_gDNA_ID_2684231_Annot_ID_192270 3000 nt of promoter + ATG
taatcaccccaaaatcaaagagtttgtattaataaaccgctctcattcttgttgttgtttgaaacagatcttgagcctgatcagactccactaagctggtatactcggatgaaaatcgcggttggtgcagctcgtgggatagagtatctccactgtaaaataagcccgtctgtgatttaccgtgatttgaaatccgcaaacattttgttagataaagaatttagcgtcaagctctctgattttggactcgctaaggttggtcctgtggggaaccggacacatgtgtcgactcgagtcatgggtacttacggatactgtgctccagaatacgcaatgagcggaagattgactataaaatcggatatctatagctttggtgtagtgttgcttgagcttatttctggcaggaaggccattgatttgagtaaaccaaacggagagcagtaccttgttgcttgggtaagtaagattaacaattgtaaccagattaaaccggaacttaatctctcgtttaatttaaccgtgttttttttttcattttcgcgttaatgcaggctagaccgtatctcaaagatcctaagaaatttggacttctagttgacccgttgctacggggaaagttctcgaagaggtgtcttaactacgcgatttctataaccgagatgtgcctaaacgacgaagcgaatcaccggccaaaaataggagatgtggtggtggcatttgagtacatagcctctcagagcaaatcttatgaagatcgaagaacggctcgcaagtctacggactctaaccggttaagacgggaaacaaaacagagttattaattaaattgtatgagtcctaagtgaaacctctgctagaatcagaaggttcctgataaggccgcataattaatgtttgtactttttttccgggtgtttttgtttagtcagatttaagaatgggatttggtcggataaagaggtttttttttttggcttgaggtaaatggtgctttgtaaaaaaacttaaaaataaaaatgaactcttacgtttaaatatatattataggtatatactatatacgatgttattggtgggtcattaatacaaatacatatgcgtacactgtacacaagtgatagttttgataaataatatttcaagtgagctagttagattttaatacaaataatttcaaaatatatcttcaaattttaaacgtcgatttcagagtagatcaagattgtgacatcgtcaagggctaatcttttgattctttcttgcaaagaagaggacatgaaatcataaatgcaagtaggtgactaactgatttacgcggacgtcgaattatcgattatactatatatttatgtcaacttgcattataccacttaatccgatttacacatactatttcccatgtctacattacatagatatataatattcgcatattgcaggtttatgattgaagaagaataaaataacatctccccacgttttacatcggtctacgttatacatcggtctagtattactactataatatgcaatgtttcaaactttacgtggaccgttagtaaatgtgtttgtgaaagaaagaaagtcacacacatgtgtaatcgactgtttttttgtcttttgctacaaatgttaatattcattggaatgaaagttgaggtgctacaaaacagttagacctatgtatatttgttttttggcaaaaaaaacaaacaataaaacaatggagttgggacaaataaagttgttttcatcggagagccaaaaagccattaaagttgtaatcgactgttaaacgaaatgttttgttttaaccaaatatcaacatatcttatcttgctcagtgaattcacatatatagttgttagcaaaacaaaagatcataagataccacatacttttgaattttcttagatttatcatatatttttaaaattttctaataaagtttccatatgctgtcacgtttatatactcggacccgccattgctaaacactgttcttcttgtttgacctcttcccactgatatttttttagtttcttctaataaatgataccgtatatcatgataataaagattttcatatatttccgatactatttactgttttgtttttccacacaagataagaaagaaatttgttcactattatcttgcatcactcgatatctacatttttgtgagttctcttgttacgtcattgaggtgacgtatatgatcgttataatagtctatattgatcatgaacgaatgtgaatggtaatttggtatacgaggaaaaagaagtatggtacgaccgtacgagcacaagttgtaactttttttttgtttaaaaagaaacaatacagtagttacctacgaacataactttaatgttatgatactttttatttgtaaaaacagttaaaggaacttaaaaactatggttcatcgtatatattttcgatctgccacccaatgagtgagcacggcctttgactctggactaaaattatattgaatattcatatacttgatatccaagtaaatatgaaattatatacatgtcaagaaaattgtttatcgtttttggattatttatgttatcatctagtagttttattgaaatagtaaaactcgagatacacaaatgagaaaatgtaaataagtagtctgaatcaaggactaattgacgttgaaatttttggaaataaatgtatatttcaacatcaaccaatcaataatcacgacgatatcaaatacacatatccttttataaaattaataatgaatatttccccaaataaagagttttgcttggtctttcctctcttcttctcagcttcttcctcctcaatctttcaattaaaatccccagaaaagaaagaaaaaagggacagttggagaaaaagattctctcaatcttatgatcgttaagggtgaaacaaagattactaaaaacagaggaaaaacagagtaaagattactcaagagtcaagagctggtttgatctta

SEQ ID NO: 14863 - DNA, 3000 bp, Unknown
  misc_feature (1)..( 3000): cDNA_ID_2731064_gDNA_ID_2684231_Annot_ID_192269 3000 nt of promoter + ATG
gttttctttatttgtttaagcttgtttgatgttaaagtatgttgttttgccttttatcttatctgtgaatgttttgtttacagcttcctgattattatgagattatcaagaatccgatggatttcaccacattgcggaagaaattagaatccggggcatacaccaccttagaacaatttgaggcaagtcttgtaattgaatccctctatacatttctgcgctttgctttagctaaaatggagtgttcacctttcatagttttggttcttcatattgttaagtcttgttcaagagtttctctggtagtaacaacatcgtgtttgcctacaagcgtgtaaggttttcttagttttcctagccacaatgtgttaattctaccatgagaaggtgcagatatactgttaaaagtgaaagccttgtggggtctgaattgtttcgttttgttgcagcaagacgtatttttaatatgtacgaatgcgatggagtacaattcagcagatacagtatactaccgacaggtttgtcttggcttatataaacttgctattttacttccttttgttataatccattctctgatagtatatctatggcatgacaggcaagagctatgcttgagttggcgaaaaaggactttggaaatttgagacaagaaagtgatggagaagaaccagtgtcactgtcacaacagccgaaagtagtcaaaagaggccgtcctccaggctcaggccttaagaaacagcttgagcaatctttgattgatcgcacgacttctgatatttctgctgatgcagcagcattcacttatgctggagatagctctagattatccggttcttacaatctaagaaaaaatcctccttcatatggattccgtcatgcagaaacttcggttagaatcaaccataatagcgagaaccaaagtggcttgttgatagattgggagaaggagtttccacgtaaagatctacttttctaatactaccttcttcagaccattataccaaatacgtttttgttgacataaaccattttgtgtagcttctgttgtgaaggctgtcaataaatacgggatgaaaaatgtcgacgagaacaggcgagatacctacaaccagaactctgcttccttgcaagattcttcgatttttacactgcttgatgataatttaaaacaattaactccagtacgtgcttagcaacttaaaagttaaaatatttctccttttgttctaagcaacaaagaatctgaccattgtttcgttattttaccaggttggactgaaagctgaatatgggtatgctaggagtctagcacggtatgcagcaaatattggtcctgttgcttggacatttgccaatgtaaggattgaaaaactgttaccaactggaaccgaatttggtcccgggtgggttggagagaaccctgagaatcctcctcaacagcaaaacttaatgtcgggaaagcaaaagtgttcgaatgactatgcatctgatgatcatcatcagtcaagtagaatcatgtctccatcaacctctgtctcaagctccatcataggaaacatacattcttcccatgaaagcaaagagtctgttcaggtattgaatcaagaaaccgagataaatggtctagtccgtggttccagcggatttaaccataaaccaaaccagatgctggaaacagctggctcgcagcaaggcaacataaaacaggaatttcagcggttgccaccagatctcaatgctaggctttcctcaccaaactcaccaggctctaaccaccaggcaggttcatcgcagcatccggatttggcgttacaactctaagtaattcctactaatattgaaagccttaccgatatatgagggagaagaagaggcaaaggcatgtgattcttgctacaaggttgaatatatagggaaagtcttatgtacagattgttgcaattttctgatttttttagggtaaaaagaaaaagaaaactgatcgataagagtactctcacaagatgtatgactgtaaaaaaatttgtacaatttcctagtccatcaaactagagtgtaatgaatgtactcgggattgtatatcatgtacgtttttgtttggtcttgtgaatctgtgcataatatataatactaatatttataaatatcgaaacttaacaggataagtagaaaaaatgattacaaagaaaagtagaaaaatattttgaaaactccgtttgaaaagattatgatagctccctgtgattaatcaaaagtcaaaacacagttattaggatatgtttgggggattatgagaaaccgtgtctcttaaatagtcagtcttacattttgataatgttatatacgttacagtatataataagtagacagcttaaattagttccaacggaaaaaaaaagaaacaaacgttgaagaaacagaaggaaggaaggaagaaagaaagaaaacgacgcgcagttccaaaattaggatcatattggctcctttaatttctcttccgttgccatttcaaatattttcacagttgcttcctttcaccactctttttaatatttctctcaacatttttccattagcatataagagagtaaaaaagcctgtttcttcttcctcttttagtatatatataaacaaaccattcttcaccattcaaaatgccatttgtataattttagtttttctccacttttcagattcttccttaaggaatcattttcccatttttctggaattttaagagagaaagagaaaagctctctttcccatttataatcccaaagacacaaatcctaggttttttcttctttcttttattacaagaaaccttggttttttgtttttgtttgttctgtttcgtgtgtagggttccgggagctgcgtttgatgataatgttggacatcatctcaaaccagctccgtctctgaatccattttcttcaaccattgttgttgtctttacgttaaataatatcatctttcacgagtttattaaggaaa

SEQ ID NO: 14864 - DNA, 3000 bp, Unknown
  misc_feature (1)..( 3000): cDNA_ID_2731072_gDNA_ID_2684231_Annot_ID_192266 3000 nt of promoter + ATG
tagacttttacgtataattaattgaaattaagtttagatgctaaaacgagttctattacctgacatcatttacatacaaagatgatgtctttctttctttctttttgtgaaaacacaaagatgatgtctaaaagactaaaaagtagaatgagatgcatgaatgaatagaagataattgcaattactttcaaaaatatctttacaagttggggaattaaatttaaaagtatgtaacaaagatttgggataaaacttgtcacatctagtgcagtttaattaacaaaatttcttttgggataataaaaccaaaagcgacctcatcacttaagagctttcacatatcgccgcctctaataaaaacattattgtagatattataattaatcatacatagagatcacgtggaattttgtaaaagtcactaacaaatctaacgataaaattggtgacttgtctcagtctctttttcagtttttcttttaccatttgaaaacgatctttgatcttttcattttccctctttttgagtgatgatgatcagtaagcaaatcttgagcataccccatcttcggattctgaagatcaacactctttttaactcagattttggtactgatgttgatgttccgagcagcaccatctcaatttcaactaaaccaaaccgctctgagttagtttgtttttcgatggtccgggtttggaattggttagtgaaatcatgacgaatttcggcttgatggtttagcatgtttttaccggttaagttatgtacggttcatgatcaatggatctctgagggatctaggagtgtttaagtctacttataaagtcaaactacatattgctacgaaccctattatccgacataggaacaacgacatttcctttaagagatgatgatttggaagatctctgaatttgattaattggtagaattaaaatgtgttcatcagcagtggtatcaatacatttctcagatgatgattgaaaaaaatgcagttacaggtcataccgcaagttccattttcccttcatgttcgcgttgagagtccaattgttttctctaatctgcatataagggacctgaaaggaagaggcaaacattgttctgaagaattaaaaaaaaatggaaagcatttttcgagttttacaaatgatataaagcctgaaaacgatgacaatcgatttcaagagtgttggcttaggcaatcatataagagtcctctaagcaaatagatggattatcaatgatactatgaaatgaaaagaactttggtttcaacaaacactctgctttgtgaacttagagattaaaagagcaaattttggaagagtcaacacacttccaggtacgagagagataccttatcaaacatttcgtagccaactttgatccgtacatcctgatcttccttgaaatccattatgttccaggcaaattctgctgctcctttggggttcttctgttagcacaaaatgatgacagttccgttagggataatacacaaggaagaaacataacttcaaagaaagttcccgagaccaagaaaaaaacatcgaacctgatttaagtcctgatcaatatcacaccgccctttaatattaaaggttacacgcttatcagctcttacaggaaactctttttttccgcgtacaagacaccgaagcttttggcgcttatcataatgcaatcctaccccaaggcctgttgaagcctaagggaaatttgtaacactatattagtattagtctacagcagaaaatgtttcacggtgacaaaatagaagaaacagcagaaaatgaaatcaaacctcaggaaaaaagtgtctaatcatcgcacagaagtaactcggagccccagttccagtatctaactctccatgaagctagcaccaaacaaaaaaccatcaaggaaattaagaaatcagaaacatgtttgcaagaaacgaaacataatccggctatactgtagccaaagccaaacaactataccacaacaaccaagctgggaacatacactgacaaataataaatcaagattcccggaagcatatggatgtttctttgctaataaccattataaagaagttcaagacacaatttttttcttatgcctaacacaagaagtctagaacctagataacattctcaaaacccaaaaccctaacagcaaaaatgatgatacagaatcctacgagaattccaagcagagagcaagtgtgtaagacacaaactactcctcaatttggctcctgcaacagctcaatgctagaaatttgaacaaaacctaggtcacaatttctctcagattaggtttcataactccaagagctcctttaaagtaatcttatcttcttaatcaaaagttcaagacaacacagttcacttatgtaaaatgcacacaacattctccgaaacacccaaaataaaaccctacatatcctcaaaagcttaaactttgcaaatcccaagagacttttgggcattaaactccagagtaaagaaacttcccaagaaattgaatagagttaaagtcctccatagcaacaagaatacgaagcagacaacaaaaaacaaaattttcacctgtaaatgggtttttgagttcaccggaaccttctctttggcatgaatcttcatagacttggaattgctggtatacctcatagaagtctccattttcctcaaacgattttctcgagaaaatcgcctagaaaatcctcactgagtcaacaaaaccaaaacctcacctagtttttgcacacttcgactactgtatcatcctctgcaccaaggttcaccataatccaaccaataactcaccgccagctgtcctattagtaaaagagccaatctagtcccttaagcccatgtttagggcccaatatatatgggcttcgactagatccgacccggggaaatagccaatattttgttaaggtctctggttctctgagtgagtaagctagttcgaagactggtccgaaaaatctgacaagg

SEQ ID NO: 14865 - DNA, 3000 bp, Unknown
  misc_feature (1)..( 3000): cDNA_ID_2730534_gDNA_ID_2684231_Annot_ID_192263 3000 nt of promoter + ATG
catttattgtttctccaccttctccttcttcttcctcttcttctttccttttttttttttattgcaatttttcttataagttagtgatggagggtgacttaattagagtttgtatctagtcgaattccaaaaaaaaaaaacagtaaaaattggtgggtcaatccacttgtgttctgaaattttttaaactaaaatatctatttcgatgtgtaatatatatttttgcagtttaactttaacatttataattgatattactcattgtttttggtattttctctacaggtaaactttatttttgttgtcatttttctaaaataaaatattgtaaaagctttttaaaatggactttgatacagacattttaaatacaaacagacaaagacgagcaagagaataggggaccctctttgtcatttgattgacatatacaggtatatactataaaagaaatgtgacaaacagtcatctatattcattttagtgatttttgtttcacctaatctcttaaagtttaagtgtcacattatactgtatattactagccctgtaattctgaaacaaattggactattattttatacactagttctgtttacacagaccagtaccgtttctgctccttaactggattaactttaatttttactatatcaataaataactgaaatagtgcatgttactgaaatgacgtacgagtacaaaagatttccaaattattataccagatacacatattctgccaagtttaatgatattattatcgcagacagattagttttaaaggatgaaaaaaaatatactttgacaggggccaataatattgttttgtgacgcaggtgaacagcactataatatatatagcagaccgatggtatcacttgggcaataattaaactgaaatagaaaaaaataacaattttgaaaaggataaaaaaagagagtcacagaaatattatcagagctataaagattatagatcccctgacgaaaaataatttagattgtaaatagtacagaaactatatataataagcatttaataatggataggcttaggtaagcctatgcaagtacagcaggttttgaattattggatgaaacatttgtttcaaatattagattttaatttttataaatctatttgtgtaatacttatatatatatatatatttaaaaatgaatattatagggttgtgtaggggttagggtaaaagaatgacttgggagatttaacataagatcgtgtgggcagttaatatttagtgagatagatagatagtgtagtacgtttgcatttattatctttttacctgattcttttgtatcattctacacacacgtgccaccgccgacacctgctatctttctactgtttcattttaatttttatcttacatttttgtcaaacatttaatatcgacaatatgaattaaaagtttttgtttccaattatttttctcacaataattttttaaatagttgtgttgagacacttgacgaaactcatgctttatgtattgttggtttactataaaccgaacatgtttgcttcgttttttttttttttgaaaaaatgatagtaaaaatatgtgtcaaaaccgaaacacaaacaaccttatattccattttttattatgaggaagagtatagaatcaaccgaaccaacaaaagaaacaaagtgtaatacacagaattgagttaaccgttggagaaagtggttaaaggaaaaataaggaaacgatcgaaaggaattggtatatatctgaggggagaatgtgtataaaataaaagaaaaaaaggtctgactcatgaatgtataatgatatgcttacacccgcacgcataaacctctgccatctttttactgcacactcttttccttttctcttctttaaagtcaattttatttgctgataaccacaaaatgtagcaattttagattacattatttgtttcacatttcttgaaatctgaaaacttttaactgcgactgcaattgttttggttgagaaatcgatcgacttggagtatgagattaccttcttatcagtgtctttagtataacggttgcattgcatatatatttcctctcaaactttaatgatatcagttcaactagtctggatcaaatgtaatattgatactttccttgaaaacacattatttggtgcgtgggaagaatgatcttaaagagatgataaagggcactagagttttggttttctttgtaaaatagtgtatttatgcaaaactcaacattatatggatgtttgcattatggtatttttcaactaatatacacccaaaacagtatccttattaaacagctctctctctcgttttgttcaaactaacaagagaaaaatgtcagcttttgttgaaaaatagataaaaattatgacataaaacccaaaaccaaaacgtcaacaccatttatcataaattacatttgtagttagctaaagtacaaaaacaacactgtaaatgatccattgaccaatcgagtagtcattaacgaaagatcacaacttaacatcacccagtctaatcaaaactccaagaccataagaattttgctaaagcagcagtatagtgataaacacacaaaacgggaaaagttgttttacaatttagaatgtcatatactttaattattatttgcatagggaaaaatagaaagagactcactccccaggtgagggcaaatagaagcccctgctccctgaatttcacagcctttatcatcaatgctcctctaacctcaaacactcaaaatccacacatctatacacatacctctacatacacactccattttctctctctatctctattatatcttcgatttatgtgccattttggtatataaatatataatcttgcacacaataaggttatacttcccatcaccttttgtatcattgctatctttgttcttccttctggtgtctcttcagtgtaacaaaaagtctctttttcagttatattaagtaaaag

SEQ ID NO: 14866 - DNA, 3000 bp, Unknown
  misc_feature (1)..( 3000): cDNA_ID_2730530_gDNA_ID_2684231_Annot_ID_192261 3000 nt of promoter + ATG
atttcactgggacattgatagactttacgaaattcgatgttgttcctcgttggagctgtcaagaacagagattgccgcagaaattgatgaacatcttctggaatctggaaagaattagctccaagaatatgaattttgtaaactacgatgaatcagtgaagactgtgagagtgagagagattgagaggacctgtaatggtaacgcggggattcgaaaagctctgaggagaagataaccatggagaaatcgctgccatgtgtttcaagatatgtccgcttctctgttttcacgaaatctatcgctactttgctgtttcaacttttattattttttagtcctaaaataatgtttttattaagtgactgaggattaaaattcaatatttataattttcgaataaatgctctaacaattaaaaacatatataaaataaaattatgtaatgcatacatccaagtcgacacataatgacacaacatttacacaattctgtttttgataaaatgtagaaaattataaaataatgaatatctttgagcaattgacgaccccaaatttttaaaattatttgtattaattagaatgatgaatactgaacaatgtacaccttcctagttagttgttaaatattactgtacttggagacactttcatagtttttttcaatcccaaacaataataaaactacccaaccatcatattaaaagtatctattttcctaaataagccacatatatcttttaatttcatcatttctaacttaaaatttttagtactttatctaatacttttgtaaatatttcgagtgatattaacttttagttttaccttagtcatagaataaattatgccagcagtagttggtcatccacatcttttacctgctggcatagaatagtttaccttagttttcaactaaaaaaacataagttaccatagtcatatttcaactttagtatacagttgaaatatgacagagcatgtaaaaatgtggatgtttttggttacaaggtttctttagtcagaatggtcaacaaagtttctgacacgtgtcttattcagagtggttactttgaccagctgctagttatatttttgactcatcaaattcaccggcaaatccagtgagtaacgacggtcacgctgttccacgaagcttcgctgtcaacaccatcatcggaacttaccggagttcgttacggtaccttaaacccaaacccttctccgttttcgctttgttgattatcttcttgagtgacttcgttttgagaatttttctgggtttcggcattgtggaatcgaaattagtttttttttttctgttttgggtctcctctgtctcctttaactccattttcctacgaatctgtttctttaaccctaggaagacgaaaattatcgcttcatcgccacttattctagggttttgaatgcaaagaagaactaatttcataaacctgattgagcttagatttcaaatgatttcgactgattcgtactatgaaactcatcttccacatttagtttctcaaatcatttgagaaatctagctcaaacgattcgagtttcagaacttttgttcatcaaaattaagaatttggtcatgatctagcttagtttgtttcttcccttgtactttcaatttgatgttcttggaatcttccttcagagagattagatccttttactcataaagttttaacctttgctctgtttgtatagaaaaatcttataggtctctttgcttttacatcttcaaacttgacttgtgcttgtgatttgattgttgtcttcttcttttgctttcttaattgtgatattattaacaggtaggtttggattctatctcttgtgaaaaaaacagaaacacaaagatgaacgctgagaataatcagactactactactcactcgaaagtgatctcacatgtattctgcactggtactgctaagctaggctctgttgggccacccattggtcttgttgatattggcgtcagcgaagttgcttacatcttccgagtctctcttcctggcattgagaaaaatcaaggtaagccttcacatttcttttctccttatgtcctgttgttggataatgaaaataacaacctgttaataccggaatggattcctcatgttttgggttagataatgaccaatgacgtgaaaagaaagctgctttcttttacgctatccgtgtatgaaagcaactttgacccaaaatgctatcttctgttctgttaatagataagatcaaatgtgaaattcagagggaggggagagtttgcatccaaggagttatacctgagattgcgattccaagtgacacgggatgcttatacagaatgcaagtgcaacagctctgtccgcctggtccattctcaatcacgtttaatcttccgggacaagtggatcctcgcttgttttctcctaattttagatctgatgggatctttgaagtcgtcgtagtcaagctcggagtgcgcatcccaacttcatagttccggttttcattcaaccacgatatcctccatgcttaatcagcatttagttgcagtggccgacctgtaagtctttggtcggatttagcagaggttagagactcaagaatgttctagtttcttttgtgtagaaccatgtccaatgatccggttccttaagatgttcttagactctgaaaaaaagcaccttgatgtgaaacggaactgttttaaccaagattttggcaatcacatcttacaactaaaactctttgtaccaaagagggaaatttaaaacttataatccaaattttataaataaagttgtcaaagtcaactaaagaagtggactcgatccagggaggtgttgtgttcctcacagtcaaaccaaagcatattccatatttgtctccaataagaaaaaatctccaaaaacacattcaaatgaaaaatacaaagacttctattgttctcattctccgtatcttgaaaaaattcttaaaaaatcgacgaaacg

SEQ ID NO: 14867 - DNA, 3000 bp, Unknown
  misc_feature (1)..( 3000): cDNA_ID_2730528_gDNA_ID_2684231_Annot_ID_192260 3000 nt of promoter + ATG
atcttagagctttgttcagcagattcttcatctgtaaactgtaatacccaaaagagagtcgttgtgttagacataagatactaataagataggttattgtggcaatagactagagttacctgtcctgtgacagtgtataaacggttgtaccatccgtttgttgccattccaattgcagagtacaaatgcttgcgagcttctccagggttttgtaaggtgtactcgatgtaatagaatcctgatcatagattgtgtcaacgaaacaatgccaagatactgcagagattctcattgagttgagatttttgtatttacccttagaagctctgctatcgattagctttgcagtcactcctactggtttttgccagcttctatccaatccactgacctatacataaatgtcatgttgacatttgtaaggaaatctttttgcagagagtttgtttgtttgtttcaattgcatgtagagagactaaccaatgtttcggcgaaagcttcgacctttccgaatgattccatcctggtgaagtctggacctagtccagtgatcgctatactcactgagacgatccatatacatcacctatcggttagctcatgacttctgtctgatccagagagtaaacaaaaagaaacaaattttgataaattttaccattggaagttgaagtttcttgtgggtaaaaagctgtgattgacttgaatccattaggttctgcttgcccgacttgccaatctttatgtgaatgcagatcaaattcattcatcactcataatgatttcgccactatcataagtatctgaaaacagagtttgattagattaccttgtgggattgatatctcgaatttgttcgtttcatctgtgtacacacggaaagcttctgatgcatctgagattcaaaagaagttgttattagaaattctcaaggaatcaatatcatcaaaaacacatagaatcaacaatacttgtctctgcaaatgcaggtgaaatggccaatggaaggaagaaaacagaggaagctatctgtaacatgacgtctcttctcttcatcccaacatgatctctagacctgtttactttaacagattcagaacaaacccagataaagaaaggtagtgaatttcactgggacattgatagactttacgaaattcgatgttgttcctcgttggagctgtcaagaacagagattgccgcagaaattgatgaacatcttctggaatctggaaagaattagctccaagaatatgaattttgtaaactacgatgaatcagtgaagactgtgagagtgagagagattgagaggacctgtaatggtaacgcggggattcgaaaagctctgaggagaagataaccatggagaaatcgctgccatgtgtttcaagatatgtccgcttctctgttttcacgaaatctatcgctactttgctgtttcaacttttattattttttagtcctaaaataatgtttttattaagtgactgaggattaaaattcaatatttataattttcgaataaatgctctaacaattaaaaacatatataaaataaaattatgtaatgcatacatccaagtcgacacataatgacacaacatttacacaattctgtttttgataaaatgtagaaaattataaaataatgaatatctttgagcaattgacgaccccaaatttttaaaattatttgtattaattagaatgatgaatactgaacaatgtacaccttcctagttagttgttaaatattactgtacttggagacactttcatagtttttttcaatcccaaacaataataaaactacccaaccatcatattaaaagtatctattttcctaaataagccacatatatcttttaatttcatcatttctaacttaaaatttttagtactttatctaatacttttgtaaatatttcgagtgatattaacttttagttttaccttagtcatagaataaattatgccagcagtagttggtcatccacatcttttacctgctggcatagaatagtttaccttagttttcaactaaaaaaacataagttaccatagtcatatttcaactttagtatacagttgaaatatgacagagcatgtaaaaatgtggatgtttttggttacaaggtttctttagtcagaatggtcaacaaagtttctgacacgtgtcttattcagagtggttactttgaccagctgctagttatatttttgactcatcaaattcaccggcaaatccagtgagtaacgacggtcacgctgttccacgaagcttcgctgtcaacaccatcatcggaacttaccggagttcgttacggtaccttaaacccaaacccttctccgttttcgctttgttgattatcttcttgagtgacttcgttttgagaatttttctgggtttcggcattgtggaatcgaaattagtttttttttttctgttttgggtctcctctgtctcctttaactccattttcctacgaatctgtttctttaaccctaggaagacgaaaattatcgcttcatcgccacttattctagggttttgaatgcaaagaagaactaatttcataaacctgattgagcttagatttcaaatgatttcgactgattcgtactatgaaactcatcttccacatttagtttctcaaatcatttgagaaatctagctcaaacgattcgagtttcagaacttttgttcatcaaaattaagaatttggtcatgatctagcttagtttgtttcttcccttgtactttcaatttgatgttcttggaatcttccttcagagagattagatccttttactcataaagttttaacctttgctctgtttgtatagaaaaatcttataggtctctttgcttttacatcttcaaacttgacttgtgcttgtgatttgattgttgtcttcttcttttgctttcttaattgtgatattattaacaggtaggtttggattctatctcttgtgaaaaaaacagaaacacaaag

SEQ ID NO: 14868 - DNA, 3000 bp, Unknown; identical to SEQ ID NO: 14861
  misc_feature (1)..( 3000): cDNA_ID_3019499_gDNA_ID_2684231_Annot_ID_192258 3000 nt of promoter + ATG

SEQ ID NO: 14869 - DNA, 3000 bp, Unknown; identical to SEQ ID NO: 14860
  misc_feature (1)..( 3000): cDNA_ID_3019503_gDNA_ID_2684231_Annot_ID_192257 3000 nt of promoter + ATG

SEQ ID NO: 14870 - DNA, 3000 bp, Unknown
  misc_feature (1)..( 3000): cDNA_ID_2037860_gDNA_ID_2684231_Annot_ID_192278 3000 nt of promoter + ATG
ggacctatgaactgctcttttccttatttggtaatgtaaatgcaccatatgaagagggcaacatgttgtcccaagtagactgttgtaaaaggattaacgctatagaaatggacatgatgagaaatggttttcagcacagtcctatctcaaggctgaatgtggttagtttctgctccatatagataggtcttgacctgttttaagcagattaatcaaatgtaatattaatctggaaaatcccttttaaggcgatactatcaatctttacttcttcattgtgtatgtttgtgttatatatcagaacaatggacttatcgtttacactttcctttttctttcccagcttagagctctcggagctgaaggtatggtgaatgagatgatccgacacctgcaaaaggctgagaacctcagtgctcacagcaatatgtatctaggaacgcctacatacaacatagtgcttcattcacttctcgaggcaaacgaagtaagttttcatggtctaatagctttatcaaatttccactggaccagcatatatagcaatattgatcgctacttaaattacatgcagactgacatggtgatcaatatattcaaacgtatgaaatcatgtggctgccctgcagacgttgctacctacaatataatgattgattgttgcagccttattcactcgtataaatcagcttgtgccctagtttccatgatgatccgtgacgggttttctccaaaagctgttacatttactgctctgatgaaggtaataacaaagtatctgattacaattttaaaagtttgctgccattgtttctcaagaacttgctacaagtaagtattcagttcaggatgaaagaattctacacacagtacagacacataccaaattttcttgaaccatcgctcacgctcagaacttccaattttttttttggaatctagcagcttattgctgttcatttaattttaattaactaaagctgtgtatcctcttagattttgttgaatgatgcgaatttcgaggaggcactcaatctcttggaccaagcggcattagaagagatacatcttgatgtcttatcatacaacaccattttgcgtaaagcgtttgagaaggtaaagatatttgttgtaaaaacgcttaaagtaatgaaagtgaataaactgctttagtatacacataacttttgtctgcagggaatgattgatgtgattgagtacatagtggagcaaatgcaccgagagaaagtgaatccagatccaacgacatgtcattatgttttcagttgttatgtggagaaagggtatcatgcaacagctatagaagctttgaatgttctgagcttaaggatgctcaacgaagaagacaaggagagtcttcaggacaagaaaatagagctagaggaaaatttcgtcatgagcgaagaccctgaagctgaaacaaagataatcgaactgttcagaaaatctgaggagcatcttgctgcagcacttctgaatctaagatggtgtgcaatgctcgggggccggataatatggtcggaagaccaaagcccctgggccagagcactctccaacaagtacggttaataggtagaatgggaagtgttttcctgaataagagctggtgttgattatctgccatttcactaagctgctccgttttggttttgtatcctatacaaactagttagtgacaacacagttttggaggtcaccaatcgattcggttagatgagacggatcaacaatacggttagaagcatttttaagcggctacgaaccacctaaatacaaggcgacttgcgaaccatcaaatgcgagttttgttatttactttagattcttactgtaacttttgtttatttttacctttcaacaactgtgtatcaaagaattagccaaagatattccaattgcacctggttatacaaagttataagtatgttttctgaatatggatttaaccacttttgaaataaaggtaacaagtgcaatgcatatgatattgaaacttgatcacttgaaacaaagaagagaatatttactgagaaaacataaaggacagatggaaacgacagaaacaaacttaataatgttacaacttgctcctgtttttcttttgtagtttactcatccaaatacaaatcactgtccatagatagaggaccaatcctttacttagctgatttcaaaccatagaataccaaatttctaactaaagtatattgtacaacaatgcaaaacaaaaaataatgatactttcctaaattttaaataaataaaaagaagaagatattttctcttttaaccaaaatgatttatgtttgttacttaattacattactcactaactattatcttttacttaataactgaggccaattctcttcttctttgtcaactattagggacatttgttttttttttggccgacttggggacatatatctttgagtgttatatgtatgtgtattccattgattcatataaaggccctgataataatgtttttatcaatgtgataacaactaaagttaggcaaatatgagtttaaccgaattacgtataagctaatactcaatttaagactagtaaaaaaaatcaatgctgccgactgccgtcattaaagattttgatattaatctttgctttattttaccctaaatgtataatgtaagctaatatatatcaaataattgttagtcaaaagtcatcaaaattaacagatttttattaaacagattgtaataagatggaaacctctctataagaagtgctcaaaaacaaaggaactcaatttctctctctctctgatgattttgtttgtttgaagaaaagagaatattgttgtttgtctctcgtgatcgaaacaatgctttgtgattctcaaatacagtaacattttcaacatgctttgattccaaaaatccaaactttcattctctctctcaatctctctatatctccgagcagcgaggtagttgcacggcggccgcc

SEQ ID NO: 14871 - DNA, 3000 bp, Unknown
  misc_feature (1)..( 3000): cDNA_ID_3019521_gDNA_ID_2684231_Annot_ID_192277 3000 nt of promoter + ATG
gcctataaatactccacaatttttatatgattttagtagctcaatagagaataacaatagaaaagaaatggaaggaacaatgaggtgctcagcgaattacgtcccgctttctccgatcagctttctcgagagagctgctgtcgtcttcggctccagaacctctgtcgtgtatggtgatattcagtacacgtggcaccaaacacgtgaccgttgcgtccgccttgcatctgctctctctgaccttggtctctctcgccatgacgttgtaagtggttaaacgacttttatatattggtcatacttttttcttttgtttaaactatttcttttatcaggtggctgctttagcgccaaatgttcctgcgttatgcgagctttattttggagctccgatggctggagcagtactttgcgtgttgaacacgacattcgattctcagatgcttgcgatggcgctggagaaaacgaagccaaaagtattcttcgttgactctgagttcctctctgtcgctgaagaatctctcagtctcctctcaaacattgaagaaaaacctctcatcatcacaatcacagaaaatccaacagagcaatcaaaatatgaacaatacgaggattttctctccactggaaaccctaatttcaaaccaatacgaccagttgacgaatgtgatccaatcgccctcaacttcacatctggaaccacatcgactcccaaatgtgtcgtctatagtcatcgcggtgcctatctgaacgcaactgctgttggtgttatgaatgagatgaaaccaatgccggtttatctatgtacagttcctatgtatcattgtagcgggtggtgctatatttggacagttacggcttttggaggagtcatcgtctgtctcagggaagtcaacgacgaagttatatttgatagtatcgtgaagcacaaggtaactaactttggtggctcgcctccggttctcaacatgattgctaatgcaagagactcggtcaagaagtcgtttccatggaccgtacaggttatgagcggaggatcctctcctcctgaggtaaaactaactatcacagagttttgaattacatgtttgttcaatcaggcttatttggttgaacttccatattttgaggttatatataatcaatcccttgctttatacgttagctccgtcacagtacattaatatttaacatagaatcatagtaaagatattaatttatttggacaggtcatgttgaaactcaagaagctaggattcaaagtgatgatggcttatggatgctcggaggtgtatggactaggaacagcttgtttgtggatgcccgagtgggagactctacctgaagaggagagtttaaggctcaaggcaagagatggtctcaaccatttcgccaaggaagctgtcgatgtattggacccaaccaccatgaaatcggttccacacgacggaaagactatcagggtaattgctctccggggaaatacagtcatgagcggttacttcaaggacaaggaagccactgaagcggcttttcgaggtggatggtactggagtcgcgacatgggtgttatagatcctgatgggtaagtaaatgaatcatgcattactttgaatgtattactttgaatttatttatgcttatgatgtttccacatgcgaagctacatacaatttaaagataggtcacaagatgttataacatgcggaggagaaatcgtgggatcaaaggagatcgaagggattctctatagtcacccggcggtttatgacgcaggggtcgtgggtcgaccggacgaaactttaggagaatcgatgtgtgctttcgtgaagctcaaagaaggagctgaagcgagagaggaagagatcattgagttctgcaagagaaagcttgggaataagaacatgaagatgattccaaagacagtagtcttctcggatgttcctaagactcccactgggaagattcgaaagaatgttctgagaaagatggccaaggatatgggttatgttcaattgagagctgtggagtaaatgaaatgataatttatcaatgcatctaataaagttataaaaaaaaaaaaaagtgtaaactttaagctttagtttatatgttctgatgttctatgttattttgacatttataaaaaataatgaagtctcatttctagtagactgatcttaacataagacaaaaatatatatatcagtagatgataatgggtatgactcggcaagtattattctcttgatactattatgtagtttcattgtttaagcacactgatagtttaatactattatgtcgtttcattgtttaagcacactgatagtttgatatttttgtatcaggtgctgttgattgaattatgtttttttttgttcttgatttactttttattggggtagtattcatgatgattaatggagactatgttatgtatataatgttagaaacctggaaatatctttcacaagttttcacctttaagcaattcattttgatagaaaaataaatattatgagattaatctttcttccatggatcaaggcaagctaatagctatcatacaaacttataccagcccagatcaaattaaaccggagagaaattggaatgcccaatcagaaatgcataaatgggccaaatgtgaagaatacggcccaataattgttttttccatcagaatgataaacctgaaatgttttcttttcggcaagcttctctcctcttctaacatggtcgcatctgctagaaccagatacacataattgaaacgagtttcgataaatggaaatgttcgcttactgatttagagtttagatttttagtttgtgaagtaagttttcgccttttctaatctcgaagaacctcagaatcgagcctggaaagccatgtacagagctctgtaagttgttttggcaatttttttttttttttttgtgttgcctactatttcaataaatgttcattgacttgcttcgtgtttgtgcaatgaag

SEQ ID NO: 14872 - DNA, 3000 bp, Unknown; identical to SEQ ID NO: 14859
  misc_feature (1)..( 3000): cDNA_ID_2731082_gDNA_ID_2684231_Annot_ID_192253 3000 nt of promoter + ATG

SEQ ID NO: 14873 - DNA, 3000 bp, Unknown; identical to SEQ ID NO: 14867
  misc_feature (1)..( 3000): cDNA_ID_2730528_gDNA_ID_2684231_Annot_ID_137608 3000 nt of promoter + ATG

SEQ ID NO: 14874 - DNA, 3000 bp, Unknown; identical to SEQ ID NO: 14866
  misc_feature (1)..( 3000): cDNA_ID_2730530_gDNA_ID_2684231_Annot_ID_137609 3000 nt of promoter + ATG

SEQ ID NO: 14875 - DNA, 3000 bp, Unknown; identical to SEQ ID NO: 14865
  misc_feature (1)..( 3000): cDNA_ID_2730534_gDNA_ID_2684231_Annot_ID_137610 3000 nt of promoter + ATG

SEQ ID NO: 14876 - DNA, 3000 bp, Unknown; identical to SEQ ID NO: 14864
  misc_feature (1)..( 3000): cDNA_ID_2731072_gDNA_ID_2684231_Annot_ID_137612 3000 nt of promoter + ATG

SEQ ID NO: 14877 - DNA, 3000 bp, Unknown
  misc_feature (1)..( 3000): cDNA_ID_2781978_gDNA_ID_2684231_Annot_ID_137613 3000 nt of promoter + ATG
caaacacgatgttgttactaccagagaaactcttgaacaagacttaacaatatgaagaaccaaaactatgaaaggtgaacactccattttagctaaagcaaagcgcagaaatgtatagagggattcaattacaagacttgcctcaaattgttctaaggtggtgtatgccccggattctaatttcttccgcaatgtggtgaaatccatcggattcttgataatctcataataatcaggaagctgtaaacaaaacattcacagataagataaaaggcaaaacaacatactttaacatcaaacaagcttaaacaaataaagaaaacttcacctcctctggatcagctggatcagagtacactccataagtatccttcctgcaagtatagtaaaacaacaatcaatcaaaaatagaagaacatggtacatggagaaggaagatatgtcagaagccataaaaattgacatacttttgaactctatcaagaatgaagaacaacaactttttgtctggcaaaggtgtagactccacaagtgaccctcctgtccacaagttaaaataccacaatctatttaattaattaccacaaaacaaatcccaagtttctgccttttcataacttcaaaacaaaaaaacaagaaaaaagatatatactttgaagaagaatgtctgtcgctttcgaagccttttctccctgcagaagaaatacacaaaacagagtatcatcaacaacctcaagttaaaaagatcaaatcataacaggtgtctgtatttatgacaaaagtgagaacaagtacaattttttaaggaaacttaagaaactaaactgatagtaaaagacaaaatcagaacttgtctcagagacatatgattgtctcttcagtgcagaaaccggctttaatttttctgataactatgaattaataccagaatcagaagaatattatataatattcagacaaaaaagaagaaaagattaacaccaagattttctcgaccaagacaaaaaaaaaaaagaggaaccgaaaaataaaaataaatatacagaaaaagctgaaattatgaatttcccatttcccaccaacaaaaaaaagggaaatagtcaaaactcatcactctcactcaataaccatatttaagcttgcagacgaacctcaattaacgcgccaaaatatccaaaaaaaaaaacctaaaattaaaactttttttccccaaatgaattttcaaataaagattgaatttttatactctataactaccgtattgtcagatccgtcaattttccggcggttgcgtgcatcggagtccaaatcgccgccgccagatttggaattagaagaatcacgaccctcgtgtgaattcaatccgtgtaaaagccgatgctttttgtctctcctctcatcgtcgtcgtcttcagaatttgaattcctccggcgatttgatcggttgctgaaattagggtttctggaactggatctaagctcttcttcgttttcttcattgggatttcttctctgaagcaattgttgctgtttgagagctcgcttttggaggtcaagaagtgatggcctacctttcttcttcctcttcatcaatgtattattatcagctacctcacccattctctctcttctcttgtctctctctctctctattgttctccgcctttctcttctttctaataaacagtcgtttcgtgtttattcattttttgcttacacatgtgtgagtgagttcgtacgtgcagaccaaaattggacacgggttactcgtgcgtgactgcaatacacgtggtttacattctatggatcattttgggataacgtttttgagttgggccaattgggccttaattccatatagatgtctggattgtctgcaaatgtttattttttgggccactacataaaatctctagggtgattagatcatgattttgaagattatagattagatgtaataagaccatgtagtttaatggtttgttttgatgttgttactcactaatcactatatcattcctttttttataacatcttgttgcatacaactacagtaactagtctactttctttttttttggccagtggtgtttataaaattgcaaaacatctacattaactatttaactttattgatgagagtcatgagaccaataattagataattgactttttaaccaagaaagatcgaagaattaagcttttaatatagaaacaatgaaaccaacagcgaatgtttagtacattgaaaatacgataaagaagatttttttttttgactattaacatcatttaaaatgacacaaaaaacgttttattttgggtagtctcggtgttcacatgtgttttcccatgacgacttctcaataattgtcaaagctttttggtatatgtctattttctattttttgtcggtgtgtgttttttctttcccatcttttgcttagatgactgaaactctcttctagtttccatctttcttcctccggtctcgattcaggcacaaaaatatctctggcggattcatacttgactacaccgatgttgtgttacatggatttgactcgatttcacccgttttcttttcaaaggttttgaatttaaccagagatcgttctcaatttctcaagctagcagaagaagaagctaaagacctttgttcttggttaagacagcttcttcagggcttcttttgttttgaactggtacgtgtgttaatcttcctttttcgtgtgtttgttatatactagtactaattagtaattactatcctgagaataaacaaaattctatatttggtaatatttcctatattagggttaaacgaatgatgattgttagaagcaaattagttgcctttattattagggtatagttttgattttagctactgaatgttgttcctcataaaaggtagaagaacttagcttaatttggtatataagatctttgattacattatagtcttattatggtgtagaagaatcaattcatcagatg

SEQ ID NO: 14878 - DNA, 3000 bp, Unknown
  misc_feature (1)..( 3000): cDNA_ID_2731068_gDNA_ID_2684231_Annot_ID_137614 3000 nt of promoter + ATG
tatgaagaagcttgatagaagctaaccgcaaatcatcgttctcatgtatctcaacaaactgaaccaagcttatgatggcagctgagtttctgatggcagaaacaacattaataaccgagtttggacagctagtgagtccaacaagaaccgccaacagctttccttggatttctggaccagtgttgcttgttagttggagaaggttctccactatttcctctgaaacaagagtttggtgatgaggtccaacaggaactttgtcgaagtcgtacccaatgttcactatattggcaagaatagttgcagagacttctttaagtcggattggaagctggtttggcccaacatagaacaagtctttgataagcggtgggagaattccggtgttgattaagagtttagcactcccttcaaaggatgagatgttgttaagagctcccaaagcagcttcccgttggctcatgtcgcgagttctcataagatcgataagagaagaacccacagtctgagccacaataactttcacatcgttatttaaagcaagaaccccaagatagaaagccatggaaacttttgtttccggtgaacctgtagatgcagatcatgttacatagttatagtttcattcaaaccaatcagtgaaaatcagtttattggtaatgaaaggttagtggtttggtgaaataatcaccttcaagaagtttagcaagaagaggctgcagtctaccattgatagccatctgtcgaacattttcctctgacctctccaaatttgtcaaagttttatcagctttctcaacagttgaaacattctctgatttgctgcttgtcagaccaaccaataagatgattgctccatggattgatccaatcttctcgcataatgcttcagatttagagagctcaaacaacacggaaacagctgcttccctcccctttgatggctcttgagacaagaacttaactatagtacgcacagtgtctccttcagctactattgcctgaaacacactaaaaatcacttacaaaggaatcaaagacaaacagagagacaaacaaaaacacaaacagagagataaccttgctctcttcatctccttcaacgactacttgaagagtttgtagagccttacaccgcacttcatgactactactctttagcatatcggtaatcaaccgaacaagctgaggattgcacacacgttgcctaattttacgtatattcctacaaatctctctgacattcttcaaagccagcaaaatattagtctcagcatttcccaaataaagtgactgacgagcaatatcaagcttcaaagcatcattccttgctctccactcttcaatagtgttacgtaaagctatacttggacttagatcagtgatactcaactccttagaagttataggacaagatagaggttgaccgttttcacgacattcttgaaaccatttctcaatagcttcacgctcaaatgtctgaccattctctaaagtgacaggattatgcataacttgctttgtcaatggacagataaaagcttcgtatatgttatcaatccctggctcgaattgtgagctgttatccgattggcttccatcccaacttccacttccagccatctgatgaattgattcttctacaccataataagactataatgtaatcaaagatcttatataccaaattaagctaagttcttctaccttttatgaggaacaacattcagtagctaaaatcaaaactataccctaataataaaggcaactaatttgcttctaacaatcatcattcgtttaaccctaatataggaaatattaccaaatatagaattttgtttattctcaggatagtaattactaattagtactagtatataacaaacacacgaaaaaggaagattaacacacgtaccagttcaaaacaaaagaagccctgaagaagctgtcttaaccaagaacaaaggtctttagcttcttcttctgctagcttgagaaattgagaacgatctctggttaaattcaaaacctttgaaaagaaaacgggtgaaatcgagtcaaatccatgtaacacaacatcggtgtagtcaagtatgaatccgccagagatatttttgtgcctgaatcgagaccggaggaagaaagatggaaactagaagagagtttcagtcatctaagcaaaagatgggaaagaaaaaacacacaccgacaaaaaatagaaaatagacatataccaaaaagctttgacaattattgagaagtcgtcatgggaaaacacatgtgaacaccgagactacccaaaataaaacgttttttgtgtcattttaaatgatgttaatagtcaaaaaaaaaaatcttctttatcgtattttcaatgtactaaacattcgctgttggtttcattgtttctatattaaaagcttaattcttcgatctttcttggttaaaaagtcaattatctaattattggtctcatgactctcatcaataaagttaaatagttaatgtagatgttttgcaattttataaacaccactggccaaaaaaaaagaaagtagactagttactgtagttgtatgcaacaagatgttataaaaaaaggaatgatatagtgattagtgagtaacaacatcaaaacaaaccattaaactacatggtcttattacatctaatctataatcttcaaaatcatgatctaatcaccctagagattttatgtagtggcccaaaaaataaacatttgcagacaatccagacatctatatggaattaaggcccaattggcccaactcaaaaacgttatcccaaaatgatccatagaatgtaaaccacgtgtattgcagtcacgcacgagtaacccgtgtccaattttggtctgcacgtacgaactcactcacacatgtgtaagcaaaaaatgaataaacacgaaacgactgtttattagaaagaagagaaaggcggagaacaatagagagagagagagacaagagaagagagaga

SEQ ID NO: 14879 - DNA, 3000 bp, Unknown; identical to SEQ ID NO: 14863
  misc_feature (1)..( 3000): cDNA_ID_2731064_gDNA_ID_2684231_Annot_ID_137615 3000 nt of promoter + ATG

SEQ ID NO: 14880 - DNA, 3000 bp, Unknown
  misc_feature (1)..( 3000): cDNA_ID_3019525_gDNA_ID_2684231_Annot_ID_137616 3000 nt of promoter + ATG
atttgagtaaaccaaacggagagcagtaccttgttgcttgggtaagtaagattaacaattgtaaccagattaaaccggaacttaatctctcgtttaatttaaccgtgttttttttttcattttcgcgttaatgcaggctagaccgtatctcaaagatcctaagaaatttggacttctagttgacccgttgctacggggaaagttctcgaagaggtgtcttaactacgcgatttctataaccgagatgtgcctaaacgacgaagcgaatcaccggccaaaaataggagatgtggtggtggcatttgagtacatagcctctcagagcaaatcttatgaagatcgaagaacggctcgcaagtctacggactctaaccggttaagacgggaaacaaaacagagttattaattaaattgtatgagtcctaagtgaaacctctgctagaatcagaaggttcctgataaggccgcataattaatgtttgtactttttttccgggtgtttttgtttagtcagatttaagaatgggatttggtcggataaagaggtttttttttttggcttgaggtaaatggtgctttgtaaaaaaacttaaaaataaaaatgaactcttacgtttaaatatatattataggtatatactatatacgatgttattggtgggtcattaatacaaatacatatgcgtacactgtacacaagtgatagttttgataaataatatttcaagtgagctagttagattttaatacaaataatttcaaaatatatcttcaaattttaaacgtcgatttcagagtagatcaagattgtgacatcgtcaagggctaatcttttgattctttcttgcaaagaagaggacatgaaatcataaatgcaagtaggtgactaactgatttacgcggacgtcgaattatcgattatactatatatttatgtcaacttgcattataccacttaatccgatttacacatactatttcccatgtctacattacatagatatataatattcgcatattgcaggtttatgattgaagaagaataaaataacatctccccacgttttacatcggtctacgttatacatcggtctagtattactactataatatgcaatgtttcaaactttacgtggaccgttagtaaatgtgtttgtgaaagaaagaaagtcacacacatgtgtaatcgactgtttttttgtcttttgctacaaatgttaatattcattggaatgaaagttgaggtgctacaaaacagttagacctatgtatatttgttttttggcaaaaaaaacaaacaataaaacaatggagttgggacaaataaagttgttttcatcggagagccaaaaagccattaaagttgtaatcgactgttaaacgaaatgttttgttttaaccaaatatcaacatatcttatcttgctcagtgaattcacatatatagttgttagcaaaacaaaagatcataagataccacatacttttgaattttcttagatttatcatatatttttaaaattttctaataaagtttccatatgctgtcacgtttatatactcggacccgccattgctaaacactgttcttcttgtttgacctcttcccactgatatttttttagtttcttctaataaatgataccgtatatcatgataataaagattttcatatatttccgatactatttactgttttgtttttccacacaagataagaaagaaatttgttcactattatcttgcatcactcgatatctacatttttgtgagttctcttgttacgtcattgaggtgacgtatatgatcgttataatagtctatattgatcatgaacgaatgtgaatggtaatttggtatacgaggaaaaagaagtatggtacgaccgtacgagcacaagttgtaactttttttttgtttaaaaagaaacaatacagtagttacctacgaacataactttaatgttatgatactttttatttgtaaaaacagttaaaggaacttaaaaactatggttcatcgtatatattttcgatctgccacccaatgagtgagcacggcctttgactctggactaaaattatattgaatattcatatacttgatatccaagtaaatatgaaattatatacatgtcaagaaaattgtttatcgtttttggattatttatgttatcatctagtagttttattgaaatagtaaaactcgagatacacaaatgagaaaatgtaaataagtagtctgaatcaaggactaattgacgttgaaatttttggaaataaatgtatatttcaacatcaaccaatcaataatcacgacgatatcaaatacacatatccttttataaaattaataatgaatatttccccaaataaagagttttgcttggtctttcctctcttcttctcagcttcttcctcctcaatctttcaattaaaatccccagaaaagaaagaaaaaagggacagttggagaaaaagattctctcaatcttatgatcgttaagggtgaaacaaagattactaaaaacagaggaaaaacagagtaaagattactcaagagtcaagagctggtttgatcttaatgggaaacatctgtcctggctctggatcttccactgttaaccacgaacctgtctccaccaaacccctcccaggttcatacacacatctctctgcttttttctttttttttggggccgaatccaaatactttagatctatttaccttttttttttctttggtatttttgacgattcttgagtttctttaagttcttgcattaaccccccaaaaaaaaaaaacgctttcctggatttttttgtttgtttcattgtgccttttcaattatgaaaatgtcaatgcttgctctgttttaacttttctgttaaagtctcaatgtttttattttcattaaatcaaactttcgtgtgtatcaatctatacagtgagacgtgtgcagaccccagagaataaaaagtttcctccgccgctggtggcg

SEQ ID NO: 14881 - DNA, 3000 bp, Unknown
  misc_feature (1)..( 3000): cDNA_ID_3019521_gDNA_ID_2684231_Annot_ID_137623 3000 nt of promoter + ATG
gaaatacagtcatgagcggttacttcaaggacaaggaagccactgaagcggcttttcgaggtggatggtactggagtcgcgacatgggtgttatagatcctgatgggtaagtaaatgaatcatgcattactttgaatgtattactttgaatttatttatgcttatgatgtttccacatgcgaagctacatacaatttaaagataggtcacaagatgttataacatgcggaggagaaatcgtgggatcaaaggagatcgaagggattctctatagtcacccggcggtttatgacgcaggggtcgtgggtcgaccggacgaaactttaggagaatcgatgtgtgctttcgtgaagctcaaagaaggagctgaagcgagagaggaagagatcattgagttctgcaagagaaagcttgggaataagaacatgaagatgattccaaagacagtagtcttctcggatgttcctaagactcccactgggaagattcgaaagaatgttctgagaaagatggccaaggatatgggttatgttcaattgagagctgtggagtaaatgaaatgataatttatcaatgcatctaataaagttataaaaaaaaaaaaaagtgtaaactttaagctttagtttatatgttctgatgttctatgttattttgacatttataaaaaataatgaagtctcatttctagtagactgatcttaacataagacaaaaatatatatatcagtagatgataatgggtatgactcggcaagtattattctcttgatactattatgtagtttcattgtttaagcacactgatagtttaatactattatgtcgtttcattgtttaagcacactgatagtttgatatttttgtatcaggtgctgttgattgaattatgtttttttttgttcttgatttactttttattggggtagtattcatgatgattaatggagactatgttatgtatataatgttagaaacctggaaatatctttcacaagttttcacctttaagcaattcattttgatagaaaaataaatattatgagattaatctttcttccatggatcaaggcaagctaatagctatcatacaaacttataccagcccagatcaaattaaaccggagagaaattggaatgcccaatcagaaatgcataaatgggccaaatgtgaagaatacggcccaataattgttttttccatcagaatgataaacctgaaatgttttcttttcggcaagcttctctcctcttctaacatggtcgcatctgctagaaccagatacacataattgaaacgagtttcgataaatggaaatgttcgcttactgatttagagtttagatttttagtttgtgaagtaagttttcgccttttctaatctcgaagaacctcagaatcgagcctggaaagccatgtacagagctctgtaagttgttttggcaatttttttttttttttttgtgttgcctactatttcaataaatgttcattgacttgcttcgtgtttgtgcaatgaagatggctttctccattgcgatttattgtgagctcgtcgtcgtcaaagttaacgccttacgtatctcgagttagttatctgttccctgtgtttcttcaattaaatttgaagacttattgcaatttgattaaatgggtatttgattatagggacgaggactaagtggaattgataatggggctggttgttcttgttctcgtagtgtcacgacaatgattggtatgtctgattttagcctcttcgtatggtctatttgtctcaatatctatttgatgttacttggattatgaaagacgagatttttttgacttaagagtgcatgtttccatatgcaggtaatgaattcattcgatgccaagatgagtcaaagatcttacagttgcagattgttgatgcccttcgttcaggagagaggcaaggagcgtcagcattgctttttaagttaatacaggggaattattcacttagtgctgatgattttcatgatattctatattattgtgctcgatcaccggatcctgtggtaagtttgatatatgacaaagtctccctttggctttgtttaatcttcgtttatctttcacaagttatatttcaatgaaattttggtagggctgagatgtaaatctgtaatttgtttctcataatacagtactcttgttgtctctgacctcaaggcagtaatttgttcctgtagtttgtcatggagacttacagtgtaatgtgcaagaaggaaattagtctggacagcagatctttgttgttcatagtaaaatccctttgtaatgggggacacttagataaggtataattattccactcgaaagccagtatttccttacataatgcgactaaaagagatgagtaaatagttttgggcatacttgttcaggcatcagagtttattcacgctgtcagagaagatgatcgtatatctcctcttctgcctatctataacttttttcttggagcctgtgcacgaacgagaagcgtatatcacgctagtaaatgtttggaattgatggatcaacggagagtggggaagaatggaataacttatgtagcacttctcaaggttagttaagaacatatcatttttcagtgccttaatctttttgtttttttcaagagctggtcgtatgccaactttaaaatttggagtgtagaagatctggagaggacttatctttttgttattgtctccatttctgtcttagctttgctgtcccttaaggactttcgtttgttccttgacatggaggtttcattttcattgatctgcataattatcttctttttctttgttatctgattaatattattttcagcttgcagtttttcagcgcaatctatcaactgtcaatgatatctggaaacactatgtcaaccactataacctggatatactttctctcagaagattcatatggtcctttacaaggctaggggatttgaaatcagcatatgaattattgcaacac

SEQ ID NO: 14882 - DNA, 239 bp, Unknown
  misc_feature (1)..( 239): cDNA_ID_2993295_gDNA_ID_2684231_Annot_ID_137625 3000 nt of promoter + ATG
ttcttcaacattggaatgtgttgcttcccttgatgcacatgttggtaagattaattggtgagttcattgtttacagtttcagcagtctatctactgggtgtgcttataagtgcggtggtttaaaaagtcttagaacttgtaactttcttatcttcactttcatgaagactctctatacctcttgtggaaacagcgttctttggtgtccctctggaaattctgacaagttaatcagcatg

SEQ ID NO: 14883 - DNA, 3000 bp, Unknown
  misc_feature (1)..( 3000): cDNA_ID_2731145_gDNA_ID_2684232_Annot_ID_137626 3000 nt of promoter + ATG
actgaccgtcgtagaagagcctctgggttgtatggaaacagtttcttctgatgtagcttaacaactgaattttgtaacgaaagcagacaatctttggcgtcttcaaaagcctgggcatgtaatctccagttttgttcaacctcagaagtctcaggcaaaacttttcttctcttcggagatggagcatctgtacttccttcaaatgggaattccacaaatagagtccatgaatcacatactgcacgcaagcatctaccaggaaaaaacagcggatgtcatatgggaatcaacctataagtatttgtttggaaaattcataacgtaatttgtaaactagagaaatcattcaaagactagagtacgagctaacatggctggtctcacacaaactaacagatcatatccaatcttattactcaagatggagcagttgatatgcaaattcttaagagaaaaggattaacctcagcaggtactctgcgcagctagccccaatatctttagatataaggtaatcaagaagtacttgatgatcataatgcagctgaaaacagaagacagaggtgaatgatgaacatattaccaagcctaaatggaaaatagcacaagagattatgagaatgttatatgaaaattacctctgaaagaaatatacagaataatcttacaggattgaacaaggttgataaacggaagagagtaatttgttcctcatcttcaagcgaacccccttccacgttaggcctgtaagtaaaaaaatgcccataagaactcacagaaatctagataactgtttgcagaaaggcaagtgttttaccctacttacaattcctgtctatgcaatggtacagacagcaattgcaggaggactttaaataatagatcatcctacagtttaacatagaaaagttataacagagctctagtgtatggtgttaaactaaaacaccaaatacgaatggcaaatacagaatgataacccaaacctcatgcatgaacagccgaacgaaggatgcagaaaattcaacattcttcttgctataaattctgtgatcagaaaacatattgcctggaatctgtcgttcaatccatttaaacatctctgccatccctttctttctacaatcaaactcacatagcttgtcgttatgtctacttgagtaaatcaaagtgaaggagcaccgtaggaacagaaacacagagagtctttgcaaatgattagaatgcatctcattgacctccctatcagacaaactcacaaagaatggcgaaccctccaaacaattatcttgaacgggtttaaactttgttagggtgtgttgaagaaagccttgagaatcccgttgcaaatattgcagccatgaaagaagaatggtacatttgattttggacttatcagtaagcctgatcatcaacacctacaaaaagggggagacagtcgtgtaggatgaagttattatccgagatatatcaagaaacaaagcaaagtggttctctgaacttgtaagattagaaacagatggaaatacgtaccagtaacttgtgccctaggtatcttgacatgcaagagccactttgacttttcaactttggttggcaccaacggaggagatccggaataagcttgatggttttttggaggatcaaatatgaaggttcaaaatcatcagaatcttctacaacatgaacctgctgaaccatggaacagagaaactggacaaagctcccaagaaatacagttgcttcctcactgtttccactctgaccttggaaatttctttcaccactaccatgctgatgagaaaaaatagtatccaatcggcaccaaggaacttttgcaagtgtagagttgacagattccaagtatacatcaaaaatttcctcattgtcttcttggctcaagcgcttcaatatattacgaagaactcgaaagatatccgacaccgtggaccagttagccttttccagcttacatttaagaacatcagaaccgaagaaacattgatctagacttccaaatccagtttcagatcctacagcaggaattgggaaactgtagataactgctaaccgcaaacattcacaaagcaaacgaatgaactcatcccattgacttccctaggaaaaacaaatgagtgagtatgagagctggaagaatacaacattctaaaatcccgagtgaggcagatgtaacatacagattcaacaagacaaccggatacttccacaagtatgttgccagccaaatgtttaacatgcacattctccatacccaacaaacaaacctgccagagaaaccagatcaagctaaggatcatagacaactctacctaacagcagaatgagaaacttacaagatccgccacaagtctttctaagcataaatactctatagagtctggaccatataaagcatcagcagattcatcatgatcaacaacagtctcctctcgcgattcctattgaaaatcttagctaatcaaatagctccaatactcatcaaccaacctatacaatcttaaaatattaggaattcttaaagcaatgaactcaccaccgccttatcacatgaaatttcgctcctccaagattgaatttctctcaacacctgtaaaaaaaaaaaaaactatccaatttaagaggaccggagcttcgaggattaacacacaggaagcaaaaaaatcatcgacaatgatgaacctgagatagagaaagaagcagatctttttccgtttccttcgtcggcaaagttacttcttctctttcctacatgactccgagaaccaattgcgtttatacaattacacatagttacaataactcataacgaaacggagaacaagagctgaagaataatacttacagggaattggcgaacacaaagatcgatcaagagatgaagacgagaagccaagtttccggtagccattttacaacgacgacagttcactctcgccggggatcaataaactcttattaaaacgtagcgtttttgttatg

SEQ ID NO: 14884 - DNA, 3000 bp, Unknown
  misc_feature (1)..( 3000): cDNA_ID_2731136_gDNA_ID_2684232_Annot_ID_137630 3000 nt of promoter + ATG
tgattccatgtatagtgtcattcgacattgtgatggaagacatagcttatgatcatcggttttgaacatgacgctaaaaatttgattaagatatctaattattaaaaattaaacttcttatatggataaaagatttagcatattttggtagcgtaatgtagatttgtatgtggtaggacaaaataaattaactacctatagcaaatgagtgaaaagtttgtatatatatttctaccctaaattatgttaaatacatgttttctgtggataatgttgtctattggcaacgactgttggcattacgctaactcatcaaggaatcattattacttctctccaattcatgatcagcttttgacacaagacaaaaaaacttcttgtgtaaaaaaagctaaagagaaaaaactgatgttacaaaaactatgttaatatgattcgagaagttaaaataaggagaacaaagaaatgtaactaatagttaaacttttagaggattttctgatttaaaattagaacatggtaaaatttataaaattatggtataaaaaaaactaaagatggaaaaattcttgtaaaattggagaattatttatagtagtgaactattactttgtagtataaaacataatatcatgtcaaaaatttaaaaatttgattttgtaattagttaagggagttgcaattatgctagaaaaaattcatttcaaaattgtagtttaatatgtagtaatttcatagtttaatgactatttttctaaatatatgatatatctattaaaaaattattttagtcaaattacaattaatgataagtacacgtgtcattaaagtagtgtaccaaatgtcgcattggtaggcaaagttaaaaaatgttataaaataatttaataatatatatataaaatatttatgactaaataaacattaaaatgtttaactacattttaaataaattaatcgttttatagttggttcagaacaccttggttgtcttggtactgtgaggaaacaacttaattttgtttagtgaatatctaaataaggtttcatttaacattgtcaaacttaaaaaaaaaaaaaggaagtaaactaagatgacaaataaatacttttttctatatagtaatctttagtaatcatagtctaagaatttccctctatttcatgaaaataaggtttcaattaacattgtcaaacttaaataaataaaggaagtagaccaaaaaaacaagtaaatactcttttctatatagtaatctttaatattcatagtctaagaattttcctctatttcatgaacttcttcaaccttcttctttgtcttctttgcctagacagaaaaaacaaatggagatacacaatcacggataatgagtaggtactttcggatttgattattctagcaagaataattatgcatctcaatggactttaacaacaccagagaaaactttgcatgtatttaccaaatatttatttagctagtatatcccataattgttgtgaaattgagaatttgaattttcaaagaatatactatatacaaatataagttagtgtagagcttagatgtttactgaacttgtaagaaacacatccaaactctagaaagatatatcgatgtacaactaaaatatgcaaaaaaaaatgaaaaacggatattgtatttggagctgagcatttgagacacttgagttgccaattgcttcttctcaagccatgcttgttatatagttgcattcttaagccatttttagttatatattaagtcataaattgtactttaatgtggtgatcaaaatattgtaacttatgagatataaagggtcataaatttttggatcaaagtactcctaaatagtgtttaataccttattacggttaagcagctaagaaaatgttaagagtatgcattaatggtaatctataatagtaaatataataattttttattatcaaaaacatataaatagtgataactttgtactctaaaacataatatcatgtcaaaattttaaagatttgattttgtaattagttaagggagttgcaattatggtagaaaaaaattcattttaaaattgtagtttaatatgtagtaatttcatagtttaatgactatttttctaaatataagatatatctattaataaattattttagtcaaattataattaatgataagtacacgtatcatcaaagtagagtgtcaaatatcgcattggtaggcaaagttagaaaaaactttctcttattatagaagatttttatctaaccagacttcttgtaaatccttcttatgggtcacaaacgcacaatcaaatgcggaaacataaaatattcacttgctttaacaactactagctgtaaaccaaacttaacaaagaggtaagcgaaacatttcactataattagtaggatcaatatgaaagaaaaactttttctatatttaatctaaatttagctaaaagagtttccatatgatagtcatcataatatttcacgataatgtcaatatagaatatacaatatttctaccaatataaattagaaaaacgagaatggacagaaacgttaggagatttcagtacacgtcagtgattaatccaacgtatgtacaaattcgatcatttagaatatgattatcttccctttttttctttagtttcatatataacttgaaacaaacaaattaattttcattgagaatgcttcactgctcgctcttctcttctttaatttcatagtcacaacaagttgatcaaaatattaatatttaacagaaaaaattaatccacattgagactatttctctactcctttttctttaattccataatcacaacaagttggaaaaaatcaatccaaataagtgtttttgtcaaaagaccaattcaatattgattcattcatatactaacctcgtgcgatcgagagctaaagctaattgcaataaatctctttgtaatttaagtaatccttaaaaaaaaactatacaaa

SEQ ID NO: 14885 - DNA, 3000 bp, Unknown
  misc_feature (1)..( 3000): cDNA_ID_2731133_gDNA_ID_2684232_Annot_ID_137631 3000 nt of promoter + ATG
aaccttcttctttgtcttctttgcctagacagaaaaaacaaatggagatacacaatcacggataatgagtaggtactttcggatttgattattctagcaagaataattatgcatctcaatggactttaacaacaccagagaaaactttgcatgtatttaccaaatatttatttagctagtatatcccataattgttgtgaaattgagaatttgaattttcaaagaatatactatatacaaatataagttagtgtagagcttagatgtttactgaacttgtaagaaacacatccaaactctagaaagatatatcgatgtacaactaaaatatgcaaaaaaaaatgaaaaacggatattgtatttggagctgagcatttgagacacttgagttgccaattgcttcttctcaagccatgcttgttatatagttgcattcttaagccatttttagttatatattaagtcataaattgtactttaatgtggtgatcaaaatattgtaacttatgagatataaagggtcataaatttttggatcaaagtactcctaaatagtgtttaataccttattacggttaagcagctaagaaaatgttaagagtatgcattaatggtaatctataatagtaaatataataattttttattatcaaaaacatataaatagtgataactttgtactctaaaacataatatcatgtcaaaattttaaagatttgattttgtaattagttaagggagttgcaattatggtagaaaaaaattcattttaaaattgtagtttaatatgtagtaatttcatagtttaatgactatttttctaaatataagatatatctattaataaattattttagtcaaattataattaatgataagtacacgtatcatcaaagtagagtgtcaaatatcgcattggtaggcaaagttagaaaaaactttctcttattatagaagatttttatctaaccagacttcttgtaaatccttcttatgggtcacaaacgcacaatcaaatgcggaaacataaaatattcacttgctttaacaactactagctgtaaaccaaacttaacaaagaggtaagcgaaacatttcactataattagtaggatcaatatgaaagaaaaactttttctatatttaatctaaatttagctaaaagagtttccatatgatagtcatcataatatttcacgataatgtcaatatagaatatacaatatttctaccaatataaattagaaaaacgagaatggacagaaacgttaggagatttcagtacacgtcagtgattaatccaacgtatgtacaaattcgatcatttagaatatgattatcttccctttttttctttagtttcatatataacttgaaacaaacaaattaattttcattgagaatgcttcactgctcgctcttctcttctttaatttcatagtcacaacaagttgatcaaaatattaatatttaacagaaaaaattaatccacattgagactatttctctactcctttttctttaattccataatcacaacaagttggaaaaaatcaatccaaataagtgtttttgtcaaaagaccaattcaatattgattcattcatatactaacctcgtgcgatcgagagctaaagctaattgcaataaatctctttgtaatttaagtaatccttaaaaaaaaactatacaaaatgcctcttaccgagattatcgcaggggctgctcttggacttgctctccaaatccttcacgaggccatccaaagagcaaaagatagatccttaaccacaagttgtatcttggaccgtctcgattctacaatcttgaggatcactccactgatggctaaggtcgaaaagctcaacaaagaatccgatgaatctctgaggaaagtcttcgaagatcttaaacatcttctcgagaaagccgtggttcttgtcgaagcttatgcggagctcaaacgcagaaacttacttggaaaatataggtttgtgaatcttttggtctcgtatatatatacatgaaataatgattttttttttaatcttagatacatgaatacttctacatattacttgatctcccaacattatatagacaccaattaaacaaaaacctatcatttttttttgtttcatgtatgtatttaattacatactaaagtgtactgttgttttaggtacaagagaagaatcaaagagttagaaggttcattgaaatggatggtagatgttgacgttaaagtcaatcaatgggcagatatcaaagatcttatggccaagatgtctgaaatgaacactaaacttgaaaaaatcatgggtcaaccaatagattgtattatatctgaagataatactaatatggacatagtcgaaagagttgatccatcattggaagcaaaagctggatgctcaaatagcgattctaagccgaagatcgatatccaccttcgatggagcaagcaaagcaaagatcacggaattcgcttcgttttgaattagttttttttttgatgtggtatgtgtcatagaccagcaaaattgagaaagaaaataatcaaatgtaaaaaaaaaaaaaaaattatacttacgaatattgtgttatcaacttatcatacatataacgcctgcttgtataaacaaaaaagaagattggttccaactaatatgtaaattaagatttttggatttttttaatgcaaatgtacaagtcaacatttaatcctactgttaaagtcaatcattgagattgattctcccttcttcgtaatttaaaaatcacaacaacttgcatatagatccaattatctcctttcacctagaaagaaagagagtcgactaattctaagtctttaagtcaacgtctcttgtcttcatatagttcatcaaaaacaaaacgttttgttaaacaaaagattcttcaatggtttcatgtatatagattgctccatacaatcacgttgagagctaaagagctaatctcttgacccaaagaaaa

SEQ ID NO: 14886 - DNA, 3000 bp, Unknown
  misc_feature (1)..( 3000): cDNA_ID_2731112_gDNA_ID_2684232_Annot_ID_137637 3000 nt of promoter + ATG
aatttattcttcccttcttttaatgagaaggcacaaaattaaataaagagtaaaagtctattcaaaattcttggatcttgttacaattttgtttcttctctttattttcttctatatttctatgctataagtgatctgtttatcaaagaaacaaactataggttcataggatgttaagttcgatcgtgccactaatttagtcaccttgagtatatgatttactcacgtattacacacaaccttggcttaggattgtttttaattgctatcacaaatttagtcgattaatttcaaaactgacgttatattattaggatcactttagtaccgacgttaaagtatttcaaaactgacgtcaaaaatgtttttttttttttttttttttgtagtggatagattttatcaaccacaactttcccaacttttatacaagtttacatatcaaaaatactatatttatctacatttattcctaaataaaatcaaaatattttattcttttgccacacacttacaagatatcatggatgcaaacattatttttctgcatttatcgtatatagatgatagttaataacacagtcacaaactgaaactgaaacctctaacattgaaatattaaatatggatttatagatagtattttgacaaccaatgagttttctcttatcaatggtgttcgaatgcatgatcttgaaaatttactatttttaggtgatcatgtgaagggtttcggtttgatgagctattcaaaaaaacgaaaatatattcaaactgattacaataaaatagggaacataaaaatttcatcaacacataaaaatcttatagagagggatacataatgaatatgtttaccactatacgtgtgcatgcatttgaagtatcaataatacgaatatataagtgggtaaaaaatgatagctagctgcaaattttgaattggcttctcaatgtgtcggacgcaacaagcaacaatttaacaagtttcatattcatcatcatacgaattataaaaatacaacataatcattagtttcattcagtctcacgttgtattgcttttagtttacattaaattaattacactaaacctcaaattaaacatttgaatgaatcttttgcgcctgtaacgtaggctaagattgttttaaattgtcaaaaccgtgcaagtagcagttatttgttgtgtttaatctcacgtgagagaagttaacgtcgtttgaccaataaccattaacgaattgaattactgacgtgtcgtagtggaacttgaaaaaaaaaaaaaaatagtgatataatgacgtttttacccttgaagtgaacatagagaaggcacagctttatttgtcgaggaagcatcgaaagagagtccccaccacaaatccaaatggcaatagcgttaattaaggaaggaacaaacctacttctttactatttacactatttatttctccattatttaatttattagtaagtattaattatttatctagctggaccaccagactcttttatgggtcccacctttacccaccacgaacatcttacgtcgacctccgattattattacatcacattttctctatacttctctcttgaaacctaaaaccaatagtagagaacaaaatagtttgaatttctgtgacatgttccaagttttattgcttctgttctgtgtatatacaagttaatacgaatatcaaagttatagtcttcagagatcgcaattgataaatttgttgttatctattgttaatagtggggtaatcatgtatattattatatggaccataatgttataaggcaatattaataccgtcggacctgagagtgtccataccatttaagtttgcttttttaaacgatatcagcagaataacttgaaacttataatttagggtcccgatcatttattggttttaattagtgtcatcgtttacatttccatataaatttttttgcattggttatagatttgtaattgataagaaaccggtatcaaactatcaactaaataaaatttgaactcgttagaaactgctgaaaataacaacttctattatgttgcgatgttttatgtcctagaacaatgtaaaatacagaattaaaaattgaaaaccctacttcgcttgaataaaaatcacaaaaaaaaattataaagaaaagtaaatagtctaacaaatggaaaaaaaaaacaaaacgctagattccaattaaaatccataatatgaaattatgattggttaacttaatattagtggccttaccaaacaaaaaaaaagatgacctgaaatgaaatctaatgcacattcaagagttggcaggattataaatgcatctgtatatgtataataatacaataccctgtcaatgtctattaaattgttccaattaatttctcctcccaaaaataacttatccaaataaacaactataatcaatgaagttagttagcctttattttcatgatgattgtgataataccaaaattcttatcttcataccaaagtacacaaaataattcacactctatagtctatagtataaatttggcaaaatttcaccgaattctcctattttctagcttcggctttgtctttttatatacacgtattaactatagtcaccaataaaaaattaattaagttaaactgattaggaaaaaacactagttaattgtgtaattagtagttttgttcaatgttgttaattaaaaagcgaacgtatcgtcgtttctctttttaactcattctctttggatccaaatctttcgctttggaattcgccattgacaaagtactcaattccaaaacaaagaataagcaaacaacaacaattttcacttccttcaaaaattataaaaatccagtttttatctttgcaagattcaaaagtttgaatttttacttgttttgatttctgggttttgtttgttttttgatttcggtaatgatacaattgagattttgatttcgtgtgatgttgagagattcttaa

SEQ ID NO: 14887 - DNA, 3000 bp, Unknown
  misc_feature (1)..( 3000): cDNA_ID_2731096_gDNA_ID_2684232_Annot_ID_137643 3000 nt of promoter + ATG
aagaaaatttatcaactgaaataaaaataacgagtaaaaagaaaaagaaacattcaaatcgtaatcccattagtcttcttaatagtttccccgaatatccaacaagaagatccaactcttttgaatgaagatttttttttatatgtttaaaggttaattcaaattataatttgtaaaccgaaataacagaaagaaattaaagattgcatcaagatcgatatgaatcatatgatacaacagtttgctttcctaactatcttttcaagtccaaaaatctaattctttatacgaggtcacataaattgaatgttaattagatgggatataattcttcatcccatttactgttacatttcatagctcaaaaaaattaaaaaggaaacaaaagaggtgatttttgcaatgtaataagaaaaatttcaaataaattatatagtaactaactaaaaaatcacgaagaaaaaggaaaagaaacattcaaatcgttatatgtttcttcttgttaattagagatcacacatttctgaatgtagaattttcaaatattataaattaaaaaacgatgtaacaaaaagaatgattgcatcgaaatagacatgatatatacttccctaacgatcttttcaagtccaaacacaatatcttttgcaaataatgcgatttaacttttggtatttgatattttctttattcatttgcgaacataaaacaagcaacaaagagaatgaagagataattattcattgattaaaccttaacaaaagatccgttcatcagatatgaacggcaacaaatatcgcatgactaaacgaaccaaaacgaaaaacaaataatcaaagaaaaaaaccctaattaatcaagaacaaacaaagaagaagagaaactagcaggtgacatggcaagtgtaacgaacaagaggaacaaagaaagggtcgttgaagaatccccaagcgacgtcgtcacattcacttttcatgttgacaacaaggttgcaacaatagtcactaacttgaaacaacctcgtgtagaaactgacttccatctgcatccgacacatcccaacaggtcccatgtttatcatacatctctcgatgtgttcccatggattctgttgatgatgaggtggatttgatggagatgatgagtgatgacttggtggcggaggtggagacttcttgggtgttggaggtggaagagacggtgttgaaggagacttcttgggcgctggaggtggaagagacggtgttggaggcggagatggagacttcttgggcgttggatggggaacaaacggtgttaatgaaggcggagatggagacttctttggcgttggcggtgggggagactttttaggagctggaggaggaggagacggtgttgatggagttgacggaatcggcgttgatggagaaatagaaatggcaggagcagatccgttgctataagtacatttccagactttggaatctccatagccgaaactatggccagtgttcaaaagcatcagttcgtttctagtgatttcagacgggtttggccatccttcgatttttggccagtattttccgacggttgtggtcggaaaagccacaagacaaagaaaagctgccgctacaagcacgatggaggttttcattcttaaagggaagatttgtgagtgtatacaaagaaatggactaactcgttctttatatatagaaggatttaacttcttttttttggttggttacaaatatatcaaagatctttttaacaaccaaaaaaatatgaaaaaatccatatctcgtaactattattttttaaaatttaaactgttgtaaatattatctcttggaaactcgaaaagaatatatttttttattttttttatctaacaactttctttcaaaactcaaaacatatccttgtttacaaatgggattaaaaagtatggacaaaaatgtataaacaccacggggtcatgggcgtaggcagtgtgtaattagggggtcaattgacccctatgaattttaaaatttctactatattttattaagagtaattataatgaccccaatgcattatagtttttgatccccatatcaaactaattcaactaaaacgacaaaaaagccaaataagtttggttcattagaattttaaaccaaattgtaatgtaataaaattaaaaatccttgacttatttaaacttaagttcaactaatgatctaatgttataattatatatataaaaaaaacacaatttgtttttgcttttcttagtctttgtggaccataacaaaaagttgtaattattaatttagttgattttcagatatttttctcaggtgtagattatttctaaacaaaataataataaattttatataatatactatttttattaaaattctgatccttataacaaaattttctagctccgccactgcacgggatgttacatcgaattgaatttttggcgtagagcatctgcacaagtattctgctcacgatgtttgaaaacaaaactttggtgacttgaaacttcgcgtccatccacttatcgtagttagatagtgttgcagtcgtggtgatgatccattgttgtttttgagactaattcggttttttatatatagaaggatttaacttctgttttttgttggttaaaaatataataaagatctttttaacaaacgaataaatatgataaaattccatatctcgcaactattatctcttaaaacttaaactgttgtaaatattatttcttggaaactcgaaaatgaatattcttaacgagaaaaaaaaaacataacgaaaatatgtatattgcaattataagacttaaaaaaataaaaaatattaaatgcagattaacaaaaagaaattattagatgcagatttgtgtagatctttgaaaagacctattaaagcccatttaggcccattaaacgacaacctattaaacccatttaggcccataataacggcgtagtttcagaattagacagtgaggca

SEQ ID NO: 14888 - DNA, 3000 bp, Unknown
  misc_feature (1)..( 3000): cDNA_ID_3037080_gDNA_ID_2684232_Annot_ID_192310 3000 nt of promoter + ATG
catacacataataataaagtacaattgtccatgttatacttatatatatacatagaggaaaactttaaaatattgcaaaagcagcctccattatcacccaccaaattagttcttttcttacacaccaaattagttttactagtttatttcatcgttttgttttagaggatagaaaatgtattagttttcttgttctacaaagaagaaaaagagaagaactttgtttatttgatattgtcctgtacttatttgtttgaatattcctaacaaacgaaaaggattttgagttggtaccacatggttcaagtctttgaacatttgagtgggatccaacgtggctctcatcgatgtaggaatcaaatggtgcgagtcattttggtcgacacttggaagtttggtgatctcgtagatttgtcttattaagttgcgatcttagttaattggctaacatagttttcatttttgctaattgtcatggtcttttctatacaaaatttgtctcaaaagtgaaaaatttcaaaaaaattgttgggtttgttgagccatgtcaagtgttttgtaatttttttgcattgctgattttatcccgcataagatttgtaattttgtgagctgaacaaaaaaatgtgtttgcttttgacccaatgaaatgattatttaggcccagtaaaactaggctacaagaataaaattgtagattctaactgttggacccataaaatcaacgaagcaggcccaataagctgatatttgaaaaaacccatgtcaatttcttgattcgaacggaagttacaagctcattttgtatattaaaaataaaagcccaatactctatcacggaattttatctttatttttgaaaaaatttcattctgagaaaaaacatatacatatataattcgaaactatattccgagattatatatggtcatcagtctctccagagaaaatgtaattttagtatcatgatatttttcgtcaattttggacattttagaagaaaagcacaacatgcaaatgattttgttttgttttgtgcaatacaatatgcaaatgaaagtaaaaaagaaaaatttgaagttcacttaagaagtttgtttttctgtaattatgtattattctgaagagaacataatgataatgtccaagaaaaaaaagaaaaaaaaaaagattccaggcagagtagataagccagtcgttagaagtcaaatcaaattttcataatttatcaactctatatattttcttatatagcaagtcgaatcatatttttgtcgttatgccttgtaacaaacacatacaacataattgaatgatgagagacatatgtacaaaccaatgatactttaaaaataaatgaaatatgtgaggaagaaaaagagacacgatgtctaacaaggagacaatctatacaagctattaatctgcaaagtataagaacaagacggctaaaaacgttagaaaacaaaatggtaagagctttcagcaatgaaaaaaatggtaaaatattaagaaattgtcttttttttttttcataaacccgatcatagatccggtcagccgtagtaaaaacttaacgaagtgcttcagactggagttttctttaaaggttccgattaatgtcactagaccataactctacgggtgattaagaaaaaactaaaacatgtaaaagagaatgataagataaaaagttttatatattatattgtttttgttcgggtttagtgtggttgtaagatggtgatcaatcacaattgtcattttagaagaacaagaagattggacacgtggcagaaaataaagaacccataattaagtgtccacgtggtaacccctaatagacaacgatggaccatgaagaaaggcacacacgttaagatcacttcgactcgaagttcatttactctacccatcctaacattacgacaccatttcgttgtcctttcttctccttcccagttcccactattccactaaccaccaaaaatgcattttcctctttacttctttatcaatttattctttcttatacataatttaactatctgtttttgtgtttgtgtttgcttcatgttggtttacgcttgtgcggttcatgtttgtgatttctttataattattgtccgagtaggatttttatgttcttcgctcaaaccgctagaccgatgatcttaaattaaagaaaaaggaatagatatatcttatataatatgacaaagttttttctaacttttcctaagctaagtgatgttatatatgatagttcgaaattgtatcccataagctaagtgctcaacattttactggagttcggttataattaaattttgcatcaggcaaaaccatcgatcgatgtatgtacgaagagtcttcatgtttgatattttattctgatgtcactctcctattcattcgttttaagaaaaaataaaatcagccaagcaatttcaattgttatttagatattacaattacattaccttttttacatgcatttataaatacgtatactaattaggtagacgtaaatgtgtttgatttttggggctctagctatttgcatagcttctaacatctaaataaattgtagcttgtcctcttctgcttgtgagtgagatgtctgaagctaaggagatgggccaaacccataacaaatcaagtccaactataaagcctggtcaacaaatacagaagatgacaaagatcaaaagctgtctctcatccgtacatgtacctgcaggaaacattgaaagagaaaggaagacgctcctctaaaactaattcaatcctctttcatccttatctaataaccaaaaattacatacatctgtatagtgtcgagagtgttctagatccttctccctcaatctctataaaaagaagaatgtaatctcattgtaattattattgaaaaacagagtaatattattaaaaggttcaaattttctcttctttctcatggtatcagagccattctaaactctcacaggtccaaaa

SEQ ID NO: 14889 - DNA, 3000 bp, Unknown
  misc_feature (1)..( 3000): cDNA_ID_3019558_gDNA_ID_2684232_Annot_ID_192309 3000 nt of promoter + ATG
ctaacgactggcttatctactctgcctggaatctttttttttttcttttttttcttggacattatcattatgttctcttcagaataatacataattacagaaaaacaaacttcttaagtgaacttcaaatttttcttttttactttcatttgcatattgtattgcacaaaacaaaacaaaatcatttgcatgttgtgcttttcttctaaaatgtccaaaattgacgaaaaatatcatgatactaaaattacattttctctggagagactgatgaccatatataatctcggaatatagtttcgaattatatatgtatatgttttttctcagaatgaaattttttcaaaaataaagataaaattccgtgatagagtattgggcttttatttttaatatacaaaatgagcttgtaacttccgttcgaatcaagaaattgacatgggttttttcaaatatcagcttattgggcctgcttcgttgattttatgggtccaacagttagaatctacaattttattcttgtagcctagttttactgggcctaaataatcatttcattgggtcaaaagcaaacacatttttttgttcagctcacaaaattacaaatcttatgcgggataaaatcagcaatgcaaaaaaattacaaaacacttgacatggctcaacaaacccaacaatttttttgaaatttttcacttttgagacaaattttgtatagaaaagaccatgacaattagcaaaaatgaaaactatgttagccaattaactaagatcgcaacttaataagacaaatctacgagatcaccaaacttccaagtgtcgaccaaaatgactcgcaccatttgattcctacatcgatgagagccacgttggatcccactcaaatgttcaaagacttgaaccatgtggtaccaactcaaaatccttttcgtttgttaggaatattcaaacaaataagtacaggacaatatcaaataaacaaagttcttctctttttcttctttgtagaacaagaaaactaatacattttctatcctctaaaacaaaacgatgaaataaactagtaaaactaatttggtgtgtaagaaaagaactaatttggtgggtgataatggaggctgcttttgcaatattttaaagttttcctctatgtatatatataagtataacatggacaattgtactttattattatgtgtatgatgatgctatgcaaattatatagcatgcctaagcctaaataatgataattttttcatgcctaacaataacaatgatatattacatgataactatgtagagagtagagactagagatgtaacctgaactttatatggctttataactcacatgaaaaagttaggtatattaagtatgttttagggttaaattttgatatagatttactatttaccatgtatcatgtatgtttgcaataaatatggacgcatggaatcacactagccctcaggctaaaataaataggattgctcaaataaggcgctatcatcaatggacgaccgtctcaaactgcgacaaacctggttatacactattttgtattaacaaagcttatactccgattacgttttttagtcgttactattacatgttatctcgtaaagaccaaataaacactattgattcggtttgataagccgaccagttataagttgtaacgtacggtgtcggcagctcgaactcttatgtgtcattgtgtttctaaacgtttttttttggtcatatatgcgtttgtatttttagtggttaattatatgaaaaatgtattatcttttatatatataataatataacaaaaagattgaatattctgtgtgtgtttaggatctttaaaagaaattttttatatggcaactattctttttactatgtattttgattaacactttcaaactaacaacattattaatcaattaaaatcgtacgcgagaaacttcaaaagtctctttccttctcatcccgcttcagaaatttaagtctgtttgccaacaagattcgttcaatgaataaatatattagatcaatcataaactaaatgatcaaatatagataaattagataaatatagttagatgaaaagggacataataacttccgctaaaacaaggttagtaaataaagacaacctaatgattcgtatcaatatgtagtatattataaaagactttaatcaaatttaatacagtaactcagcatggaagaatcatttttcattattattcttagtgtaaagtatcactactattaatgtaaagctgtaaacaagagaccaacaactattcattttaagtttagagtaattacgaagcaaaaactatatatactaaacgatattattcaaaaacaaaactatatattaaacaagaaataaagtcaaaagtgtaacgtttcagaacggacggtcacgcgtgacacagtggctctctcttttaattgatattgtgtctccactttaatttaaatttcattcataaaataaatttgaaataatcaaattcataattaacctttttaactaatttatagtcaacttctaagtttctacttaaacatattaataagggaacttacgtaatgacaccaaatgagaaatagtatcaacaagtcaatttattaaaaagcttttaataatttcctaatctgaacacttttgtatcttgaatttgtggataaaattagccaaattttgtaaattaggtttgtagtaattaattactgagattaagtagcgaagaagaagaaaaaaaggacagtccccatgttttaatgacaatggctctactttccacgtttataatattacaaaatctttcttttgctcagaacacaacttgctttgaactcttttaccttcttcttcttctttagattctctgtagcttgaagtggattcatgaatctgtaatctcgtctctgtatctaaaaagcttctgcttttaacattatctctgtttcataagcttctagaagcttcaatg

SEQ ID NO: 14890 - DNA, 3000 bp, Unknown
  misc_feature (1)..( 3000): cDNA_ID_3019569_gDNA_ID_2684232_Annot_ID_192306 3000 nt of promoter + ATG
taagaaaaatttcaaataaattatatagtaactaactaaaaaatcacgaagaaaaaggaaaagaaacattcaaatcgttatatgtttcttcttgttaattagagatcacacatttctgaatgtagaattttcaaatattataaattaaaaaacgatgtaacaaaaagaatgattgcatcgaaatagacatgatatatacttccctaacgatcttttcaagtccaaacacaatatcttttgcaaataatgcgatttaacttttggtatttgatattttctttattcatttgcgaacataaaacaagcaacaaagagaatgaagagataattattcattgattaaaccttaacaaaagatccgttcatcagatatgaacggcaacaaatatcgcatgactaaacgaaccaaaacgaaaaacaaataatcaaagaaaaaaaccctaattaatcaagaacaaacaaagaagaagagaaactagcaggtgacatggcaagtgtaacgaacaagaggaacaaagaaagggtcgttgaagaatccccaagcgacgtcgtcacattcacttttcatgttgacaacaaggttgcaacaatagtcactaacttgaaacaacctcgtgtagaaactgacttccatctgcatccgacacatcccaacaggtcccatgtttatcatacatctctcgatgtgttcccatggattctgttgatgatgaggtggatttgatggagatgatgagtgatgacttggtggcggaggtggagacttcttgggtgttggaggtggaagagacggtgttgaaggagacttcttgggcgctggaggtggaagagacggtgttggaggcggagatggagacttcttgggcgttggatggggaacaaacggtgttaatgaaggcggagatggagacttctttggcgttggcggtgggggagactttttaggagctggaggaggaggagacggtgttgatggagttgacggaatcggcgttgatggagaaatagaaatggcaggagcagatccgttgctataagtacatttccagactttggaatctccatagccgaaactatggccagtgttcaaaagcatcagttcgtttctagtgatttcagacgggtttggccatccttcgatttttggccagtattttccgacggttgtggtcggaaaagccacaagacaaagaaaagctgccgctacaagcacgatggaggttttcattcttaaagggaagatttgtgagtgtatacaaagaaatggactaactcgttctttatatatagaaggatttaacttcttttttttggttggttacaaatatatcaaagatctttttaacaaccaaaaaaatatgaaaaaatccatatctcgtaactattattttttaaaatttaaactgttgtaaatattatctcttggaaactcgaaaagaatatatttttttattttttttatctaacaactttctttcaaaactcaaaacatatccttgtttacaaatgggattaaaaagtatggacaaaaatgtataaacaccacggggtcatgggcgtaggcagtgtgtaattagggggtcaattgacccctatgaattttaaaatttctactatattttattaagagtaattataatgaccccaatgcattatagtttttgatccccatatcaaactaattcaactaaaacgacaaaaaagccaaataagtttggttcattagaattttaaaccaaattgtaatgtaataaaattaaaaatccttgacttatttaaacttaagttcaactaatgatctaatgttataattatatatataaaaaaaacacaatttgtttttgcttttcttagtctttgtggaccataacaaaaagttgtaattattaatttagttgattttcagatatttttctcaggtgtagattatttctaaacaaaataataataaattttatataatatactatttttattaaaattctgatccttataacaaaattttctagctccgccactgcacgggatgttacatcgaattgaatttttggcgtagagcatctgcacaagtattctgctcacgatgtttgaaaacaaaactttggtgacttgaaacttcgcgtccatccacttatcgtagttagatagtgttgcagtcgtggtgatgatccattgttgtttttgagactaattcggttttttatatatagaaggatttaacttctgttttttgttggttaaaaatataataaagatctttttaacaaacgaataaatatgataaaattccatatctcgcaactattatctcttaaaacttaaactgttgtaaatattatttcttggaaactcgaaaatgaatattcttaacgagaaaaaaaaaacataacgaaaatatgtatattgcaattataagacttaaaaaaataaaaaatattaaatgcagattaacaaaaagaaattattagatgcagatttgtgtagatctttgaaaagacctattaaagcccatttaggcccattaaacgacaacctattaaacccatttaggcccataataacggcgtagtttcagaattagacagtgaggcaatggagcataaagtaacacccgaaagatccgacccggagaagagagatccggacaacccgacccaaatatttgacatttttggttcgatgttcttcttcttcctctattgatttttctgatcttcccgttcgatctcactctgtttcccaaaaaccttcgtgtaccttcgtattctctgcattggatttgaagcaaattgatgaactagtaatctcacacggatctaagagcaggtaaaaccaaaaatgaacactacaaagctatcaacgaattttccatttttttttgaaattttattttctttcgaagatcagatcagtaatcttattatcagcttctctcgttctcttgatcgatctgaatcgaaattgtgacaatgatcagccgtattttgtctttcagaagtt

SEQ ID NO: 14891 - DNA, 3000 bp, Unknown; identical to SEQ ID NO: 14886
  misc_feature (1)..( 3000): cDNA_ID_2731112_gDNA_ID_2684232_Annot_ID_192299 3000 nt of promoter + ATG

SEQ ID NO: 14892 - DNA, 3000 bp, Unknown; identical to SEQ ID NO: 14885
  misc_feature (1)..( 3000): cDNA_ID_2731133_gDNA_ID_2684232_Annot_ID_192292 3000 nt of promoter + ATG

SEQ ID NO: 14893 - DNA, 3000 bp, Unknown; identical to SEQ ID NO: 14884
  misc_feature (1)..( 3000): cDNA_ID_2731136_gDNA_ID_2684232_Annot_ID_192291 3000 nt of promoter + ATG

SEQ ID NO: 14894 - DNA, 3000 bp, Unknown
  misc_feature (1)..( 3000): cDNA_ID_2995053_gDNA_ID_2684232_Annot_ID_137644 3000 nt of promoter + ATG
ggaatgtaagtcattttcgttgcttttagatttctgtcagctggcatgaaattgctatcccttttttttctcgcagcaattcattcttgtttgttatattttggaactgcagaacgcaagtgggttcgcaacccatcacttcaatttcttggcttcctatgttgcgtgtacttgtcactgtgtccaaggatggatctcttcaagtgtggaagacacgagtaataattaatcccaataggccttcgacacaaacaaacttctttgagcctgctggtaagcctgatatctcttatagagaaaatatattttcctccccgacttaggaataattcccatggtttggtttggagactttgattacgcattgtagcactatccttttttttttttctttgcagctatggaatcaatagacattcctaaaattctctcccaacagggtggcgaagctgtttaccctttaccacgaatcaaaactttagaagttcacccaaagctgaacttagcagctttgatttttgcagttaagaatacttcctactggcactccttccttaggtagaagtgtggcttctgtctttgacatactgggtttcttatacagaacatggtgggtaatgagaacactcaaaatcgagcagctcagactagagaaggaaggaagcagctctttgcagttttgcaaagtgctaggggatcttcaggtgaatcttgaacactaatgttattcaaacataacaattgatactcttcttaagctgtatggatgtgtctcttgagagtaaccaatcctctgttaatagtatgggttgtgggttcgaccagagtcgttcgtatcaatatccggctttctaacatgtgagatgattaacagcttctgttctaaaggaaaagctttcgtctatgggttcctctggaattttagccgagcatcaacttcaagctctgctacaggagcacaaggggtaggtggatatttctcatgcaatcactgttggaaaattgcgcaaaaaaaagttactagcatgtgctgtgaattccgtaccaaatgactcaaatttcatctgcttcatagttcactctgttacttttctacagccagagtcagctaacaatttcagatatcgcacggaaggcgttcttgtatagtgtatgactgctttaccttcttgcttagacattatgtttgttttattatttggaactattttgagcttagtcgatgaattaatccgtacagcattttatggagggtcatgccaaaactgctccaatatcaaggttaccccttattacggtcgtggatacaaaggatcaacttaaagacattcctgtttgccaggcatgtaactgttgtttagtgtttcttttctgtagtatctgatttatgcctgactgattggattatctgacagccatttcatttggagctgaatttcttcaataagccaaatagagttcttcattatcctgtgaggtccttttatatcgagggccttaacctcatggctcacaatctctgttctggaacagacaacatctacaagaagctgtacacatcggtataatctgatatcatgtgatttcgttttagtttttggtttccttttacttacagaacttttctgtttcagatccccggaaatgttgaatatcattcgaaacacattgtttacagtcgtaaaaggcacctctttctggttgtctttgagttcagtggtgctacaaatgaagttgtgctttactgggaaaatacaggttcccagctgcctaatagcaaaggaagcactgctaaaggtttgtctaatcattggattcccttgctattctttagagaacttcctatcctgcctcataacttttagttttgaaaacattaaacggtatcatactgcatccagtcatttaaatataccaggggtacaatgtatgctataaaacagtagttactaacaatcaaggaagctgaacgtttcaacgaatgatctgtttacttgatagagatgcaagcttagaattatttaagccgttcatcctttttgttttcctatgtttccaaaggcgtaaacgaacaagagaagagtaacctcaaagctatacttttttggtatgcaggttgtgatgctgcctttatcggcccaaatgacgatcaatttgcaattcttgacgaggataagacaggactgtctatgtatatcctcccaaaacttaccacaatggaagagaatgagaagaatttgttatctgaagaaaaccaaaagaaagaggcggatccttctggaattcagggtccacaacaattcatgtttgagacagaagtcgatcgtgttttttccacaccgataggtgatgttgcatcagataatctcattcttgaagttacagataatctcattcttgaagttacttatcaattggagcatgccatcgctaactgatgcctctttaaattacagagtccactctgatgtttgcttgtaatggaacccaaattgggctggcaaagttgtttcaaggctaccgtctctcagcttcagatggtcattatatttcaacacaaggtgagggacgaaagtcaatcaagttgaagaaacatgaaatagctcttcaggtatgcaacatctattataacttcgtactgtttattagtagtttggtgggaaattttccaaccaaataaacttttgatatctagtatttgattctatgaccagctcagtaaatgcagtcgttttattccttaccctttaatgtggtttacatctggccggttctctttgaaattaaaacgatcatgttcagaaaattgactcgtcatgttggtgttagcgttctattgctgtcaaaaattggttgaatcgacaattgatattcctgaaattttggtcaatcaacttttgtattacgtagagattcttagaatatgatttagatttctaaagtagttttttccatcaattgtataaagaactaattgttgtctcaaaatgtacaggttca

SEQ ID NO: 14895 - DNA, 3000 bp, Unknown
  misc_feature (1)..( 3000): cDNA_ID_2731086_gDNA_ID_2684232_Annot_ID_137646 3000 nt of promoter + ATG
caaacacatttttttgttcagctcacaaaattacaaatcttatgcgggataaaatcagcaatgcaaaaaaattacaaaacacttgacatggctcaacaaacccaacaatttttttgaaatttttcacttttgagacaaattttgtatagaaaagaccatgacaattagcaaaaatgaaaactatgttagccaattaactaagatcgcaacttaataagacaaatctacgagatcaccaaacttccaagtgtcgaccaaaatgactcgcaccatttgattcctacatcgatgagagccacgttggatcccactcaaatgttcaaagacttgaaccatgtggtaccaactcaaaatccttttcgtttgttaggaatattcaaacaaataagtacaggacaatatcaaataaacaaagttcttctctttttcttctttgtagaacaagaaaactaatacattttctatcctctaaaacaaaacgatgaaataaactagtaaaactaatttggtgtgtaagaaaagaactaatttggtgggtgataatggaggctgcttttgcaatattttaaagttttcctctatgtatatatataagtataacatggacaattgtactttattattatgtgtatgatgatgctatgcaaattatatagcatgcctaagcctaaataatgataattttttcatgcctaacaataacaatgatatattacatgataactatgtagagagtagagactagagatgtaacctgaactttatatggctttataactcacatgaaaaagttaggtatattaagtatgttttagggttaaattttgatatagatttactatttaccatgtatcatgtatgtttgcaataaatatggacgcatggaatcacactagccctcaggctaaaataaataggattgctcaaataaggcgctatcatcaatggacgaccgtctcaaactgcgacaaacctggttatacactattttgtattaacaaagcttatactccgattacgttttttagtcgttactattacatgttatctcgtaaagaccaaataaacactattgattcggtttgataagccgaccagttataagttgtaacgtacggtgtcggcagctcgaactcttatgtgtcattgtgtttctaaacgtttttttttggtcatatatgcgtttgtatttttagtggttaattatatgaaaaatgtattatcttttatatatataataatataacaaaaagattgaatattctgtgtgtgtttaggatctttaaaagaaattttttatatggcaactattctttttactatgtattttgattaacactttcaaactaacaacattattaatcaattaaaatcgtacgcgagaaacttcaaaagtctctttccttctcatcccgcttcagaaatttaagtctgtttgccaacaagattcgttcaatgaataaatatattagatcaatcataaactaaatgatcaaatatagataaattagataaatatagttagatgaaaagggacataataacttccgctaaaacaaggttagtaaataaagacaacctaatgattcgtatcaatatgtagtatattataaaagactttaatcaaatttaatacagtaactcagcatggaagaatcatttttcattattattcttagtgtaaagtatcactactattaatgtaaagctgtaaacaagagaccaacaactattcattttaagtttagagtaattacgaagcaaaaactatatatactaaacgatattattcaaaaacaaaactatatattaaacaagaaataaagtcaaaagtgtaacgtttcagaacggacggtcacgcgtgacacagtggctctctcttttaattgatattgtgtctccactttaatttaaatttcattcataaaataaatttgaaataatcaaattcataattaacctttttaactaatttatagtcaacttctaagtttctacttaaacatattaataagggaacttacgtaatgacaccaaatgagaaatagtatcaacaagtcaatttattaaaaagcttttaataatttcctaatctgaacacttttgtatcttgaatttgtggataaaattagccaaattttgtaaattaggtttgtagtaattaattactgagattaagtagcgaagaagaagaaaaaaaggacagtccccatgttttaatgacaatggctctactttccacgtttataatattacaaaatctttcttttgctcagaacacaacttgctttgaactcttttaccttcttcttcttctttagattctctgtagcttgaagtggattcatgaatctgtaatctcgtctctgtatctaaaaagcttctgcttttaacattatctctgtttcataagcttctagaagcttcaatggcggagtatatctgtttattcggcaaggttcttctctttctttctctctctctcgtgtctctttttgtgattaagcttctgggtatctctgcatgtatgttttatcaatggaatctaccaaaaagttctgttttttgcaaagatttcataaggaaaagtcatgatttttgagtctctctgttatttctccgttgtaaatgaatgtgattggtttagggtttagcagtagattcttgtctgctctgtgttttcatattcttgattccgacttaattttgaaccaaagtgttgtttctatttgaaacaagaaaacgaagagccaacaaaagccctagagagagcaattaaggaagaagattcacttgaaatagtttgatttagggttttaaaatcaattctctaggcaactaaagactcttgatttggttgttgtttgtaacaggacagtgcagcgattgttataaagcaaccaaagaaatcaccattattcttaaggatgattgttttagtgtttgctatggtttgtggtctctacatttgcgctgtttgcttaaaacagttaagtaatg

SEQ ID NO: 14896 - DNA, 3000 bp, Unknown
  misc_feature (1)..( 3000): cDNA_ID_2731191_gDNA_ID_2684233_Annot_ID_137649 3000 nt of promoter + ATG
ctcacattttagtttgtactaatctttaataaataacagtcattatcagttgaataacacattgtcacataatattaattggactttaacagcaacacaaacaatcaatcaaacttatatgaataagatcaagaagaagaagagacaacggacatgaattcttgatctgattccaaagcttccataaactctggaagaagacatacttccaaatctatggttcctcctccttctcttcctgcatatgctgatatcttcccatcaaacttaccgccataaccgcttctaaccgcaaccgcttttcccatcccaaactcgcattcatacatcttaaacctcggagagcttccaatgtgaaccaccatcgctcccaaaagtttttctaaatggaaaacataagatgatttcaaccagtttttgattgtctccgagaccacttcactagtgtttccaatcacagcttcatgcattttcaaagcagcccatcccaaatcattttctagtagctcaccggatgtaacggtcttggactttacagcagaaagacaattaccaagatagctcaaagacaatggtggatccaattttgttccattgttagcggcaaggctacaacgaatttcatgatcataaggtaagtttcttgctcttgtaatgcatctccacataaatgcggctaacgcttgaaaagaagaaattgttgttgttctgctttcttcattagcctttgatttcaatgatgttattgtttcagacgagaaatggaatattctctccttcaagaccggtgattcgaatcggctaatgaattcatcagagtgagtgaaaggaaggttgtacacaggaccgtaccctttaggaaaccaacgtgaaaggactggaggattcttgagaagcaagttatcggtttcttgtgcattgaaaatctccgacaaagagttgaaaaaatgccacaaggaacctccatctcccacagcgtgattcaatgaaaatccaatgaacactccatctaccaattctgttacctgaaaagattcatctctttagggtattgcatgcatagttgcgtgatatacaaacaactaagactacatagatacacaatacttcgatgtatctctaaatcaaatggcaagaagttaagtaaacctagtactatatgtgtattactatcgttcagactaaacttctaggctaagtgaattatatgattttgagattacaagaataaattaatgtaccttgactgagaagagactcatggtgtgaccatcatggctcacggctttatggtggtcaaagaaagattgaacaaccaaaggaacatagttggatccaacaatatctcttacacttagatccgatttggcatggataaatccagctccgggactgtcattacaatccacaaacacagagtaggatctcggattatcggtttttaaagtcgagagacgacccgcgagcggataaaaatggacaagggtttcagctagagaatctctaagcttttgtagccaagtctccatgaaatcttttgttttggttgcatcatcagatttgagaaagagaagaccattttggaggtaatgcatagagagcatcacaagatccaacggtgataaatggtatggctctttccatttttcagggatggttttgggtttaacaaagcattgagaaacgatttttacttccgatgaagtagaatccatataaagaacaagagtgtctctactttggttctgtttctttgtttttcttcttctcctacagcatcaatcatgagattcttatataagttttatcattttgggggttgttgtaatttttagcctttgtttaaggtaatattgcaaaatgatgtgcataatgggtgaaatacattgtattatactattttctaggatgtcttttaatagtatagataaatatatagagattttattctattcttatgaatccaattatctgccaaaattagttacttccatataaaatttgaaatctaaccatattatgcaaactatgtacgataaaatagaataaaatctttttgaaattaaattagttgataaagatattagatatggtttaatctatctgggccaaattcaggccttttattgtaggcccaacagtaagaagccttgattaattaagctaatatgaggtggcaaattcgattttaaagtggatcaagtatagtaacaaacaaaaaaaaacgatatttgtctctgacacacactcacgcgcctttcttcttcttcttcttcttcttcatctggaaatcgatatacgattctcactctctacccgcgaaaaaacactaattgattcatatcctccgtcaaggataaatctgtgtttgattcaccatatctctttcttctccctccgcgctaagctacgacgcctacaggtttctatctttccccgattcaattctattacgttgtcgtcgtcttactgtgaaattgatttggtctttatgttgtttggattcatcactaagcttttattatcttagtttctttgctgctttagaattttttagatgaattttgggtggttctgaatttcagcttattttgggaattctcttagtatactgttcatttgccagagttttcgattctaaagattgggacttgttactaaagtttttattgttcgttacctaacctaaaattttgatctctgaaaatatttctggcgatctttgcagagagatttatggcttgttctgtagcacttcgcttttttttttttttttgaatgaacactttgcttatttgtattatctgaatccactaagtttttttttccatccttgtcttgttggcagatctggctggtaaaaatcacgcagatagagactctggcccgatgctctctttacccattgatccaggctttttctgatttctctttgttcctagaaaccattaagctcctacctctttctagttgatgctcgtgttctcttcactgtctatg

SEQ ID NO: 14897 - DNA, 3000 bp, Unknown; identical to SEQ ID NO: 768
  misc_feature (1)..( 3000): cDNA_ID_2125786_gDNA_ID_2684233_Annot_ID_137650 3000 nt of promoter + ATG

SEQ ID NO: 14898 - DNA, 3000 bp, Unknown; identical to SEQ ID NO: 775
  misc_feature (1)..( 3000): cDNA_ID_2125790_gDNA_ID_2684233_Annot_ID_137651 3000 nt of promoter + ATG

SEQ ID NO: 14899 - DNA, 3000 bp, Unknown; identical to SEQ ID NO: 769
  misc_feature (1)..( 3000): cDNA_ID_2125794_gDNA_ID_2684233_Annot_ID_137652 3000 nt of promoter + ATG

SEQ ID NO: 14900 - DNA, 3000 bp, Unknown
  misc_feature (1)..( 3000): cDNA_ID_2125798_gDNA_ID_2684233_Annot_ID_137653 3000 nt of promoter + ATG
ctctagttcttcatttagttgttgtaagtgtttttatagcctaatttgatttccgtggaaagataaactgaaagaaaaatctgatttgatttagggaatgaaaacttggattcgtttgaagttagttgtagaaagtgtttctataggttattggtgctaatgattcattgcctttgcagtggtgatttttgtctctaaatgtcgagtagctcggggagtttctcgggaagcagtagctcggcgtgtagttccagaagtgattgtgagaactcgtttgatgttgaagatcttttgcagattgggactacacgcagggaggtaaacacttcattgctatgctcattataaggtagtttctgactcttagattgctgaagttgatttctgttttgttttgtgctctttgatttgttattggcagctaaggaaacaaaaggacttgctgagagaatcacagccccatagtattgaactagtcagagtagtcttcttctccttgtttaatatgagcaattcagggaaagtattttctcattctgttggttgagttttcggaccttaatcttctcttcaccgcagaggttggaacttcacacgaagtcattatctgaatctcgcttagaagacacagcaagaattcagatgatggagaaagaattattgaattgctataaggaaattggtaattttctatttaagccaaccagtcttgatttttctgaactaataataatatgtttcagcatatattaatcttcgccttgtagattacttgcgggatcaactaattttcagaagcaaggaagtgaattatctcaatgaacatctgcacgatcttgagttcaaattggctgaatcaaggaatctggaagaagaagttaactctttaagagatgagttgtgtatgtctaaatccgagcatttgttgttgttgcaagaactcgagagcaaggaaatagaactacagtgttcgtctcttacattggagaaactggaagagaccatctcgtccttaacattagagtccttgtgcgaaatagaaagcatgaagcttgatataacagcgttggagcaagcactctttgacgctatgaaaatccaagaagaaagcatccaagaaaaagatcaattaaaaggaataatcgaagagtcccagtttcagtctcaaagggcaaaagagaatgtcaagtacatcgaaaagcaaaacgaagacctgagggagaaatttactgcctctgaaaagagtatcaaagatttctttcaaagtactaaagaacggttagaaagtgaagatgaacagcctctaaatgcaatgtgcttcttcgctgaactgagccatgtgcttccagtgtctaatgaagttcggtaagctccagtttaaggctaatttattaagtcatcaaattgagttatccccgtccctaataatgttggttttgtgtctcacagcaattgttttgatgctatcatgaagaaactagaactttctcagaatgtgaatttgattgataaagtggagggtatggggaaacagatacatcagcacgaagatgttgtaaagcaactcaaagtacttttgaaaaactgaagaactctatttccttcctttgttaccattacagaatccaactagttatacctgcggttgttggtttgtgcaggaagaactgaaacaggagaaactgaaggcgaaggaagaagcagaagaccttacacaagaaatggctgaattaaggtataagatgacatgtttgcttgatgaggaacgcaatcgccgtgtgtgcatagaacaagcatcattacagagaatatccgagctagaagcacaggtactacttatgtaatgcttccttgtttttggtcgaatatgtgaaaatggaatctaatctctcttttctttcctctgttgttaagatcaagagagatgtaaaaaagcctgcttccaatgaaatgctgcctcttcctgggttatgaaaagtcttgagctttgatgtttacctttacacacatttctgagtctcatccatgggttttctgttgaaactgagtgtggaaagtgctcgagtgattgaaagacggattgcaagtttggatgttgatttgtatagaaatcaaatggtagggtagtcagaagaaatccagagacttggaagaggtttggagacgcaaacaaaagaagtttgggttaagagtttagctttagagattgatgttttctttattctgagtgtacataaaaattgcttggaacaaacattagaaataaaagtcgttctaaggtaatacataattgcattttctttgatgtcttaacaagtctctaaatatttactctgcagcaaattgaaaattgatctccaaccaattcttccataccttatgttcttttcctctttataaattgaaatctcaaacatttttcttatcaagttgctttgataaaatctgtatacattttctttttctttaacgatacctgtacttttatctaaaagaaaacaaaaataattactcttggtagattttattgataaatagtttaatacaagaaagtaaataaataggaacaaaagaaaactctttttcaacaattgtgtttttttgctaaggtttctcaccagtttcctctataacggactccaatatttgaactcgttaaagcctcttcttcctatcaacctttctctctcggaacctctcaatcctacttcaatttccaggtactaattcgtttttttctttcttctcgtaatcttccaagtcgatttaggtctactttgattgttggaaaattgatcttttaggaatcgatcgttgatcaaaagagatagcagttataaatacttgttcttgctttttttcaacttcaaagttcagtatcttctggtaaatttcgaatcaaggatcaatagcaatcttagttttggatttctgcaggagaagttgttttcttagttttggattctctgatacagtagaatttcccctgaaccttctatg

SEQ ID NO: 14901 - DNA, 3000 bp, Unknown
  misc_feature (1)..( 3000): cDNA_ID_2685712_gDNA_ID_2684233_Annot_ID_192344 3000 nt of promoter + ATG
acacaaacctgaagattacgcgaatgtgctctcgcaactaaatctgttggtgtcatgagacggttattgttcacaggaacaattgtgtctttccatggaccaatcccaattacatatggtttaatgtaatccaaatatgcgtctgatgtgatctctgcgtaagtctgcattcacattcattaccttatgtataagcaattttgacataatgagaaaggaagaaagtgaatatgtaaataccttattagtgtcttcggtaagaatagtgacatcgtcgatcaaaaacaattttggtgagtctgtcatgtttgaaatgtaaactagcgaagttgctgcaaaagactgaataaatattggctgttttaaccaatcttcagacagatatgagcctttgtatccatatttcttcaaagtttccacaaatttatcttcaaattttttaccatccgcccacttcacctgcacaagtttccaaatacaatttaacatcctctccatttgttatcatcaatgactaaaagttgaagctaagatttgatggtttgcttacttgctgattcatgaaaaccggattcttgatctctggatatatcccaaccactctaggtgcatccagtgctatcgaaatatactcgtcgaaggtaataatcgggaatttaccattgtattgttgatccctgaaaggatacctctgctttgcaccaagtgttttcagctctttgagagtaaaatcaactgttcttggaatgttcaatctcatcgtcaaaatttgaaaaaaatgaaactatatcaaaacaaatgataatggaatgtttttagttaccagtgaagaagccggtcatgttcattccttggacttcataagtcctcttacggtctgcaaactccttatggtctgcaacatcggttgtatcatcgagattaacatcgtggtgacatataagaacaccgtctttggaagacaaaatatcggtttctataaaatctgcaccctcctctatggccctctgcaatcaaaaaaaccttgtgaaaccagacaaaattagtgtaaaggtaagagacttttgtatagatccaataccatatatgcaggagcagtttcttcagggagctctccgtttgatcctctgtgtgcaaggttgtaaggacgggaagtctgaagtggtttcttggttgcatgttttgcttcgcttgggagacgatacaaaggccttgaggcacaattagcaaccaacaatgacagtaaaagcaatggtagaagatctgcaaaaattataacaaaaattgctttaaacgaagaatcaacttagacatagaaacaatggagatttgacacttacacttgaaggccatgactgaatttgagctagaaaaattcctccaacgaccacactgcatgaatccaacattatatagatagacctgcaacttatctttagaagatttagccaaaaaatcgtaacaacccaatcagcattaagaatattcctctgagaaatctagtatgccaatagaagataaactccgtgttgtttgaaagtatattcttcttctattcactaggttttagttttacattttaaatgatcgcagatatcataaggcagtgtagttttagaacgaagtgaagttgcagatccagattgtattgctatgttctagtcttttgatcctttgttaattacaaaatgtacttgcttgtcgatcatgacaagccaagtttgtaaaacaatctctggttgaatgaaattgtcgatgataaaatgcaatcacgaagcggttgtgaatggaaaattaactcttttatagcatcccaagacacaaatcagaaacgagttcacaccaattctagagaagaaaatacaagagtttgagagagtgaaaactaaagagaggctcctccattcttctcaaactcccatgatcctccattcttcttctcaaactcccatgagatccccatagctacgcatgaggacgactcctcctgcaaacataccaagtgctcgcagaagtttctgcaaccaaaaggaattcgtatgagacagatttcgatccaaatacttcaaaggcatgaactataataaaccctaaatctctaagagacccaacatccccaaattcccattcgaacatccaaatacttcaaaggcatgaacttaacttgtgattgataaaccctaaacctctaagagacccaacattcccattcgaacacacaatttcataagaagaagacacagagataagataaggtcatctgatttggcctatcgaagcataggagagaaaatcaatcctacgttaaattctgaaacccaaaacgaactcattaaattcaattcccattcgaacacacaatttcataagaaagacaaaagaatcacattgtacgctcaattgaatcaatttgtaaatcctaaaccgtaattcaaaatcgctgtacaactcattaaattcagccgaaagcccagaatctaatcatgaaacatacaagagaatcgagacttcgatattcaatagacaatcaagtcggaattaaacgaaagagagaatgtatgaaggttaccatgttcaccgcccatttttgttcatcatgaacctcggagtgccagagtgctttcatcttttcgatagagacaacgttgttcaccatcttgctgctgaaaaatcgaaacttttgatcgtcgaaaaaagaagaagctagggcttttaaaacgacgaattgggatcgggaaattttagtcggttaacttattaagggtttacgttttgtttaattaccaaactaacctttactaatatactaataaccggtaaaaagtgatgtgatttggattgatttcaaccggagaagagttaaccactcgccgaacgacacgtgttcaacacaatcctattcctcctagcaatctcaaagcttgtgtgatctacaagctcttggtttctccattgaagaaaaagctttgacaaaaccagggaaagagacagagagagata

SEQ ID NO: 14902 - DNA, 3000 bp, Unknown
  misc_feature (1)..( 3000): cDNA_ID_1020790_gDNA_ID_2684233_Annot_ID_192343 3000 nt of promoter + ATG
caaaacctgattacatcagctcataatccaataatcaaatgaatccgaacacaagaaaaaaaaaactcaaatttgataatcacctgattatttctcgtagcctccaccacgcgtatccaaatcctcctcgactgtggtggtcaagtaaaccttagggaagtccgagacgtcaaaactcttcttctcgttcatcatctgaaccacgttgtccttcgtcaatacgtatcgccggatcggtgggcggtttctgcgctgatctctgccgtggtatacgatgttgtatacggtctctggatccgaggaaggcacgattgcttcttcatcaatcgtagcggggcatcggagacgatactccgtcgcctttggaacagcttcgaggtattctgggtgagcgcaaggtccggtgatctgccatggcttcttgatgtaccgcctaaggttttgcacaagcgaggaagccgccgtcgacactgatttcgccattgttgagagaccttcgcttcgatttggggagatgaaaccaaagttcgaatcgaaatcgaaggattattaaaccggtctcatatattggattggttcaatactttaaaccgataaataacctcccagtgtactgctttggttacaaaaactcggagagaagagagacgtcacgtcgtcaatgattttgagattctgtgatgatgagattattgttaaagtaggcccaatacaaaatttgaatccattatagttgggcctaaggttttatagttacacttccagtcaaatatcgttacatatcttgtcaattatagttggcccaaaataacatattattcttttgaaatatgtgtatggattcaattttagttttgggcctacttaacaatctcatcatcacagagtttgttacacatctttggttacaccggtctgagatagtggattggtcaaacatttaaaccgagatttaacatccaagtctactagtttggttacaaaaattgagattatgtggtgatgagatttttttttttttttaacaccaaatcaattatattatattataaaaatgttacagaatacatgattcatggttttataaaagccctttataaattgaaactgacatcaagttgggtgagattttgagagtatataataaactctttggctttgtggtcttattacttatgaagtcatgggatattcatagtttcatactcatacatatgttagtaatcaaacaaacgcattaacgcatgcataaattttttaattgtgagttaacaataacaatgacatagtcctccgtgagacatagctttgcagtaatcgccttttccattcccgcatccattgtgacaccaacggttacatctctgattgtcattgtttgtgttgcactttccaaatttcgggtggttattacaacacaaggaaccaccactctctacattatatccttcaacatctgccaatatcacacaaaattgaaacagttttgcctaatatgagttcatggaattttgtaattaaagtaacaagtttgtattgaaacacaaaaataagtttgttagtgttataaacactcgagaaaatacccctagttataagagagaagacgtaccaactgagaaagtgagaacaaggatcaaagcaaaagaaaaaactttcaaactggccattgttactagtccttttagatttttataagtgtttaagtttggtttgttttcagataaaaagaaagatatatgttgttcttatttatacctaatggataccacaattttagttgatctgttgatgaaaaaaacttgtttttgctaattatactgtaacgttttgtctagtctattggaaaattcaaacccttcatgttctgttgtgacagacaacttcttcttgttgcacataacaaaaacaataagtaaacgtattgaaattcaaaacgtttctcttggattctgtatatgaaaccatttacatagatagaaaatagtgaaaatgactggttgatacaatgtagatcaaatacattataaagttttcatcttaaatgcagaaaagtctcttgctacaccgggtaaatatatttgatacaaaaaaaaaacgatcgggctaatcagatttctgcaaattggagacaaaaccagaagcagcaaaagcagcagagccaccaagaacagagagtagagccacaagaacctgaatcactacttcccaagtgtaatcttcaggaaccacatatgcaaaaaccggtccaagaaggagtaaaccgaggctcaaagtgaataacgttccaggcgtttccgggtttgtggcggcagacaaaacgccgaactcctctgctttggtcagcaatccaagacgctcgatggtcgatagagagaaacctgatttctctgctaaagacaaaagtcctgctttctcggctttggtcagaagcttgagctgctcgactcttgtcagcagtttcacctgtggagtcgctgtgctctgccaaacataacaaagagattagattttgggacatataagaagataaattttgattttcaacttttaccttctttgaggttattgttcttgttgcagcagaaggtgatggcttcttatttgccattgaatgcactgttaaagacgaacagattagtttagccgccattatctctctctgtctctttccctggttttgtcaaagctttttcttcaatggagaaaccaagagcttgtagatcacacaagctttgagattgctaggaggaataggattgtgttgaacacgtgtcgttcggcgagtggttaactcttctccggttgaaatcaatccaaatcacatcactttttaccggttattagtatattagtaaaggttagtttggtaattaaacaaaacgtaaacccttaataagttaaccgactaaaatttcccgatcccaattcgtcgttttaaaagccctagcttcttcttttttcgacgatcaaaagtttcgatttttcagcagcaagatg

SEQ ID NO: 14903 - DNA, 3000 bp, Unknown
  misc_feature (1)..( 3000): cDNA_ID_3019602_gDNA_ID_2684233_Annot_ID_192338 3000 nt of promoter + ATG
aatccgtggccgagcagttcttgaaaatacacgacgccaatttcgctagccgaccaccaaactcaggagctaaacacatggcatataactatcaagatcttgtctttgcaccttacggacaccgatggagactgttgagaaagattagttctgttcatctattttcagctaaagctctcgaagatttcaaacatgttcgacaggtaaaacaattataaacggtattctcattttctaacgctatagctcactggcctgtaatcatgtcatttcaatgttttgactttttctttatatatacataattataatttataattgggatttcaaaccctatctctcactatttcaagactagaccggattggaatttgaacttttgtaatgaatattagtatctgcacataaattttatgttaaagttgggttttcttaaagtgaatttatatattaaaaatatataaacgattgggttttactcaaatgaatttacataagagctaggtataagtgcaaatatgcaatactgtcattgtcgtggatgtataaaagtatgatctaactttgatgatgccatggaaaaattggaaagttcagatccagaggaaatattgcttgaattataaaatgtatggaccacattgtttccttaaatggaaggtctcacgagtttctcaatttcagactactgataatatatgctattatagattttattttctaattattttttttggtttaatttaattagagtaaatttttaaaaagaaatatatggttttgttaaccgtgttttaaaatttgatagagcttttagatcataatcataattttttcgtattaattgtgattatgttggacgaaaatacttaattagtattcaagaaaacttttattctaaaaacagaataaaataaattttacaggaagaggttggaacgctaacgcgggagctagtgcgtgttggcacgaaacccgtgaatttaggccagttggtgaacatgtgtgtagtcaacgctctaggacgagagatgatcggacggcgattgttcggcgccgacgccgatcataaagctgacgagtttcgatcaatggtgacggaaatgatggctctcgccggagtattcaacatcggagacttcgtgccgtcacttgattggttagatttacaaggcgtcgctggtaaaatgaaacggcttcacaagagattcgacgcttttctatcgtcgattttgaaagagcacgaaatgaacggtcaagatcaaaagcatacagatatgcttagcactttaatctcccttaaaggaactgatcttgacggtgacggaggaagcttaacggatactgagattaaagccttgctattggtcagttttttgacaattaatttccttaaaaatcgtatataatgaaagttagattgttttttttggttgtaaatacagaacatgttcacagctggaactgacacgtcagcaagtacggtggactgggctatagctgaacttatccgtcacccggatataatggttaaagcccaagaagaacttgatattgttgtgggccgtgacaggcctgttaatgaatcagacatcgctcagcttccttaccttcaggtaccgttaacccaaaccggaatttggaattgttttggttagcgagctattgttgttaatccggttttggtttaaaacaggcggttatcaaagagaatttcaggcttcatccaccaacaccactctcgttaccacacatcgcgtcagagagctgtgagatcaacggctaccatatcccgaaaggatcgactctattgacgaacatatgggccatagcccgtgacccggatcaatggtccgacccgttagcatttaaacccgagagattcttacccggtggtgaaaaatccggcgttgatgtgaaaggaagcgatttcgagctaataccgttcggagctgggaggagaatctgtgccggtttaagtttagggttacgtacgattcagtttcttacggcgacgttggttcaaggatttgattgggaattagctggaggagttacgccggagaagctgaatatggaggagagttatgggcttacactgcaaagagcggttcctttggtggtacatcctaagccaaggttggctccgaacgtttatggactcgggtcgggttaaaatttaactttgcttcttggacaaggtatatggcttgcacgaaaataaagttttaaaacagcgtagtttgatccggagttagctttatgtaagaacgtgtaacgccaaatcaagtcattattaaatattgtgagttgtttgtaacctatatataaatcttgaagaggaagatttcagaaatcttgaatatgttttaggaaaaacattgttttttttacagtagcgcaagttgaattaaaacctattccttacagaaccaaatgcattaataattctagatatttttggccaagacaatcagatttttcaatatttcatatatactaggtggaacaccaccacctgcaactctgcaacacatgttacgttacacaatcacttttggcggttttcaattatttatataaaattgtaaatgtttgtacacagtagaaaattagtaatagtgaattttgtttctccgaatatgtatagcaatatatatggcatggatcaaactagccgacatcctaacttgttcacagctttcctttttacttatctagtcgattaagcatcagaaagtatgttttaatttttaaatttgaaaaaggtgtacttacaagttcgggtgttcacacggaggagagctacaataatgaaaaagctgactcaagaagggctatagaagaaacaagagtcacggaacaagttgtcactctcaatctccagtacactagcttccataactctctctctttcttctctctctaaaagttatcagaatagaaatctctctctctcaacaagtctaacagtgccatttgtatctctgaactccaacc

SEQ ID NO: 14904 - DNA, 3000 bp, Unknown
  misc_feature (1)..( 3000): cDNA_ID_2731167_gDNA_ID_2684233_Annot_ID_192336 3000 nt of promoter + ATG
ttgttttgttttccataacgaaaagagggcccccaaaaaggtactcaaggagctgacaaaaacaataaatatgcatatatatattaatgtaattaaattgtcttaagaaaatatcaaaatagcaaggataatatatatgaattgcaggcttgcagcttcgtgtaagcaggaggctcgcagatgagtttgaaagttgagtaataggatggttaggtaaagatgaccaatgatgacagtatactaggagatggaaatatcttcatggactaataaatgtatcatgtgacatgtcaatatattaattcctattacaaattaaaagtatctctaaaaattaaaataatttgcatgtgggaagatgtggaatcaaactaatacgtcagagaaaaacaagaagaatgacttgccatatttgtcgaggtaccgtaagtaaatgggttaaaccagaacaagaaggtaaagtttggttttctttttcggttcggtttcaggttttaggcaaatcacataaattttagttttatagaaactcaaacctctggatttactgctatagacaacgactatcaatattgaacaacacggaaacaacgtcattcaatgattcaagaattcgtaattctcaaaactctgcagttcatttcaattaacttgattacgtacaaaggggaagacaaaatatcaggttaaagaaagctaccacaaaagtcaaaacacaaactaatgaggctcaagatttaccacaaagatgtcaattgtttgagcaaaactacctaccaaggagccaaaaaatgtacgtcgagatagcctttttttaggaccgacagttaccagttggttcatatgaaatttcttttagcataatcgaatatttacgaagatttttaataatatcagacgagttctttctcatatcatggagacttatatacgaagcttgatcgtcatcatcatccacgaaacgtctaagctatcatataaaccctatgtaataaccacgaaaccctatgatcctgaaccttattctcatttgacaattgaaaattgttgtttctcgatgccttttgtagacctcgaacatggttatatgtagaagaataaaacaagcactattaacaaccaattgtcggttaaactaaagttccaaatctatatcatggaaatcgaaccaagcaaatcttgtaaaaatacttttcgctcaaaataaataaacatagtgctaagatatcaaaatgtgactgtcggatacttttgcatgtaaataaatttcaccttcttatagaaaatatacaaaacgttcataaaaaaactgttgcaactaatgtcatgactcgtcactcatgaacaaacgatgttgaaaacaatatgagatatctcattatgcgtaaaccaccaaaagaatacaaagtttaagggaaactctctccatacttgatacttcaaacgctggaagatgaatgagcagccgagcaggaccgttataaacccaagaaacagaaacggttgcaattaggcttataaagcaaaatctttcggatgaaagtaattatattctacttttcagttttttttggatgaaagtagttatattctaatttatattaaaaagtatttatattatactatgataagagagtgttgacctgaaatttacagtttatcagcaacaatattcggtttattagtttccaagaaagacaaatttcccttataacaattcaaaagtatgtgataatgtggcagtaagttataaaagatgccataatcttacttaaagttagtcaaagagtatctataatttgactaggaaagtcttatgaaaagattataaaaatcggatctaccttttttaataatgtaatgaaaagattgtcatgtggaaacacatcaatacgatgctgttttaacatcttaggtggttccctagttaattaaatggtccgtcacttgccccaaaaccaactagtctaaccttctgtctttgaaagagagttctgatctacgacccatctccttcgtacccgagcctgaaatttatcttccggacccgagcctcggatttgctcctgcgtccgccgttgaaaattttcgtactcccttcgatcacttatctctctttctctcttctcctggtttcgttaattatcggattcgaaaaccctaacttattcttagaaattgaggtcggagaagaaagcttgtcaggctttccaattgttgtcgacgcgacagaacaagtgtaagtctgcatacatctctcttactcttagtagaaaccctagttttgtgtaatgtcccaataggaaaatgatgtgtgaattcccaattctttggagcgtgttggtaaaattgaagtaagataggttctcgtttgaggttgaattctaggttatggtaatgttcgtgttagccagagcttcgattttgggtgaaattgtgttgcggcaattttgatctcagagtaggttctcgagatttccgataaagtctagaaattggtcgaaattagcttatttttcagctgccatagagtgtttatagctgtgaaatgcgagagttccactgtttattttttgtataaggatcttgatgatatttactgcaaatgaatactcgagattactggattaggtgcatttgagtttgttatagtttcagaagttgagttggagtttaggctttggcttagtggaccttggatgtcaatgtacggttttcatttaaggaaacaatgctgattcagctttccttatcacctggtcggcgttgtctcgcttcgttggtctgagggttttcctgcgtgaagatttaaactttcttgtcttaaactgaatcagggttgaggatcttgtccgatgattttcatttgactcacttttgtttcctaatttgcagaaaacaacgattgttttagatcaaaggagacacaagattgaaatatttttcgtttcttttcgaggtccagatatttaaaaataatttctagaagctgaatctatg

SEQ ID NO: 14905 - DNA, 3000 bp, Unknown
  misc_feature (1)..( 3000): cDNA_ID_2731171_gDNA_ID_2684233_Annot_ID_192335 3000 nt of promoter + ATG
atcctcaaaaggtagctcccaaaggggagcaacagtcaccttcaaaatctgatagtttagttagagatggattgaatcacagggaatcagtgaaccacatgccgtattttggccaaaatgtaactcagagtttctcgactaagaatcattcagcctcggttggagcagatcatcaacaaatcagtcctcagatggccccatcctggtatagtcaatatgggacttttaagaatggactggtgcaacccgtgaatgatactgggagattcacccccttaaagataggagaacaatcgtctaatgttggaagttcagttgatggcacacactctgttcaattgtcacagcactttaaaatgcagcaaatgtcaggctccacactaggagcagagattccctcatctgagtcattgcctcatggtgcaaccgaacaacttctgaaggttaataaaccaaagaagcgcaaaaccgccacatcagaacttataccttggaataaagaagtcatgcaggggcaccagaggcttaagactctcgggtatgtggcattagcactaatagtccctttttttctttcaatatcctttaccgtaattaactttctacattattttcagtgaggccgaagttgattgggccagagcaaccaatcgatttgctgaaaaagtaagtttcctcattacatgttttctcacgagtctctttgtacaatcttgttaatacgttgatggcttttgttctcccaggtggaatttgagactttacttgaggatagcccaccaattaaatcaaagagaaggcttgtatatacaacacaactcatgcaacaactatgtagcccgcctccggctagggtgatatctttggttgctagctcaaattatgagtttgttgcatatactgccgcaagaggtgcactaggagatgcatgtagctccagtagtaccgacaggagtgagggcttttggccccccaacatttcaaacccgtaaggatattttcagtttatccttgaagtgttgtagattttctagagtttgtggttctctattgacacgaagagacgcactcttgtgtaggttgtctgagagaacgaaaactgaaaaaatcagtgaccaatacatctccaaagcagctgaagatttcattagtagaacacggaaactagagactgactttgcaaggtattaaccgtagctaactgattccattttggcatggccactcatctgtgctggtttgacctcattcatgaacatctctggttcttcttgcaggctagaaaatggaactacaattccagacttgagagtcgaagtccaggatctagagaagtttgcagtgatcaatcgttttgcgaaattccacccaccatctatggacaggaccttgaattcagttaggataaacccacaaagatatgttacggtagctccaatgcctcagaatattccagacagggtacaatgtctctcgctctaaccaatgatgaatccccatagaattcagtttttggccaatcttccccattcattgctttcatataatctcttgccccaaatctttcattttttttttgggtgggcacgagttagttggtcggaaccctgagatcagtgaaggcctccatttgttgaaaagccggagattttcctctaaatatgtagcattatcgtatgcatcaccataacattgtaagttaaacccatctgtaaacagtactttagtaaagaaaagttgtttagtacaaaaaccctgatggcctgatagtattacatcatcacctctggtatcctactttcggttaacaaagcgtatctgacttttgtaatgcattatattatgcatatgcccaaccctagtttatgtaaagaagataatattgaaatgcaaaacatgaattcgttgaaaaaatgtgaatccatatcttaatctgactatctaaataacaatgattcatgaattattgcaatttaatcgtatggtgaaacgtatcgatacggcgtcgtatttgtttagttataattgtcttatcactggcccacactacaacaactctcatctaaatcctccgtctctactagagagttttggatctacgagccatctgctgtggacccgaacctctcggacccgaacctggagtttcgatcactttatctctctcttcccctgatttcgttaattcttggattcagaaaaaaccctaacttgttcttagaaattgaggtcggagaagcaaatttccagttgttttacggccaaacgttatacaagtgtaagttcacatctctctttcccattgttgaaaccctatcttttttttctttaaattccccaattggtggagcctgtcggtaggattaaagtctggaacgttctcctgtgtggttgaattctaggttatggtaatgttcattttaaccagagcttcgatttggggtgaaattgtattgcagcagttttgatctcaagtaggttcacgagatttccaataaattctgtaaatttctaatatatgagcttaatttcagctggtttattgcggagaaatgggaattttagctggtattttttgttaattgatttcatttactgcaaatgagctctcgagtttactagatcaggtggatattgagtgtgatatagtttcagaagctgattggagcgtagactttgtctgagtgtttcttagacgtaggggttttagctttcttgtgaaccaatagtatctactgtttttgtttcactttgtgtgttcaactttaaatgtacagtatctgctttgcttgtttaacaggaaaatcttgagcattcggatttcggagcatcttagttggaagtagctcatgaattctcgggggaaaaaggtgttaaaaatgttcctttttgttttttttacattcgaatataagatcgaaggagagacaatattgaactcttttctgtttcttctcgaggtccagatatttataataatttatcggagctgaatctatg

SEQ ID NO: 14906 - DNA, 3000 bp, Unknown; identical to SEQ ID NO: 771
  misc_feature (1)..( 3000): cDNA_ID_1013016_gDNA_ID_2684233_Annot_ID_192333 3000 nt of promoter + ATG

SEQ ID NO: 14907 - DNA, 3000 bp, Unknown; identical to SEQ ID NO: 773
  misc_feature (1)..( 3000): cDNA_ID_2125817_gDNA_ID_2684233_Annot_ID_192332 3000 nt of promoter + ATG

SEQ ID NO: 14908 - DNA, 3000 bp, Unknown; identical to SEQ ID NO: 770
  misc_feature (1)..( 3000): cDNA_ID_2125806_gDNA_ID_2684233_Annot_ID_192329 3000 nt of promoter + ATG

SEQ ID NO: 14909 - DNA, 3000 bp, Unknown; identical to SEQ ID NO: 774
  misc_feature (1)..( 3000): cDNA_ID_2125798_gDNA_ID_2684233_Annot_ID_192326 3000 nt of promoter + ATG

SEQ ID NO: 14910 - DNA, 3000 bp, Unknown; identical to SEQ ID NO: 769
  misc_feature (1)..( 3000): cDNA_ID_2125794_gDNA_ID_2684233_Annot_ID_192325 3000 nt of promoter + ATG

SEQ ID NO: 14911 - DNA, 3000 bp, Unknown; identical to SEQ ID NO: 775
  misc_feature (1)..( 3000): cDNA_ID_2125790_gDNA_ID_2684233_Annot_ID_192324 3000 nt of promoter + ATG

SEQ ID NO: 14912 - DNA, 3000 bp, Unknown; identical to SEQ ID NO: 774
  misc_feature (1)..( 3000): cDNA_ID_2731187_gDNA_ID_2684233_Annot_ID_137654 3000 nt of promoter + ATG

SEQ ID NO: 14913 - DNA, 3000 bp, Unknown
  misc_feature (1)..( 3000): cDNA_ID_2731183_gDNA_ID_2684233_Annot_ID_137656 3000 nt of promoter + ATG
ccaaaatatatgaacaattatataggtcagttaaattcaaaacctctaggtgaaaaccttcacagctttgctttcgatataatttcaattatatgtgaggttgctaatcgtcgaagtagtggggcagtttcatttgtatccagagtcctttagttctgtttgcaacttttgtcccgtatatattactcttatcaagacttatctcggggttaaaattatttacaatttaacacggcagtttgcatttaaagtctatataaattaaaattgtataatgatagattctttaaataaattcatgaagaatggtttgaaccattcccgttgtgtatattacccttgtaaatgatatgactgctatcttgaacccatagcctataaattgttgctaactttgctaatcttaacaggggttgggtgtgatgctaaggttgcccttgagattcacaatctacgggaggagaatccagagagattttatagccaggtaaccaaatgaacattaattgataaaattttgatataacctcaggaaaactgtatttctatatttcacaatcatgatataactggcatatattgtagagaagctgtatggttaatcctttagtccatgaaactgatatttgaatggtctccatgtgcagtttatgaacaaagtcctctatgccagagaaggtgcaaggagtataatggacagaacattcgaagatttcccttggcaagttcgagttgaggtggatggtgttgacatcgaggttcctgaggtgagtcacagataccttacagatacgacccgcatgataattaatgctctaacttctctatgctaaatctctgaaggatgcggaaggaatactggttgcaaacattggaagttacatgggaggggtggatttatggcagaatgaagatgaaacatatgaaaactttgatccgcaatcgatgcacgacaagatagttgaagttgtgagtatatctgggacatggcaccttgggaaacttcaggttatatttgtactcttatgtcttatttgtatacatttgactggtaacctaaaaactaacataaattgatttttgttttgttttcacatcttcaggtcgggttgtctcgtgcgagaaggctagctcaagggtcagcagtcaagatacaactttgtgcgcctttaccagtgcaaattgatggagagccttggaatcagcaaccatgtaccttaaccatatcgcaccatggccaggttcttctctccatttccctaacttagattctggattcaaatcaagttttctactgagaaaaagttgcactagattgtaaaagtttgtggtcttctgttttttcttaactcctctaaaagctcgaaccattttttgtgaaactgtttttagttttctcacttaccttcacttgcaccaggctttcatgctaaagagagccgcggaagagccactgggtcacgcagcagctataatcacagatgttctagagaatgcagaaaccaatcaagtgataaacgcttctcagaaacgaacgctgcttcaagaaatggctctacggctaacttaaaacaggggaaaaaaaaagaaaagacagaagacaaaaccttccctcttcaacaaccaatcaatcatcactggttagttacaaatatttacaaatgcgtgtattttacatatcttgtacctctgcctaatgaagggaatgttaaaaagtcttgaagatcgaaatccgctgattgacaaagcgggttctgtgtggaagtaggaaaaaggaaccaaaaattggaatctggttcctagatttttggctgttctcatagtgaatgaaagcaaaacgtgtttaattatctctgtctttctcatattttattattatgggttccttttctatatcaaatagaattttgagaagaatcatgtatgtacatatagatgaaccatgttcttaatttgtgattattttctagaaatagtattattaggcttcttacttcctgttctttttgctgcgtgtttgttcctaatgtttaccattcataaaacttttgaaattatgggctgagttctttgatattcagtatataatacaaacgatatcaagtcaaaagacttcacattttggcttttcacatcaacttcataacttggttgactggtcggtttcgaatttgagttattagtgtttttggtttgaaatttaacgagatgggtatgagaataaaataaatggaaaagaaaaaaaaaaattagtccgaccatgctgttgcttgaggaaggggctatatatcaaaagaaacctcgttttcttgtaataaaacaagccatttttctggttaatatcatatatacgttggtttaacaacactatcattagttagaagtttagaaccaagaaaaagacgtttaacaacgaaagttttaaaaatagaaccactaaaagaaagattttgcaaacaaaatgtttaggtatgattgaaaggtaagaggttatgtaagaaacaagacaggtaatgtggtcagaagacaagtttaagtacttcaaaaatgagtctttggtaacatagatatctgaaatttccctcgatttgattagtgggatcaccaataccaagataaaatctgaagtttagttcattgactcaatagtatttgagtcttggggctcgaaatgattttgattttgatttcttaccgatcttcgagtttccaaagctaagcacttttatcaaatttagggtctttttacttttccaaattatatttttctgtttttggggacgaatttggctttctttctatataacccgcgagcgagacagagaccttgaccctcacctaaacctcaaaaaccaaattttgaccccaaaagccatctcttttagcaatcagattactttgaaactttctctgggtatctgagatttcttcattatttatataaatcatctaatcgaaatctactgcgacgatcggcgaagaatcggaaacacaaaaatg

SEQ ID NO: 14914 - DNA, 3000 bp, Unknown; identical to SEQ ID NO: 770
  misc_feature (1)..( 3000): cDNA_ID_2125806_gDNA_ID_2684233_Annot_ID_137657 3000 nt of promoter + ATG

SEQ ID NO: 14915 - DNA, 3000 bp, Unknown; identical to SEQ ID NO: 773
  misc_feature (1)..( 3000): cDNA_ID_2731179_gDNA_ID_2684233_Annot_ID_137659 3000 nt of promoter + ATG

SEQ ID NO: 14916 - DNA, 3000 bp, Unknown; identical to SEQ ID NO: 771
  misc_feature (1)..( 3000): cDNA_ID_2731175_gDNA_ID_2684233_Annot_ID_137660 3000 nt of promoter + ATG

SEQ ID NO: 14917 - DNA, 3000 bp, Unknown; identical to SEQ ID NO: 14905
  misc_feature (1)..( 3000): cDNA_ID_2731171_gDNA_ID_2684233_Annot_ID_137662 3000 nt of promoter + ATG

SEQ ID NO: 14918 - DNA, 3000 bp, Unknown; identical to SEQ ID NO: 14904
  misc_feature (1)..( 3000): cDNA_ID_2731167_gDNA_ID_2684233_Annot_ID_137663 3000 nt of promoter + ATG

SEQ ID NO: 14919 - DNA, 3000 bp, Unknown; identical to SEQ ID NO: 14903
  misc_feature (1)..( 3000): cDNA_ID_3019602_gDNA_ID_2684233_Annot_ID_137665 3000 nt of promoter + ATG

SEQ ID NO: 14920 - DNA, 3000 bp, Unknown; identical to SEQ ID NO: 768
  misc_feature (1)..( 3000): cDNA_ID_2125786_gDNA_ID_2684233_Annot_ID_192323 3000 nt of promoter + ATG

SEQ ID NO: 14921 - DNA, 3000 bp, Unknown
  misc_feature (1)..( 3000): cDNA_ID_2731156_gDNA_ID_2684233_Annot_ID_137667 3000 nt of promoter + ATG
aaattccggtaacctttggtagctcgtacggcttcttcacaaaattgccggcctatgaagatcatttccttcatttaaccctccaagctccagattatccattgctgtactcacaaagctccaaagtcttgttcttttcttctttgtttctttaattactgctcatgactatctctctgatggaaaaagtcgaagcctttttctgtgtttctctaacgggtattgattgctaagtacttcgatttccgcgtagtatggtacatagttgaagtttgagaatttgggttttgttctctgatattttaactttggtgggtagcttttatatgcttattatagcttctttcttcgaaattgaaagcttgagcctttgattctaaagcttggagtgagttcgtttggattgatgcagatgttgtcaatgagggttagtgtttatgtagttggattggagaggatccaattactcttttgattgttgaggacgaagagagaagaaatggatctatggttaatcgcagctactgctgctacaggatatataaccaagcatttgcgaaatgtatccaaaggtaaatcttcttctgaagatttgactaatgtgaagctagagtcaccgagatgcttggctagtaatgtagtaagagttaaaaaaccaaaagaagaaaactttgaggattgcttaaatggggaaactcttgatctatatgaatgtggcaatgcatatggagtggaagtagcttcgaataatgaggaggatttgggatatgatgatgagattcgttcaggttcttttgggaacagagcgtttcttaggagaaatcagtgtcctatcaagcctttttctttggagaaaagcattatgtctcggttacatagagagaaaatatccatggaggaatatatgcgtagtccgtttccatcaccttgtggttcagtttcgaggcccttgcttgttactgatggtacaaatgtaattagcaagaatactggagattctgttagccagcaagtttcggaatgcgggattcctcagcttaggaagttgaaatcttcacttctttacgctaaaaggggagttggagatgcgaagagcgtgagtagaagatctgataatgggactggtaaaattcttgctctctttttaaaatgttacatttgtttatattgacaaaggagaagacttaacatgttatctttcttttcaggatcaaatgatccagtgttagtgctatgcgttgggatttcaattgggataatgtcatcatttgtagctaaccaaaccgaactaaacaaagtcagagcagagtcaaagcagacagagaatttgggaaaagagttagaagatgacatacacgatggtgaaaaacagtgtgatgaaaagacagcagagaattcagaatctataagtaaaattgaagcagaacttgaagctgaacttgaaaggctggagatcaacatgatttcctccaacattgagacaaaactctcagatgtctttgaggtgagctttatactctagcttttgctttttcctttcctttcactgaatcattgtctcattttggtcgatcatgtctgttcattctggaagttatcccgcagcactaatgatcctgttttctccatatatgaaaattgagcaaaacagatatttgatcataagactagccattgtttaatcatctatagaagttcagcttgtaaattgtttctcaattctgcagctggagccagatttcgaagtagaatttgcgcagggtgagctgagagatgatcaggttgaaagacagcgttttgatgaaaccgtgtccaaccaggaacggagtagcaattccacacctgaatcaggaaactacatagtctcacctcgtgagttaagcttgcgtctgcttggagttatcaattcatgctatgaaaaacggataaaagaacttgagaatgccttacaagagagtcagaggaaagtggagcagctggtcatagaatcagaggaaaagaagaaaccattgtcaaggatttgggaaacccatgaagagatgaaatataagaggggctcaaatcctccagtttctgtagctcatatagagaagaaacataatcctgcagagatccaacctctggttatgactttagaaggggaagcacttgacgcattcaatgaatcttacgaggaactgatggatattaacgactattcagaagaagacgatttacaatgtgtgatgcaggagaatgagcggcaagaagaattgtctttgacgagcaaaagctcaccttggagccataaagattacataaaggattcttcaagaacttcagaggatgtgaatttgtccatgctgcaagatctacttggtctgagcgacgaagaagaagaagaagaagatgagatggagaagcatctgataaagcagattgttgagaaaacaaagcaagggtcttctgctgtgttaaatgcccagaaaatgctattcctcatggaagaaatacaaccaaatctataaaaagcatttactcaaattctcatcattttttgatgaaagtattacacgtctctagttagtgtgtgtgtagatatgcaaagattggtgtaacttatcttgtcatatgcaaagaaactgaagagagaagaagatgtgttgtcaaattcaatgtatatatcttaagaccagtgtcaaagcttaagatgtgataatctttaagaccatctccaaaactccgatggagatgctctaagtttttctggcagaaagaagagtcttttgaaacctgctggttgggtcagagagtttgagagaaggcgccaaataaaccaaaagctagacaagaagaagcggtgaagttttgaaaacgagaataaaattcggcgggaataattaacgaaaaatctaatagctcccgcgcaaatctttcttttacaaaacaaaaccattttgcttcccatttcctgtgaattctaaagagaaagaagagatagagctagagattaagatagag

SEQ ID NO: 14922 - DNA, 3000 bp, Unknown; identical to SEQ ID NO: 14902
  misc_feature (1)..( 3000): cDNA_ID_1020790_gDNA_ID_2684233_Annot_ID_137669 3000 nt of promoter + ATG

SEQ ID NO: 14923 - DNA, 3000 bp, Unknown; identical to SEQ ID NO: 14901
  misc_feature (1)..( 3000): cDNA_ID_2685712_gDNA_ID_2684233_Annot_ID_137670 3000 nt of promoter + ATG

SEQ ID NO: 14924 - DNA, 1118 bp, Unknown
  misc_feature (1)..( 1118): cDNA_ID_2731254_gDNA_ID_2684234_Annot_ID_137672 3000 nt of promoter + ATG
gaattctttgatgaacaactgatgtatgttggtcaaaaatttgagacaagaatactgataatatcatgtatgttcctcagtcctgaacatttggtcatttggatcatgtgttgtgtgttactgtgtttgacaatctgtattgttgttatggtaaataacggttgtgttgtatcacacactataacaggtttacgtttacctaaacatattaagttataattaatgggccacaggcccatattatataatgtagttgggttttgttgacttgaacggctccagtaaattaccggtctgatgattgattgacgaataaagcgaataaaccatcggttatacaatttaaccgggtttatgacaacttcagagaccttatatcagatttcaaatcttcttcttcttctccgcgacgacgacgagcttcttcgattgatgactgtaataatctttcaagtttaattgcatcgcataaagataaagcccaatcctttattcttctaaaaccctaatttagcgtttcgagaagccgcaaaattgagttttgttatttcaaaaaatcgaaacctaaaacctcaattctctgggaatttcaaattctcttttcagtgtaatcgtcgtctcttctcaattcgacctaccgagtaagtttatcttcttccatttaagttaaattttgactctttccagcatccatggtctcactgtgcttctctttccttcacctcttcattgggagctttgaatagcgttttaatctatgtttaatatagtaatgtcattgacactgtgaatgatgctgatggttgttcttgtatgtgcacatgaattgtatttctgcgtatcacttgcattactgacgttaatctagtttatcaatcaaattctaattcagtgattttattgacttgcaattctttgccaatgtattgttgaccattttctttcttgatccattcatgtgcacgtttaagaacatccttgtaaggtcatgctttgtgatttacctttcttctgttatgccttgtaagtaagtatagttttttttggtacttttgttcacaggctgtagtacgtttgctgctatcagaaagagataatcaagaagcagaaataaaatg

SEQ ID NO: 14925 - DNA, 3000 bp, Unknown; identical to SEQ ID NO: 5813
  misc_feature (1)..( 3000): cDNA_ID_2041439_gDNA_ID_2684234_Annot_ID_137673 3000 nt of promoter + ATG

SEQ ID NO: 14926 - DNA, 3000 bp, Unknown
  misc_feature (1)..( 3000): cDNA_ID_2731250_gDNA_ID_2684234_Annot_ID_137674 3000 nt of promoter + ATG
cactgattaaaaaccgtggaacagggagattgcaagcacacgattgtgattcgagacatgaggatgagtcatccagaggacgttcagaacagagcagcttacccgatcatgttctggccgaaacgtaggattcagaaatgcggtgtttgtaagataaagagagcttcaaaggttgcagtggatgacaagtgggcaagcgagaacagtagctatttctgtgatgtttgttttgagcttctacactcagaggaaggcccacttaactgtgacttcccagtgtttgattatgtgcatgagtaaagatgatcttctttgttgcataatatatagataggaagaatacgaagaaatagttggcattgcaagaagaagacatgatgagtcttgtcttggtaaatttgttgcataattggatatatataaaagattttcttgaaatgatgacatgacaactatttctgaatttagccattgtcaaaagctctcttcgttttgaagcggtagaaaattagaaatgtttatgtttagccaaattcaaaagtagaggagattccttgaatttctgttttctctcgctgtcttctcaatattcaaaactcaaattggtgtcttctccaatttagaaaacgttaaaaacaagagaaaataaaactaaactttttagaaccaaaaaaaataaaaataaaacgcatttgggatttctcattgtcatcccaagttcttggaacagccaaatactttttcattattagtttataatcgtctcataaaggcaaaaaggtttatttcggaaataagatgggagcatatagagcagaagacgattatgattacctcttcaaggtggtcttaaccggagattccggcgtcgggaaatctaatttgttatctcgtttcaccagaaatgatttcagccacgactcacgtgcaaccatcggtgtcgaattcgccacacgaagcatccaatgcgatgataagatcgtcaaggctcaaatatgggataccgccggccaagaaaggtacttacactctaaaattactctcaaaagttatttaacgtttgcatgatgaccaaataaaattttaaaaaattaggtaccgagccatcacgagcgcttattaccgaggagctgttggtgcattgcttgtttatgacgtgacgcgccacgtgacattcgagaatgttgagagatggctaaaggagcttagggaccacacggacgcaaacattgtgatcatgctcgttggcaacaaagctgatcttcgtcaccttcgagccatctcaaccgaagaagctaaagcttttgcagagagggagaatacctttttcatggagacttctgcacttgaagctgtgaatgttgataatgctttcactgaagttctcactcagatttacagagttgttagcaagaaggctcttgaagctggagatgatccaaccactgctttgcctaaaggacagatgattaatgttggaggccgagatgatatctcagccgttaaaaaacctggttgctgctctgcatagacacacttctcacttttttcttgtacttttattactaaacactaacatttttcaatattttcctgcaaatttgtatacattcttggaattatcagacaaacaaagttcacactcaaaagtttttttagtttcggttccactctttacaatcgcttgcttcgtgctctctctgcttctaccgatcgatgtacttctgaatgttcatgaagatgttccattgttgacgcgctcctttttccccatctgcaaatagaggttaaaacagcctaatcagtttatatcatatgagcgtgaaatcttaaaaattgtacttcaaaatgtttctttcaactgtgagttttgtctagtaatgaaaaagctaaagccaacatggaagcagaagaagaagaattgcagattttgagtgcaacacaaacttaggaattatccaaacatacttggtacttgagaaatggaccttccatattctgatatttcatgctaatgtactgaaaccaattgcgaaaacagaggactatggaactcatttataatatcactttgtatggattctatatatgtgagtagcaaaatgaacctaaccatgaaccgtcttcgcttttttttctgcataaagttggataatattcagctcaaagaaaactagattctgatcttaatcatctataagtaaacaaaacagagtccatacagatttcgatatcttaggatcaagcaaagagtagttcaataagaaccaaggatctacataaagttataacaatcctaaaatgtcaatggcatactagagcaaattcaacaattttcttaatatcagttacactagaacaaagacgaacttcgttccaattccctaatcctaaactctcataatcaagaacaaatatcaaaccataacaattgagttactcagtttgaaaaaaacgaatctcaccagagaaaaaacgcagatacggaatcatttttcttcatcgcgaggcttagaactcgattgaagagaaggaagaggattagagcccttgatgatccaaccgagtccgaagaaaaaacctccagctagaatcgcagttccccaagcgtgtgagtaccatttactgtattgccgaatcgcgaatttccattgctcccttaacgtcgcctgatccggattcaccgactcaggcgggttataataccttttacccgaacccgatccgatctccggcgtcggttttttcgccgacgaagaagtattgttgttgttatcagggatttggctcttctccgccattgtcgtcgtctagattcttttcttcagatgttgaaaatcattttcagaaaatgtgtatttaactctaaagccactgacacgtgcaagataatgccacgtggcagtttctcgtactaaaacgattccgtttcattgtttcgtctacctctaaccccaccttagggttttagtactctctgtgatttttatctgttcgtca

SEQ ID NO: 14927 - DNA, 3000 bp, Unknown
  misc_feature (1)..( 3000): cDNA_ID_1441974_gDNA_ID_2684234_Annot_ID_137676 3000 nt of promoter + ATG
taaaatccaaaaagtaaggtacaacaatcaattgaattagttgataaacaattgacggtttgagcggaggtgggaagatctttctttaattctttagtgtgactgtttgatgcaataaaaaaagagacatgaatggatttattttgttttgtatgtgaatgaatgaaattgtgtgtgtaggaacaaactctctcatcaaccttttatttgcaaaagcaaaacatatctacactaaaatgagcattcatggagacgtgaattaagtgttatattaatggtcattaccgaaaagatcagagccggctcaaactttttgaagaccttgtgctgatttataaaaattggctttagttaatactgtttttaattacagagactagattttaacccgcggtataccgcggaaacaatttattttttaaattaatatatataaaagtttgtaaattgtatctatttataaaatgtttttattgtatagtttacaatttttattaagtaacgtcctgccaaacccgtctcgccaacccgtcctctaaaaaagactcatttattttattaatgttgatcttatttatgatatgtttataaattattgtctaaatattttgtaattttgtagtaattaaatgctatcaaatatctatacggtttgatgattataatcatgcagaaaaaatatcaaaaatgataattttgtagtaattaaatgatattaaatattttagaaattttattttagtaattaatagtgtagttaaggtagagagattttggaaagattgttaaatgtcaaatatttaattagaatattttctttctaattatcaaaaacaattattaaatgtcaatggcagccgctgtaaataaatctcaactctaggatttatttcacaaagtggctgcaaaaatgtatatatagatttttggacctaaaatcttaagtaaaattggaataaaattgatgactctgtgctttagctcctctggcaccccctagagccggcactggatatttgtttgttgctttgactaaatcaattaaaagtttcaaaacaaatacgagctaaaaagataaactactccattaagcatccagcccattactcaaactcaaatcagaacctaacctagttgagtatggatatgctttctttctttacaacattttggtctcaagtctttgagcctagacacaaacatttctccatgttttcaatatgagacttttttccatgtgttcaatgtatgttttttcaaacaaatcaactttggacattcatttctcattcaaatgaactttaatttgaaaaattactagaaaaagtagttcaacataacttgtcaaaataaattctagcattggagtacaaatggttgtctcaaaataagaagttgaaagagtggaaatgatcattcatctttttttttttttttttttgtcatttaacatgaacaagttagaaaactcattcaatctattcaaccaaattgttttttaaaaataaataaattatacagaaaatttggtcaacctttttatctactatttcgcagatatttttttcttctaattattcatgtatatatcgaagatcaaaaatatcatattccctaatttgttgtcatagtttcttgctaagtcttttttgtcgtcaacgtatgcgcctccaaatcttgctctcatttgtgaatttcttagaagtaaaagtttactcaaatcaattttaattagaaattcttgattcttgttttttttgtacattttttgaaaatatatatcttatttgttgttgtttttaagacatcaatgcaccatgcataaaacccccaataagtctgattcacttaatctcatttcacaagattggaagaaaatattcaacaatatgaatacataacgagaaatgtgttcatttgcttgtggatgtaccaaaacttcgagaagcacgctaaattaatctagaaggtccctttatttaaatcttatatataaataagcatttgttataagttcatcatcaattatgtcaagactcactatgactacagagtgatatcctacgaaaatagggttaggaatccgtgattcggcgagattatagtaaataaattttccttgttcacccattcattagtaatgaagtatgtcggcttctatcagatgtaactcttgcaaaactttttctattgtgttgattcttcggacatgttttagaattcttttcttcatgaaaggatcctcagcgcatccagacttgtgatctctgcaatcaaacaccctaaccaattctctgggaattccatatgttttggtatggagtaaagccttttcgatcgttaatccataacagtgatgcatgttcttagtttctgcacatttttgaagctcttctaaatcactaggagggtagataccaagtgcatagtggcggataaaactttttttttcaaattgtgcaatgctagtttgttgggatgtttcttcattttcaatggtgctcgatgctctcggtcactttgacttttgtttaggtgttatctttttctcgtatccttttgctctctctttcacttgttccatttctttttgattaaactcataatatttgttgctctttgtttgttacatgtaataatctattctatatatctaagaaaaatacttacaaaaagaacattattatcacatatgcacagaaaccgccaaaattgggtcttttaaattagattaaagaaattgaacttgacaaagaagaacaaacaaaatagaggggtctattccacaaataaaataaagttgtaaaaagacgacccaaacaaaacgactcaacttctctctttcttcttcctcttcaccaatcggatccacgaaaaattcgataaacctcgattgatcccaaattcccaatggaggtttctgttctcacctaatttagctccatatccctcgcagtccgattcaagtgagattcttctaagttttttggaagaataatg

SEQ ID NO: 14928 - DNA, 3000 bp, Unknown
  misc_feature (1)..( 3000): cDNA_ID_3019687_gDNA_ID_2684234_Annot_ID_192374 3000 nt of promoter + ATG
tgccacaaaagttgctcaatctcagcaggattaacaaaaaaataccaaagaataacaactgggcagagttttccaaacttaccctttcattttctctctgtaagaatttttctcttctttctacttcacgacgctgctcacgctgtaacctttcctcttcttttattctttcacgcatcaacctctcttcttccttacgcctctcacgctcgttcctttccatctcttttctcatgcgttcttcattctgaggacacaagcatcaactcatcaatatatctgttacagtgatactaacaaaagacaataagacacctttccaaataatcagtaaggaggataataaatgtagagcaaatacctttttcctctgaatttctagcttctcaagatcttttggtccatgattctctcgggtttcactccctcttccaagtctaccatcgttaatctgtgagagtaaacatagaaaaatgacattacaacaaagacacatcttgtcaacaaaaacggatgaaataaaagttggtacaatgaagctacctttccctttctatgcacatcactactcttacgcactccatcaggtaacaaatatggatcttctgtaccaaggactgatgagtccttctccagcaggaatctatcaccatgatgcgctgattcaatggggcttggcatgtcttgttgagatgtcgaacagttacgagacgcatgtccaggggtaacataggaccttggtacaggtccattcgcgtgcataaatgatgaaattctagaacgtgcaacttcatagtccataccacgtgcatgattttcagagtatcgttcatacatattaggtgtaaaagaagacggatcatccagagattgttgctcatggaaagaacgggcagcagcatgagactataatcaacaaaagcaaatatgttaagcaaagtagtaaaaagaaaatattataaaactgtgaatacatgaatggacaagaaagagaatagaaacagcagagcggaattcatctttctaacaatgatcagagactaaaaactgccataagactaatgtcagccttcatgtaatgagaactctaaaaattactcctaccatataattcatagaccatcagtttatggtaacctcttcaactagtcaatttgagatatctaggtgcattataaagaaactaaatagagcatatctgtttagtcagaaaactaactcttcgaggtcggggatcatgtcgctcatacagatcgctctcatagggatgaagtaggtgtttctgcatcgctgaaatgccaatgaaaacaaagttagagagttacttatcacaagaagtgtaatactaacactgacattggttacacaagtcataaaacagggcaaacatagaaagtaatgtatacctataggtgttccaaacgcaccaggaggcaaaggatcaaactccatgccaagaataggtccatcatctctcaatggctcacctaactgagcctcaatacagacaatagctctatgcaccattgtcgacaaccgcgactcataactcggctttcccattgtctcatattcatccaattcagctcgagaactactactaccactagcaaaattcctcctagagttggaataaggactgcaaccagactcagaacccgaatcagatctggaatcttgctcaggtaccgatccagcagcagccggtaactcgttaaccgaagccgattgaaccgcagcaaccgatgatttcaccggtttattagactgaccatccttcttgtcctttaaccgtctatgacaaaaccacatctgtaattgtcgatctgacaaatccaatttctcagataactcagccctcgtcgcctccgacggatacttctcctctgaatcaaaaattcaacatcaatacttaaaaaaacaaagagaacgaagattgaatcaaattaattgagatgaataagaacctgaataaactttctccaaggtttcaagctgaaacggagttttcatctgacgtttaggcttgacacgaccatccttagaggaggaattattatcaatcttcttcttcttattattaagattagcatcaccaacgacgctcctgatcttctgatcttcaccgtcagaacccatctccatggaaagagaagaagaagaagaaacccagaaacggccgcaagaagaatcaaagaacacaaaaacaaaaactagggctttctattgaacaaacaaaccctgatccaaaaacgtaaaaaaataaaaataaaaagaagtagaatatataagagtaagaataagaagaagaggaagaacaaacaataataatagtaaaatcgataaaaaccaaaaaggaagaaaaacaacaacagggcttctagtagtagtagtagtagtaccactcatctcaatttcaacctccttcatattcctttctttttttttgcctttcttcttaattaaaatcttgtttttttttgttgtaaatgaaaagaaaaaaaaaatcgaaacttgaggattctacagcgaatcgcgtgcttatgtgtgtttctgccgttgatgtgtttatcaaagctttttttctttttattatataaatcaagttaatttaaaactaaattaatacaacaactcttgaagggctttaacgtgcttttggtctcgtgttcgtgttgttgtctttcagatccgcaggctggttgcatgattatcatatcccccagattttttttttgaggaaccacttgtgttgagagtaaacatcttgccctttattgttttcaagtgtacagtccttgtcgtttttaaaaccggttcaatacttcaattcagattttttaatcccggtttactcgccgtccctatgaatcacagaggaatcgaaagaacctttacgaggaagctttgactcgaaatctctctgaagaagaagaggagagacgaaactgttggcttagtttccgacgccgggaacgtcggaactccggtgaacagaga

SEQ ID NO: 14929 - DNA, 3000 bp, Unknown
  misc_feature (1)..( 3000): cDNA_ID_3019691_gDNA_ID_2684234_Annot_ID_192373 3000 nt of promoter + ATG
tggagatttcatttttaatcagatgtgattaaggatcagacaaatcaaacattgatttaaaccatctacaagctctgaaaaatatgaactgacataccatgaaaaacaccacttctctgtttgcgagagccgctgtgatctcggttctttccatctcatgctcgatgaagccttgcaactataaagaatcaaagcaaagcgcggttacagattcattcgatctaaatactggagattgtgaaatgtgattatctgaaacaaaacctggtggtgatatttggtaacagctgcccagaggctttttaactgtgacagggcttttgtgagatacggttgcacagagagaaccttctttcccttccagtgaatgtcaaatgcttcatcaactttgggcagatgttttctttggatatcgctcatgagctaaatacagatacacaaaggagaaatgagaggctatgagattattaaacgacggtttaattgtctattcctcagatttcatatcactgggagtccacagctggatttgaaatttaccttcacgaacgggcatctgctaggtgtgtgatgccttcggttattgaattctctcatcttcaagatgcaataggaacaatcatcagtgacgtgaatttataccccacttggtcacaactcacaagattcaactgcattaagcgaaagaaacttaaaggcaaaaattaaaaacctgctcaagatgttgaacctgaatccactgctccgtaacaacttctgtcatctaaaaatgataaaggaagtaggtcagtgccaaaagagcttgaagcatttggtgacagcaacaatctaaaactcattttcatacaaacatatcagaaacagacagatttcatttgctaccacatcaaagggacaaacaaaaacaagacaaggacaaaaccaaacaaaagtggggtaatttggtactacacataacaaatttagttacatagattaatagatgcttaaatacctaacaacaacaagttttatgccgatttatgttggttctctgagatccaaacatatatattcaaagtttaaaggaatctatcaaaatttttgtagaaattaaactgaagtgaacttagagatgattctgaactaccaagaatagttaataatttctgctttggatagaagattaaaggaatgggtgaagtaagaaaagccaataatcacctgttcaacttccaaagccttagctttaagtttattcttagcttctcttgctttatcctctaaaacgtgtagctcgaagttggttgttctcaaggcagcccatagaagtttcacctaccattgccaaccctgttctttagattagtggagttgaagaataagtagctccagcattggcagaacacaatttgggaaataaaccaatagaaaaaaacattttgagaactagtctaaagaatagaatagccacatgactgaacagacctcttcttctaactcgcttatcctcttttgaaccaaaggtaagccgctctgagatcaaataacaagtgttagcaatgcaactaccatgataaagtgatggcacaatatacatttcagataagaaactagctccaaacagaagaaacaaagaccctacttcaagagcagcaacataatcaaactcagtacaatcttctaagggtttataaactgattcaaatacaactagaagagggataaaacattacgagccgagtacttatcatacaaccaggcaagttttcgtatcaccaatacttagacatcctacaacaaaggtgtggcaactatacagaagtggcagctacaactataatgattaagctcaatagggcattgagttttctcaagtaaacattattcagaaagggggtatcataggagagcctcagactagcacatacgatctaatgagtgtcctaccacattcattccctcatcagcagaggaaatttttaaagccttttagctaattctacttaacataactaaatgttcaatacattctccttagagaaccaaaccaaccttgtcaatgtatgaagcagactgcaaatcaaggatctgagtttcagcaacttggatcaacttctcacgctctttcaagtaaagggtcttaccatccaacttctgtattgtcgcctcaagaacagcttctacacgatcagagccaatcgattcccagcaaacaaaacaatacaattagcaaaaagaaaaagaaaaaagagaagccttggtggttcaacccaaaaccaccacgaacaaaaagaaacaaactttacccaattgagatattctgagcttagctgagtccagatcattgatcaagttctgattagaaccgatctgctgctggacttgagaggagaaaacgaagagtggtgaaatgatgaaaaacagagcagccaaatgcagccccattctctgttcaccggagttccgacgttcccggcgtcggaaactaagccaacagtttcgtctctcctcttcttcttcagagagatttcgagtcaaagcttcctcgtaaaggttctttcgattcctctgtgattcatagggacggcgagtaaaccgggattaaaaaatctgaattgaagtattgaaccggttttaaaaacgacaaggactgtacacttgaaaacaataaagggcaagatgtttactctcaacacaagtggttcctcaaaaaaaaaatctgggggatatgataatcatgcaaccagcctgcggatctgaaagacaacaacacgaacacgagaccaaaagcacgttaaagcccttcaagagttgttgtattaatttagttttaaattaacttgatttatataataaaaagaaaaaaagctttgataaacacatcaacggcagaaacacacataagcacgcgattcgctgtagaatcctcaagtttcgattttttttttcttttcatttacaacaaaaaaaaacaagattttaattaagaagaaaggcaaaaaaaaagaaaggaatatg

SEQ ID NO: 14930 - DNA, 3000 bp, Unknown
  misc_feature (1)..( 3000): cDNA_ID_2731231_gDNA_ID_2684234_Annot_ID_192372 3000 nt of promoter + ATG
acctacaaggtcgttgagcgcaaggtctaaatcaacgagtttactgagttgacccagcgagtcagggatctgtccgactaaatgacactcagtgagccacataacctcgagattcgtcaagttcccgaactccggcgggatccgactcggactaaaggggttatacgaaagattcagcatcttcaacgtgctgatgttgccgagaaacggaggaatcgtaccgtctaagagattgtaaacaagagaaagaacctctaggttttcgaatttgccgaaactcgccggaatgtcaccggaaaagttgttaccggtcaaatctaagtgaaccaaagtcggaatatcggcaagagtttgtggaagctcaccggtgagtagattctgagagagatcgagagtttgaagactcttacaagcagcgatgttgagaggaagagtagagttgatggagttattgtacaaagagagatgagccagattagagagacgacaaatgactgaaggaaaaggtccggcgagattagcgctggagaggtctacggaagtgacggaggagaaatcaccggcgcaggaaacgccggaccaccgacaaggagaagcatcgttggagttccaggaagagagatatgagtctgggtcgtctaacgagagcttgacttgttgaagaatgaaaccgtcttggttaagagagaagacggtggggaaaagtaagaagagaaagagaagatacatgtttcttcgtcttccccggtatctatgacggtggttgaagaaagagagagagataagagagtatgaagaagagagtgtttgtgagagagtgctttgaaggaagagaagaagagagtctataaaaagcgttgaccggagacaggtgaattatcgtgactctgactgtgaatgctataaaaatcatttgtttttctactatcatttattttgtttttgttttctataacgattctctctaattatttgtttgcaattattagtatctatgtcgagtttccaacattgtataattatcctgtgtttatctgattataaaagagaatgttactaataatgatgatctagctaaatagccatatggaaggaaacattctttttttgtactttgttgtttaagagaatgcaactgtttttaaattagttatgtaggagacgataagattgtaaattttcaattaaataattttagctttataatatatatggaatttgcatacaaatttgatttcattatatatgtttttaatgtaaatgaaaagttagttagtagagtaaatgtgcattttaaaaaaattgcaaggtgaaaagaaggtacggtaaacattaattttgaaatgtagatatctgatttttttttttttttttttttggagatggaatgagatatattccgacagttttatttattatcggcgtttgtaaagtagtaaagtacaaatattgttagaacatatcaaaaaaaaaaaaaacagaatgtgttggaagtttacttggaacgtagtctaaagtcgatgtgaattaaattaattatcattcaattttaaaaagtttatgcacgtcttaaagagtattaggaatattgtatcaactattaagagaataaactagcatgcatgtagaaacatgaaaatattttattttgttgaaatgtgaaattcatttttgaagataataatatgtagttatttacaaaaaatgcaaagaaaatatggaagataggataagatatcaaaatattgagatatttatgaaattaaacattctctaatgaaatttgttatactaattagtattgcaaagggaaagagggggacaaacttgtatggttaaacgttaggaaacatattgcctaatggtgtagtcaatatgagaatgcacttctcaagcgagagtcatgagtattgcttatcttagagatgtcatagtcttaaaaaagtattcgagtcgaataagagttctttatggtttttaaattttaggttgatatgcaacaaaattggaagacgtaaaataatgtattgtgaaaaacaaactgtgtgtacactttgttcttattctcacaacttggttttcataagttgttacggctaaacgaaatcgtaaattattttgtaggatgtgaaaaagagttgcactaactgtacttgtgttcaagaattttgtttttgaggacgtgaatacattgttgaatccagttaaaaaaaattgttatctatttttgtttttattttcttacgatttggatttcatgcccgttacattatgagaattgttacgtttactatcataatctcaatcttagtttatcagttggaatttgattttattttagttaatcttaatttaacaaaataataaactcataaaagaacaacacaaattttgcctacatatatgttagttagaaaacgtatgttctaacatatgtatcggttgagaaaagcatcactttaatcaacataccatttgaatgatatttaaagagatagatgagtgaaattttggagatagattgattccaagcagtcttctcttcttcgtgtttctaatagtttctgtgaaacacacaatacaagttgtcaaaaaaaaattagggtacactaaacggagttcgacacttgtatcctataagatagacatttaagaaattacgtacactacaatagctacaaatctctgtcttatgagattgttataagcaaagtctctttcatcctacaaattgttgctagctagttgattgaaagaaaccgtcaaattagttttgtttatatttttaatttcattacttagttaatcaagtttccattacgtgtgattgatgtcctcttatagtttcataacattgtcactttggaattatttaatagaactattaatttgttacgagtattgtgtacaagcaagcaacctttgatctatattttgagagttcaagttcttatataaatggtttgaaggcattacgctcctcaatgcttattagcaaca

SEQ ID NO: 14931 - DNA, 3000 bp, Unknown
  misc_feature (1)..( 3000): cDNA_ID_2686404_gDNA_ID_2684234_Annot_ID_192371 3000 nt of promoter + ATG
aagagagatccctagcttctcaagcggcttatgaaatatttgtgccacacaaaacatttgagacaaatcagctaacttgatagaatattctgaaacttttgtcccatcattgttctctattgaaaaactacttcctaggctcatttttccgagggtgttgttaacgagtatccttgcttcttcaccgatcttaaggctttgttttttcatagccttatcgagtaattttctatgaaacctctctagctcagctgcacgaacaccacgtgtccgctctagcgcttggggtccgagtgccctggccatgatgagctttctcatgaatttccagtaatcttcacatggagctcggaaatatccaaaagaaccaaacacaatgcattcatcgattgcaacatcaccacgataagagacattaatgtcgtttgtcttgaagatatcgtaagccgttgaggcagaggatacaagaacaatggggacatggaaaatgcgaagatggagaaaaggtccgtatttggatgagattttttgaaaacacttgtggattgaagcaaagaggagaagatgaagatgaccaatgatgggaagagaaggagggcttggaggtacatcaaatccatcgtttggtttcttatagaataaaacaaagagaaagagagttgagatgaggaatatgagggtaaagatgaaacaatttagaagatcaaagctgaccattactgtcattgttgctaataagcattgaggagcgtaatgccttcaaaccatttatataagaacttgaactctcaaaatatagatcaaaggttgcttgcttgtacacaatactcgtaacaaattaatagttctattaaataattccaaagtgacaatgttatgaaactataagaggacatcaatcacacgtaatggaaacttgattaactaagtaatgaaattaaaaatataaacaaaactaatttgacggtttctttcaatcaactagctagcaacaatttgtaggatgaaagagactttgcttataacaatctcataagacagagatttgtagctattgtagtgtacgtaatttcttaaatgtctatcttataggatacaagtgtcgaactccgtttagtgtaccctaatttttttttgacaacttgtattgtgtgtttcacagaaactattagaaacacgaagaagagaagactgcttggaatcaatctatctccaaaatttcactcatctatctctttaaatatcattcaaatggtatgttgattaaagtgatgcttttctcaaccgatacatatgttagaacatacgttttctaactaacatatatgtaggcaaaatttgtgttgttcttttatgagtttattattttgttaaattaagattaactaaaataaaatcaaattccaactgataaactaagattgagattatgatagtaaacgtaacaattctcataatgtaacgggcatgaaatccaaatcgtaagaaaataaaaacaaaaatagataacaattttttttaactggattcaacaatgtattcacgtcctcaaaaacaaaattcttgaacacaagtacagttagtgcaactctttttcacatcctacaaaataatttacgatttcgtttagccgtaacaacttatgaaaaccaagttgtgagaataagaacaaagtgtacacacagtttgtttttcacaatacattattttacgtcttccaattttgttgcatatcaacctaaaatttaaaaaccataaagaactcttattcgactcgaatacttttttaagactatgacatctctaagataagcaatactcatgactctcgcttgagaagtgcattctcatattgactacaccattaggcaatatgtttcctaacgtttaaccatacaagtttgtccccctctttccctttgcaatactaattagtataacaaatttcattagagaatgtttaatttcataaatatctcaatattttgatatcttatcctatcttccatattttctttgcattttttgtaaataactacatattattatcttcaaaaatgaatttcacatttcaacaaaataaaatattttcatgtttctacatgcatgctagtttattctcttaatagttgatacaatattcctaatactctttaagacgtgcataaactttttaaaattgaatgataattaatttaattcacatcgactttagactacgttccaagtaaacttccaacacattctgttttttttttttttgatatgttctaacaatatttgtactttactactttacaaacgccgataataaataaaactgtcggaatatatctcattccatctccaaaaaaaaaaaaaaaaaaaaatcagatatctacatttcaaaattaatgtttaccgtaccttcttttcaccttgcaatttttttaaaatgcacatttactctactaactaacttttcatttacattaaaaacatatataatgaaatcaaatttgtatgcaaattccatatatattataaagctaaaattatttaattgaaaatttacaatcttatcgtctcctacataactaatttaaaaacagttgcattctcttaaacaacaaagtacaaaaaaagaatgtttccttccatatggctatttagctagatcatcattattagtaacattctcttttataatcagataaacacaggataattatacaatgttggaaactcgacatagatactaataattgcaaacaaataattagagagaatcgttatagaaaacaaaaacaaaataaatgatagtagaaaaacaaatgatttttatagcattcacagtcagagtcacgataattcacctgtctccggtcaacgctttttatagactctcttcttctcttccttcaaagcactctctcacaaacactctcttcttcatactctcttatctctctctctttcttcaaccaccgtcatagataccggggaagacgaagaaacatg

SEQ ID NO: 14932 - DNA, 3000 bp, Unknown
  misc_feature (1)..( 3000): cDNA_ID_2990990_gDNA_ID_2684234_Annot_ID_192366 3000 nt of promoter + ATG
ctatcaaaacagagcacaatgaatgctataaaattattgggtacaatctctagcaaatttcaacttgagacttttcttttatttatttctttatatacatatatatgaaacgattcaattataaaccgtaaacaacaattaccaatcaagattcttaattaaaagaaaaaaaaataattttaaattattaatttacaatcacaaccacagagccccaacttccttaagaattggaactaactcaccggagatatgagtagccataaccctatctaaccctccaaacaacctccctcctacataaaccgccggtaacttcaccgtacctccgccgccttgaactccaatattctccaactcactcaaaacttcatcttccctctcctcatcaatctcaaggaccgccggattcactccaagtccaagaagcagcctcctcaccacatgacacatgcaacatcctctccgtccaatcacaatcaccgcgttctcctccaccaccatccgaactctctcgccgtttccctgcgttttaagcgatagcggccgcagagattccccgacggttgtcgtcatgttataatttcttgcacaagaaatcgttccttgcattttcaagtatgtttttaaagatagataccaattaggaaaggaaggttttgttatatatacatgaagaaagagagatcagagaggaaagtctagcgtcaacgatggttacgtaaggatgtgcgtcacaggaagctatgggtgatggtgctgtttacgtcactggattggagtggacttagtcataggaccgtgtcgttatatcgtatcacatgtttcacgctgactttttggatcccactttattcttttaataaatctgcacgttttaattttggttcctctctactttacataatattttactgcttttttcatatcaataaaaaataggagaattctcagaatttattactattatatttgggttgtttcgaaactttcgatagatggttgtatacttagaaatattcgcatgtgacgaccacatagtggatgcttgcttctttcgatctcgaccatcaaaacggaatcaccagactatatacaacaattttggtaatctaatactaaaattgtagaaaacacaattttgttttgggattgctaaataaatacactagagatgctagagagacctagcctaaactttcgatattttccgttttatcattcaagtaattaatataacatttaggtgtaaaggttaataatatatatgacattatattcttagtgatcaaaaatctaaacataaacttttaggaaaaagacatatactactttccaaattaatgtaacacgatcatgtcatatagtaatgaccatgtttggatgaaagtggtaattatgagacgtgattaagtactcttgttgaatccttcttttaaaccaatactaagaataagtttgacattattgtcatattatttgtactcggactttccgagtagtagtggagccttattaactaataataataatacgcatgacaggaaaaaactgagaaggtcatttagaaagaaccatcgtcgaaggatggacggtggaaaagtcggtagacgtcagcaccaagccaccaactaatttggtttgttttaatggaatcatgacgtctttcttctttaaaactcatgtcacccatttcttcctaaatttggactattatatgattatgggaattgcatttctttattaaagtcacgtgtcatcctttaactttataagttcttcaggttccaaactccaaagcctttccaattttatcgttccaccaaatcctgaaatgaaagttcaacatccatcatggtcccaaaacgttaaaaatattttaaaaaatagagtgtgggggatttaaaaattcatgaccgctagtaaaatatacaaattttcaacaaaacaaattgcatgaccgctttgttggagatattatatttacagttgcctaacgtgagaagtttgcataacaaaactaatcacaaactcacaatatataccattcttctgtgcaccggaaatctataacacttaaaatcttaaatgtgtaaaccctaaaattttaccatacaatttttgaattgagaaaacaattatttgtttttggtttctaggattagtaaacaatcatttatagtagcatcggatttttcatggactatgaatcttctcaatagacagacttaggtcacgctttaaccaacaaaaactcagcaagagtggtttctttcttctataacaaatgccaaatatgcgtttcaatataaccattttctataacagttaataatcaaaattttgtaacgtagaaaatggtctttattaatactgtcgtagatttgtaataacttattgggctctgtggtctcttattgggctttataagattctccagtagcccaaaaataaactttcagcgaatctcaaagccaaccgcaggtgatgcgttttgctatgtaagagagacgaatctcacgccggaatctcttttacttcaccgtcgtttgttctccgtcgcgtcacctttcgattaattccttcacaggtaaggaagcttcttcaattttcctcttacatcaattctcctttcgcattgatccttgtcgttatcgtctctaaacgcaagctttttctccaatgtttgtgtcgatcttaaagcacatagattgataaagccgttccggttctattgaataaaattctaaccctagattagccaggatttaatcggaatttctctggatctaatagttttgtcgagtttgatcattgtgacttaggaactctaattttgcaatcgtagaatttgcgcatctccagaacaatccctgccaatgagatgaaatttcaaaattctgtttctgtaactaactttgcataagaacttgtttctatagcttaatcagctgtgttatttggtgtatagggtagcaaaattttgttgatttcgggatg

SEQ ID NO: 14933 - DNA, 3000 bp, Unknown
  misc_feature (1)..( 3000): cDNA_ID_2731247_gDNA_ID_2684234_Annot_ID_192365 3000 nt of promoter + ATG
gcaagagtggtttctttcttctataacaaatgccaaatatgcgtttcaatataaccattttctataacagttaataatcaaaattttgtaacgtagaaaatggtctttattaatactgtcgtagatttgtaataacttattgggctctgtggtctcttattgggctttataagattctccagtagcccaaaaataaactttcagcgaatctcaaagccaaccgcaggtgatgcgttttgctatgtaagagagacgaatctcacgccggaatctcttttacttcaccgtcgtttgttctccgtcgcgtcacctttcgattaattccttcacaggtaaggaagcttcttcaattttcctcttacatcaattctcctttcgcattgatccttgtcgttatcgtctctaaacgcaagctttttctccaatgtttgtgtcgatcttaaagcacatagattgataaagccgttccggttctattgaataaaattctaaccctagattagccaggatttaatcggaatttctctggatctaatagttttgtcgagtttgatcattgtgacttaggaactctaattttgcaatcgtagaatttgcgcatctccagaacaatccctgccaatgagatgaaatttcaaaattctgtttctgtaactaactttgcataagaacttgtttctatagcttaatcagctgtgttatttggtgtatagggtagcaaaattttgttgatttcgggatgtcttcagctcaagatccattctacattgttaaagaagagattcaggattctgtaagttgttcagaaattgccagagatgtttttttgtttagattttgaagtacagtgattgatggatgatgctttgttagattgataagttgcaatctacattccacaaatgggagcgtatctctcccgacatgggtgatcaagcacatgtggcgaaggagcttgttgctacttgtggaagcattgagtggcaggtactcgtatttagtcacggttctattaatctcgtctttatatataatttagctggtgtggaataggatttgtgtttgtaaatggatcttgtaggaatgtattggcccttatttacatgattagaaattccaattgaatatattcgagtcctttcatggctattgaagctgtttttactgataggaaggtagatgagctggaaaaagcgattactgttgcagcaaaagatccttcatggtatggcattgatgaagctgagcttgaaaaacggaggagatggactagtaatgctaggacacaggtatgttctctaagtttgttatgaatactgctttacatagtggcataaatttgttgttagttgacttgtgcaagacgattacgattttttttataggtgcggaatgtgaagtctggtgttttagctggaaaggttagttctggagcaggtcatgcaagtgaagtgcgtagagaactaatgagaatgccaaactcgggtgaagcaagtagatatgatcagtatggagggagagacgatgatggttttgtacagtcagaatcagataggcaaatgctgttgataaagtaaagctctctctgtgtgttctacattgttttgcagtcttttctttgcttctgagtttataacgattttagactgaagattgtagcatagtgttgttcaaaaacagagtagtgccataacttaacatcatttttttcacttcaggcaacaagacgaagaattggatgagcttagtaaaagtgtacagagaattggaggagtggggctcactatacacgacgaactcgttgcacaggttagtaatatgggaagatgatttaacagtaggacgtatcagtagagatcagaaacatcaagtttttgttattgtgtgtgttcaggagagaataatagatgaattggatacggagatggacagcacaaagaaccgtcttgaatttgttcaggtaaaccccttaaaggtcttgttgctggtttgattgcagaaagtaaaaactgaaagaatgaaaatggtattgtgacagaaaaaagtgggaatggtaatgaagaaagctggagcaaaaggtcaaatgatgatgatatgtttcttgctcgtcttgttcatcatcctattcgttcttgtcttcttgacctaaagaacagagccgcgggatcttatagatgggagtttaatgtcttacattatcatgtttgtggtgaaacaaatggaatatttacataaggttgtctgttttttcttctcctatccaatcccacatataattttgaactttggctgtgtgatctctagagaacctgaaattaaatactttcatagcttgatcccatggctaagttccttaaacaatacaaatcagtctcatcaaaagtaagccgtcaaaaacttccctatagaatacacctttattatgccttctttaagtttccgcaatgtctcctttgcttcttcagttctgtaacgaaaaaaaaattccgaaagcagactccataagaaacatctaaagacaacaaaatgactccaaaaataaagaaccggcaaaaatctaacaatttgtggcaacaaacccggctactgctcaaaagaccacccttaatagttcataattgaaggcaaatgcttcaactgatcgatcatcaacgaatccaaaggactcactcactataagcatgatctccggaagaatcattgccggatataattagttgaataactgatttattgttgaatctttctgatactatcgttaaactcttatgacaacgctttttttttttttttgtgtgcaaaatgacaacgctttagattgtaaaatgaataatgagtcattgtatcattaataagaagagatttgggctgataaggcccaacgtaagcccataaaagaatccgtcggctgggatataagggctggatcgatttcaatcgatttcaaaaaagaaaaaaacgcacaggtcagatacacacaaggaggcgcaggagaatatg

SEQ ID NO: 14934 - DNA, 3000 bp, Unknown; identical to SEQ ID NO: 14927
  misc_feature (1)..( 3000): cDNA_ID_1441974_gDNA_ID_2684234_Annot_ID_192364 3000 nt of promoter + ATG

SEQ ID NO: 14935 - DNA, 3000 bp, Unknown; identical to SEQ ID NO: 5813
  misc_feature (1)..( 3000): cDNA_ID_2041439_gDNA_ID_2684234_Annot_ID_192359 3000 nt of promoter + ATG

SEQ ID NO: 14936 - DNA, 3000 bp, Unknown
  misc_feature (1)..( 3000): cDNA_ID_3019674_gDNA_ID_2684234_Annot_ID_192383 3000 nt of promoter + ATG
gtgcctcttgtcgtcagctgtctttctactgttgtagaatggtatttggtttatatgtaatgtgtgattcaagtaaatcttattcgtatttgtgctaatctaagtaggaatacagttctgatgttggagaaaacttgtcactcatggtttattcttctaatagctaagctggttgattgctttctgtatcactagattattataattgtacataatgttgcttgttgttttctgtttcagtcagtgcgttacagaaaatgaaaaaagctttaggacttccttctaggtttggatggaatggtgatccatgtgttcccccacaacatccatggagcggggctaattgtcagttggacaagaacaccagcagatggttcattgatggactgtatagctcgtttctcttctttttgtgtatactcataaataacagattcattaaccctttcttttgcttaggcatctcattagttagagtcttagagtcaaaggatctctctttgagtttctggtcttttatcaggttttctaataaacaaactttgtttttcgttgcagtgatcttgataaccaaggtctgaaaggtttcctaccaaacgatatatcaaagctaaaacatcttcagagcatgtaagtcaatacattatgcacatcctgcaaatgtttatccaagtgtctacgaatattgtatgtaaacgaacaattttgttatcttctccaagaaaatgacttgtctaatgaagaaattgtgtccatttttcttgtgtgtcattagtttttcttccctcatttgtgtaatcccccttacagtgaaagcttcttgatccatatcttgtccatatttcagaaacttgagtgaaaacaacattcgtggaggaatacctgcatcgcttggaagcgttacgagcttggaagtattgtaagtaatcagtttgtttattaattgagtactttatgtgttaacttttcaattctgaaccctgaaactgaatttttatgcatctttgcagggacctctcctacaattccttcaatggatctatccctgaaaccttaggagagttaacatccctgcggattctgtaagattatcaactttctgtttgtctccatgtcaatttcagtggccagtggagttcacatggtcggcaacatgaaaccttttattgtattacaggaatctcaacggaaactctttgtctggaaaagtaccagcggctgtaggtggaaggctgttgcacagagcaagcttcaagtaagatgattgaatcagagacaaagtttttaaagaaatatttggacttggcatgtgaagaatgatgtttggcaaatagcactcactaccctgtaactgttttctctatctctgcagcttcacagataatgcaggtctttgcggaatcccggggctaccagcttgcgggcctcacctttcttctggagccaagattggcattgcattcggtgttagtctagcattcttattgatcgttgcatgtgcaatgatatggtggaaacgacgacagaatattcttcgggcacagcagattgcaggtaaacattcatttccgtcactaggaagttgtatttagtcttttaaaacaaacctttatgagcctgcactgtgaaaatattgcagcaagaggagctccttatgcgaaaaagagaacacacgtatctcatgacatccaaatgtcacggcacgggcacaataaccatggccaagctcgtaccgctgtggaaaatggaccgagcttgttgtcttgagtcacttctttcaatcttctttgggttttttcagcaacacgaatcccaaacccccacaaggtcaaaatgttcatatcatgtctaccacattgctcgccacaggaagaagaccaagaggaaatacatttgtaaatggtcttgggttcttttaattatccagttcatagaataggattcgatttttcttgttcagtttttatgggattagtcctttggtacttttgtctggtgggagtttagaggataactagaacataaaaattacgtttcaatatattacacatgttagttgaaaacaaccgaatgtggagttgttatactcaatggatacatctcctagaagctagaaccaaatcaattgatcacaaaacaggactttgtcctcaagaagcatgcttctgatgtggttcttgaatctcgctaacaagctcgccttcagcttcagcttcaacttccataaaactctaactctacaccaagtatattaaaaataactacatagaactttcttcaagatcttcgagaaagccttgaatatatggaaatgaacaaagggaaccagaataaagatgtttggggatgacaaaaatgtagcagaaaatcatataagagagctccaagtcatgtgtcttatacaataactttgtcccatgtttctgcacgttttctactctcatttctttctcccatttttgtagtgaaccgaattaaaccggttctgatttcattttcttccaaatctgagtcaaagcctctaaagggtttcttcttctctgtttcttctatcttcagggttcagacttttcacggagtgaacacaaacgcctacgataaaccaatctcagaggtcagctcgatttctgtctttgttaggttgtatttggaggtttttcaataggagttctcaattttaggagccaatgtcagtttctagattgaaatcgatctcaatactcaaagcttagatcgaattatatgctaaagctaccaactttgcataaccgattatgtgttggtgacaatgagaacaagtgtgagtttgtaagtaaaagaaaaaagccaagagcttggaaaccaaacaatatagatagagagagatacagagagaggagatgatagaatataggataaggtgttacttcactctgacttctttctgcataaagtttcaaaattaagtcattttttttgtgtgtgttttgattttcagaaacagcttcatcgtcagagatg

SEQ ID NO: 14937 - DNA, 3000 bp, Unknown
  misc_feature (1)..( 3000): cDNA_ID_2685931_gDNA_ID_2684234_Annot_ID_192378 3000 nt of promoter + ATG
ttgatttgttatgaaatgataataataatttggaatctctgttaaatttgatttcactatgttaaatttgatttgttatgaaatcaaatgatggtatcattgtaaactatagtttcaatattgtgtgaaaacaaaccatgccccaagtcagcataatatttgggccttaccatactactgggccttgatctatttttgagaatcaatagccaactgatttcgtttcctagtgtataaacaaccaagtacatgcaaccctcatgatctttatcattcataagacgtgtgataaacaaacaactattgaatcctcaaaggcattatcttaattacattatacgtttgatataaaacaagctagtttcataattatacaaaaacattaatttaacaagatatgagctgtaatcctttatgtaatctgtttttaaatagctcaaaataagtaggagcatcatgcagatcgtaagagttttggagattatgcgtcttcatgtttctaacatgtctatggttctcataactaccttcgttatcgtcattttctcgaccgtaatggcaagaccttctatctctacgaacaaatctccatctctagatttagatccttcgtttagggtgaaatccaagagctttttaccaaagttgtatggcgattatgggttttggaacccaagcccggtttacggaggaggttttccttatcccgggccagttcctcatggcagtctaggtccaatacagagacataagaagccgaaatgaaaccggaagatatgttggattggatgttcttcaactttgctacttacaggtaaaacttttgacatatgggtgttgtataaataaggtagtgctgattaaagcttgtgtaggtacttactgcatatgaataatgtcattgtttatgttttgtagtagatacaaatagttatatatatacacatcttgttccactctctagataaaccatgtatgtgtagtatatatataatctttacaacattggcatgtattcagttatgagaaaagattgagttcatgaaatatttttatgaaaaaacatggagcataaagtagctatgactaaaactaacaaaggatttgttatcttccttagcattttccgaaacataaatttgaacacgagtcaaaaggaaacgcttcataaccaaaaattcttgggtaatttgaacacgagacatagaattcaaaagatcaacttggtatggtgacttttcttcaagtcttacacatgcttttcgggttcaaccacacgttaggaattttattgaaatatattttaggtgattttcttaacaaaatgtttcatagcatcgtagagtattttttccttgttaatattaaatacaaaaattcaaattgcattgatatctctagatgtatctataaaactgatataatttctttaaattcatccaattaacatcgtttaaatacttatcaatactcaaataattactttagtaaacgtttgattatatacatcttctaactataagttgttgaataagggtatgtatgtatacattgttttgatgtgaagccaaatttctcagatccactattcatccgatgacaagttacatttgtttacagtaaatattgaagaagccaaagattgataactcttaatcacaacaaacttaactagtagaaattcatgtgtttttatattgttttcaaccacatttttcagtcgaatttgagatccaaactttatagaaatatatgtaaaatcctactatatttggtccgacgccgcaactttgtcaatcacacagtaacatgcgacgaacaacgtgtaagaagtctcgttgctatatataccaactgtagtgtggttgacacccaattacacaaacaaaacgaacatatgaagggttatatgacaaaatcttacatggaaataaatattaaagtcgatgatgtaacgtctcacagccttacattatgagaaaagtctaccaaagaaagtttcatgttacatgttttggtatcaagtcttcatgacatccgccagaagtttatattagggaaaatcatatttgcagatcttgattcaaattatatatcattttggtggtgggcacatctaaatttcctaagaaaataggttaaatctaaataagacttcattttaacaactcagtctagactgtctagtgattgaaggattaataagaatgagtttaattcgagtttttttatataaaaaaaattgtggtgagcattgagtatacattaaatgacaactcgaaattaatccagatctctcagttcttaaaagataaaagacataaaactaaatttagagttcattcaaaaataaataaatagagtttgataatgatttagataattgaacacattagtatgaggttaaataaaacactaatatgagtgacacaagctgattttttcaaagaaattgtactagatgatataattgataaaatcataactaagaaaattataattaattagaacagtagacatcacactagacaataaccataaacttcgttagtgttagaaattggacaaaaaactacaaaacaaatctgctgattttacatagtcctagtcaaatatcatcagcctaattaactgcctaagtgtcctctaacaaacttaaaaaaaaaatcagtaatctacttgctactaaaacaacattaagacaaattaggtaataaaatattataattccttttgtcacattaaaatcattcacattcacactatataattccatatccgaaattcaaacataattttagccgtaaagtcaaagtaatggcgtgttgactaaataatgttttaacgattttctttccaaaactattcttaaagtatttcactttgagccatacaccgttgaccacttcaataccttcgcgcttctcttcttcttcaccaccacacacagccacaatcttttgaattttcctcctcatcatcgtctctctccgatccatg

SEQ ID NO: 14938 - DNA, 3000 bp, Unknown; identical to SEQ ID NO: 14933
  misc_feature (1)..( 3000): cDNA_ID_2731247_gDNA_ID_2684234_Annot_ID_137677 3000 nt of promoter + ATG

SEQ ID NO: 14939 - DNA, 3000 bp, Unknown; identical to SEQ ID NO: 14932
  misc_feature (1)..( 3000): cDNA_ID_2731244_gDNA_ID_2684234_Annot_ID_137678 3000 nt of promoter + ATG

SEQ ID NO: 14940 - DNA, 3000 bp, Unknown; identical to SEQ ID NO: 14931
  misc_feature (1)..( 3000): cDNA_ID_2686404_gDNA_ID_2684234_Annot_ID_137683 3000 nt of promoter + ATG

SEQ ID NO: 14941 - DNA, 3000 bp, Unknown; identical to SEQ ID NO: 14930
  misc_feature (1)..( 3000): cDNA_ID_2731231_gDNA_ID_2684234_Annot_ID_137684 3000 nt of promoter + ATG

SEQ ID NO: 14942 - DNA, 3000 bp, Unknown; identical to SEQ ID NO: 14929
  misc_feature (1)..( 3000): cDNA_ID_2731227_gDNA_ID_2684234_Annot_ID_137685 3000 nt of promoter + ATG

SEQ ID NO: 14943 - DNA, 3000 bp, Unknown; identical to SEQ ID NO: 14937
  misc_feature (1)..( 3000): cDNA_ID_2685931_gDNA_ID_2684234_Annot_ID_137689 3000 nt of promoter + ATG

SEQ ID NO: 14944 - DNA, 3000 bp, Unknown; identical to SEQ ID NO: 14936
  misc_feature (1)..( 3000): cDNA_ID_2995061_gDNA_ID_2684234_Annot_ID_137693 3000 nt of promoter + ATG

SEQ ID NO: 14945 - DNA, 2479 bp, Unknown
  misc_feature (1)..( 2479): cDNA_ID_2731203_gDNA_ID_2684234_Annot_ID_137694 3000 nt of promoter + ATG
ttcttaccaaattctagtaaagaataaattttggtaatttgcgtttatatatcgtaattttttttaatctttcatctaattaaagtttggatatgaggtataatgcataaacaactaaacggaccttatatcaacatctcgtttccacatattcaaagagttaacgtgagaagaaagaaaagatgaagattcttccttacaccagaaaaagctatatcatcatcattcacaaatgtgcaaaaccatgggaaaagctagcgatatcagcaacacatgggccgctagatctagccgttacatgactcttttacagttttacttttacccatagatacacattcccctctttacaaaagtcaaaactaatataagatatcgttggagcatcaagaaaagataaaagaaggatggagtcttccacatcgtgtgatcaaagatagttaggcttacactcttgaagctacccgttgacttagaaagctaatgctttaaatgatgaaggccaaactatccatgcgcatcaccaagcccaagtattattatattcacaatagcccatttgttgttacattattttgttgattgaataatacctaaatagtttaactaatcttctattcgagttttagttatttacatgtttatgtaaagattaggaagttttgagttttgagtaaatactattgaatacaatgacaacaacaaggttagacatagaacagtaaaaccaataagaaaaacatatcacacctttgcagcaggaagaaaagacgatctcgcaaactcttcataagttgcgttatggcacttgtgtatctttagtctacaatttcgctctttgttactattagtggaaatcttgttagatatctcctaataatactagcaatttaaatcaatgatagatgttgtggaggatggagacgatagagcaatttgtagtgtctgatgataaactataatttcatatttatgaaaaaaaaaacaaaaaaaaaacttttacaaatggtttcaattgtagactttgtagtagagaattttatatgtaatagagagatttatagccaacgacttcttattttggttcaacgactcgagtggggaaatgcttttgatgtgtttaccaaagattgcgcatcaatcaatggttacaaaagtcaacaaagtcaaagctatatagattacgaccattctcagccgtccgataaataaagggtattctgtctttttgaatgacaactagcatttctggtgaccacgagaccgggaatgttcgtcacgggacgttttcattgtcgttcgttcccaccaacatttatcgttattaatttacaaacaaaaccgtttttagcaactagtaatatttaattaatcactaaagcactgatttattgttctaacaactaattgattgcaaaaactacaaaaactactccaccgactccacaattccgcaaaatcagttttgtagtttttttttttgtatcaaatccacaatccgtaaatcagtacatttttcagtcattatacatacattaaattatttttgtcaattgaaacaaaagttaaatctaagtttttcaactatgacttacggtaaaacctatcacaatcatatacaaatacaaatatttgtttacctagttgatgttcgtttctccattaagatcatttatctgaatggatttgaatattgatgttcgttttaaccaacttaatagagcaatgagataaatcagttaaatgaattttaataaactcatccaaaaatgatcgaaatctggctgattctgatcagaacagttaactggaagtgattcagtttaaaatactaaatgttataaatacaaaaaaaaaactaaatactataaataccaaaaaaataaaaacgaacatcattcagataaattaatgagatggatcatttgaataaactatttggatgcatatcctaaataagcaaactaacaagaccctaaaaggattagatattgttttgaccttttttcctaatcttgttctacatcaaatttgtaaccactttcgtgactagaagtttattttatacccttactagaagtttaacgagacctctctcatttgagctttcttattcgatatacgcatacatggattttgtggtcgacatttccaaagcctataagatcatcaatccaatggttaaagataaatgacattgagcttgactacgataacttaagtgcgcatcaaaacatttgattattcctcatccaaattaaaaaaaaaaagaacggtgggagcatttaataagatatttatttacctgcactcacgtcctctctcttcttctttcactcttacacgaaaggaaaacaaacaaaaacgaaccaaataaagttattttagtgctctctaatggcgatatgagagattcgtgagagaagatacagaaaaaagcttcataatttgagattctttctagaaaaatcaatcaatg

SEQ ID NO: 14946 - DNA, 3000 bp, Unknown
  misc_feature (1)..( 3000): cDNA_ID_2731312_gDNA_ID_2684236_Annot_ID_137698 3000 nt of promoter + ATG
accagtcctaaccagacaaaaaagaaaggtgttggttttaaacaagctctggtgttacaatgtgacattaaaacacgaatcttttctcttgagaatcatcaatagagagagagagtgagtggtcatattagggttcataacttgcttgaggttttgtaaaaagcagagaaagagagagagaggggcctagaaagaaagaaagaaaagcagtaagagactattaaatgttgcaggcaggtccagccagtgtcccctctcttctgcgagattccctcaaaatttattacaaagcatcttcatcgatgttcttttaattcttcctcaaaatcttttctctttttttggttatatatatttgaattttgatttatgaacctcctcaagaaggaaagacagaggaggagacaaagaagtataggttcacattgcatagccagtttagttttgaaggatggatatatgaaaaaaatatgaagagagagaagagagaagaagaggaggattaaagagggtgaggccagcttttgtgctttggtagtagatgaggtttaaatgctccataccttccatttccttctctcttaccctaatttaattcttcctctcctttataactccccacagacattctcacttctcctcctcacacttcacatcaacacttctttcttgttttttcattttacaatgtttcctttgatatccgcactttaagcatgagagagtccctttgatattggcctggttcactcagatcttacctgaccacacacgtagatatacattattctctctagattatctgattgagccgcgccaatatctcagtactctctcgtctctattttggactttgtggtcttgtagatcgatttgtatgtgtgtgttgaaatggagacaagtacttgtaacttctttgttgttatattgtttacctataggctgatgtcataaactcttttgatcttgtttctaacttccagattcttgaaaaatcaagtcgtgtgtgtgtctccatggaagccttttccatttcttcttttccaaggtatccccttaatcagcttccttgccaagtataaatctgttgtagggttttgcttcaaataatctatatggatccttttagaatgcatattgtgttgataccaattttgagacagaatgtgtcagcgaaactgatcttgtttattagtacaaatgcaggatgttagagagttagctaataacatatacaacaaaatcacaaaaccggtgaagcaatgtaaaatgtcacaatcacaagatgtttttttcaaaaacaggggaaaaagcagagttaatgagagagaagctgacgagcacgaaccctaacctgcaagcgagcaagagcatgcatacaatgtaaagcaattcgtgcttgtctcctcacaagcactcctctagccaccgcctgtaacttcaccagactcttcaatgctttaaacgctcttcttgcctgcaaaacactttaatggttttaccaattttgttttttcaggttttcaaaatctacagagatagaaaatgtaaattaccaggtgccctctgaaaaaggcttggattttaacggcggcaatctcttctcgagttgtttctggagctgaagagcgaatgattgtgattctgctttgagatcgtcggagaagtttccttcttacaacaccaaacaaacgtttggagttggccatgtttatgggtggatcttgtcttcttttggttttggttttggttttaaaagaggacgtctaaggaaacgtaaaatgtgaataaaaagtgaagacggtggctttaagggatatatggaacatgatgtgctctcctcatttctaactaacgaacgtgctcgcatgctcctctctttacacttggtttcgttttgtttattagtagttttcaagacacacgagtctttggtcttttttacatttagttattgaattatagttatgttatgcctaactcaataaaaagaagcttattgagattttgaaaaggttattataaagggtgattgttgcatttcaatgctcaaaattaccatgttatgatatatcttataatcacatgtgaaatctacactatttttaaaatttatgatttagacaattttttcgaaaatgtcactctatttttcaacaagaaaataaaattaggtcattggtattgtggtttgtaatatactaatgacccccactacaatcctaccgacaaagcgtccactctttgtaatgaagttctttgatcatttctctattcaatcttgacactatgaatgtaatcgcgcagcggaagaatggttcatcatactcttacactgttacacaggtccagccctgaactaaagtgtttgtgtttttgtatcggatatgattagcaattgtgcatcaagttagttacggtctcttctcaaatccagtaaaccaaaaaatatataaaaaaatcatactctataataaacttacatcaaatgtcctttttttaacgtttatgttgggagtacgtagtgagatttttcagatatgataaatgtttatgtttgaagttctattttgagtatcatcattttacacgtctcctatcttttcttcaatcaataaagcctttgagcccacaacttcgtaataccgttaaacccaattgttattgggcatgaaaacaaggcccaactcaagtctatctcccccacttgttcatcttctattgtcttgttgcgagtttgcgacttaaacagtaattaaattactaattacgcaataatggcggattaatcgaacctactctctctctctctctctctctctctctctctctctctctctctctctctctctctctctctcgtgcatctccataaactatcttcaaagattaaattttgaagatcttctttttggcttattacccgattctgtcactgtctcttcttcttctccaatcccaatgtttgcttgagagaaagagagagagtcaaaccaaaac

SEQ ID NO: 14947 - DNA, 3000 bp, Unknown
  misc_feature (1)..( 3000): cDNA_ID_1014464_gDNA_ID_2684236_Annot_ID_137701 3000 nt of promoter + ATG
ttggtggtatcaaaactcaattagaaaaataataatgtgcacgagggatgggacttttaccaatgctaggctgacatgtaagagtacggacacaaatcttacaaagttcttattgtaccttccctaactttgctctgttgagataagtttctttggtaattaagaagtgtttgaattatgtagctataatttgctgatttatattaaattcttcactacaagaatctgtatctataactataatatgttttgtgtacaattagagactaactaaactaagagtgtgttgtaagaatgttaagcaaataaactctatattggacaagtgacttgaaaagagaatcaagtgcagtctcaagttcctctgttctttcctctaatctctctaacatcttcttaatttccttggagttatccccatctgaacgtagaactgcatccaagttctgcaactcgctcattatcgacgatgacgatcggtgaccaccactgatcagcctggagacgaatttgagagaacatgtctttgtcttcattgttgatgttgtggacaggaacatgaaaagagagcggaagatggagacagagagctcggttgtctcagagtcatccaacttcttcttgaggccaagaagaagcttgttagtctctttcttgatcttcttcctaaaggaaaagtactctttgatctgaacttccatggatttgtcttttcttctcaatgcagactgaagattaaggagatgctctctgagagtgagaactaggtttctcgctgcgtcgcaagagtctagtaacgtggctgacacgtcaagagaatgttcagcttgagctgtgggaagagagtgattgagttggtgaagggaatggtaaagctcagagaggttgagtaacgaggcgtgaagagattgagaatcagatgagttttggaagagatgaatctgagagagagcagcttgaaacttagcagaaggatggtggattcttgatggaagacttatagatctaactggcatttggagtttggtttctggaaatgccatgtttcttaattctgctgaagaaaaagaaagaagagaggtttggtatatatatgatgaagccaaggcatgtgcaggaaacatgggatattatatttgttaaaaataaacagtgattgtttagtcaagccacgatgcacatggaggtggtgaaggaagctttgaatgctctgttttatgctctgtttttgaacgtgaaaccaattttagaggaccaaagatagatagagccattactagatgttgcctttgtgattcccatttagttagccggagagagtgggcttgtcagagtaaggagacatggaaacatttgtcgcagaccattttcagatttcaactctttcttgtttcatccaattgtcaattttttttttcttcctattaacttattcaccattggttcccaagacggtcgtgaagagaaaaaagatgtcacaacactacaaagttgttgtaaaacaaaaaaaataaatactatatacacgaaagatgttacaaaaaaagtattattttgcattttcaatgcaataattaaaatgaattccaagtttattctttttttttttttttttttttttggtgcaccttccaagtttattcttataaactgattcttattatgtaaaaagtagagaaaatgcagagagttacatggaaaaaaattcaatgtagtcttaatttgtgagattttttttttatagaatgacacttagtataaaatcgggaaatattatattaagaataatcctaatcaggattatacaactgtacctactttaaataatgttgattagaatttaggagggcggttcaatgttttgtgccctaataatagaacgttgtattataagtttttgattgagtgcttcaaggctgtcattggattcatgatcaattggaaacattgttaagtgagagggacaaacttatgaattaagatattggccctttgtctccgttacaagagctatgcttatatgataaaatttgtttattaaagaaagaagggatcattgtagatcgcatataaatgatatgatgcaaaattacgggacgatgtaatgtacggggaatcttaaaagtggtacgtttcagacagaagatcttcatggaatttgatacattgaacctcttctcaaagtgttaatcaactcatctttatctgtcagaacccaaacttaaaactcagtcgaaatgtattctcaaaatatagttaataggcaacaaacttcgactatcaataataaccacataatttggtcggaaactagaagacgtcgcaacattatcaaacttaaactatgtagaaaatttccaaaactataagctactttaatgttgattaaaatgtaggagctagggctagtagctgttcaatgggttgtcccctgattcaccatatccattttagtataagtttttctttaatttgattgagtgattcaagactgccattggattcatattgatcattatcaattggacgcattgttgaattagagagacaagattatgaatcaagatcatggcttgtccccgtttaaaaatggtttaaactatatgataagtttatttagaaagaaaaaaagatcatgtacggggaatcttagagaagtggtacgttacagacaaaagatcttcacaaaatttgatacattgaacctcatctcaacgtcaatctacaactacgccttcaatagtaacagaaacaaaacacaaaaagtccataagttaaacactgggcctgacaatttaggcccatatactgaaggaaaacgagtctataaataattgggcctaatgaaatataaaagcccacgatactagattatcgaatggtggtccctattagttacgtaacgtacgaagatttatctacaagtttgaatcactccaaaaatttaaaattcagtgttcaccattttttatttttctccacaaacccaatctttctaca

SEQ ID NO: 14948 - DNA, 3000 bp, Unknown
  misc_feature (1)..( 3000): cDNA_ID_2731303_gDNA_ID_2684236_Annot_ID_137702 3000 nt of promoter + ATG
tttaatttgattgagtgattcaagactgccattggattcatattgatcattatcaattggacgcattgttgaattagagagacaagattatgaatcaagatcatggcttgtccccgtttaaaaatggtttaaactatatgataagtttatttagaaagaaaaaaagatcatgtacggggaatcttagagaagtggtacgttacagacaaaagatcttcacaaaatttgatacattgaacctcatctcaacgtcaatctacaactacgccttcaatagtaacagaaacaaaacacaaaaagtccataagttaaacactgggcctgacaatttaggcccatatactgaaggaaaacgagtctataaataattgggcctaatgaaatataaaagcccacgatactagattatcgaatggtggtccctattagttacgtaacgtacgaagatttatctacaagtttgaatcactccaaaaatttaaaattcagtgttcaccattttttatttttctccacaaacccaatctttctacaatggttctcttcttctccactcgttttctcttcttctccatcttcttcccttgcctcatctctatcactctctaccaactcgactcattcgagccagcttcacttcccgcggactcactcatcacctctcccacttcaatcccgccacttctcaacgacagatttctcaccggagctgagtttatcggcgtcggtcttctcaataaccccgaggatatcgcctaccataaggactctaatctcatctatactggttgtgttgatggatgggtgaaacgagtcagtgttcacgactcagctaatgactcaatcgtagaggattgggtcaataccggtggtagacctctcggtatcgcttttggacttcacggcgaagtcattgtcgccgacgcaaacaaggtttagacgattctttattttttgaaatcgaattttgaaaatcttatcttaggtttgatattgttggtgtgtgtagggattgttgagtataagcgatggcgggaagaagacggaattgttgacggatgaagcagacggtgttagatttaagctgacggatgcagttaccgttgctgataacggcgttttgtatttcacagatgcttcttcgaaatacgatttctatcaatttatctttgatttcttggaaggcaaaccacacggtcgtgtcatgagctttgatcctaccacacgtgccacacgtgttcttctcaaagacctctacttcgctaatggcatatcaatgtcccctgatcaaacacatttcgtcttctgcgaaaccatcatgtatgtgcattacatttgttatgtttctaactcaaaaccaattggtaattagtttttatttatagattttgtatattactttaggagaagatgcagtaagtattatattagtgaggagcgtgttgaggtatttattcagggcttaccaggttatccagataacattcggtacgacggagatggacattactggattgcattgatttcggtatttatactataattgaaatcttttcattaaagtttatgatgagattattatatcatctttaatcttttatttgatcattgtgttgtgaaaacaggaagtaacaacgtcatggaaactctcgatgaaataccttttcttgaggaaactcatatacatggcggctaagtatggcgtggaactactgtctataaagaatgcagccgttttgcaagtggatttggatgggaatcctatcgcaatgtaccatgatcatccattctctcacataacaagcggagtcaagattgggaaccatctctattttgggagcctcttgcattcctacattactagactcgatcttttaaagtatcccgcacaaaagaagctttaaacatcaagtttaggagtattcactgtcacaaaatgtaaagtcttcgtccctggcacatcatcatgtccttttgtcttcgtccctggcacatcatgtacggttgttgtaaggtcgagttttggtgttaaggtgttgttagtttataatctttgtgaatatggttagcttcttggtgcattgcaaggttaggtgaggtgaatagaggtggcgaataggttttagtggtttcacttttcgttgagctagtgtattagtccatgtttgctcgttcgttttgcgttagttttcggagaagctataagcttctatctggaggttttgtggacggtgttgttctcggaaaactaaagtatagcagaagattgcaaaatacttcgatggtttattgatatgaattgcatgcctttaaatagccatgactacaaagactacgtcgttcacaactaaacaatgagaaacttgcggaagtaagctaaagactaggaccactataacaactactactcgactcttaaagaccatgagtttattcaaacatgagaacaacttaacgacttattcaaaacccaacagacggagagtaatgcttgtgacaactcagatgaggattccagtgcttcggtattgcggcaacagcgtacttttccgagcttcgcggattcggtgtttctcctcctaacttggtcttgatcactcagccgcgatcttttgtacttagagttatagtgttgttctttaattttctgtagattgcttctctctccttctattcttctttgtcaaaaataaaaatggtataaaacttcatcttttacccaaaaaaaataaatgtaaagtcgtgtacagtgaatattactctgttttcaactccagaaaacataattgggcctattgggaatataattaaagcccacgagattcgactagcgagagttgttgttggttacgtaatttagcgcactacggaacaaagaagaccaaatttatacgagtcaacactcaacagcgatttgatctgcgatttgatcatcaacaacaatcactccaaattttgtctgctcaccatttttccacaaagccaattctcttgtatcca

SEQ ID NO: 14949 - DNA, 3000 bp, Unknown
  misc_feature (1)..( 3000): cDNA_ID_2731301_gDNA_ID_2684236_Annot_ID_137703 3000 nt of promoter + ATG
ggtgtttctcctcctaacttggtcttgatcactcagccgcgatcttttgtacttagagttatagtgttgttctttaattttctgtagattgcttctctctccttctattcttctttgtcaaaaataaaaatggtataaaacttcatcttttacccaaaaaaaataaatgtaaagtcgtgtacagtgaatattactctgttttcaactccagaaaacataattgggcctattgggaatataattaaagcccacgagattcgactagcgagagttgttgttggttacgtaatttagcgcactacggaacaaagaagaccaaatttatacgagtcaacactcaacagcgatttgatctgcgatttgatcatcaacaacaatcactccaaattttgtctgctcaccatttttccacaaagccaattctcttgtatccaatgcctatgttctactcctctcgttttctcttcttcttcaccatcgtccccttactcgtctctatcgctctctaccaactcgacacatttgacccagctccggttccttccgaggcatacgcctcctctactacttcaatcccgccgcttatcagcgacaaatatctcaccggagctgagtttattggcgtcggtcttctcgataaacccgaagatatcgcctatcatcaagactctaatctcatatatactggctgcatagatggatgggtgaaacgagtcagtgtccacgactcagctaatgactcagtcgttgaggattgggtcaataccggtggtagaccgctcggaatcgctttcggagtccacggcgaagtcattgtggcagacgcatacaaggtttggattcgtgaactttttagaaatcgaattttgaaaatctcgatcttaggttgattagtgtgtgtgtcggtagggactgttgaacataagtggtgacgggaagaagacggaattattgacggatcaagcggaaggcgttaaatttaagctgactgatgtagtcgccgttgcagataacggcgttttgtatttcactgatgcttcttacaagtacactctgcatcaagtcaagtttgacattttggaaggtaaaccacatggccgtctcatgagctttgatcccaccacacgtgttacacgtgtacttctcaaagacctttacttcgctaatggcgtctccatgtctcctgatcaaacgcatctcatcttctgtgaaactcccatgtaagtccactgactctgttggattttactaatatccgactcataccagttagcaatgtgttaattcatcgatatactatatctaggagacgatgcagcaagtattacattaatgaagagcgtgtagaggtgtttattcaaggcttaccaggttatccagataacattcggtacgacggagatggccattactggattgctatggtttcggtatgtaaaccagttgaaatattttctttaaggtttatgatgatgagcttttgtatagttttgctcatagtgttgtgaaaacagggagcatcaacgttgtggaggctctcgatgaaataccctttcttgaggaaaatcacagccatagcggctaagtatggcgtggaacttatgttcatgaagaatgcaggtgttctgcaggtggatttggatgggaatcccatcgcttactaccatgatcagagactctctcacattaccaccggtatcaagattgggaactatctctattgtggaaatatcttgcattcgtacattatccgactcgatctcctgaagtatcctgcacagaagaagaagctttgaaacatcaaagtttatacaagcactaaaaatttccactttaggagtatgcactttcacaaaaatgtaaacgtatcgtcccttagaataaatgtatgataatgtctcttaaggagtacatagtagcctgaaacaatgaatacaaaaccaatcaaccatacaagccattccaatgtgtcataaaacttaacaaagtttagtgcgcatgttctttatatattaatgattagaagacgtcccctgactacggttacggttattacgtttacggtttattaaccaccggttacggttataaatttttgttaatcttaaccttaaccgttacatgtacggttaaaacggttacggttaaatacggttacggttaaatacggttatggttaaatacgattacggttatttgataattatgatatagttaatatacgaagtaaaatattatattttttaaccttcataataaaaaaataaataaatagtaatatatcaaataatatttattttacgcgattatgtgcttcaaatatctatagtgaatcatctatctattttcttaagtaaatcaacgaataaacaaattaatggtcataattataataatttaattacattttcgaaacaaaaataattctaaagagaagatgttgtgaacattaaaaaacaattttaagagtataaataataataatatgaactacttataatttaatttatggtcaaaagagtagtggagtaacttcgattgtagtagtgacatattaaacgatttaaggtgatgttttagtaaaataattattcatttaaaattatacacaattacaactatattttaaaagttttaactatacggttaaccgacggttttgatacggttacggttaattaacggttacagttagtatatttttttaaccgtaactaatctattttcacggttaacggttacggtcaggttacggtcagttaattaacggtccggttacgatccgaaatacggttacgattagattttggtcatgcgccttgagctcctctagaaaaatattgggcctactgggaatatggttaaagcccataagattccgtaacataacgtactacggaaaagaagaagtcaacgatttgatctgtgattgtttttctctcaatcaacttcaaaatttgttgattcaccatttttttccacagaaccaatccttctaca

SEQ ID NO: 14950 - DNA, 3000 bp, Unknown
  misc_feature (1)..( 3000): cDNA_ID_2731295_gDNA_ID_2684236_Annot_ID_137705 3000 nt of promoter + ATG
tacatcaatggagggcgcgtggagttatttattcaaggcttaccaggctatccagataacatccggtatgatggagatggacattactggattgcaatgccttcggtaactataaaaattgaaacccttcttagagtttattgagttggtttaggtctcggtcatattcagtatgtgtgtcatcttttatatcatcttttattgatcactattgtatcatcttttattgatcactatagttgaaaacagggagtaacaacgttgtggaagctttcaatgaaatacccattcttgaggaaaatcacagctatggcggctaagtacggctatgaacctatgtttatggagaatgcaggagttttgcaggtggatttggatgggaaccccatcgcatactaccatgatcaggcgctctctcacataaccaccggtgtcaagattgggaactatctctattgtggaagtctctggcattcacacattctccgacttgatctcctaaaataccctgcacaaaacaagaagctttgaaacttcatgtttataaaaaaaaaagacttttacattttaggagtattcactgtcacaaaatgtaaactcattgtcctgagaatgaatcatgatgtttctctatctctaaggatattagtaacctgaaacaatgaataccaaacgaaaaaaatacaatgaagacaaaccaaatcatacttaagatgcacaattcctaaacaaagcagatatttttctttgtttagaactcaaggcaacccattgtccatacaatattggccctactggtaacatagtaaaaccccacgagatttcgactaatagttggttacaacttacaagggactagagtcaaagattattatgagtcaacgatgatttgcgatttcatcattaaatacacgtgtttaatttagttgtttttctcttcaatcacaagttcacaactacaaaattggcatgttcaccatttttccacaaactcaaatttgctccaatgcctgtacttttctcctctcgttctctcatactctccattattgtccccttacttatatctatcgctctctacaaactcgacacattcgaccccgctattgttccttccgatgcattcacatcctctgctacttcactcccgccgcttataaacgacgaatttctcaccggagctgagtttatcggtgtcggtcttctcaatatacccgaagatatcgcctaccataaggaatctaatctcatctacactggttgtgttgatggatgggtgaaacgagtcaaggtcgccgactcggttaatgactcagtcgttgaggattgggtcaatactggtggtagaccgctcggaatcgcgttcggaatccacggcgaagtcattgtcgcagacgtacacaaggttggggttttgaaatcgaattttgaaaaatcacaatcttaggtttgactttgttgttatgtatagggactgttgaatataagcggtgacggaaagaagacggaattgttgacggacgaagcggacggtgtgaagtttaagctgacggatgcagttaccgttgcagataacggcgttttgtatttcacagatgcttcttacaagtacactctcaatcaattgagtttagacatgttagaagggaaaccttttggacgactcttgagctttgatcccaccacacgtgttacaaaagtacttctcaaagacctctacttcgctaatggcatcaccatctctcctgatcaaactcatctcatcttctgtgaaactccaatgtatgtgcattggatcagttaaattttttataaatttccgactcagtttgatttggcaataagttaatttatctatatctgttatatactactttaggaaaaggtgcagcaagtattacatcagtgaggagcgtgtggaggtattcactcaaagcttaccaggttatccagataacattcgttacgatggagatggacattactggattgcattgccttcggtaacgttacaaattgaatttcttttcttttctttgaggtcatgttattaactcattacatgctaataaaggatcatctttgtgttgtggttgtgcaaacagggagtcacgacattgtggaatatctcgttgaaataccctttcttgaggaaactcacagcaatggtggctaagtacggcgtggatcttatgtttatggagaatgcaggcgttttacaggtggatttggatggaaatcccatcgcgtactaccatgatccaaaactctctcacatagccacatgtgacaagattgggaaatatctctattgtggaagtctctcgcaatcacatatcctccgacttgatctcctgaaatatcctgcacagaacaagaaactttgaaatattatgttttcacaaataaggaaagtttccattttaggaaggagcattcactgtcacaaaaaatgtaaactcatttcctgagaatgaatgatgattgtatctcttttttttttttttttttgtctctctcgtagatttgtatcattgattccaaaagcatatactatctagcatgatgtgagtgttattgttcctttaattagactcgatacattcctttaattagacttggtcataattaaaggaataataacactctgtgatatatgaaaagcatataaatggtattaagtaagaatcgaacctgtgacctttaagaagttaagctggcttggaaaggtgtatgaggtggtcgtccactaattagattcagagagtcaggacttgatccaacgattaacgcaaaatcatttgcacgttctacgcaactccataatttcaattcctctcgacgtttcacggcgaagcttcagatctacttttccccagctcaggtgatcttttccatcttccatcatcttcgttcgctgttagagattatcttcttcttcgtcttcgtcttttcctttacgatttctgaatcttcttttgtctcttgtttgattttagt

SEQ ID NO: 14951 - DNA, 3000 bp, Unknown
  misc_feature (1)..( 3000): cDNA_ID_2731287_gDNA_ID_2684236_Annot_ID_137707 3000 nt of promoter + ATG
actgcccatggtgtccttaaagatggttggagctccctcagacgctattacctgaataactttgctgatggaactaagcaggtcagtgaattttcattctcagtaactctagttgtatcatctaataatgttcagttgcaactgtgtgcgactacttttggtgtcacttacccctgtaactggaatgtgtcctgacgcaagttaatatggctatgtgcaataggatgcaattgatctcttgcaagggcactacatagttgctgtgagccgagacatggctcctgtacctcaaaagggaggccttgaggctgtagccgtaagcatttatcaattaagattagaactaatttccactatattagcatacaaagaattctagtcttataacaatgtaaatttcatgtctcagaacttcccagtggcattgttcgtggttctgatgagtttctggtttgcaacaatgtctctaaaacaaagtaagtatggtatttcttttgctggatagttaagattttctttcaaacttaatctgaaactgtgtaaaatttgctgagcagctgggagtgattataagcataagcacttgttcttctcattgttgtggacgggaatttgcgtgggcatggctgcactggtgagggccaatggcaggatcttctgtaaccgacctcgtctgcacaagcccagaggctgattcatttcgtgagatcaattaattaaagacatggaactcaagtcggagacaaaagttttctcccttcgattgttttattttattgtatcaaaattggaccttgtgacaccatctagaggcaattgtctcaggtttggatccctcatgatttaatactcccacagccatcaaatgactcgatacagttacacatctttcttcatgttcattctatgattactcggtccgacaaatggctttctaaatccctacttcttgttgagtgattccattgtagaattcatcatgaggcatgatagaccaatggcagacaaaggaagtgcatgttctaggttgtttagccataacctatgcgcatctttgttattcaggctcagtccctagatggtcaatcgttatattagtgttaggatccattattttgtggcagatgcacatctaccctctgttaaatcttttctacggttgtttctgagagattgtgctccattgttgcttgatcattttttggatatttggtaaggattcaaacaaaccaaaaagaggcctcacaagttcaagaagcagttcaatgaggcatttttaaattatgaaaccaaatattaatcatttaaatatggttaagatctacagtacaaaaaatggaatcaatcaaaacttggaaaaaccagagaaaaaagcacacaaccttgaatatctctctgactttcctatcaaaagaggaaacaaaaaaagaataaagtaactcttcttacctttttccaacttgctctcagttccttcacaactcgttcaaaacacctttgaggagatccaatccctctgcagagatgctcctcctcttatgcgacttgggaatctcaatccgaggaggcgcttcgggcgagaaacagacaaccactacagtaagattgtcacagctgtttcgttgaagagcctccttaaccaaagcttgagagcatctctcaggatcattatgctgcatcagctccctcctcaccatcgtcactgcacactggctactcatcacatcccagagtccatcacagcccattataagatactcatcctcttccgtcagcacaatctcttccagctcaggctcgcagctgagcgggcagagtgaacctttagttcccttaatgtgccaatctcctaaggctcgagccacagatagctgcccgttaaggtaaccatcgtagatcacacctccaagcttctcaatacgtagccgctcggaagtacagttaggtttgtggtcctttgataactcaatggctctgcctcgtttcccaagcaccgctctggagtcaccagcgtttgcaatcaacatagtcttgtccaaaatgagagcagtgagtgcagtagtgccagaggatctatcaagagaagaagcatcagccaaagcatgatcagtcttcacaaaagcactccttgttgccttctttgtgctggttgggaaatgtttgtcttccattacaagcttcataatgttcttttttgtgaatgatgcagcatcaacacctccgtgtccatcaaacaccttcataaacaaacaatcattttaaaaaagagaacttttttgaaatattcgatgaagcaaatcttatataccccatagaaagctccagtggatgatccaatatactcagtgagatcatcaacacaaatgaattcatcttccattgattgttttggtcctttatcagaccaacttccagatctaaacacaggctggaatgttgaatttactccttccggagattttgcaccaaatctctcatctccttcctgcaaacaaatcattttcacattgtaagtttcaaactttggattgtttttgagtcacgagatccgatctaagctacattatcttatctgttcgtgaccgtgcaattacaatcacaagcatttgaatttaaaaaaaaaaaaaagcaaagaagagatgaaccaacgtaatcggtcaaccaggcagtgctgttgcaatggcgcattgcagagatgtttcttggaggtttcccagaggaactgagattcgtcattttgtcatctgcgacttccaatgtgttgatcatcggagaaacttcagtcaccggtgccatttccagattccgatcaaaagctttctttttttgtcagagtcatctcttttaaattataaaaatagcttctttcttcttcttcctccttattttactcaccaatcagctctctggatgccacgtgtgcttccaatctccatattttttttttagtttgaatataaaagagaattaaatcttttattagtttcccattagcgaaag

SEQ ID NO: 14952 - DNA, 3000 bp, Unknown
  misc_feature (1)..( 3000): cDNA_ID_2731283_gDNA_ID_2684236_Annot_ID_137708 3000 nt of promoter + ATG
cccgacaaggttcattctttgtcatttgacccgtaataattattgcctaactggagttttcaaaaggttaagcctttgttaaagctaatattgggccaaaggacattgatttatctgtatgtaagtgcttttaacagtttttgcttaccaattagatatcttccttccaaaggtatcacttctggctgctaaattgagcctagagctcgacttatattcaactgaaaatacattcatagacaaaccaattaaacacatgattttgtatgtgatcattccccggaaacagcctctgctcaagcacaatcttcaagcgccaaggaattaactttcaactgatattttgactccaatctcctaccaacaaatgaaagcaggcaatgtctttccagaacaaattgttgatctgaatatcaactcattgaacaaatggtgacattaccatcagcttcagacattcaaaccgcaggatggcatatcgaattctttgtggattcatatctttcacaggggcaaataaaagagaggacagctgatcatcgaatttcaggcacttactcgttggaacatggcatattgttgaaattacaaacaaaatctagcgggtgataaacagtgaacagaagcaagctcctttgtaaatgcagaattatattcaaagtatatgtggagacaacaatcatcactgtatgagttgcagaatcacacaaaaggattttaaagaaagccatctcttttatcttgttcttgagcttccttattagcagcttcaacggatttgaaccataggaacacctgaacgcaaaaaaaccattttttcagctgatacagatcaaatggataaaaacgaaaagagagagacaaggaactcacagaagtggggattccagtaagagcaaagaatccaagcacaggagtataaaagatgctgtcagattccaagatcccgaaaactggattcttgcttgtgtactcgaaaacagaaccaatctacagtgaccaaacgatgcataattaagataacatctttgatatgagaatcagcaatgcaaacaacaaaaggagtgaaagagagagaagaagaagcatacagcagcaatggcagtaatcgcggaagctagcagataaacaaagaaaggaacctcaaagctctcttgggacgtagaagaacgaccttcgtttctagcccaaggaggtggctcatctgagtcaggattcgcccaagacggttcactttctttagattttttagatccctccgtcgccgccgtcacaaccaatctcctcactgtactacgttcgtaatggagcaagtgacccttcctcctcccagccagaggatgatggcctggaaatggtgatttggtaggtgaacggttgcaacattcatcaccatggctaagacaaaaaccggtcggaagagatgttagagacgcggccatagatgcttaagaagaagatgaaagcactcactcgactttggtctaaaacagagtctgaagcggtgaatcgatttgcagccacacgttatagtttttgaatagaaatatctaatccatcatcattctgttgtggatgaaggacacgtggtgcaaataaacgacatttggtcacagttttggttaaatttagcactagaatctagtaaaaactgtagcaagtttaagtctttactcccaaaccattgtattaactcgaaagacacaacaagtgaacacaacagttttctttaccatctccaattctctcaacacacaacaaaagcttataagttatataagcagaaacaatgttactagataaggcgattttttacatatgaatgtggcaaataaaacaagtgctaagctatagaatcaaggatcaactaaaccttccataacaacgagtttgtccaagagctcaagtttctcatcttcaagtgctttaacctcatcctctgcttcctttaactctctctccaacgcgaaactatcttcctctagcagcaaatacttgcgtctcagtgctctgtactcgtttcctggagatgaatctgaatttggagacatctcaagttgatgtgaaatcgcatgaacctggttcgatttgctccgatttgaaacttttttcccgatacgtggtggtagttgagtcaagggttgttttggagtaggaatcttcattctttttgcttcagagaaaggtggaatctttgaatcttgcatctctgctcaaagatcatcaaaattaacaattttgtgagattaaaaaagcatcagagaaacaatggaattcgatggtctcaattcaaaagcagagaatagaacataaattgagatatcagtgtgtatttctacagtcgaacttacctgcgatttgtctagggtttcacaggaccttcgccgacgagagagaattgggaaagcagattatgaagttgcgggaagaagattgagttcggtttggcttttatgatttttagtgtagaaccgacattgacttcaaaccgtaaaaccccgttaaaggggcttagacattataccggttttaatgtccggtctgattttaaagattgcaataattggctgaccaaaggtccaaaagcgtaagacactctggaccgactagaggtttccaaactcaactgtatttagacatttgtgtgattaagaagaaatgtgatcctcatatggttaagtagttgttgtaatatttcctttttgttttgtttatcaggtaattccattatataaaagacttaagaatcggtcaaaataacaatgtcactttctccttatatctctctgcttgaccaactctttttcactctcctaccgttattaccacttctcaaactgctacatgctttgattaatcactaaaatatctttaacaactcgtttttttggtttgtgaaatgaatctgggacattgcagaagggaaagaaacatatgatgttctatcaacagaattattgattcgtggaaagtaaaatcactgtaaaagagaaaaagatg

SEQ ID NO: 14953 - DNA, 3000 bp, Unknown
  misc_feature (1)..( 3000): cDNA_ID_1440790_gDNA_ID_2684236_Annot_ID_137710 3000 nt of promoter + ATG
attctctgtaaccctccattgactctcttaccatctgcaccaaccttgtcattatacttccacgccaattgccatccaccgcctatgcttgtagccgtcgctgtctcacccacgtttgccataaacaagctgctctgtcgcctatgcatggtaccaacggtccgctggtggtagtcatccggctcagtggtttgcggagaaagcagaggactgtttaagttttcatcttggtcagaactatcttcattgtttctctctggatcccactgggactcctgccttcccatcattcccagtatacttcccatattggggaagagcatgctgcgggatgatgcgttcatgttctcggaagggagattctcatgaatgctaccaaagagagtgacaagtgggtccatgagggatccgccacgcggtaacatgctgccttgtcgggaagccaatgcgagagaactctgtcctttcactggcttagccatccatgactgtccatcctctggaccatatagttttatctgatctttcctcggcagttcatttccaccctcgttttcctcgttgtctggtccaatcacatattcttctatcgacgtgtcttttcccaccccaagcccttcaaccagcagagcaagctcgcctaaatcataccccgagttagtataagttcaaagatcgataatctagaggtcttagtgttcatcaagacaaacctgaaacatcttctctgccacggagtctctgcagaacctgtctagcttcatccatacggcctttgctgacaagccaccttggagattcaggcaagaagaaagccgcaagtacaaagtaggcaatggacggaattgacaaaacaccaagcatcagcctccagcttggtgattcttgaagcgacatcccaaacacaagacaatacgacaaaaacatcccaccggatccacaaaactgcgggaaagtgttgagtaatcctctgatctcagaaggtgcggtctcagagatgtagattgggacgagagtgacagctaaaccgatcccaaaaccatcaagaagccttgcgaaaaggagaacgtagacattgggagaccaaaacataacaatgctactcagaaaatagagaacagaggagagtataagcattgatcgccttcctactttgtcagagacaggaccagagaaagttgtgatcaaagtggctccaatgagagacattgccacgatcagtccttctatctttggttctttctccaaatgaaattctttcttaatgtaaattacagctcctgccaccaagaatcaacatcaaatcatagtgagatttcgttagtatgcaaaggaaaaagaaagagaaatatagaaagagagatacctgcaatggtggcattgtcccagccctgcaacatattccctatcgcagcggctaaagcaacaagcactacactcctcatctttttctcttttacagtgattttactttccacgaatcaataattctgttgatagaacatcatatgtttctttcccttctgcaatgtcccagattcatttcacaaaccaaaaaaacgagttgttaaagatattttagtgattaatcaaagcatgtagcagtttgagaagtggtaataacggtaggagagtgaaaaagagttggtcaagcagagagatataaggagaaagtgacattgttattttgaccgattcttaagtcttttatataatggaattacctgataaacaaaacaaaaaggaaatattacaacaactacttaaccatatgaggatcacatttcttcttaatcacacaaatgtctaaatacagttgagtttggaaacctctagtcggtccagagtgtcttacgcttttggacctttggtcagccaattattgcaatctttaaaatcagaccggacattaaaaccggtataatgtctaagcccctttaacggggttttacggtttgaagtcaatgtcggttctacactaaaaatcataaaagccaaaccgaactcaatcttcttcccgcaacttcataatctgctttcccaattctctctcgtcggcgaaggtcctgtgaaaccctagacaaatcgcaggtaagttcgactgtagaaatacacactgatatctcaatttatgttctattctctgcttttgaattgagaccatcgaattccattgtttctctgatgcttttttaatctcacaaaattgttaattttgatgatctttgagcagagatgcaagattcaaagattccacctttctctgaagcaaaaagaatgaagattcctactccaaaacaacccttgactcaactaccaccacgtatcgggaaaaaagtttcaaatcggagcaaatcgaaccaggttcatgcgatttcacatcaacttgagatgtctccaaattcagattcatctccaggaaacgagtacagagcactgagacgcaagtatttgctgctagaggaagatagtttcgcgttggagagagagttaaaggaagcagaggatgaggttaaagcacttgaagatgagaaacttgagctcttggacaaactcgttgttatggaaggtttagttgatccttgattctatagcttagcacttgttttatttgccacattcatatgtaaaaaatcgccttatctagtaacattgtttctgcttatataacttataagcttttgttgtgtgttgagagaattggagatggtaaagaaaactgttgtgttcacttgttgtgtctttcgagttaatacaatggtttgggagtaaagacttaaacttgctacagtttttactagattctagtgctaaatttaaccaaaactgtgaccaaatgtcgtttatttgcaccacgtgtccttcatccacaacagaatgatgatggattagatatttctattcaaaaactataacgtgtggctgcaaatcgattcaccgcttcagactctgttttagaccaaagtcgagtgagtgctttcatcttcttcttaagcatct

SEQ ID NO: 14954 - DNA, 3000 bp, Unknown
  misc_feature (1)..( 3000): cDNA_ID_2731279_gDNA_ID_2684236_Annot_ID_137711 3000 nt of promoter + ATG
aacggtaggagagtgaaaaagagttggtcaagcagagagatataaggagaaagtgacattgttattttgaccgattcttaagtcttttatataatggaattacctgataaacaaaacaaaaaggaaatattacaacaactacttaaccatatgaggatcacatttcttcttaatcacacaaatgtctaaatacagttgagtttggaaacctctagtcggtccagagtgtcttacgcttttggacctttggtcagccaattattgcaatctttaaaatcagaccggacattaaaaccggtataatgtctaagcccctttaacggggttttacggtttgaagtcaatgtcggttctacactaaaaatcataaaagccaaaccgaactcaatcttcttcccgcaacttcataatctgctttcccaattctctctcgtcggcgaaggtcctgtgaaaccctagacaaatcgcaggtaagttcgactgtagaaatacacactgatatctcaatttatgttctattctctgcttttgaattgagaccatcgaattccattgtttctctgatgcttttttaatctcacaaaattgttaattttgatgatctttgagcagagatgcaagattcaaagattccacctttctctgaagcaaaaagaatgaagattcctactccaaaacaacccttgactcaactaccaccacgtatcgggaaaaaagtttcaaatcggagcaaatcgaaccaggttcatgcgatttcacatcaacttgagatgtctccaaattcagattcatctccaggaaacgagtacagagcactgagacgcaagtatttgctgctagaggaagatagtttcgcgttggagagagagttaaaggaagcagaggatgaggttaaagcacttgaagatgagaaacttgagctcttggacaaactcgttgttatggaaggtttagttgatccttgattctatagcttagcacttgttttatttgccacattcatatgtaaaaaatcgccttatctagtaacattgtttctgcttatataacttataagcttttgttgtgtgttgagagaattggagatggtaaagaaaactgttgtgttcacttgttgtgtctttcgagttaatacaatggtttgggagtaaagacttaaacttgctacagtttttactagattctagtgctaaatttaaccaaaactgtgaccaaatgtcgtttatttgcaccacgtgtccttcatccacaacagaatgatgatggattagatatttctattcaaaaactataacgtgtggctgcaaatcgattcaccgcttcagactctgttttagaccaaagtcgagtgagtgctttcatcttcttcttaagcatctatggccgcgtctctaacatctcttccgaccggtttttgtcttagccatggtgatgaatgttgcaaccgttcacctaccaaatcaccatttccaggccatcatcctctggctgggaggaggaagggtcacttgctccattacgaacgtagtacagtgaggagattggttgtgacggcggcgacggagggatctaaaaaatctaaagaaagtgaaccgtcttgggcgaatcctgactcagatgagccacctccttgggctagaaacgaaggtcgttcttctacgtcccaagagagctttgaggttcctttctttgtttatctgctagcttccgcgattactgccattgctgctgtatgcttcttcttctctctctttcactccttttgttgtttgcattgctgattctcatatcaaagatgttatcttaattatgcatcgtttggtcactgtagattggttctgttttcgagtacacaagcaagaatccagttttcgggatcttggaatctgacagcatcttttatactcctgtgcttggattctttgctcttactggaatccccacttctgtgagttccttgtctctctcttttcgtttttatccatttgatctgtatcagctgaaaaaatggtttttttgcgttcaggtgttcctatggttcaaatccgttgaagctgctaataaggaagctcaagaacaagataaaagagatggctttctttaaaatccttttgtgtgattctgcaactcatacagtgatgattgttgtctccacatatactttgaatataattctgcatttacaaaggagcttgcttctgttcactgtttatcacccgctagattttgtttgtaatttcaacaatatgccatgttccaacgagtaagtgcctgaaattcgatgatcagctgtcctctcttttatttgcccctgtgaaagatatgaatccacaaagaattcgatatgccatcctgcggtttgaatgtctgaagctgatggtaatgtcaccatttgttcaatgagttgatattcagatcaacaatttgttctggaaagacattgcctgctttcatttgttggtaggagattggagtcaaaatatcagttgaaagttaattccttggcgcttgaagattgtgcttgagcagaggctgtttccggggaatgatcacatacaaaatcatgtgtttaattggtttgtctatgaatgtattttcagttgaatataagtcgagctctaggctcaatttagcagccagaagtgatacctttggaaggaagatatctaattggtaagcaaaaactgttaaaagcacttacatacagataaatcaatgtcctttggcccaatattagctttaacaaaggcttaaccttttgaaaactccagttaggcaataattattacgggtcaaatgacaaagaatgaaccttgtcgggctctttaaagatgggttgttgtataaaaagttgggtagttaaaagattggttatttgggctctgcactcaagtgagagagaagatagatagatctgagtagaatcttcgattcattattcgttgtcgtcgttcatctgtgagaagcggacaaaccaaagaatccaccggagctagtgat

SEQ ID NO: 14955 - DNA, 3000 bp, Unknown
  misc_feature (1)..( 3000): cDNA_ID_2731276_gDNA_ID_2684236_Annot_ID_137712 3000 nt of promoter + ATG
tcagagaggagagaatagatcaggaggagagtcaaaagcattgtcgaagatgagagattgaggagattcatcatcaatgttaagtagccagtttgtatccttgacatctttaacattcaagagtgcgtcgtaacgagcactatcgttcttgttctctgtgttgttcccttctttcgttaagcttcttccatcttcctcttcatggttgctgctgctgcagctgccttcactactaccacacggttttcttagacccgaagaagaagatctgatgctgtgtggatacaacattgggcttgaaaacgtatgtgtactaactttaccatttcgtgccaagtcctgcatttgaagtgacactattatcgtcaagcaaaacctcataaaaaacgttactatactattgaccacgataaacgttataaatgacaaaaatatttagctataatcaaataatgacaagagaacgttattaccaagtgattgatagccatttgaacagaagctcttgacaacttccttcctggcctagttgaatcggcaacagtggcagatggctttatagacttgggagttgttgttgtatgtgaggtgcctgaaaaagtcggaatcagagaaggagaagcagagcgtcctttaggcctcgttcttgtaacatccggtgaggtgtttcgttttggcgagttaacatgacccactggtctaccaaacgctagagtgactgtttcttttagtcttggcggtgtccgaggtgttgctgaaactgttgtgcttctatcaggacgtgatgttacagacgaagaacgcacattggtcctactacttgcatttgctgcaatctgaggctttgctcttggagtcaacgatcttgatctttgagcatctccagctgttttgaaggaaggagtggttgaagtagttgtactgattcttgaaggagttgaggttggtgatggtgttttgcgtgatgagggagtcaaagatcgagagacagttctttttggagaagaaaccgaagctgaagcttgaatttgtgttgttgttgtcttcttggggaccgaagaggatctgatagtgggaatgttggagggacgaattgttgaaccgcttctcgttggtcttgaagatggatcactctcgctctacatgaaaaaatataaaaatattacatgagcatatatgatacatgaaattatagcgagcttgttgcatcatacccttaaaggaacccttgtagtggttatggactgaagcttggaagttgtgtttctagcttctagaaccaatctagaaagatctcctaatggaacttctgcaatggtataaagcctaaggaacaaagattataaattataataacttgtttgcattgtctatttcaggtttattattgcgtataaattcaaatgagggattacataaattcttacggttcatttgcatgtatattgtgattattgtcatcatcaggtccatgcttagcaactttagcttgttggaaagaatgtcttcctggtttaatcaaaactgcataccatatagatcaacatgctagatcacattaatatggatgacttattggaagacgaattattgtatacaaagattggcaaaaaaaactagcaaattgaaatgagaatagcatgaaagcgatcttagaatgcaaaacgtgatagcaatctaaacacaactggaagaacaataacaatgtgtgttggtgtagaaaagcaaaagataagtcaaatggaccaaataatagatgatgataccatccaaagaagttccacggttgactgagaagagatccaaattctcatccgcctggcgattgcttttaccggggagagactttttcagactccgatcactcatcgacggtttaaaaacacacgatcaaagaacagggaaataaaacagaagtcatataaagacaaaagagagatagagatagagaatgtttcaaaatttggttaaataaaataaaacaaaggcattttccattcccgtgtggttttggttttcatgtcattttcttccattttttataaagcatgagaggaagataatgtgaacatagaaacttaagattagctgattatattatgacgtgtaaatagacgtgtcacaatatatgctgcacggaaataaagtagttatctacatgtgtgtgttacatttatttgataatctaatttattcggtttgctttgattcggccaatttctgtttaccaatttttcaaaaatacaactataccgcggatttatttcacaaagatgccaaaaggttacaattatattcaattccgaagaaaatagcttctgattctctgttgaagctttcgtgttaaaaaaaatttgtaaccaaacgaaaatctgtttaaggggtctatatttcaaatcactacttattaaaccgggtcggtatcatttattctagagctggatttaaaaaccaaccggaaagtaaccatggttggctgatcgtgttagattcggttcggtttaaaaattccaccttaacaaaaccggtttacaattaaaaatggatccctaattttctcaacagttgtcgtcatccgtctccaaatttttttaatcgttcttctctagtcatatcgccgtcgtcgtatgtctctctcacaacaggttcagttttgatcgttattgcgtttggagtgtttgcattacgatatcactgggaaccaacttggggaatgaaaaattctgaaagattttctgcagcaaagccattgatggaacaagggtttgtttcttttctctgcatcctctttgaactgttctttaataatctaacctccgaaaccctaattcttaattttattttagtggcaaaagttcgagaaagccaggttttatgagtgaggacagaatcagtgagttgcctgaagttttgcttctgcagatactgtcttcacttcctacaaaacttgtcatatccacaagtgttttgtccaaacgatggctatctctttggaaaatg

SEQ ID NO: 14956 - DNA, 3000 bp, Unknown
  misc_feature (1)..( 3000): cDNA_ID_2731274_gDNA_ID_2684236_Annot_ID_137713 3000 nt of promoter + ATG
tgctactagacgttactatgcacaatgcttacttgtgagttcagcattcattaacttatgatgttttgggcatctcagattgctaagtttcatggccagtatgtggaagcgcttagggatctgtttgagaggcacaagtcccgagtcggctatgatcttgagctgaaaattctttgaacaaaatctccaatggaaataattacttgtgtgtatccttcattaattgttaccttggagctggatttggacttaatataaatgactacatcatgtagtctacatgtattgcatgtctttagcatcgactgttgaagtaatggaatacgtttataaagcctgtaaattacatgtcgtcttgcacaagagtatgtggtaataataacatttgacccaaaaataatactagttaaatttttccttgacttctctgacaaaccaaactaatttgttcatgaatctctctaagcaaatgaaagtaacaccacgtagtaaaagctctgcttgatgagaaggattcttacacatataagatcattcgaattcaaaaacaaggtggcatgaattggaagtcatgaccacaccatccaattcctcgcgcatcttacgtcttttggccaatttacagagcctcttcgcttcaatgggatccgtagagaaagttgccttcttcagctgtcttgcgttccttagaatgtacgtcgccacttctttctcttcttctcttccccaattgcaatttctccacataaacgtttcgagacattcagggacatactttggttgattccatttcccttggtccttgtattttttgtcgaattctagattttcatgacgagtctcacgctaccaaaagggaaatgaaatgtatattagaattagtccttcaaaactaaccccaacgagagaccatcaacaatagctagctaactaataatgaaatgtcttacatcaatgagcttgaggacttgtagtttaggagagctatcaagcatgtgcgtaagtagattccaccactccactttatgtgtatgcatctccagatataccagctgatggtacataacttcagtaggatatgtaatctattcatgagacaactattagtatatacagaaacaacaaacaagtcaagtgcgataaaagcgaagttaccttcaaaggtgataagtccaaggaaagacgtttggctgacttgagagatcccaaaatattctcattgactatcttagaaacgtttctaatatttgcctcaactagctcggttacattctcaatcagaaaatactcaaaaccttctacactttcaattcccaagtacttcaaagaaggagcttttatcacatatcccctactactctctcgcgcactaaagggatcggaaagcaaaagtgtcttcaaagatggcgcatcaatgatgaaattcactacagcatcaaagaagaaacctcgacgcaggaccaaatgttcaagattagggcagctagcaaaaagattatgaccagattcatcgcctttgtagaccacagatagaaggtgaagagttctaagggacttcatagaaaccggacaaggaacataaatataaacgtaatcaagtttcaaggtctcaagtgtatcaaagcaaaacaagctagttggaaatctgactcgagggccatggtaagaactaagatcgagtacgaactcacgaacatggcgtgtaaatgcaattgtagcccatactccaacataaacaccatcaaattgatctccaactttcagatgcaaactctctagaactggagctttatgtgaaagcaaagacctggtaacgttttcagcaaagtcatatatgtttcgagaagattcaaactcgagtctttgtaccattttccaaagagatagccatcgtttggacaaaacacttgtggatatgacaagttttgtaggaagtgaagacagtatctgcagaagcaaaacttcaggcaactcactgattctgtcctcactcataaaacctggctttctcgaacttttgccactaaaataaaattaagaattagggtttcggaggttagattattaaagaacagttcaaagaggatgcagagaaaagaaacaaacccttgttccatcaatggctttgctgcagaaaatctttcagaatttttcattccccaagttggttcccagtgatatcgtaatgcaaacactccaaacgcaataacgatcaaaactgaacctgttgtgagagagacatacgacgacggcgatatgactagagaagaacgattaaaaaaatttggagacggatgacgacaactgttgagaaaattagggatccatttttaattgtaaaccggttttgttaaggtggaatttttaaaccgaaccgaatctaacacgatcagccaaccatggttactttccggttggtttttaaatccagctctagaataaatgataccgacccggtttaataagtagtgatttgaaatatagaccccttaaacagattttcgtttggttacaaattttttttaacacgaaagcttcaacagagaatcagaagctattttcttcggaattgaatataattgtaaccttttggcatctttgtgaaataaatccgcggtatagttgtatttttgaaaaattggtaaacagaaattggccgaatcaaagcaaaccgaataaattagattatcaaataaatgtaacacacacatgtagataactactttatttccgtgcagcatatattgtgacacgtctatttacacgtcataatataatcagctaatcttaagtttctatgttcacattatcttcctctcatgctttataaaaaatggaagaaaatgacatgaaaaccaaaaccacacgggaatggaaaatgcctttgttttattttatttaaccaaattttgaaacattctctatctctatctctcttttgtctttatatgacttctgttttatttccctgttctttgatcgtgtgtttttaaaccgtcg

SEQ ID NO: 14957 - DNA, 3000 bp, Unknown
  misc_feature (1)..( 3000): cDNA_ID_2731262_gDNA_ID_2684236_Annot_ID_137716 3000 nt of promoter + ATG
gttctccaaatctaatacaaccagttcagaaagatgcatgagcgaaggcagttcttttatggctgtaccaccaagatataactttcttaggttttttggtataccctgaatatcctcaagctctaagcattgagaaagatcaagaactttgaggttgtctagataaaccatgattgacagactttgcgaatcagacgagacctcccgattcaagaatttgtgatctttatgatcataaataaatgagttatcttgtggagagaaggtcacagttggtattgatcttatgccagtttgtttgagatacagctcctcaatattaggtggaacctctgggaaacttttgatctttatgcaaccagagagatttatcacccgaagatgctggaaatgacctgttgctagaaatctttgtagtcttgcacaaccttggagatcaattacctccatatttagagcaatttggagttcttgaataccaactagctgttgtgaatgacaaagcatgatcctcttcagcatcccaagttcctggaaaaacaaattgttaaaaaaataacaacagagacgcaaaatagtaattggttttcaaatgcatatagactttcttaccttggttccttcccaaagtctctgaagtttactgtaacacatgttgagtataacaagatttctagtgttaaaatcttgtggtaaggataacaatggaaaatgttcccagtgcagtaaccttaactcctccggtagggatttgacgcccttgggaaggtgtagagcataatggtttccaggattggaactgcaaatcttcagatatctaagattatacatattctcaaacgccataggattgacatcaaagcttaaggcagatgggtccagaaatatggcttcaatatcttcactaccctgaaacaacaagggaaatagatggatcaagaacttggctcaaattccaatattgagctttgtgggaaaataacagaattcaacataccaaaacttgtctatcttctagaaaatacttaattatcaaaggtttccacagtctggaacgcctctttcctccattgataattttgcgacctatggattggatcaaattatgcatcacaaccctgccttctgccatactcaccaaacacttctcaacaagaacattgatttcaacacgtggaaagaaaccacatccctcaagcagatgtattacacagtcgacattttctcctctgaaaagacacgcaatatcaagaaatatgttcttctcgttggaactaagcgaatcatatgtactcttgactgcatcatgaatctcatgtgccagatatttcttgactttggggaatgcaatctctataggtttaggattcttccttgacatacatccaaaaaaaatcagagctaaaggatttccattagcataatcaatcactttctttgatagtttctgcaaactctcatgtataatctcctttccgaatgcacaccgcgagaatagctgcagagcctcttcctcatttaaacctggaacctcatatatctgatcgacccgacatatagaaaatacttgtttatctcttgaagttatgatgatcaagcttcccggacaaaaccaatcaaaccctccaagaaaggactctgcatctagaggcttacacacatcatcaagaacgacaagaactcttttatggcgtaaaacatttctaaggaggatcggtcttgtaatcgaactttttatgccaagctcttccctaagaattttcccaaagtgtgcctctaacaaaccataaagtcccttctcatgaaacgccttgttaaagtctttgatgaaacaagaagcctcatagtcaccagagagttggtcaaaagcagctttagcaagagttgtcttgcctatgccgggcattccccatattcctatgctgcggacaccccacggttgcttgtaaatcaatgtttctatcttccccaactttgagtagattccaatattgtctgacatgttgagcttttcacgcacatcagccacaatctcctccacaaagtcagagtcactgcatatttttgtagagaatgagtaaatattccaaagtggtctaggtctagtgaagttaatgatttaaaaatgcttcaaagttcaaacctttgcgtatcgtataactcgtggcctggtaagtctacagtttccaatagagcacttggccaatcgcttctaacatcgcccaaattccagatttgtttcttcataaacgatttcgtgactgggtaaaataccggaaccaccgcgagacagtttttccgccggcgttcggaaaccttgaccagctcctccatgcatgacttggatgacgagtatttctcagagaaaaccactacagaagccctagacgtctccaacttggagaatccattgctttccgaatcggagccgttttctctgatgaacgaagatattcctctgcggcggaaagcggcgcagaggtggctgacaaaagagtaccgcaccgtatcctcacttctgtcgaagctgatgtaaacatcgctgcaatccaccatgattgtttaggcgcgtttttcttgcacctagatttaggggattttcagttttttttttttttttcatttagactggatcaagtcggaattagtgaattcgtaaagagacgtgcctcacgatgaagaagtcgttccgagtagagtgttgacctagtttttcttacaaatttcttggaattgtgttttttgatcgaggccggccaagttcttctcggaagtttcgcttattctctttgtcacaacacctcaacttgaacttaaataaaaccagaatgatagttaagttttatagtttgtttaattcgtagcaattctttttgttttgtagatgagtagaacaggtcaagattttgaaaaatggtatctctaaggttgtttgtgcaagcatgtcgtcttgtatctcaaaaggaaactcaagaacgatttgtttccaaacaaactccg

SEQ ID NO: 14958 - DNA, 3000 bp, Unknown; identical to SEQ ID NO: 9729
  misc_feature (1)..( 3000): cDNA_ID_3019747_gDNA_ID_2684236_Annot_ID_137718 3000 nt of promoter + ATG

SEQ ID NO: 14959 - DNA, 3000 bp, Unknown
  misc_feature (1)..( 3000): cDNA_ID_2995065_gDNA_ID_2684236_Annot_ID_137720 3000 nt of promoter + ATG
gaaagcagagggtgcaaatcccaccaatctgattgaaagagatatcaaccacgatgttttgcaccagacatttaacaagcttgacctgcaaaagaaaagaaatttaggtacttgaggagataacaatcaaaatgataagcatgcataaacaccatatacaaacttggaatactcattggtcactgcagactctagtttctggaatttgaataacacagagattatgtaaacaaacctcagcccgtattaactgcacatccttaaccacaaattgggaggacaagttatgctcttccctctcaagtacagcaaaaactttggcagccagttcttcctcatgatacagcccaccaaaagcagtgagatcaatgtctccatcaggaagatacgttttcaatggaaccgatccaaaagaatgtacctgaaagacacataccagtagaaaaaatcacaactttgcaaaccacactcatagtcaatcaaagttataagccgcaacattgcagaatctctggtcagtaatagaaaaaaggtctgctttttgcacaccactttcgaaatataaaacaacaagtagatgacttgagataatctaacaagaaaagccatcaacttaagaataaaaagacacaagacaacattaaaaagccatcaacttgcatcaagagaactcaataaaatgcagaacaacatcgccgactcaagtaaagttccaacatttaaagtttttatccaaatgttaatgcaaacagagaatgttttattcaaatttacctcgcatccaagtgtcattctgataagtttttgaacatatagaatcacatctcttcgtcgatcctcggagacaagagttggatgaacctgctctataatttcacgggttgcttcctcaactctcatccacaactccggctgattcaacggagaccgaggcggcggaagaagcggtggtgataatgaggaagaactctcttcttccaaatcatcgagatccgcagccatgaaaaacaacaaaaacctaaaaactaaccaaaaaaatcgattgatacaagaacacaccgattgatcaaaccaaggaatcagttcgttgtaaactacgcccaggaaattgaaaatccgattgagttcgaacaaaacaagcgagtacaaagaatcgagagatgtctcaggggaagaagaagaagaaagatgagttttttcttctaggttttgaaagatcccaagtgattactgttgaggaccgattttgtgttatttgattgttctttcttctctctcttttttgttttcactgcatcggaaaaaaaaaaaaaacaaatttgtcttaactttgtgtatgcaacttgaaacccttttagatgtcgctctttttgtgtacctttttatttaccttaacgatgcagtatttagaaacaacgaccagcattaaattcttaagacatcatttgaagtttgattagagtgacttgggaagttatttgttcagaattttgatttcactatagttggttaaattgtaaagttcagatattcttccattaagtttttatagagttgtgattcttatgaatgttttaagagaaatgtcaaagattttaatacatgttttcatggtttagctttatcttttttatcattcaaaaagttagaaacttttaactttttttttctatgacatactaaattctcatgtaccttaacaaatataaatttttttttatgatttaactaacgcagtcgcgcttttttctattgaataagctcgattatcataactgattatgcttttaaaaacgaaaaaggtaacatttgagaatcattgtcttcaaaatcctttattcgagttaagttataaggggatccaactgtgtttcacgtgttccagaaatttgatcacctgttattctcgaatatgattttgttttgacgtggtatccacatataatgatatggttagtaaaacaaaataaataactccaataattagataaattaataattaattttgttctataaaagaattttaaattgaaaactccaattacaaaaatctagtaaacgttttgttttggaaaaaaaaatatataaaaatctctaattttagtcccgttttgaaaacaaaaatcaaaatcttgttatacacagaacaaaacaatatagaaaatctgcaaaacaaaatcaaaatttaagaattttacatggaatattaaaaacttatgtataatatttaaagcaacagattttactgatgtgaatataacagtccaaaaatgaacatcgttatatcttaaatatatataacaaaacatatttgttttaacatttagtcgttataacaacgacatttcaccccgaaactatattttcataattttttgtgaatacttttctatttcgaaatatataacacggtcttttaaatcaaaattaggaagcaatgtactaatgtattctaatactttgtgtaaaattttcttatctaaaatctcataacacaatccgtttagctacagatcagatggtcgtgttttttttttttttttttggtaatgatttaaaacgaaattatatacatcactaaaatatgttaaaccatgtctctttttttttgttctgatataagttgattttttggtttcgtcaataatcagttaccaggccctccgaccaaaacaaatatcagttactaggccctatacctggtcaaaactgagttggaaacaataaagttgggcctgatattttggcccaataataacacggatgagagttctcagttctcacatttgacatcctccgcttcaattctaaatctcccggcgaagaaaattaccggcaaatttcacggagaaacctcgccaacgaagcggagttatggcgggcatggctgcggtggcaggattacgaccgtggaacgcttttattcaagctctagttctgatatctctatcatttccctttctctccagcgcttaccgacctggagatatcgtccggatg

SEQ ID NO: 14960 - DNA, 3000 bp, Unknown; identical to SEQ ID NO: 9728
  misc_feature (1)..( 3000): cDNA_ID_2731258_gDNA_ID_2684236_Annot_ID_137721 3000 nt of promoter + ATG

SEQ ID NO: 14961 - DNA, 3000 bp, Unknown; identical to SEQ ID NO: 9728
  misc_feature (1)..( 3000): cDNA_ID_3019743_gDNA_ID_2684236_Annot_ID_192431 3000 nt of promoter + ATG

SEQ ID NO: 14962 - DNA, 3000 bp, Unknown; identical to SEQ ID NO: 9727
  misc_feature (1)..( 3000): cDNA_ID_2995065_gDNA_ID_2684236_Annot_ID_192430 3000 nt of promoter + ATG

SEQ ID NO: 14963 - DNA, 3000 bp, Unknown; identical to SEQ ID NO: 9726
  misc_feature (1)..( 3000): cDNA_ID_2114138_gDNA_ID_2684236_Annot_ID_192429 3000 nt of promoter + ATG

SEQ ID NO: 14964 - DNA, 3000 bp, Unknown; identical to SEQ ID NO: 9729
  misc_feature (1)..( 3000): cDNA_ID_3019747_gDNA_ID_2684236_Annot_ID_192428 3000 nt of promoter + ATG

SEQ ID NO: 14965 - DNA, 3000 bp, Unknown; identical to SEQ ID NO: 14956
  misc_feature (1)..( 3000): cDNA_ID_2731274_gDNA_ID_2684236_Annot_ID_192422 3000 nt of promoter + ATG

SEQ ID NO: 14966 - DNA, 3000 bp, Unknown; identical to SEQ ID NO: 14953
  misc_feature (1)..( 3000): cDNA_ID_1440790_gDNA_ID_2684236_Annot_ID_192419 3000 nt of promoter + ATG

SEQ ID NO: 14967 - DNA, 3000 bp, Unknown; identical to SEQ ID NO: 14952
  misc_feature (1)..( 3000): cDNA_ID_2731283_gDNA_ID_2684236_Annot_ID_192417 3000 nt of promoter + ATG

SEQ ID NO: 14968 - DNA, 3000 bp, Unknown; identical to SEQ ID NO: 14951
  misc_feature (1)..( 3000): cDNA_ID_3019763_gDNA_ID_2684236_Annot_ID_192416 3000 nt of promoter + ATG

SEQ ID NO: 14969 - DNA, 3000 bp, Unknown; identical to SEQ ID NO: 14950
  misc_feature (1)..( 3000): cDNA_ID_3019767_gDNA_ID_2684236_Annot_ID_192414 3000 nt of

SEQ ID NO: 14970 - DNA, 3000 bp, Unknown; identical to SEQ ID NO: 14948
  misc_feature (1)..( 3000): cDNA_ID_3019771_gDNA_ID_2684236_Annot_ID_192412 3000 nt of promoter + ATG

SEQ ID NO: 14971 - DNA, 3000 bp, Unknown; identical to SEQ ID NO: 14947
  misc_feature (1)..( 3000): cDNA_ID_1014464_gDNA_ID_2684236_Annot_ID_192411 3000 nt of promoter + ATG

SEQ ID NO: 14972 - DNA, 3000 bp, Unknown
  misc_feature (1)..( 3000): cDNA_ID_3019774_gDNA_ID_2684236_Annot_ID_192408 3000 nt of promoter + ATG
acagaggaggagacaaagaagtataggttcacattgcatagccagtttagttttgaaggatggatatatgaaaaaaatatgaagagagagaagagagaagaagaggaggattaaagagggtgaggccagcttttgtgctttggtagtagatgaggtttaaatgctccataccttccatttccttctctcttaccctaatttaattcttcctctcctttataactccccacagacattctcacttctcctcctcacacttcacatcaacacttctttcttgttttttcattttacaatgtttcctttgatatccgcactttaagcatgagagagtccctttgatattggcctggttcactcagatcttacctgaccacacacgtagatatacattattctctctagattatctgattgagccgcgccaatatctcagtactctctcgtctctattttggactttgtggtcttgtagatcgatttgtatgtgtgtgttgaaatggagacaagtacttgtaacttctttgttgttatattgtttacctataggctgatgtcataaactcttttgatcttgtttctaacttccagattcttgaaaaatcaagtcgtgtgtgtgtctccatggaagccttttccatttcttcttttccaaggtatccccttaatcagcttccttgccaagtataaatctgttgtagggttttgcttcaaataatctatatggatccttttagaatgcatattgtgttgataccaattttgagacagaatgtgtcagcgaaactgatcttgtttattagtacaaatgcaggatgttagagagttagctaataacatatacaacaaaatcacaaaaccggtgaagcaatgtaaaatgtcacaatcacaagatgtttttttcaaaaacaggggaaaaagcagagttaatgagagagaagctgacgagcacgaaccctaacctgcaagcgagcaagagcatgcatacaatgtaaagcaattcgtgcttgtctcctcacaagcactcctctagccaccgcctgtaacttcaccagactcttcaatgctttaaacgctcttcttgcctgcaaaacactttaatggttttaccaattttgttttttcaggttttcaaaatctacagagatagaaaatgtaaattaccaggtgccctctgaaaaaggcttggattttaacggcggcaatctcttctcgagttgtttctggagctgaagagcgaatgattgtgattctgctttgagatcgtcggagaagtttccttcttacaacaccaaacaaacgtttggagttggccatgtttatgggtggatcttgtcttcttttggttttggttttggttttaaaagaggacgtctaaggaaacgtaaaatgtgaataaaaagtgaagacggtggctttaagggatatatggaacatgatgtgctctcctcatttctaactaacgaacgtgctcgcatgctcctctctttacacttggtttcgttttgtttattagtagttttcaagacacacgagtctttggtcttttttacatttagttattgaattatagttatgttatgcctaactcaataaaaagaagcttattgagattttgaaaaggttattataaagggtgattgttgcatttcaatgctcaaaattaccatgttatgatatatcttataatcacatgtgaaatctacactatttttaaaatttatgatttagacaattttttcgaaaatgtcactctatttttcaacaagaaaataaaattaggtcattggtattgtggtttgtaatatactaatgacccccactacaatcctaccgacaaagcgtccactctttgtaatgaagttctttgatcatttctctattcaatcttgacactatgaatgtaatcgcgcagcggaagaatggttcatcatactcttacactgttacacaggtccagccctgaactaaagtgtttgtgtttttgtatcggatatgattagcaattgtgcatcaagttagttacggtctcttctcaaatccagtaaaccaaaaaatatataaaaaaatcatactctataataaacttacatcaaatgtcctttttttaacgtttatgttgggagtacgtagtgagatttttcagatatgataaatgtttatgtttgaagttctattttgagtatcatcattttacacgtctcctatcttttcttcaatcaataaagcctttgagcccacaacttcgtaataccgttaaacccaattgttattgggcatgaaaacaaggcccaactcaagtctatctcccccacttgttcatcttctattgtcttgttgcgagtttgcgacttaaacagtaattaaattactaattacgcaataatggcggattaatcgaacctactctctctctctctctctctctctctctctctctctctctctctctctctctctctctctctcgtgcatctccataaactatcttcaaagattaaattttgaagatcttctttttggcttattacccgattctgtcactgtctcttcttcttctccaatcccaatgtttgcttgagagaaagagagagagtcaaaccaaaacatgggcgtttgttgccctttccttcaaccctgggatcgagctcgtgatcaatgtctcctcaacctcccttgtctctccgatcctggtaccaatttcctctctttttaccctaatctatctcacgatccggtgtttcattaggttcttatgattctgtatctaattgctatcttcttcatctacccagttcgaagatcttctctacttctgaaattggcactagtagctctccacctcgtctttatcggctttctcttccttttcgatgctgaatttattgagaaaactaaacgagatccatggttattactccttatctctctctgcttattcaattactgtatccttgagcttaatgttgattactctgtgattctttctctgataggtat

SEQ ID NO: 14973 - DNA, 3000 bp, Unknown; identical to SEQ ID NO: 10752
  misc_feature (1)..( 3000): cDNA_ID_3019786_gDNA_ID_2684236_Annot_ID_192402 3000 nt of promoter + ATG

SEQ ID NO: 14974 - DNA, 3000 bp, Unknown; identical to SEQ ID NO: 10753
  misc_feature (1)..( 3000): cDNA_ID_3037848_gDNA_ID_2684236_Annot_ID_192400 3000 nt of promoter + ATG

SEQ ID NO: 14975 - DNA, 3000 bp, Unknown
  misc_feature (1)..( 3000): cDNA_ID_2731364_gDNA_ID_2684237_Annot_ID_137723 3000 nt of promoter + ATG
gcatgtaccacgtacgattcttcagaaaattaataattagaatataccgtatcactaacaacggtccaagttataagttttaaagtttagtgatgtatatatttgataagatataaaggagttcattaaataggaagtagaaacgacatatcaacagactcagtctaagacagcctaacagtaacaaatcaaatattcgtatcaaatgaaactgtaccttcaagtagtagaatgtattggcgttttgtgtgtgtgtgtttttcttcaatatacatgaacttcggtaattctttcttcacgattatttttttctatatcagtcacgcgaatttacataacgtacaatatctttcattgatttcattttctctaaaaaagcgtgtgattatatgaaaattctgtatatcattgtacatatctcaataaaatgaaaacttgtttttcgctgcaaattcaaaattttaaagcgttactttgtgtgtataatggaggagtaaacataacagtgtgaaatctttattcttctgaatatccagtaaaatttgagataatccaatacaacaaactcgtgtcacgctcaagtagtcaaatgtcgatttggtcacatccgcacccgtttattgaaacttatcaaatatatatcattttgaaaaagcaataagaaaacaaaggcatgcagagataaaaagctggaggaaatgaagaaaaagcccgtgaacaaatagttgaatggaataattagtatgcacagtacatatgaggctgtctttttaattaaaaagaagctcttacttcattctatttttttttttttttttttttttgtcaatccttacttcattctattataagtgattctgataccctatatttgtggaagataaaaaaaaattaaagctaatgagacgactttgagttaagttcaaacttttcattattaatcgcatgaaaagtcactatgattatgtttctttgttcatttataacacactcatcattgtatttaaataaaatttaagattgatgatgtctttaaatgacgattggtaagctagcaacctttaattcaaataaatttgcatgcatatctgacaaaccctttcatcgtcaactctatagatttagataactagatcccggtttcatcagcacacgaacattatatatcagattattccgttttactatatgatcattatttagatgttgccatgttgggttatgtattctattatttagttaaatgacgtgaccttacttctcttaaagattatataatcctcacacaaacaaactattttgaaaattttgttttgaattccaatccatccaataattcaaatgtggattaacgttaatattttgaatgttaatgcaataataatacgatgaacctaacaccacgttgacctctaacacctaacatgttgatctctagtgtgccaaaggaaaaaaaaaaaacacgacaaccaaaagctaaaacaagttatccaaaaaccagtaaacagaattcagaatttaaagttgctaattatatatcggcttagaaataatatttgtcttggtaacgaagtccgacaaatattcctgaattctgattttctgataagaaattgacaatagatagcataaggtataagaaacagtggtgacattattattacagtaataattgacttagcgacttttggaaatactatagttttgttgctctgacgcaccatgtcaacaacaactcactcacgtgacccctcctcaagttctcacttattcttaaaatctttctaagcttttctatcacattttaccaaacctcctgaaaaaatcgatttcatcctttccctttttcttgttctcatatctaatttcaaattttgaaatatggccaatgacgttagtggcgtttgattacgaattttccatcatttcacatttttatatctcgttgattgtaaacaaatttgcttgcttccatcaaagactctagtatacatacatactattgtgattatgtccttgagatttcgagccaaagtcaaaatactaatctctgaaattaacgaagcgccaagactgcttgttattttattgaaacatcagcattggttaactatgattgaaatcacatttgaaaaactccaaatctcccaacaccttgatgagtcattcgactattttaaatttagttggtctcttaaaatattcataataacatttacaatatctaacattactttttttttttgttcttaaagctgttttggagaggtaaacctctaataattttacagacagaattttggtagaatatagcaaaaaagagggtttgatggtacttttgcactgaaatactgaaatcatagttaggtataagccaaggttgacccaaaaaaaagaattaactataagcccatatcttattcatgggctttgatgttggcccatcaaattattaattctctgtgattatttgccacttttaaccattgcccaattaggcgaaaatattaatgagatcgatttctcacaatagagagggggctaattgatcaaatcaaaaactaaaggggtgaaattttaataaggatggattactataaataaatccgggatggaaaaataaaaaaaagttccgttttggtttcctcatctttttgtaccgctccgttgcgcctctctcttcttcccttcctctctctagcggcggagttacattgtcggccgccggggaaaccggcgacagtggattctctaaactcttaaactcgctacgtcgattcttaaaggattcatcgccgataacttttatacctccttcttttccgataggatcgggactcattttgtttccaacaccccggatccggtgatttagggcgctttttgatgcttatcgagtaaaggatttatcgatttaggtatttcgttattgatttgatctcggattttgacgggattaagattaaaggtccttactttgattttgtgtagtgatcgttt

SEQ ID NO: 14976 - DNA, 3000 bp, Unknown
  misc_feature (1)..( 3000): cDNA_ID_1808426_gDNA_ID_2684237_Annot_ID_137730 3000 nt of promoter + ATG
caatggcagatttgtacagaacacactttgagttcaacattggtccatcctagaaacgtaatcttcgaatcagtcaaagaaaaatagaaactttgtgaaaatttaagctaataataagttaataactacctgattgattttccatttagaatcagaacctgtgcatctcgaaaactttctactcgtaacaaaacccttaaattcatcttccaagagtctcagcttcacccccaaatcaagatcagcctgagttctctcataagcgttcctcacaatctcctctgtaaattcaggtttaaaaacctcttcaagcacccaactaaaccctaattccaaacccagaaccaacccaatcaccaaaatcactttcagaaaaacaacaatcagtagtcttctctctttcttcgtcgttttcctctgttcttcattctcgaaaacttttgatttcttggtcagtttcttcttcggggaagagatcatcaacttcaagattgggcgagaaacagaagcaggggtggtgaccaccgttggatcaaacgaagtcggagtagattcaacggtggatttgaaattggatgcagaagaaagcttagtgagagagcttttttgaacactgagaggcatgagatcaagcgtagcgttgagactatcaagacaaatctcgcagctacaattcgcatctttacgacagtctgggaagtaacaattactgtctcttctctcccaatcttccgtagatacagttgtagtagtcgtcgttgttgttgttgtgctcgatgtcattgatttctccgacggtgaaactaaaatctttcctttcatggtttctctgtttatcatctgattttcgttggccctagatttcatcaatctctaatttcattttgtatttttatcgttttgaaatttaaatgtcaagtcccaacggtcctctgatctcggcagtttttgtgttatgtaaatgactaacatacccttacttaacacgtgtctttctctttccttttaatgggccggattctagtttgggtccagttataatttcctttgtgtttcgaattaggtttaaattttactttattagaattaagcccaataacgagttttgttgccaaattttcttacttgctatatatgtcgtcaacatgcatactatataatctcataacaaagtttttttttttttttttctaaattgtaaatatcatataaatgaaaaaacaggttttacaaattttgataacctaaaccatttgaactctttggcaaaaagaaataaaaaacaaagagtcaatcgaaaactgggaaaaaacttggaagtttcatcacagtcacaacgccattaacttgcgaaaagggcgtctgtttcttcttgagatgataacgttttttatttcgcggtcgatgcacttgaaaatagaaggcggagagagtgaagtagcgttatgcaggacattgtttcgctgcttccagatgtggaagaccgtagactgaacgacgatgtttctaagaaccgatggagcggttgtttttttatgatgtgactctccatttttatgatgtgattacaaaaaatcaagtacagatactacttcttttgttatttcttggaaagctatgtgacgctgaaatcttcaaatcttttatttaaacccaattttacatgttaacatacatacacacctttgacaaaaaaaaaaaaaaaaaaaaaacaacgtacatacatacattcacaattcacaactccagtcagcacatttaatgtttatgcaaaatccacatctatagaattgttttctctaacgacattgttttaaggaaacgtcacgcgttattaatgattccttgcgacttagcttgtccataaacacatcacgagttccttctatatttgtgacaatgactattgactaatattatcaatttatatccatggatctagctactacttgataggtaataccataacaagaaataatcattggttaaaagccaacccagtgaatatcaacaaactccaactccaaatgataatagtttcatgtgaattgttttctagttaaggtaatctctcaaatcaatgtaattggcacggttttttcggaatttatattggaaaatgaagtctcaaggtataagattagtatatcctaactcgatttaattttattaaattttgggatactttgaattgacataaaactttgtttgcctaataaaacaaatcccaaatgatttttcttctcgcttcatactaagttttctttttttgaggtctcattctcatcctaactcctaagctaagtaagtagcctaactttatgaattgttgtatatcaacttgaaaaattaactaaagttttgttggaaacacctaccaacataaatgcttgaacgtggcatcttgattatagttcaacgaattagtattgctacttgctaaagttcttcagatattactttctttgtccaaggattacgaaactaaattctggtgacacgttatcccgttaactttaatcacgttatggtttaatcgtttattttcgtcacgccacagtttatctgatacaaaaatagatactacataaaatagatactacttttcacgattattatttctttcttttgctacatatatatgacaccatttttcctgtcaattataaatcctattaatttcataactacatcttgttccataattttatgttttgagtgtttttgcttaaccaaactcatttaaattatatccaaaaaaagaatcaaattcaaaaactagctttctttggtaaaagttagttaaggtagttgagtaccaaaagtcaaagtcaaagccaaattcgagaaattaccttaatatccttttccactatatatcatgcacacatatatacaacaagacatatcaccataactatttcatttacacagaacccaaaccaagacaatatttgatcaatttatcaaattctctcaacccctagtctaaacacaaaa

SEQ ID NO: 14977 - DNA, 3000 bp, Unknown
  misc_feature (1)..( 3000): cDNA_ID_2731334_gDNA_ID_2684237_Annot_ID_137733 3000 nt of promoter + ATG
agcattgcggatatatgaatttggaattaagtcaatctcaaattttagtctttgactgaaactctattttgctcttctttttaaataaatttttctggaaataaagcaagtcctgaggggaaaccatgacatcgttcgtagaggagacaaacccaacgatttggaatctcattgttgtctcattttggtgaatcgttatcattttgtagcttatgacacggtttttgtgccattaacatttcattagttgcagagatcaaaaagcaatgtaaaacagagacaaaaatcgcagagcttgagtaaatcaagttataaaacaaaacaacaaagccgacttaatcataatcttaaaaagcaaaaccaaaaataaatccattgtatcttctaatcttatttatccttgactgaaagtgtcttgagaaagtttgttcggagaaataatgcattgagaaggctctaataactatctgatttatcgtgtggttgtggctgagatgatttgcaatgtggctgatatgatccgtcttcatcatcatgaatttctccctcaacaatcaattgattaaatttctgggttctctcaaattctagtgttctttgattctgaaatttggggattttcgatcttaaatcgggtctactcaggttaaatccggtttcgtttagtcctaatgtggttaacgatgtctgggtaacaataaaccgattataaaccatgtttatgtgtgttttaggtttgaattttgattttatgtgttttgagatttcgaactttcaaattagggagaaataggagtagaacttttcatttgtgttgaccaagatcgaggttggaattcggtgtaagtctagtgttatatgaaacttccgagggacacacaggtcgttcacccttaaataaatcatctaaatttttaggaaatcaagaaactcaatatttaaataaagataaaatttgggaacaaataaaaagttaactggcgaaaaaaaaaaaaattgaaaaggaaagatgatatggcaaactatatgacatagctttctttatctctttctctttttcctctatacctctctctctttttaactttttatagtattattcttttgctttatttactttgtttgatagacccaaatcttggagagaaaatgtaatacaaaaaaatattatcatcatgtggtaagaaaaaaaaagatctacaaatagatgaatggacttaatttatatcagttcaatttcagaaagaaatagaaatggacaccgaataagttagtttacgaaaactagatgaaagaatcaaactagtttaggcaaaaatgttcttgcaacaagaaaaaaaagagtacagatagatgataaacacaactacctaactgatgaattggcaatactctctttttaagcttaattaaccatttgcttattatgttaactttgttaagtgttacaatttacatattcgagcgtataggtttgtggcaatttgtatcccagaattagtataagctttttttggtgcttaatcagtcaacatcatatacatatttcgcatgcaaaaaaaaatctctcttgcttctattacttttggttcattctgatccacttgtaaatataaattgcaccaacgattatgtctcaattaatttgtaaagtttcaatttttattatttaaattaacatgatatttcattcgattaaaaatgtatttgacatatgacacatcttattagctaaatgattatgatacaaaaaaaaaaattatcgacttttacttttattattacaagaagtgatgataagttcttactagagttgacaaaaccaacaggcatgtttctatcaatcatagattgtcgcagaattctataattatacaatattaatcacaactaaattaaatattatgtcattctacaattttttgtcagtaatattaaaactcgttttttatcaatcttatttatttttctttttttttggcaaaacgtttctacgatttatttatgaatcgagacgtacatactgatttttgcattttcttaagaatatagatcaactgtgttgaaaaaagtgtatagataaaatgttattggcgatggcaaaattcaagaaaaaaatgatatttgccaaaaaaaaaaaaaaagagaattaaagatttgaattagacagacgttgtcaacattaaatattcgtattggaaatctaatcaaatgggtctgtcaaatcgtggtattaaattagatgaataaaaagtttccaaaaacaaaacatagtactaattacaaacaaacaaaaaaacgaacttagccaaaacttaaaaataaaaaggtagagcaaagaacaggactaaaacactcactagtctctgcaactttatttttgttcaaaatacgctgcttttactttgcccgtttcattgaagctcctctctctccctttctttctttctttctctctgtagaatttgttaactttaactttctcactctaaaatctgccctcattgtctcgcctctgtctactttcaagaattgatgtctcttcaacactttctcttattttaagtctctctctctttgctacatttcctttttttctgtctctgccattaaaccttctctcaagaacaaaaaagaaagaaagccctcacattgctttgtccaaagagagtcttagaatctcaaacctatctcttagggagaaaccctgattctatattcttacttgctttcctttaagtttctgtctcgtccagagggacaaagccccccaattccagtcaatttcctttgtttttgatggattgagtttctttctgttggagaaagaaaaagaaaagagctacacatacacttgcagagaagaagcaacaatgagagaagagaaatccaagactaataaggtttctttattctcgaaatctattaactttatttttgcccatcttcatggaatttaaaagctgaactcttttttttattctatgaatttctgaaatg

SEQ ID NO: 14978 - DNA, 3000 bp, Unknown
  misc_feature (1)..( 3000): cDNA_ID_1827934_gDNA_ID_2684237_Annot_ID_137734 3000 nt of promoter + ATG
atcagcttatcattgatcaaaaaaaggttagaatatcaatatttccttcacaagttctgcaagacagaagaattgacaaataatataaagtcaaagtaagcaatcgagggaaatcaaatcatatacctgaatggggagggatacaccaactaaggtcttgacgccaagtactatatttgggtttccatcccattgcatatcaagttccaaggtaatcccatttttatcaccgtcgataacggaaacacctaacgaataccaaggagcacaagcaaaacataaattctaaagcaacaatacaatttcgtttaagattatggttcgtctttttgcaaactttaaacacacaatccgaagaagtgtaaagaaggatactgctgccattgcctgattatttcccagtcgaattgataattcactcctcagttgttattcaattgaatattttccttttgacaggaattcgatgactatcacagaatagtaggttacaatgtggagacacgtaaaagtaagaacattcttagtctaagctcaagctcaagaaaagttcacaatcaaaaggattccaccaacaattcaacatgactcaattgcacaagttctggtaccttacaacacaaagttttacacttaaaaagagaaatgaacaaaactaacctgtaaattgaggtgccactgtaccgagagtaagcttagaaaatgttaaggaggccacaatggcaggtctatattgctcaagaacaggctccacggatgcctttataagctcagaggctgcctaaaactccaaatcgaatcaaaagaggacaaaaaaaaaaactcctttaagaaacaatatctttatccataatacaaataacatatctctacttgaacgaattagacaatagaaacatacctcatcaacataaggccagatctttgtcaagtgatggttgagccaagtcaactgaagtaaataaaaagccaaagcaacaacaagaatcagtcccaagtatgaccaaattctaaaactttcgtgttcttccaatacgcagaaagagagagatgaaaacacatcaatatgtaagtaatgttgtaactcaacttctgacgctcggagaagacaacccaggaaggataaaactcaggaggcaaaagcttcctggaatcctccaccgtcatcctcgcaaaagcagccaccgtattcgccttataaaacagaaacaaaatcccgattaagaagaaaaaaaatcgaaattttcaatccgaaaaagggagagtggggtctcacaagttcagagcgaagcttggatcgagaattctccaacttgacaaagccgatgatgattgcgattccgacgaggagtccgattacaacgccgactatgaaacccatatttaatcgccggatttagaaaaattgcaatgtccgtattactctgatcaacaaacacaccagattcagttccacgagctaaaccgaatgaaaaataaaagagaagtaatttatttcttttctaagaaatctctataggaaaacaaaaataaataaaaaggtttttgattttaaattgggattagtctcattttaattacagattatatatttccgaagagttcgctaccgacgcagacgcaaaggttgtgctatcgctcgcaccaataatacaatgacacgtcatataacttggaatttacagaatcggtgagattttgactttgacattgttaaagacaaaaacaaatagaaaagaaagacagtgatggaactaaatccccggaaagattttgaacatcgtcaccggaacataatcgcaatgacaaagattgagctttgcaaatcctcacttaagaaacgagtccagagttctgatcatatgcaattaggatcttgggggactaacagttgatacttcattatacccttaaatcatgagatgactacataccataataagtcttgtactcgtgtagctgactggtttcggctatggtaatggctcattgatgttatgtgacggtacggtcttaagaagttagttttgttatacagttttcgatatttgcttctctaataatcctctgaggaatttgtaacttgtcacaaaaacataaacttaggagattaataatggtcccctctgtaagttattatcttctgactaacacagtttagcctttttcctaatttgtcaaagcctcataggacgtgatgtgttcattactgcgattagataaaaggtgggcacttaaagtgaagttggtacataaattttctttcatcatatttagaacttgttggtgatgtaaattaatgaccaagttccaatatcaaaaagactttgcgtgaagaactcatacctctctctattaatgacaagtattcttctctgttttctctccttggaatgatgttgtttgctactttatattctaaaaacctttgtttgtatatgtttgtaagtaatcatttttggttgccttttctttcaaacacaatattctttagtttaaaaataatataaaggtctaatagtggaattaaatgccagcaagaggaaggtagttgatttcaataatactccaatctccaatcccattcaaagaaagggtttgagattcttttataaaatagtaaatgattcgatttttttcatttaaattgttataacaaatctagattggtaaactaaaaagattacatttcaaaacaaaagcaaaaggaaaacacagaaaaaaaaattagaagcagtaagacataatttattacacattgtttgtcttgtaatgaaatatcttctcttcctgcagttttgagtgacgtgttgactctgtaatttcagagtggtcaaaaaggtaatttagaacagaaaaaaacaatgcttgaaatggaaactgattaatgagctgtttttttaacgaaatgtaagaaattttttgaccaaaaccaaaaagcagagtgtgtggaaaaatagtaccgttttggcggtatgagagacctcctgaaatagcatg

SEQ ID NO: 14979 - DNA, 3000 bp, Unknown
  misc_feature (1)..( 3000): cDNA_ID_1827922_gDNA_ID_2684237_Annot_ID_137737 3000 nt of promoter + ATG
taacttttatttgtccatttaatacatatattattaaattttcccaaatttaaaagctttcgtttatttaaattttggtacttaatggaggttctaactataattaaaatttaactcatggtatttataaatatatatactatctattctctaaactttacaaatatattaggttagtatggtggttaaacgtggattgactaactatcttagtaaatttggattaattaggacaaagagggattgactatcttaataaatttggattaattaggaaagaagggggattcgaacttagatttatgaagagaatcaatccacatttaaccattagattacactaatatatttgtaaactttagaaaatagattatacatttcgtgaatatcatgagttaaatttcaaccacagttagaacatccgttaaaatataataatcatgaatttgaatgtttgaattaaaaaagcatttaaaaacataaaattaatttagatattattcaaacaactatagatattaaacagatatttttcgagttttttctctataaaaatatgatattttttttctttttgacagcatgatactttttctttcgttctattttttttataaataaattatatagtatattcagcatgatacttattatgatctccatcatggcgtacgtcgtggatcacgccaaaagcggtaaaacatgttatctcatgtcacatgaccccaaatgaaatcccattactctcatctaatatattttccatttatatacatataacagcacaaatccacgaggagacacacctcgtacgtattaagaaagtcacttcaaaaaatggcgcaaccgcattttctactggtaacgtttccggcgcaaggtcacgtgaacccatctctccgttttgctcgtcggctcatcaaaacaactggcgcacgtgtaactttcgccacgtgtctctctgtcattcaccgctctatgatcccaaaccacaacaacgtcgaaaatctctctttccttactttctccgacggattcgacgacggagtcatctccaacaccgacgacgtccaaaaccggttggtacacttcgaacgtaatggcgataaagctctatcggatttcatcgaagctaatcagaatggtgactctcccgtaagttgcttgatctacacgattcttcccaactgggttccaaaagtggcgcgtagatttcatcttccctctgttcatctctggatccaaccagccttcgctttcgacatttattacaattactctacaggaaacaactccgttttcgagttcccgaatctaccttctctcgaaatccgcgatctgccttctttcctctcaccttccaacacgaacaaagccgcacaagcagtatatcaagaactgatggattttctcaaagaagaatctaacccgaaaattctcgtcaacacattcgattcgctggagccagagttcttaacagctattccgaatatagaaatggtggcagttggtcctttacttcctgcggagattttcactggaagcgaatcaggtaaagatttatcaagagatcatcaaagtagtagttatacactttggttagactcgaaaacagagtcctctgttatttatgtttcttttggaacaatggttgagttgtcgaagaaacagatagaggaactagcgagagcactcatagaagggggaagaccgttcttgtgggttataactgataaactcaacagagaagcgaaaatagaaggagaagaagagacagagattgagaagatagctggttttagacacgagcttgaagaggttgggatgattgtctcgtggtgttcgcagatagaggttttgagacaccgagccataggttgttttttgactcattgtgggtggagctcatcactggagagtttggttctcggcgttccagtggtggcgtttccgatgtggtcggatcagccagcaaatgcgaagcttttggaagaaatatggaagacaggtgtgagggtgagagagaactcggaaggtttagtagagagaggagagataatgcggtgtttggaagcagtgatggaggcgaaatcggtggagctgagggaaaacgcagagaaatggaagcgtttagcgactgaagcgggtagagaaggaggatcttcggacaagaatgtggaagcttttgtgaagagtctgttttgaggttttataaaacagaggagggtaaaacaaatgtaacaatcagcatgcaatgttgggtatatttcgtaactacaatttaataatatgtttttatagatgtatatcgtcacaacgtgtcttgcacagattcatgttgtaggtgactcatgggaacctgactcatgtatagttgagtttacaaattatatgcaccttcattgattcaataaaacttgtattactaacgttattgtgatccccgtttaaatttgttgcatttaatttgttagtctaatatttaatttagatgtgggttacataaagttgctttgataattgggatatgtttttttctgtctaatacacagataaaggcaaatatacgatcaatcacagttttaattatttttgttttttcaatgaaacaactctgacaaagaagatttggattggccaagtgatctcacatattctaaaatgtgagaaaaacaaaacagtattttgaattttttttatttaatagaagatttggtcaattgttaacataagttgatgatgaattagttgccaaaaaacccaaaatccattataacttttgcaattaattactctgttactttttaaccctaaaaaagcatgtatgtatgttattagagacagacgactctctctactcataaaatctctctcacatagatagatccctttccacagtttcgtctctgcttttgattcttctgaggtcccctgaatttacagaatcacaaagaccaaatttttcattccaatttcggatctttacccttaaaaaccatg

SEQ ID NO: 14980 - DNA, 3000 bp, Unknown; identical to SEQ ID NO: 5640
  misc_feature (1)..( 3000): cDNA_ID_1827914_gDNA_ID_2684237_Annot_ID_137739 3000 nt of promoter + ATG

SEQ ID NO: 14981 - DNA, 188 bp, Unknown
  misc_feature (1)..( 188): cDNA_ID_2731322_gDNA_ID_2684237_Annot_ID_137742 3000 nt of promoter + ATG
cttggaaagaaaaagcaagtctcttcctcttaaagttattcttctctcattattgtttccaccacagtggtgcatttgatctctttggcatgagggatgtctaagtggtttgtctgctttcctctgtttttgttcttttgcagattaagaggcttcatcttttgcttactgtcaaggagtcagctatg

SEQ ID NO: 14982 - DNA, 2932 bp, Unknown
  misc_feature (1)..( 2932): cDNA_ID_1829007_gDNA_ID_2684237_Annot_ID_192471 3000 nt of promoter + ATG
cttggaaagaaaaagcaagtctcttcctcttaaagttattcttctctcattattgtttccaccacagtggtgcatttgatctctttggcatgagggatgtctaagtggtttgtctgctttcctctgtttttgttcttttgcagattaagaggcttcatcttttgcttactgtcaaggagtcagctatggatgttccatccaacttggaagctcgaaggcgtcttactttcttttcaaattcactattcatggacatgcctcctgcacccaagatccgcaacatgctttccttctcgtaggttccagtcacgatggacatcttctcgtaggcttactatatcttaacatcttccattttgttttttcatagggtccttacaccatacttttcagaggatgttcttttctccatatttggcttagaacagcaaaatgaagatggagtttctatactcttttacttgcagaagatcttcccaggtttcacttttccatctgttttaattttttcatatggtactgttactttgtttgagctatcagctgagtccatggcttacatcagatgaatggacaaactttctggaacgagttaaatgtggcaacgaagaagaactaagagcaagagaggatttggaagaggagcttcgtctttgggcatcttacagaggccaaactctgactaaaactggtagactttagtctcctctcttaatcggttgaattctgcttcatttttctaacctgacgaatttatcttttgataaacttgttgtgcctgatttctgatctgtttcaactagtgcgaggaatgatgtattaccgaaaggctttggaacttcaggccttccttgatatggcaaaggatgaaggtgcttgaagaatcttctctgtgattcttttcgattcttaaaaagtatgaaagcattccttaaactaccttgtttttgttctagaattattaaaaggctacaaggctctcgagttaaccagtgaagaagcatcaaagagcggagggtcactttgggcgcagtgtcaagcacttgcagatatgaagttcacctttgtggtttcttgtcaacaatacagtattcataagagatctggcgaccaacgtgctaaagacatattgagacttatgacgacgtaatatcttcattctttcatcctttatctttccagttggtttgttatttagttcttagcctcattagttaagcttgctatttcctcatggcaggtatccgtctattcgtgtcgcctatatcgatgaggtagagcaaacacataaagaaagttataaggggacagaggagaaaatttattactcagcgcttgtaaaagctgctccacagaccaaaccaatggattcttctgaatctgttcaaacactagatcaggtataagttgagaaaactaagtaaaatacttaacattttggtgctcctttttttcccaaaatacgaggatgagtttaatcctatgcagtgaggtcagaggatatagatgctgctgttcaagagagactgagttatatttattttctgtcagctcatttatcggattaagcttccgggaccagctatactaggagagggaaagccggaaaatcagaaccatgctatcatatttacccgtggagaagggttgcagacgatagacatgaatcaggtgcgatgcgtagttttcttttgtctaacatgtgtcgctaatgaatcacatataatatgcttaaaattgttcaaagaataatcaccgcaggagactcttaacctctaaatatttgaccttaggacaactacatggaggaagctttcaaaatgaggaacttgctgcaagagtttcttgaaaagcatggaggcgtaagatgtcctacgattcttggtcttagagagcatattttcactggaaggtactaacagaatgatcctatttctgtcttctagatttttagtttctgtgtgcatactgatctcctatgtttgtggtttcttgtgaagtgtgtcttctcttgcatggtttatgtcaaatcaagagaacagttttgtaacgattgggcaaagagtgctagctagtcccttgaagtaagtttcttccctgttctgaaatcttgtcagggtattgtagttgtcaaaattgatgtgctctttctgttgctgctccagagtacgattccattacggacatccagatatttttgatcgtctgtttcaccttaccagaggtggtatctgcaaagcttctaaagtcatcaatcttagtgaagacatatttgcaggcactagcttgatctcatattctttggtggtacacatatgatctacttcattttttacattttttctcatacctttttactggtttcaggttttaattctactctgcgtgaaggaaatgtgactcatcatgaatatatacaagttggtaaagggagagatgtgggcctcaaccagatctcaatgtttgaggcaaaaatcgccaatggaaatggcgagcaaactttgagtcgcgacctttataggctaggacaccgatttgatttcttccggatgctgtcttgttatttcaccacaattgggttctacttcagtaccatggtaggttgagattctccctttttatctctcaatcactagatatatacatggcaggtttgtttttctttctcaagactgaagccattatctgtgtgttttgacagttaaccgtgcttacggtgtatgtgtttctttatggacggttatatctagtacttagtgggcttgaagaaggattgagtagccaacgagctttccgtaacaataagcctcttgaggcagctcttgcttctcaatcatttgtgcagattggttttttaatggctttgcctatgatgatggagattggacttgagagggggttccacaatgcattgattgagtttgtgctgatg

SEQ ID NO: 14983 - DNA, 3000 bp, Unknown; identical to SEQ ID NO: 5639
  misc_feature (1)..( 3000): cDNA_ID_3077964_gDNA_ID_2684237_Annot_ID_192468 3000 nt of promoter + ATG

SEQ ID NO: 14984 - DNA, 3000 bp, Unknown; identical to SEQ ID NO: 5640
  misc_feature (1)..( 3000): cDNA_ID_1827914_gDNA_ID_2684237_Annot_ID_192467 3000 nt of promoter + ATG

SEQ ID NO: 14985 - DNA, 3000 bp, Unknown; identical to SEQ ID NO: 5641
  misc_feature (1)..( 3000): cDNA_ID_1827922_gDNA_ID_2684237_Annot_ID_192465 3000 nt of promoter + ATG

SEQ ID NO: 14986 - DNA, 3000 bp, Unknown; identical to SEQ ID NO: 5642
  misc_feature (1)..( 3000): cDNA_ID_2159919_gDNA_ID_2684237_Annot_ID_192463 3000 nt of promoter + ATG

SEQ ID NO: 14987 - DNA, 3000 bp, Unknown; identical to SEQ ID NO: 5643
  misc_feature (1)..( 3000): cDNA_ID_1827934_gDNA_ID_2684237_Annot_ID_192461 3000 nt of promoter + ATG

SEQ ID NO: 14988 - DNA, 3000 bp, Unknown; identical to SEQ ID NO: 14975
  misc_feature (1)..( 3000): cDNA_ID_2731364_gDNA_ID_2684237_Annot_ID_192449 3000 nt of promoter + ATG

SEQ ID NO: 14989 - DNA, 3000 bp, Unknown
  misc_feature (1)..( 3000): cDNA_ID_3019895_gDNA_ID_2684238_Annot_ID_192493 3000 nt of promoter + ATG
taccccttagcgagggtcactacattgcccgtatcatggttttagtgaggtacaaattctaggtaccttctttagaggagttgatcaaagataccagatggctcttgattcagagaggaatgttaacttcaataccaggtatccggcagatgctacatctttgagcctgagcctgagtcagaagaaggtgtcttctacattgatggtcaaggttacaagaactttggacagccagaaggcaactttagtggcaacaggtttactgggaacaagagttcttcaggtttcagccccaaacctaccttccagaagacctatcctcagagcaacttcacaaggtcttatggtaattcttcttaccaaacccctcctccaccgtctgcccatagtaagatggaatccatgcttgagtagattcttgagggtcaggccaagttagttgtggacttcaatagaaagtttgacgctatctacacagatcttcatgggaagatcgacaatttgagctctcacatgaagaagctagatgttcaattggcttaaactgattagtctatcaagagacaagagggttttctttctggcacccctaatactaatccaacgaagagctgcaatgttatcttagtcagagatggagacaatgtataggaggaattggatacagaggacgagttggagctcacagctctagagctggtgtcgatcgacaccatatggtaaactcttttccaaaactacttctgaatagagtgtcgatggacacactcctaacgtcgatcgacaatgggtacgcattgcaccttacgagggtcatatccctatgcaacccaaccttgtttacactcttacggttccatatccgagaaaccgtcgttctaagcaggaagtacacgatacgaagtgcaaggcaataaaggagaagaacttgaccaccattcctaaggatacctcagagaactcatttgctcaacttattagatatgtcaagcatttggtcaacattggaatcaactccaaggaagccaacctgcttaaagagatatcagttccatactgttgaagaaggtcaagaaagactagtcgaagagattagtgctttctgaacatgttagctccattgccaaagggtaaatgataacactgtattttactcattttaggtgtatgtttatcatcatttacttttgcatttgctcattgtatcatatcattttgcaccattttagcttgttttgcatacttaggcatctaggatcatcttgcatatgcattgcatgttttggtatgttttcaggtgcagaaggagataaaaaggactctactcgatccatccactcgatccaggcagctacagaagaggcatcattctactcgacctctttactcaatccaggatgctacaaaggaggctgcagttaactcgaccctcttactcgatcaaggcaacctcagatgaagaagcagattgatctactcgcccctcctactcgatccatttactcgaccaagggtgaccatctctacaagacttgttgagctatcaaagcgtcttcggatcctcctcattccccactcaaccagacatctgagcatacatataggagaggagaagcatctactcgaccaattgatcactcggagcatagacacaaaggcgcagactttgcagcaccctctttactttatccccaagatcgagtattcgcccaaaccgcctcaagtctcttgtcttctagtgaatctagggtttcaacattttactataaatagatcactttgggggttgtccaaaggatctatgctttatctttcagtttttctttgtgtttatgaatcttaaaaccttaattactcttaatctgtttcgtttttgcatttagttgttttagtaaagttgtttagcttgtttagatctatattttggtataattttagtaatatctgggtttgtgttcttgagaatgttgtttaagtagtgattagggttcttgaggatgaattagattagggtaatctctaggttagttaggtggttactgtttaactttatacccttctggattcgcttggcccctatgtggtttttgctggctaatgtggagattcgatcatagacgtccattgtccaaaagatgttcaaatggatgtctgacctacgaattccagagatttgtagactcgaccaagagattggcttgtctgcctattggctttggtagattgtttcgtaaaccctgctcttctatgtttcatcaacgagagttgagattaggaagtggtagagttatgggggtctctatcacgagagtggattgacccggtttttgaatctatcgtcatgggtatctacctttcgcctattagccatctgatgaaccctagagttgcccttatcaatgaatccatccttagaacttctattagatttatttgtatcccttgttaattgcacttttatttacctgttatttgtatcccctgttgattgcatttaggttacttaattttgttgcatgtttgttctactcgacccaatgatcgagtagggctctttaagttctcatttttacttgtttgaatcctgacctaggattgttactagaaacccaccatctttataatctggcttgacttagttatttctgtacagatcttgattgctagcaataacagtagactggatagacaccccttatagctgcatcgacatgtttgtgttttaggggaattgaactgaatcacacattcaccctaagcaggcatgaaaaacctgctttcaatttggcgccgttgccaattcattgttgcattgttacattcaagatatcagaaacttttaagatcaaattcttttacatttataaagttactaactcatattttcgtttgcttgtttttgtggtataggtactaatctttgtgcatgcaaactcgatcgaaaggttctacacacctactaccattcagagattgaattgacagaatagctcgtgagtt

SEQ ID NO: 14990 - DNA, 3000 bp, Unknown
  misc_feature (1)..( 3000): cDNA_ID_3019861_gDNA_ID_2684238_Annot_ID_192502 3000 nt of promoter + ATG
aaactggacatgaaaaacagaaacaaacagtctcaaagacaaaaccctaaactacaaaccagtcgttaactattaaatccctctggtgaaacgctagctttagacgttacaaagcttctcacgaaaactcgtgccgatcggaaaccagatgatattacgatgttagttacaatccttgctggtcctaattcgcgtctgagaaaacgtgtctcacgaaactgcgaataactcaaccaattataatccaaatccacttctgtaaactggagaatatcgataaaatacttgggaataactctactaaatttcgttacctttgaaaacgatttgatatgtcgcaaccgtttcctcccaaaccctaatgattctggttcttctctttctctctatttttctcttttataaaacgaaaagtggctaactaaagccctaattttgagtttctttcttttataggcacactctaggatttccaattaacccaaccgattaaaccggacgatttaagtataaaccctaaccgatttttctatttacgggtgttacacttatgactatacaatgccaattttttttagtatgagcattggaaagcttgccatggatggaagatgagcttttgcaagtgtgtttagcaaatgtgttataccattacaattcgtctttgatttgcatggactgcttttggatttgattaaaatttcgcaagcttaacaatcgtttccttacttgaattgtagtttatatgtgaaatttacacattgatcagttttatgatacaaatttcatttttctctttgttcttcacttctttgatttcttgagttttgttgttacttgcagcgtgaaaggagtaatcctcatgacctaaatagaaagaagttcaatatcatagaaggcatctagatatataaaatacgtttagctcgataatcattactttcatagattcattatgtatggtttaaaagtcgagcctataagctccttaggctgtcatgagatttaaaactaccaatccggattagccattgcatcaactgacattttaaaagttataaattacttaattaagatacttttaaaaagcaaaaataccaatagatatgaaaaaatgtaaatttttaaagaaaaacatatgtaaaaaaaaaaaaaacgtaagacgtctaaaaataatctcttaattttttgtaaaaaattaaaaaaaaaaaaagacaataaaagaaatatttgaaatatggatacatttctaactatgatgttgtgttattaaaaatgtaatataaaagtaatcaaatgtaaagttttaatattgtaaagattattaaatttataaaccaaaaatctaaaaatatgaaataattctgaatataattttgttatgaaattcataaaaatgaaaataacaaaatgtaaatttatttgtaaattttattactttagaaaataggatatttattataaaaacatcattattagtcttacaaaaatttcttattccaactttaattataaaagtcgaagtgatgagcttttaaggccgtctacatgggatttaaaacgaccaattaaagttagcaatcacattgaatattttagtcatctcattaattaatattttaatttttattattattttatgtacaaagatatttgtaaaaaggaaaaaaacaatatatgaaaaatagaaatgtaaatttttggaaaataatatatgaaatatattaaacttatattattatttttatttgttaatcttcttatcttctaaaaaagaagaaatattcataggaaaatatatttgattaacactagacctaaacgagctagtcacatggattgaaggtggagctgatgatgatgacaatcttgagcctactctgcattacgtggtatttaacggtgttggtgttgaagagtcacaagatgtgaaaactgtaactcctgcgccatgtcaaaggatcaatatcgaggtggtggagaagattccatcaagtgcattggttagggaatgcatgaagtgtttgaactccatggaagaggttgagaaaggtagtgatctttacatgtttgcgatggatttatttatgaacaaagagtgcagatagatgttcttgttgttggagacctcaaatttgagaatgacttggatgcttagacgtcaatcttgtggctctaccattgctgcctaagatcctcttattctcctacacttctgcttatgtcttataattatgcttaaaactctttattttcttttgaagaaaacagtttatgtgtttactagataaggacccgtccgatggatcgatttatattcttataactaaaatcaaatttaccaaaaataatacttaacaaaattgtaagtgtaaattatcttttaaaagtaaatttattttttggttattttcactgttatattgttttcttactactaaaattattgattaaaaactttcaatatcatatagtaataactcaaaattatttgaatgaaaaatatattacatatcaataactcttggtatacttatatgaaaactaaattaaaaatcgttatcataaagttggcgaataaaaccaaaatggttttcaaattagacatattaaaaatataaagatgatcaatcaatgtcgactagatgtctcaggacaaaactcccagacacctatttatacaaaacgaaattaaatgataatagacgggccagtaacctaatcgcccgacccatagagtgataatgggccgagatgggcttcgtgatccgatggagctccaggccgtttccaaacacttcttcttctcctcttctcttcattgttctcagcttgtctggttgagtgcggatttgagtcgactctgaatatgtggtcgagtgcttgatcgagtgatggcgatgattggtgaaggatatactcgaccagggggtcgagtgatgtcatcgagtggcctgagctgctgttactcgaccagggggtcgagtagatggaagaatg

SEQ ID NO: 14991 - DNA, 3000 bp, Unknown; identical to SEQ ID NO: 8932
  misc_feature (1)..( 3000): cDNA_ID_1989272_gDNA_ID_2684240_Annot_ID_137744 3000 nt of promoter + ATG

SEQ ID NO: 14992 - DNA, 3000 bp, Unknown
  misc_feature (1)..( 3000): cDNA_ID_3044064_gDNA_ID_2684240_Annot_ID_137747 3000 nt of promoter + ATG
agaccagcctccggttaagtttgattacacgaacccgaacgtaacccaaacaaacccgggacttttgttcactcaaaaatcaactagcgccaagattttgaaattcaatacgacggtggaggtagtgttacagaaccatgcgcttatagcggcggagagtcatcccatgcatctacatggatttaatttccatgtattggctcaagggtttggtaattatgacccgagccgtgaccggagcaagttaaatctcgttgacccgcaatcccgtaacactttggctgtccctgttggtggatgggctgtgatccgtttcactgctaataatccaggtataaactctctatccaattccttagttatactaaaaatgtaattatatagtttagagttttacaaaggctattattgttgtttatgcatgaaacctaaatattggctacattgtttcaggtgcgtggatttttcattgtcatatcgatgttcacttaccattcggactagggatgatatttgtggttaagaacggaccgaccaagtcgaccaccttgccaccgccaccaccagatcttcccaaatgttaagcaagataaaaaaaacatatttcatcgaaaacaataaaaagaagattatttagagcaaagaagacaaaaatttgtctctctgtctcacatttgttttgatgtagtcggtaaagaaattgtattgtagtccattcatatgttgttaccaattgtgtgtgctgtgagtaatttatatgatttattattatttttgtcacttttacaagttttaatttgatatttttgaaaagaacgtcacttgaaccaaaataaaagttctactaattaaaaacatttttatagaacaagaaaaaaacagtttttgataatttgcataagctaaaaacatttgtaatctagacattacccgaaaaatatttattcaaaattttaaaatacaaagttagtgccccatatctttgtaaagtactccaattttgtgatttgcagtttaattactacttcaatccggtaattttaatctgatttagtttcataccggcatttgggataaaccgggttcccggttaaacaaattccaaaacattatccaaaacaaacagagaattttatcaacggaattttcccaaaagaaaaacagagaatgatgaagctgcaagggggacttctccagtggagtcgtagcagcttaatcccgtcgatttatacgccaatcaacaaaacccaattctctatcgccgcctgtgtcatcgagcggaaccaccagcttacggcgaaggagagacggcagctccggaacgagcggcgggagagtaaattggggtatagctggcgagaagaagttgaagaaaagttgattaagaaaccaaaaaaacggtatgcaacgtggacggaggagctgaatttggatactttggctgagtcgggtccgcaatggtgggcggttagggtttcgagacttcgtggtcatgagactgctcaaatcttagctcgagctctggctcgtcaattccctgaaatggaattcacggtaattggaattttactggatatttgggttgtgttgggtgattttaaagtttggattttgacaatgagattggatcaaactggtatcttgatagaattgctgacaaactctaaacagttgttgatggaaagtgaaaagatttgattttgggttattgtgtgatctttagaatttgtggggaattcatacattggtattgaaacaagtggcttttgaatttggttgtccaggtttatgcaccatctgttcaagtgaagagaaagctaaagaacggttctatatctgttaaaccgaaaccagtgttccctggttgcattttcatcagatgtatattgaacaaagagatacatgactccataagagacgttgatggagtcggaggtttcataggttcaaaagttggaaatacgtgagtagtattctcactctcactctcaccctatgtgtgttaaggtctgtgaattaatttgtatctgcattttttttttgtagcaagagacagattaataaaccaagaccagtagatgacagtgacttggaagctattttcaaacaagcaaaagaagcgcaagagaaagcagatagtgagttcgaagaggcagatagagctgaagaagaagcgagtatactagcgtcacaggaacttctcgcattatctaattcagatgttattgagactgtagcagaatctaaaccgaaacgagccccgagaaaagctacacttgctactgaaacaaaggcgaagaagaagaaacttgcagcgggttctacagttagagttttatcagggacatttgctgaatttgttgggaacctaaagaaactaaaccgcaaaactgcaaaggtacactaactaactacttctagctcctttgtgttattgataacaaagctggtcaatttgcacaaatgtgtttgtttagatgtctctctgattctttcgtatggttggttgcaggcaacggtgggatttactttgtttgggaaggagacactagtggaaattgacatcaatgaacttgttcctgagattcaatcttaaatagtttgttcactagaatgtgaattttttggtttgaaatataaatccatgatcacttcacatgttttggaagttttggtgtgtttgttctgttaaattcgccaaacgattgcaacgacgacgttctatcttcatttgaaagatgagagcctttactggttaaatgggcctaatttgtgaaaaggcccaacaaacaagagccgtcagatcagaatgaagcaaacaggcacgaaccgttagattaagattcacaaagaaaaccctagaggttcccttatcctcaggccaaatcgtgaactataaaacggctgataccaaaaccctaatttctttacgtcaaactctctctatacacagagttaaattgagtttgtgtctcgtaacttatcctgtgagcgaaaatg

SEQ ID NO: 14993 - DNA, 3000 bp, Unknown
  misc_feature (1)..( 3000): cDNA_ID_2731431_gDNA_ID_2684240_Annot_ID_137749 3000 nt of promoter + ATG
gatctctgcctccataagcttcccttctctctctctctctcacctaccggatttaactgtaaaagcgttgagtctcgttgaggtcgcgtgaacacactcgctctttcgactagattcgtagggcttgtgtttcgggggatcttttattccttttaattactattttgcccttataattgccatttactttgttacccttaatcgttatcctctgtcttaacttttggtcaaccttttttgggggatatttaggtaaatcacttaaaacggaagatcttcggaagttgatgactttcttctatggcgggaaattcattaccggtggactaagtacttttattgggcctatttaagcccattattcaccatatcaggcctcttcatgacccattcaatggataatgaaaactgaaagtgaaaagtaaacttatttctctacccaagaaagctaacctagaaatccatttttttttattttttttgtcgtaacctagaaatccattttagacttctgatttatcactcaccgttaattttcttcactagtaaataacaaaataatattgtttcacgttaatgagataatattgtctcatctttcattattttgtttttttatcaaaccacattttaagatggttacaattttttttaattttttttgggttttaaatactaggttaaatccggtgctaatttaatataaaatttaaagtaggatttgatttatattagattctaagaaattttgaagtattttcaatctataaatacaaatgataaaatagtaaatgcggaagtaagctttgttattttgaccaaatttcaaaatactaatgcttttttgggtaaattaaaatctaattaatgtttaaacgtttgaattatagaaagaattctacatcctaaatgggtttctaagtcaactcacaaaccatgtttaaaaattcagtttgcccaactaaaattgaaatttcatgagaaagtatgcaagatcctggagttgattgagtttaagtagtctttaaaatttgaaaagtcaatgagaatccatattcgcgtatgaaatgagatggcgaaaggccgaaagctaataaagaaagctcatgatcagaccaatgcttgcacatacagtaaacagtcagattattgttaatagagaacgacctttgcctgaccacaaatctttagatttgaataaaacgatttttcaaattatggcaagaacgttcgttttacaatgtacataaaatacattattaacctaaaatttaattgaccagatatgtagaacctatctttacaataatcaagtatgtacatataaagttacatgtccactgacgtcgtagaagaatgattaactggatcaactaggccggtcaagagaaaacagttgtcgcatccaatattacaaatattcatgcagagatatattatgtgaaacgtatatagaaaatatatctagttatctacacaaaaaatacatgcaacacgtttctcgaagatattgtaaagttgacttggatgctttcaagtttcaacttgaacatatggaccgtttctatgcacgtacgtatcaaaattcttcattatatatatataaaaatgtattaaagtaaacaaattaatatgatagtggggaactttttataagaaataattgatcaatagttgaaagaataatttcacaatacaacaactgtcatatattctgagacaaaatccattggcctgtgtctggagtgcgtcgcatgtattgcttttgcatttaaatcaagtctaaagcaaatttttggattcgttgattccttaattttatcgaattcgatcaacttttaagtacgtatactacgatctcttatgattcttggatatcttttcacttttaaattctgagaacagtagcaatgaaaaataatttgaccattggtttctttagtttctaccttttcaatgtttaaattaagatttggattactttgatattgaattcatcgatctttgggaaggattttgcaaattcagaaatgttcagttttattataaatctgtcactaaaattgtggttgttacttagatatcaaattagataagtagttgtctatattggacttgtaatacgaattatattgaattgaggttgtttgtgttgagaagcaaaaaatttgatgacttttgttattatttacgaaaaaagtataaactaaaataataaagggagtaatcaactgttagaaatttagacaacgatgtctctactaacagattgaaaatacttattatgggcatagcttcgctagcaagaaatgtttcaatatctacaaaaatacacgtagacaaatatttagacacaattgattatgttagagaacagtggtcgtctggtcgatgtacatatagcaatccattaactccgattctaatatttcttgactaattatttcgaaattgtgcaacaaaaaaatcataaacaagttttaagaagcttacattaaaatgaataattaactatacatttcttgtttaaattacacactagctattaataattgtaagggattttttctgtatagaaaaggtatcgtttttttaagtttaatcttcgatagccattttaaacaatatatcatataataataaacaataagagagcaacgaactataatactaaagttgaaaaactatcaaaatgatgtggcagtaacattggatagaacttacgtttacgtagctagttaaagttctaaagaaaaccaaacaaccaaaatataattataatagcacatattgaatattcatttatatttacttgtatagtcaaaccattatcttagacaaccctaattaacatcaaatgtttagtccttcgttagttatcacttaccactctgcattctataaattattaagtagaaccacaagtctcgttgcttcaatatctccataacacgtttctctctttctctgctagctctctcatccttctctctatagatg

SEQ ID NO: 14994 - DNA, 3000 bp, Unknown
  misc_feature (1)..( 3000): cDNA_ID_1019230_gDNA_ID_2684240_Annot_ID_137752 3000 nt of promoter + ATG
ccgtccacatttggaatgagaactgcagcaatatttttttcctcatgatgagatattgagatgtgtcaaaagagatatgtttctcaaaaatataatgtacctcatttgtgaccaccacatcatcctctccatacccgagtttctcgagtagttcgtgcataccacttagatccactctccagcatgcttctccgaaaggggtcaagggcaatggctcctttgttgcaggttcagtgtatgatggagtctgtcattattaagtcccatgtacacataagaaagcctgcagaacccgaaaccttggaagatttaatgtagtaatgacttacagggatgttttcttctttgacgttgggccataactcagctcttttctcaagtcttgaaagagctgacataagaaactttatgcttggcctctcgtctggttcagggcgcaaacagcgggaagctagatggataagttctgttctatcctcatcagagaattgaccatccagagctgaatccattagcaccaaatagtttttaccacggaacagatcaagtgcctgaaatgacagataagctaaaaatcaatgaaactgctaaagatacattatgtatatacacattttgctttgtgagaagaaagttacatggtttggtggaatatgtctgccgctcataagatccagtaacaaggttccgaagctaaatgtgacactctccggtatcacagtacctaacaataaaagtaaaagaaaaacatctttgagatttcagctgatgaagttttctctcaagaaaattaaacataaaacacatacctagacgtaaatattcaggaggagcaaatgccaagttggtactatagctctttccctctcggctacacttcatgagaccaaaacaagacagcctaggattcccaacctgttccatcacttttataaataacttatgataacatcaaaccgcgtatgaagtttcttaccttgtcaaacaatattctgtaggtgttaagatcgtgatacaaatctattccccaatcattacagtactccaaggctgttgcagtatgtaacgcaactctcaacctcatttcccacttcattggtcttttctcccctgaaaaaccattttagagtaaaaacaacttagacacaataatgaaactctaaagtaaagtttaaggccaaaagagatcaagaacttgaaatgtttgagtctcacagtgaaagagatgcttagcaagtgtttcattaggcatgtactcagcaacaagcaacctctcgtgaccttctgagcaacaaccgatcaaattggccatatgctcactcctacatctccctacagcttgtgcttcctcctgaataacaaatatgccatattcaagaaattttcctctgcaacagatcaagcatagaaccgaattgaatctttactaagtcaaacagacttgaaatttgcctcctctgcaacaaatcagaatccagaacattgcaacattcaagagaagtatcacggagttagtaaccaataaagtcaaatcagatgaataagcgatcactagtcaaatcttatacaaaaccaaacagagaagaatcaataagtattgatgggtaaaggacacgaacgatgaattctaaagaatcaggccatgaaagccgttgaaaccgcttgacggcgatctttcttccgtcgttgagctggcctttgtagacgatgttaggaaccctctcgttgtgctccgacacgatgttgtcggcggagaatccgtcagttgcgactctcaactgttccaagctgaactccaggaaattaggacaagtacttccttcatcttcttctttattatctgcagccaaaactattaggttagttctctcgatcatcgtcttcttcagaatctaattaacgcataggaggagtggctggcgaattcgttggattttacctagatcgtcgatgacggtgatggtggatgttatcgacggagaagacgatcgacgccaacgtttgaaacaaatgcagcccatcgccggcgacagtagtttctccggtggagaaaaacttttcaagtgcttggttaaaaactcccgcctgcagggagaaaataaattattatttttttcttttttgcctagcgaatattgttggaaagttttacggagaaagtggtaaaatagacccaaaaatatcatttatttatatatcacataattaaatagttgatgaccaatatatactttttttttttttgaaaagatcaacctttatactattataaggataaaatgtcgacatgatctatgtattaatttaaagaaaatattgtttgcttgttccatttaaattactcggtattagattaattttgagcataaacattacaggtttttattttggtaaataatcattagactgttgagtttggtctttactttagcctcaattttaaagtctatattcaatggattttgcttacatacatttcattcacgtttaaaccgaaattaaaatatctcatttaagttgtaaccaaaaaaaaaaaaaacagaaaaattctcattaaaattaatttttgctagttaccgcagcttttcgagactgggtgtgtaatatccatcacactaacctttttttttttaatccatccatacgtttaactacatttaagcaaatatcgctatcaaatcgttttggtatatttcgctcattactggcaaaattcactctacaaaaaaagtctagtttgtaatgggacgctcgtttttaggtgacttatataaaaataaataaatagattaaaaaacaaataaaatcagtataggcctaaataaaagttagcttacggaccatttatgatgaaacttgggccctaatgcaaagcccattaattttatctttggagtctgaagtctctcctctctgtgctttcacataatcacattgcatgattgatcaaatactcgattttccgtgaaatctctttgaatatttcgattccttgttacc

SEQ ID NO: 14995 - DNA, 3000 bp, Unknown
  misc_feature (1)..( 3000): cDNA_ID_2731421_gDNA_ID_2684240_Annot_ID_137753 3000 nt of promoter + ATG
tgtatatgtacatatgcagtggacatttaatgatcgaaggagccattgattgaacacaattaggaacaccatgcatcttatctacaatttccaatatcttcttgtaatactcaaagtcaaaagattggatctacaatctgacgaaagaaataaagaaacgcttacacagtctttttttcatttcaccaacatgtattattatctcacatttgaatctaaatagtaacacaacaatatcagcacaaaccaattacatatttttcgtattataatatatttttttcatatcgattacaatcttaacgtcgttttataaaataaatttggggtttttttttgttaaagggttttaaaacaaaatttgttccaagttaaatgtcgttcaaaaatttaatggaatatatatatatatatatatatatatatttttttttttagaaaacactagttatagaattaaaatggataaaaatatgttattttaattgaacatatatacatcgaaactttttgttggttttgttagcgtttagcgatgttgagctacgagttctattgatggttgtttacaacaataattggattggagaacaagaagttatacatgattcgtgaagttaattagataagtttttaatacgaagaaatgagtcccgagacaaaaatgaagcttatggaattaattggtaaattagcatggcgacatacatttgtgttatgaaatcatctagttgtaggcacggtgatggatccctcagatggtcatgctatcattttcgctttcaaatagcgcgacctaattttttatataataaaattactaacgtggatcgcatggtatattttaatataataaaaatgttttaagaaaataaggaaatggaagagcccaccgtccaccaataaattaccgagtaaacgatttatacgaccgtcgaaatgaactgagaagataacgagaaaaaaagaatcggaattatatattttgactcaaaaacgagaaaataattcgtagcgattctaactcctactttataccttaaggaacacgaaacttatgagattttatggaagttacaacgtggttagttttttttttctttctattggaccagtgttaaattttcaatttggcatggtgtaaaactacacaaacagcctttctttctctgacccgtaaactactatttatctatttcaaatctaacagatttcattatggcgatagatatagtccttaaaaattatattggattcattagcaaaacataactatacattgaaattgtattgataaaatttatattattacatgcaaccaagcaagagcggatgtacacgttttggtgtgggtgcgagttccacatcagaatttgtttgtctatataagtaattgtgagagacaatcggaataattggctagaatcagtctttttttcctagtggatctttaaaaaccattcttttataccaagcatgtacatgctgtggtgtgggtgtaagtaaatcctgccccaatgaaaattgtttttggactcgccactgcaacgaagtgtaccaacaacttgactaggattctaagttcttttatgtataggatgtctatattaaactaccatgactaacatatatatagtagttccatatgctcgataaactatgatagatcaacaattttaaacatatagtttaacactatttatttgttcaacgtcaatagtttatagttacgcatgcgctcggcttagatttggtccccaacagtcgaaattgtcaaataatataaaataaaagtttcattgttaggattcatttattcttcgggtggttattgtaataaaaggcaaaagaaaaagaagaacaaaattcacaagtaaaaaaaaagataacatcattcttttagtcgacaaaaaaaaaaaaaaatcaaaaagatttattcagtactacagtttaatattgttttgacttttttctttttctttatattatctgaaaattctagactgcagctgaaacatgtgatatggattaaaggcgtatccagtatccacataaagaggagtggtgtcgctcacccagtcacccttgttacttgttagatagcattaatacatttgtaagcaacagcttatctgatagacatgtcttaattgggaaatatgctctaagatgatacaaccatggttccaactgttgaccaccatagctgataacatgttgattacattttttcttttcagttataacgattacttttttggggaaattattgatataatatgattcattggatgatccgatatcatgcatataaagttgtatctcgtgaaacacgagatagtattatactccattctttcattatcggagtatgtttaaaatttgaaaacaaatacagacacggaccgtggtctttaccttcagaaaaaaaaagagaaaaaaaaaacaatccactgtttattataggagttgtagaaaatcgggcaacgatattcgatatgagttattattagggccttattattatatggtattactggatattactaaataaaataatcatataaatttcacattttaatatacactcgttggacacgcggaatattatatgttctaaatgttaaaaaaatcaaaagaaatacaacgatcgacggatctagagtctagaccatgcaaataaatcatcctatttaaatataataactgtgcatatagtttagtcaaataaaaaggtaaagaaacaatatacaacctataacgtcaatatccatgtacgtagtaataattaggatatgacagaaaacacgatatcttgatatatacaaaatgaaaacttaaaaattgattaatatggcctggctgggtatattattataaaaacataaagagagatcaataattgattcgaagatcactatataaagaacgtcttcgatatgtaaaagaaccatcctaaacattttttcttgaataaaatcagaattacaaacaaaaatg

SEQ ID NO: 14996 - DNA, 3000 bp, Unknown
  misc_feature (1)..( 3000): cDNA_ID_1444487_gDNA_ID_2684240_Annot_ID_137754 3000 nt of promoter + ATG
aaaacacatttcagacaaactttacatataaacacatcatagatctcgctgtctttgattcacttatataagaaactttactatgtttaatctaatagtagctagggatctactctggtttccaacttaaaaaatcatcagtttcaatttagtcatttagactcctcaaaaatccctaaatttctgtgtttcagcttctaaaatataagtgtttaatttagcaaaatagttttaggcgaaaagcgataacacatgtgtcgccatttggaaactgagatatagatagatctattggttcaattggttgtacattcaagtcattttaaaaatcatgttgattgtattcttctataagaactatctaataatattaatccgatttctatgttagtttatataattcatagtgtaaattttaaattttcaaagggtttgtatctttaaattctaaaatagaaaacataagttatgaataagtttaaaatattcctaaatactaatttgagaaataataaaaagatgatgttctaaaattgctttagcaaaatttctggattcctttgatgattgagtacgtgtataatacacatatcaatacaatgtgtagactttttggaacgaattgttaaatttaataatatttttaattctagttcacgtgtacacccgtatgattcctccggccaacccgacagctccattgaagaacacagcggaaattaatttctttatcaaaaaaactttactaaaatcatattccggtctaaattctaaacttatatctacccgattttcccggaaacgtaacactcggaaatttccatatgacaccacacgatctctctagtcttccgataaaaacaaaaagaaaattgttgcaagaggaaaaaaaatatatatcctaagagaaaaatattgacctataaataactccattaacacaatcatctcaaaaaaaaaaaaaaatggatgcgaaacatatagttctatgcttcttgctaacgtacgtcttctccatggcggcagcctcatcggaagctgagcctccggcaacaaggaaactcggcaggcacgaatggccaggagaggaggcagaagcaccggaggtttcacatttggaagagactgtacggcgaggccaccaccattccacggtggaaagatcggttgccggaggtggagttattctcggaggcttagctacaacgtttcttgtggtagtgttttgctatataagggctacgaggaaacacaaacccaattatgatgaaaaggagactgagacccctaaagtgttagtttaattttgacttttcgttaatctttgtaaatattttctttgtattttggtttttgtgatataaaatgattctattttattttttgtcttcttcgtatttagttatataatttgagcttcattctcattctctgtttattttccaagttttaaatttatcttacaaaataataaaagtcacattaaattttagtgctagtcatactatatagaagaagccaggtgatatacaataaaacttttcttaaaacaaattcagctcgaacccagggtcggatcgatataactgatgattttagttaaagcaaacccacaatgtcatctaaataatgtggacagagcagaaaaatagtttggaagattacattttgtatttctttgttcaacaagaagccaatttatagaacctacaagttaagaaatttgacattatatcttacattaaaatattagtttttttttttttttacagcattcgaatttaacatttatattcatcaaatgaatcaattttatcgaattaagtgaactacagtatatgttttgataacataaaatcaaagcttatataacttggaaaacataaaaaaaaaaaaaaaaaaaatgttacctcactaaaaaaggggcccaataggtttcggttcaattgggtttcaaatcagcccaatcaaattccttatcctagtttagttttgagcctttcccagggatttccaaaaaaagtcaaagatgtattcaatattcattactattgggcctagcgaagataggcctattttgaaaattccggatagagagacccgtttcttccacagtacttgtgaacgtaattgctgtttttttttttttttttttcgtcgaacgtaactgcttacgtagcccctcacaaaaaaaactaatcacaaatataaaagattcgaaaacaaaacttagcatgaaagtattgaatccgtcaaaagctgtcggtatcattaaattttcccttaatacggagtataatataatactcaaaaaaaatttcttcaattacgaaacgattatgcaaaaaaaaaacagggagtaaaaaaaaaccgtatcttaccaccctaatttatgtggaattttaaacaattttgatgtagtaataaaaacacagcacgctactcagggcctgttcttttcccaatcgtcgcgactcaagttagcgactgaaaaaagcactggatttatctaattagtgtcgctaaagttaaagcagcgacagataaaaaaaaggcaacgacattaaattcgaaaaagagatgtcgccggtgaacgctgattttttcagcgacttcatctccatcgtttataaatctaaagttgtcgctggttttctctgtcagctgtattatgaacctattcttttaattataaagcatttaaacctctatttttctggtcgctgtcgctaattgagcgattgagaaaagaacaggccttcaaccactaccctcatttaaagtcaaaaagttgaccacctaatattcatcctatttgttaatttcaaattttacgaaacattaatctgattattctcgtgaccaactattcttcatacatccatttaaccaaatccaaagtggttataaataactgctaaccatcattgctcaataaaacacacacacacaaagggaaagccaaaccggtatattttctttaaacaggatatatagatg

SEQ ID NO: 14997 - DNA, 3000 bp, Unknown
  misc_feature (1)..( 3000): cDNA_ID_2993463_gDNA_ID_2684240_Annot_ID_137757 3000 nt of promoter + ATG
ctttgaaaacgagtcagtcaattgattttgtagatttattcagttttcatagatgtccaacactggaataattgttgataatttcaggaaaagcatatgttaaaataatgctaataacaaaaacaaagctagtgatgtgtatcaaactaccaattgtgcagagacaaaaacaaaacgccaaaatgctgtgttgtacccttttttgtcaactgcgtatctgtttttttttcagtataaaaaacttaagaaatctctaaacctaattattgagagtaaaaaaaaaaacaaataaataatcaaattttactgaaataaattgtaatgatcaaatatatttaagcattgaattttttttgtgtagtcctaaagttgaatcttgaaaggctgctgatcttaatttgtctttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatctatttatatatttaatgatgaaaattgtagtttgataaaaaaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactataacagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatggaaaacatcaaaaaccctaaaaacgcagatgattgttccgatagcatatcaaaaaacagtcatcaaggcgttgatgattccctgaaccagtcaagatcttacgtatgcagtttctgcataaggggcttctcgaatgctcaagcactaggagggcatatgaacatccacagaagagacagggctaaactcagacaaaagcttatggaagataataaggatgatgtcgtcgccgagagtgatgcatccgaagttgtgtctctagaccttaatgaacaacaacaacaacaaggagaagctttgacatgtgatgatcacgatcaatatgttgataacgatataagtcctaaacagaaattagagttttgggttcaagaaagcaagcttgatactaatgatcatggaaaggtcacggaggctagcatagatggttcgagttcgagtcatcatcgtgatattgaagtattggatctcgagcttcggttaggccaaagcgtcgtaaagaagaagacaacatagtctctgaacgatgaatcatatattgattgcattgtatcaatgggaaaatccctatgaaacaccaaactctctaatccgtctattacaaatggattcgtggctcaaattgtattgtaaggtatgcatttgtatcttattgctaccattatcgttgttgtaccttgtattgatatttgtttccttgcttgggttaatttcaccaacaacttttgtaaatgacatacacgtccaaacaaacaaacatatatatagaaattatatatatttggtgtttgctttatagttgtttagggaaaatgaataactaataagcttaacttagctcaacattattgatctggtcatggtagagactattcaaacttgttcactgagaaatattgttacagttgagttatatattggtagtcgtcctcagattttcgagtaagcatttgccaattatgactcttatattcgagattagcactcaacatttaattatatgttagcaaatagtataacattagctagcaaacttataaacgataaatttgaccaaaacaacataaaccaaggtcactttatctactttttgttctctgaattctgaaaacgaatttgaatatcgtattctaacagtgaatattgcatttatactaaaatttacgatcatagccataaataagtagttatgtatagtcaaactatatgtagttatacagtactttaagacgtttgaaccgctaagattcccataatctgcatgataatataatgtatgtaaactgatacatgcacaattgcacatgataaatataactaaattgatacatgccgatttgcgcatgataattataattatatgctctataacatgttaggatttaaaatgaaaagagcaaatggttcaaggctgcaacttggtgacgccaccaatgatgaccttttacgtcttaaccacgttccggtttggttcgagaacttgtttgagatccgctttggatctaaattcagattggttttatttgagatgccgtggaaaattggataatttccaccagagatatatgatttaattaattggattttggattcgattatagtaaaccgataatagtgaggcagtaacgaacaaaacaacttcaaccggatcattgggttggtttagtttactaattgaaccggtttgataatgtttaaaaaataaacaagtgacaacgaagaccagcaggtccagcacacgatcctaaatcctgtgagcatcgtctccatcgctggtcttccattattgacgaatctctttgcctttttttcttccttcttaaacaaacccaattcgatttcaacgaacgcctcttctctctcactctctttcgatttgttctttgccggagctcgtagtgtaagcgtgatccgcggcggagag

SEQ ID NO: 14998 - DNA, 3000 bp, Unknown
  misc_feature (1)..( 3000): cDNA_ID_2731409_gDNA_ID_2684240_Annot_ID_137759 3000 nt of promoter + ATG
aacgattcagctccatggcctcggagttatcggtaaaagaaattcctctgttttttcgatatctaacgaattaatttataacgtttgtgaagattcttcctttttctggaaaatatagacaatctgtggatatcttgaccggagttacacctcctacaatcagtttcattcaccggagaagttctcagacatcattcaccagttctgtcgcttccttatacaagagacgtccaacctctattgcaaattcgtttgcgtcttccacaagcaaacaaccgctgctctctgagaaagacgatgtattattcctttcatctcagatcgggttatccaacaccgatctctcgtatggagaaccaaatttctgctcgtttcctcaatctgttctaaatggtaagacatagtatcggtattgattttgtctcaaaagtctttagggtttgggcattcggttcggttgaacagagattttatcgtcataacaaaaagaaaagtttcaatctctctttaagttgaacctatttttggtgaaggaatcaatgtcctttgtggaataagtctactcacaatgccttacgcggtgaaagaaggaggatggctcgggctttgtatactcttatcctttgctatcatcacttgctacaccggtatcctcctcaaacgatgtcttgagagctcttctgatctccgtacctacccggacattggtcaagctgcctttggatttaccggccgcctcatcatctccgttagtcatatggaaatcatttacatatatacttaacatatctccaaactaatatatagggttcttgatctctcatgagagttgcagatacttttgtacatggagttatacgtatgttgtgtggagtatataatcatgatgagcgataatttatcgagagttttccccaacattacattaaacatcgttggagtatctctagattctcctcagatctttgctatatcagctactcttattgttcttcctacagtttggctcaaagaccttagcttactctcctatctctcaggttccattttctatcataagatccttccaatatagcttcgagattcgttcatatattctttaatatgtgtgttccattcttttagccggaggagtctttgtttcgatcttgcttgctctttgtctcttctgggttgggtcggttgatggagtcgggtttcacacgggtggaaaatctcttgatctcgctaacttacccgtcgctattgggatattcgggtttgggttcagtggtcacgcagttttacccagcatttactcttccatgaaagaaccatccaagtttcctttggtgcttctcattaggtgaaaaatctctttgcctaaggttacttataatggacgttagatactaggtcaaaattttcatttctccgtttctttttgcagttttggtttctgcgtattcttttacattgtcgtagcgatttgcggctacagtatgtttggtgaggccattcaatcacagtttacactaaacatgccacagcagtacacagcatctaaaatcgcagtttggacagcggtgagatataactttaaaactcggtaaacatgtttgtctcgacatatatataattactaaaatttgattggttctttttctcttactttaggtggtagtaccgatgaccaaatacgcgttagctctcacaccaattgtgctaggtctagaagaacttatgctgccatcagagaagatgagatcgtatggagtatctatctttattaaaacgattttagttctctctactttggttgtcgcacttacattcccattcttcggtaaaatactcttaccttctttttgcatgaaactatacaacaacaacaaaaagcatcttaatttatcgtcgtttgttctaattataactttgcagcgatcatgggggctttgatgggatcattcctcgcaatgcttgtcgtaagtcaccgtttaagaaaattacagctatcattgattatagacatatcacatctgttaaaaggattcatatttttttgtttaccgtgcaggattttatctttccttgtctttgttatctcagtatcttgaagggtagattgagtaagactcaagtaagatatatttttttttcttttatgccataaagtaaaatggttattgtttagagtcaatatatttttacatgataatttcatttaagctttatctatttgatattttggcagattggaatatgcgtattcatcataatctctggcattgtaagcggttgctgcgggacgtactccgccattggaagattagtaggaaaactggattgatggtagaatagtgaacaatgaaacaacatagaattgtgaaacaataagagattttctttaataaaagttctatcaaatacgtaatcaagttttgtgaaactttaaacactaattttagtacagttttacagtttattaacttgcaatcttcttttttttattaaatgaatttatatatgagcaactaaaaatgctcattaagagatatcatcatgaaagtctttgcaagccatgattctagttccaattacaaacctgaacgttacatagctaaattattggagacgaagcgaattatcgaaaatgctctgacatttttaaatggagctaaataatttcggttatacggataatcagaaactgcattttaggaattaagaaatgtgtcagcaaaattttgaaaacaataatagaggaccttaatgataaaattaaaacaaaaggggcaaatacgaaataatataataaagaaggggtcatttcaattaggtggggagcttcgagttcaagagatctccaaaatcgtcgacaacttcagacgtactccaacaacaaagtacaacaacaacatcaatcgagagaaagcgaataaataaaacaaataatttaaattaaaaatccactcgccggagacgccgtcgtttcgacgccggtgctccaaaaaaaatatg

SEQ ID NO: 14999 - DNA, 3000 bp, Unknown; identical to SEQ ID NO: 11025
  misc_feature (1)..( 3000): cDNA_ID_2731368_gDNA_ID_2684240_Annot_ID_192573 3000 nt of promoter + ATG

SEQ ID NO: 15000 - DNA, 3000 bp, Unknown; identical to SEQ ID NO: 11001
  misc_feature (1)..( 3000): cDNA_ID_2724771_gDNA_ID_2684240_Annot_ID_192572 3000 nt of promoter + ATG

SEQ ID NO: 15001 - DNA, 3000 bp, Unknown
  misc_feature (1)..( 3000): cDNA_ID_2731376_gDNA_ID_2684240_Annot_ID_192570 3000 nt of promoter + ATG
ctggtatccctccagcaccaagaggtgttcctcaaatcactgtctgttttgacattgatgcaaacggtatcctcaacgtctcggctgaggacaagacaacggggcagaagaacaagatcacaatcaccaacgacaagggaagattgtcaaaggacgagattgagaaaatggttcaagaggcagagaagtacaagtcggaggatgaggagcacaagaagaaggtggacgccaagaatgctcttgagaattacgcatacaacatgaggaacacaatccgtgatgagaagattggcgagaagcttgctggagatgacaagaagaagattgaagactcaattgaagcagccattgaatggctagaagcgaatcagctagcagagtgtgatgaatttgaggacaagatgaaagagctcgagagtatttgcaacccgatcatagcaaagatgtaccaaggcggtgaagctggtggtccagctgcaggaggaatggacgaggatgttcctccttctgccggaggtgcaggtcccaagattgaggaagtcgactaataactttctctcttactctcttactctcagtctttatgtgtttgtatttcaacattttcctgttttgtcccctagttttttttttctttttctttcttgtattgactctattttgagggctcgcttgtttcgatgagctccttattttttttaatctataacaggaatgttttgattaattctgcaaggtttttattcttttagcctttttaacttaagaaagatactttatctcaaaaacaatgagatactgtaaccgcatgattcaagtctccctttggaactctggtgagttgctttggaaaaagcttgctgagattcaacaacataatcatctaagattgactattatctgtgatttgttgattttagaatactcgacacaaatcataatccaccatacttcagcaaccaagttctattcgtttatatcgtatgatttcaagagttaaaaacccataaaagacatcggttggtgtgggtttgataaggtttagcttgggattggcaaggtcgggaaatacatttgatgttgtctgatcatcgtggaagcccagctgggctttctcgatattcaccgattccaagaagatcctgcaggaaagaaaaaaacagcttcttagggaacagcttctggatggtaaagtgcaagatatcagtgtgttgtcttgtctctttcaaatatgcaggacctttaggctaaaacctctacatgttaaggtacttgattctctaagcttctttgtttccttgaatatgcagatgtttaagattcaacaagtacagtctgtgacaaaatgacatagcaacttgctcaagtaactggagcattagaagtggaagtttacctgacaagccctgtttttggctctggtctccgctgtgctagggatatcgtgattcggtttaagaaatttcttctcacgtcgctcacaagaaccccatccgtcagcgaatcttcctccactgcgagaccccatcaaccaaaaggttaaacaccaattaatcactacacactatttgctaaacacaccatcaaattcaagtttatatagaagaacattactgcataatggctcgaacgatgaactcagcacgctggacatttctgttttcgtcgaattcaatagtcttgtctcttatttcataagacacattgaagtaaaacgatattttcctccaaccttcacatttccatacaatgtagcatcaaaaccaattttgaatgtaaaagaaacaataagcagactacaagcataatcttcacctgactttttgatgtatgccttccctgatatcatcgtgtaatcagatttctctagaatctgcaaaatgatgaagcaatattgttagttcacgatagcacttgatgtaccaatgacaaatatgatattggttgagtgaatccaagagtagtgatctagcttgggttctttggttttgtattgagaaaaatttagaaattattatgaaggaacaagtcatgatcgaaataatcaagcaaaacaatgcttgacatttcatcgaacacctttcagtgcacaaaactcatttccgaaataaacaaaaatggatagaggaaaatcgaaatgataccgccattgctgtattctggtactccttgaacagagtagcagaaggaaagctaccggacaagctatgtcgcatctcattaatcggatcgttcttaacacagctcgctgacggagaaacctccgcaaaaggcgtaggctgtctaatcccaggcgacaagtaactctccggcgaagaaaacttcgtcgaattgatgatattcggggtcgaattccggtgcgccgtcgtaacaagagccatcggagtctcactcttcacctcagacaagatgcgagatctggccattttgctcggacgattagactcctcgttcaatcctcggccaagattagggttacgattggggatctgaagaattttcgactgtggagaaggatacgaaacaggcgtcggaggagaattgtaatttggatacctaatagcaaggggtttcggagatttgccggcgatagtagctgcagcggcggcggaatcaatcaccgcccataaatcagcgtcgtctaggtctttctcatcaaaggtgtaggaagaaaccagagatcgtgacgatgacgacgccattgaaagcgttcactgttttttcgtgcaaagcggcaaatagcttattttaatacattcaaatttacacgaaaatccgctaattgggatagaggctttaggcataaaggtcccttcttattccattccggttaaaatctctcctctttgaaccaatttaaaccggtaatttcgatttcagttatgtattaatcattcggttgggctgtcgcaatcgtgagtcccagagatgtaaataataacatatttgaaacagtgaagtgatctcttcctttgattcttcttctaatcttcttcaatg

SEQ ID NO: 15002 - DNA, 3000 bp, Unknown
  misc_feature (1)..( 3000): cDNA_ID_2731384_gDNA_ID_2684240_Annot_ID_192567 3000 nt of promoter + ATG
tccgcggccagctcatttgggaggctatcatggatgaattgttgtcgatgggcatgtcacatgcgaaacgtgtaccgtcctcattatcttataaatcttaatttgtagaacttaagtctctgtcttgaaatcccattaatgtttctttttgttttacatgtttgataaattgcaggccatgctcacaggatgttctgctggtggcttgtctactctaatacattgtgactactttcgagaccatctgcctaaagatgcaactgttaaatgtgtttccgatggaggctatattcttaatgtgtatgtaacttccttttatcacaagtcatgactttaccttttcagtgctctttcattaattccttcaatgaagctggtgatactcccacagagctaaggaaaagcagctaacaatgactatcaacaaaagctattttccttcactttcaggcttgatgtccttggaaacccaacaatgggatctttctttcatgatgttgttaccctgcaggtttgtattcactttctgtcaatattatcttgaataagtcttcattgaaataatcaagaacatgtcatggttttgggttggattgctgcggttgacaccgaccagagcgtagataagagcttggatcagaattgtgttgccaaaatggaaccatctaaggtagcttttgtctcttccttcgaaaaatctttcgtgcctaattatgattggtactgaggcttcttgatttcggtttccagtgtatgtttcctcaagaatctcttaaaaacataagaactccggtatttcttgtcaacacagcctacgattattggcaggttagagttaccaatcctagcaatattatgagaacttttgtcctatctccattttggttttactgcaattcatgattgattttactaaaagtaagcacacattcagattcaaaacggcctggtaccagattctccggatctagatgaaagatggaaaatttgtagactcaatattcaggaatgtgatgccgcacaaatgaaagttctgcatggtaatttatctactcattaataaacctttaactgattctatcaacccttggagcaaaggttaaatcttcggtctttcttggagcataagttatgttttgtcagctctatattttataaatcttctatgatttgcaggtttccgcagttccctgatcgatgcgataggagaatttcatgtgaacaaagagggtgggatgtttataaattcgtgcaattctcattgccagataagagagtcatggcattccgcaacctcaacaagaatcgaaaataaggttagaaaaagacaattgacgcaatctgttgctttcttttctctcgagcatctcttctagcaaattaatgaactttccaaactcatgtctcctctttttgtttttgttgaaacagacgattgcagagtctgtaggtgattggtacttcaaccgaaaaccggtgaagctaatcgattgtccttatccgtgcaatgcctcttgttgaacatggattttccgtatgttaatcattggaactgaaatagattgtatcgttttgatcttattacgatagcttttataacagtagaaatgtaatagtgcatgttattaacggtgcatgtttttcctttttatataaccgaaacgtgaattatataagtgtggatgtgacgaaccatatgaataaggtatctccctaaatgagcatgtttggggtaataaatcttcttcatttttcttttacaaatagttaaaaagttttcacgatacggaaaagtcagctaggtggaattaattgagaaactctttgcttccacgttctatccaatccccgtatattcgttgacaaaatttataagatccgcaaaatataataattacgtgcttaagcataatatatggttatgttgataaactaattgcctcataaattaattaaaaaatgaatgttccaacactactctgtcctgatcatggcatttcatcgagttagtctcatcgactagtagcaatattagtaatttaatatcattgtgtgaaaaacagaaacatggtacgttgaatttttcaaaagaagaaaaagaaatttgattgcagagttcatgcaatacatactgcaacgcaagcagccagctactctttcaagaatatctggtatctttttttttctattaatttcctatatgaaaaaactaatagttttgttttctgcattcacactttttaaagttttgaatagctaaatttgctaagtcatcagcacacagatttgccttccctagagagacaggtaaagcaagtttcctgcatttagtttcttctttgtgactggtctaaccacgttactcattgaattaacatgtaagccatttgactttttgcattccattagtttataaattcataatttttcagttatttatgaaatcaaaacacacgtacccttctttaaaagtcaactccctcgtaccaaaaaataaacaaatttatctaaaataacaatgaatttttttaccaacagatgtttgtttttttggtaaacttgtcattggtttaaagaatgtcaagtaaaattggacttatggtttataggaaactgagttaattccagcgttgcaaaggccaaagagggcaaatcttttttttattcctcacagaaaacagtgttaaaaggaactcgtggacatattgtttaaagaaacttgtcaaaagtttcatgaatttttttactaattcaaataaaaatcggcataaacataattccaagagaataaacctcattgaaagtcaacccttttcatcctcttcaccatttggctccaacataaataaatagccaaaaaacttctcgttcataaatctcgacaaatctccttgtagactaacggcgccgtttcgacttcattctgtgacacgacacggcacagtttcttcttcactgaacggtgacgtttttagctgcgtaatccaacattctcaaatg

SEQ ID NO: 15003 - DNA, 3000 bp, Unknown
  misc_feature (1)..( 3000): cDNA_ID_2685913_gDNA_ID_2684240_Annot_ID_192566 3000 nt of promoter + ATG
accacgtagtcctattaagaaatcggatcacgggtcgggtctattcgaacgccggttcttatccggtccgattgaaagcggtttggtttcagggaagaagaccaaggagaaagcaaaactgaagaaaagtggaagcaaatcctttacgaaaccaaaactgaagaaaagtgaaagcaaaatctttacattcaaaaacgttttcaccaacttatcttgttcgaagaagagtgtgattaagccaatcaacggtttcgattcattcgatggatcatcagatactgatcgttacatacctgagatcaactccttaagcacgattgtgagcagccatgagaaacctagaatcaaagaagaagaagataagactgagtctgctttagaggagccaaagatacaatgggcacaggggaaagcaggtgaagatcgagtacacgtcatcctctccgaggaaaacggttggcttttcgtcggaatttacgacggattcagcggtccagatccaccggattatcttatcaaaaatctctacactgccgtgctcagagagctcaaagggttactatggatcgacaaaggtgaatcatataatagaaacggcgagtccaacatcgagaaacagagtacagtcgagcatgcatccgattcggatcaagaaaactgccctgtgatgaatggaaacgatgttgcttgtggatcaagaaacattacgagtgacgtgaagaagttgcaatggaggtgcgagtgggagcataactcaagcaacaagtctaataatattaaccacaaagacgttcttagagctcttcaacaagcgttggagaaaacagaagaatcgtttgatctgatggttaatgagaatccagaattagccttgatgggatcctgcgttcttgtgacattgatgaaaggagaagatgtttacgtgatgagcgttggagatagccgagcggttcttgctcgaagacctaatgtcgagaaaatgaagatgcaaaaggagcttgagagagtcaaagaagaaagtccattagagaccttgttcatcaccgaaagaggactgagtcttctggtccctgttcagctcaataaggaacatagcacaagtgttgaagaggtgaatctttttgcgagtcctgattcagtgttttgttttgcgaacattagacactaacgatcttttgatgtgacaggaagtgagaagaatcaagaaggaacatcctgatgatatattagcgatagagaataatagagtgaaaggttatctcaaagtcactcgtgcatttggcgctggatttcttaaacaggtatatatatactcatgattttaatcagatagtttcaaaattttgcatgttttatagtttttagggttggattattaggtctacaaggtttgtagaaatatcaaaatgcagaaaaatactattacaaaacctggtttgtttttattcgatttgataatagttttgttcaatgtctttcctcagccaaaatggaacgaggcgcttctagagatgttcagaatagactacgtcggaacatcgccgtacatcacgtgctctccgtcgctacaccaccatagactctcatcacgtgacaaattcctaatcctctcatccgatggactatacgaatacttctcgaacgaggaagccatcttcgaggttgactcattcatctcagccttccctgaaggcgatcctgctcaacatctcattcaagaagtcctccttagagctgccaagaaatatggtaatactaagaacaaaacgcaaacgcacttaagattcgaaacgcaatctttgattaaactcacgtgcatttttttttttttttaggtatggactttcatgaattgctagagataccacaaggagatcgtcggaggtatcatgacgatgtttctgtgattgtgatttcacttgaaggaagaatttggagatcttccatgtgaatactaatcttttgaagagactcttactaaagtaacttttagaattgattcaatctttttagaatagattttttttttttttttttttggatttcgctgaggttttaccattttgttactcagcatattttaacgatgttgcatttgtgtcccatatacgttattgttagtgaaaaatataatgtaagaataatttatataactatcctactagcaaagctaacgcaaattttgaactcgaactttagttaccgtgaatgaaaataacagacttgaactttataatactcgtagtatacgtaatttttgctttttgcagatatgcttgccactaataaagtcataaattttatattttcataaactatagttatacacttttgactaaacaaacaaaatcggtttagcaaaagaaaaagttacttttctgatgaactaggataaggaattcggaactgaattttgctacgttctctctggaccacacacactgaacacccttttaagattttctccttctctttttcaacgtaatttatcttttgatcagaaacgacaaaaaagaagtctaacaatatcaaacaatttttttatagatatttttagatatttttcctgctaattttatctagtgtagacaaacccaaatatacgattattataaaaacacgaaataccaagtggacgactgaggttaatagatctagccgtagaataaagatctgcatgaaaggcggtgagaatctaaacggtgataagaccataacacacggaacatcggtacgctctcgaacgtacaagaatcgacgacacacaaacactccacaattatttgaacactggacaattattgaaccgacgtacgagaatcaatgcgctgagggtaaagacgtaaatgaagaactagttttggagataagagcggagaaagattgcgacacatgtatggtcaatattaatctcatttagcttataaatttgggagcttcctctatcattaattttcattcataaatttttcttcaatttgaattttctcgagaaaaatg

SEQ ID NO: 15004 - DNA, 3000 bp, Unknown
  misc_feature (1)..( 3000): cDNA_ID_3020080_gDNA_ID_2684240_Annot_ID_192564 3000 nt of promoter + ATG
tgtcattttcccaccataattcaccaagtttacataaaaaaaaactaggccatttttccaaacttttcaaagttgtccataaactcttttcggagtcataccattggatcattgtacaattacaatctagaacacattctctatcacacaatatttagatcaaataaatcaatgcaaatgatagaaaactaattttactgtaaaaaaacacaaaaaagcaatggtgaaagactaaaaacttgaagaaccggggttttgatggttcgccggttttagccggcttttgaaatgtgtattacaaatttaatattaaataacaaattttgtatattacaacttttttttcttcaataacatgcatgcattataccggtttaaaaatgagaggtgacaaaagacccgattacaaaattacgacatgcgacaatggcactagcacaaatcattaggcatatcatagttaatcacataagacttttttagttttgtacaatttttgtgactaactattttataaattattttgcataactttttgtaatacattatcaaatattaaactacatttttatattataactataagttattattgaaaatttatttcattaccataaattatattttttctttagcttacggatctataaacgctaagcacggtgccgcgaagacacaattcattttagtgtatcagagttggagatccatgattcataatattttacaggacattgactatgcgagagtcaacgctcttgattttctccatgtactagtggttttttcgtaggttcacacatgctcacttaacgactttagcagatgactcccctacgctacagcggtcggagactctcagctgtagggatacggtttacctacacatacatgtagtgttaatgtatttttttttcttttccaaataatagttaattcttttattgcacataaaagcaacactaattttaatgtatttgaatacagttcgttcgtttgtatcagcatctagagacatccaataaccaaataatttaaaagctcatgcttttgtgttaaagagtagactcactattcattacacaatatgttctcaacttaaaagtctcgagataaagagaaacatcataaggattcgattcctaaattaataattcatttcataaccagaaaccttctatgatagttagatttgttgaaatcagaaaacttgtgaaatgctgataatttcaaagagaaaaacaaaagattagcaaaggcaaacaaagtcaattactttatttttgtgtaatctagtcatattactattaaattgcttcataaatctctacgatatgcacataatcttatacacacaatttgacttgtcctttggttcatatatgttggtgaatgattcattatgtttacacaattatgagtcatgattcatagccatcaaatggtagtagcaagagcacgctctaaactatatgacttgtcattggttctaaacacaatgtcaagccactctagcattccccaaatctctcccgtttgacgtttttcaatcgcaatttccgcccaccaaatttttgcctccttcttaccgaacacatactctaccgacacaactgccattttcccaccataattcaccaagtttacacgagaaaaactacgcaatttttccacacctttcaaagttgtccataatcttttttcggagtcataccattcgattcttctatcagtataacggtagaacacgttctctatcacacaataatgggataatgaaggacatcaccaccctttatttatcgctatgtctgctgttcgccatctacctttatgcagcttgtaagtcacatcctttgcctcagactttacatagacagttccttcatactctacgcttctgtactttgagcctccaaatatctcctcgctagggatctgcaaaaactcccaagtttgggtctgcgtatcaaaaacctccatccaattcgttgaatcaagatttttgcaacctcctgttacatatattttcccatcatggacacaaacagagtgggacaaacgggccacatgcatacttggtgcctcacgccatgtgtgagaataacaatccatgaccatgacgctagacgaataattcttatttactaaccctccaatagcatagatgttaggaccgactattgcagcatccgaccaggatgcagatggaaaattaggagatgaaatcggaaccaaaatttttttggagttaaatggtccctgacagagcgtgaaccaacgtagttggtcagattcggtaaatagtcggaaacacacataaagacatctctcggtgcggcccaggtgggttcgggtttgataaagttccgttgaagcaaggagagagcggaatctcgtggagactaacgagagagttggataatacaatcttgagatgcgggctaagcagttgaatagcaaatcattaggaagcatcagaattgtcatctgtcttcttttaaaaggtgtcgtctcttctccattcatggctatggaagtgcacacttgcgatagttgtatggatggccttttcttgcgcttgttccttctgttaacttctttatgtatccagaaatctcgaccaatctcacctcaagttttcttcttttttttttgccaataccacctaaagtgtttatatagggaattatcattcctaatccaccatgtattattattaaccatattagttcacttttcgaataggaaaaccatagtgtatatgtaaaagaaaatattcctttttaaaaaaggaaacaattaaaacgaaaattggatacgagaattacattaccgagagtacggcgccgtttaagtatttcccgatatttcctttatatgatttgtataattaacttcatgactcagattatatttaggtttaggtttattgaggtctcccacgtctcattcgataagcttcttcggttttctactaattgatcgttagggtttatg

SEQ ID NO: 15005 - DNA, 3000 bp, Unknown
  misc_feature (1)..( 3000): cDNA_ID_2731389_gDNA_ID_2684240_Annot_ID_192562 3000 nt of promoter + ATG
cacttctgcttgtatgatattataataaaatctttcttgtgccgaacttttaacagtcagactattgcagtatgagcaaaaggggaaaacaatgttctggtgagtgcaattgttttctatcagattaaagttcttcactatcgtttgagcacttgagaatctatttgggctgtgtcgcagagaaaggtgaaaaagataaagatggggctgaagaacatgctgatacttcggatgaatcagacaacttttctgacatcagtgatgatgaggtcggtaattgtttagtagtaaatgctatgtcaaatttccaacctcgaatatggaacatgaaataaagaagaattctcaacagtttcaaagtcttgttttctcactacagtttcccttgttatatttgatcgtcagtcatagtattttactgttgctcaggtaaatggctatatcaacaacgaggaggaaacgcactataagacgatcacatggacagaaatgaacaaagattatcttgaggtgatttcagaggctatataatatgtatcttctcttggattccttttgatttatcacctaggagatcaaatcacatacaaaattatgttgttttgtaggagcaagctgctaaggaagcagctctgaaggcggctagtgaagctttaaaagctagcaactctaattgcccagaagatgcaagaaaggctttcgaagctgccaaagctgatgcggcaaaatctagaaaggtgactcagtttgaactttgaaattatgttcctgatcaagcatctgacttttggagaataacatgatacccattgatgacatatggtttctcaatcaatttctgattcttttttctctctcttcatataggaaaagcaacaaaaaaaagctgaggaagcaaagaacgcggctcctccagccacagcagtggaggcggtacgccgaacgcttgataaaaaggttagaatgtcagcttctttgataccttgatacttgaaaacgaatatgcaaaaaaagataaaccgagtatgccatgtatcatctgttaaaaacctggcctggaagtacatagtcaacaacatggctgtcgaaattattagcattgaagaaactttagagtctgtgtttcttcctttttcctgattttgagtgttgactcttacagagacttagttcggtgatcaactacgatgttttggagtcgctatttgatacatccgtaagtttttgattacctcttcttgtatcctcaattctcatcactttttgaggtctttacaattttgcttctcttttcttctttcaggcacctgagaaatcacccaagaggtcgaaaacagagacagacattgagaagaagaaggaagagaacaaggaaatgaagagtaatgaacatgagaatggtgaaaatgaagatgaagatgaagaggatgaagaagaaggcaatgtagaatcatacgacatgaagacagattttcaaaacggcgagaaattctatgaagaggacgaggaagaagaagaggatggtaatgattttggattgtattgatgatatgtattgtgaaacacaagagttttaatttcttttgttttgccggattagttgattttatttgcattaatataggagaaccccaactaaatttattctttattatcagtaacaaatatttaagatttaaaagaaaaaaaagttcacacaaatgatctatttatttttacaattcaagtggtactgactaagaaatgaaaaaccactaacttaattaatttaataaaatctatatgtatttaattttgataattttattttccttgtttatgataattctaatttctatcagataacaactaacaatcactgaacttatctcacctatttgatgagctaaatgtattttaaatttatttttctataaagatataactgaaacaaaagtgatgactttttatgaaaattcccaaaatcaaataccagaaaattcaattttaaacaaaatgtgtcggtccggatgatcttacatctagcttggttttacaggatagtatttaagaagaatcataaagttcatctcaaaccaaatccgacggtccagagtcacctgcaaagcttggcatcgtatacgtgttcagtggtcaacggatcagctacgagtgccgtttgaggttcaaacttctgtttctgaggttaactctctaccgttaacgtccgttagtgtaccttctaaccttgacgacttttccactttccaaaagataacgacggcgttaaattggtctattttactgaaccagctttaaccagaattagattgcattacattcaactcgtgcttatggataaatatcagttcggtttggagaaaataggttacttaaggtaaaaagaacggcaagtaacggtgtgacgtcagcagaagaagtattcgttataatagtgagagagagagagataaaacttagggaacccttttttatgttttattttctcgctttgtttcgatcaagtcttctctttctctctctatccctctctctctggttcaacgggcaaagtatttttcgaataaagttttggttttttttttaacgttcctttcgccttctttcttcttcttctgctggtgaattcgtgtatctatctatctcgatgagctccacttttaatccagccgcttcttctccagatgaggttagtttttgtgtatcgaatctgaatttttaagggttttgttcttgtgatcagattctagtgaaattgagttctttgttgtttggctctgattcgaaacgaatttaactttattgaaactataaatttttgtgattacaattgttataaaccctaattttgctgtggttggtgttaatgttgagctgtttactgaattcgtgatttgtgagatctgggttctgtctgctttgtgttttacgatgattgcttttttagggtttctctgtttcttatcaaagtctggatcttttttttctttcattgagatg

SEQ ID NO: 15006 - DNA, 3000 bp, Unknown
  misc_feature (1)..( 3000): cDNA_ID_2993463_gDNA_ID_2684240_Annot_ID_192556 3000 nt of promoter + ATG
caaacattagtttacatataaaagtaaaacaaaatttcaatagtaactctaaaaatagtcttcttgtgaatacttttatccatttcctctttttctaaccaatcaaaattttgttacctaacaaaaaaaataacggaaattttctattgggtttcaagtaaataagagaagctgaataaattttacaaaaggaaaacaaatgtttttccctatatatgtactaacgaactaaataaatcaataattgcgaggagaataaataatgatccgagggaagatctcattggcatacaaggcacaataagaataagcaaggaaaggcagtcaaaagaagtcgaatattatttgtctgttagaaagcataatcctaagttcccatcattggctcatagagaacatataatctttctccaatgatttgatgtctcacactcactagtcactacttttacttttcacattttatatgccatttgcttgcgcaaaaatacactgcgaatgaagtggttgtaatttgtggtttcattagtttgatcgatcgacataaaacgatttgtaacaatagatccaaaacagttgcaagtcgatcgataactagtatgggttcaagtccatgaaattcaatcacagctttgcggaattcaattgcttagatttcttgaagagttttgttaggaatttcatgtctcaacaagaagaaacttaaaataacacataacgaatgttagctaacataaacatattcacgttgtaaatgcattacgttttaatcttagaaattcatgaatgtctatattcttaaagaataccataaatttatcagtacagattcgacatcccatcaatcattcgcatagttatagctctaaagatctatccagtacaatcatatcaaacaaagaaggctaagacatacgaatggacatgatagaacatgaacaacaaaattttgttttccactagagcatatgttctcatagcattaaacctttcgaataagcatcttctcaatactatttagcctcacgagggttataaattctcacatttccctactgacttctcaccaaacaaaaaaaactagaagaagaacgatacataaactatgctcacgcaagaacttgcgcgcattatggggggtgacgatgatgagtattggtgaggaccgggtaatctgcatcctgaggtttaaagcttaatttacgcaggaaatttgtatacgcatatacgtatgtgtattagtataccttttagtcctcgggatgcggattacctcgttcttacttacaatacacgtactcggagacacgattactcatcatctagaggttggttttgatcctccatttcttctaagtttaaacatcattaataagatatttaagactgaatatcaccacacatatatagagtcagtctcatagatgatgaattggtaatattatatgacactactgacttaaaattattatcatataatattactaattatattaaagttttttttcgtcaacatacacactagttaaaaatttgaatttagaaaagttcaattgatgactcatttcaggaatgctcgaaacaatggcaacgacgcttgtgtatgtttgaattagtgatatatccgttttattcatacttaattaaactggtaactctaactaatacgctgtatatttacctttttgtctagtgaataaaaaaaaatcacgacgacctagttttatgtcttttatctattgctcaaaggtcgctcattgcctttgactaatatgtttagacttgtgatttctgctattcaattaaattaattaactgcgtttattaaatttcagttaggtgactcataaaaagaaaacatagattaattaagttatatatatagtataatgatgtacatacaaattcaaaagtactatggatcttgctttgaaaacgagtcagtcaattgattttgtagatttattcagttttcatagatgtccaacactggaataattgttgataatttcaggaaaagcatatgttaaaataatgctaataacaaaaacaaagctagtgatgtgtatcaaactaccaattgtgcagagacaaaaacaaaacgccaaaatgctgtgttgtacccttttttgtcaactgcgtatctgtttttttttcagtataaaaaacttaagaaatctctaaacctaattattgagagtaaaaaaaaaaacaaataaataatcaaattttactgaaataaattgtaatgatcaaatatatttaagcattgaattttttttgtgtagtcctaaagttgaatcttgaaaggctgctgatcttaatttgtctttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatctatttatatatttaatgatgaaaattgtagtttgataaaaaaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactataacagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatat

SEQ ID NO: 15007 - DNA, 3000 bp, Unknown; identical to SEQ ID NO: 14996
  misc_feature (1)..( 3000): cDNA_ID_1444487_gDNA_ID_2684240_Annot_ID_192554 3000 nt of promoter + ATG

SEQ ID NO: 15008 - DNA, 3000 bp, Unknown; identical to SEQ ID NO: 14995
  misc_feature (1)..( 3000): cDNA_ID_2731421_gDNA_ID_2684240_Annot_ID_192553 3000 nt of promoter + ATG

SEQ ID NO: 15009 - DNA, 3000 bp, Unknown; identical to SEQ ID NO: 14994
  misc_feature (1)..( 3000): cDNA_ID_1019230_gDNA_ID_2684240_Annot_ID_192552 3000 nt of promoter + ATG

SEQ ID NO: 15010 - DNA, 3000 bp, Unknown; identical to SEQ ID NO: 14993
  misc_feature (1)..( 3000): cDNA_ID_2731431_gDNA_ID_2684240_Annot_ID_192549 3000 nt of promoter + ATG

SEQ ID NO: 15011 - DNA, 3000 bp, Unknown; identical to SEQ ID NO: 14992
  misc_feature (1)..( 3000): cDNA_ID_3044064_gDNA_ID_2684240_Annot_ID_192547 3000 nt of promoter + ATG

SEQ ID NO: 15012 - DNA, 3000 bp, Unknown
  misc_feature (1)..( 3000): cDNA_ID_3020125_gDNA_ID_2684240_Annot_ID_192543 3000 nt of promoter + ATG
aattatcttcttttttgcagtcctctttggcttcttaattatcttcattatggcagccatctttggcttttcatctataaagtaacaacgaaagtttgttacacttggttaacaggaagcaagaatcaacaagatattgacgtacctgggcggccacaaatgatgcggcctttctggcggcgggggtggaaaatgtttcttccatggtaagcaacaaaccgaacaactgctttgcgcccccctcccatgtcggtcccactaagttttggggccttgtctattgcgtcttctcccagtagatacactatagagaagctgtaaaaaaccaggacgacaagtctttagtataagtttagactttactaacttggggaaatatggttggggaggaacaagccacaaacctatcgaaaatcatgacatgatcaaccttcccacatgaagagaaaagtttactcaactcgcacttgatatcagactcactaagcgaagtgtcgtatcgtatccttcaacctctaactcaacgcaactgaaataattggattgcagcagatgatatagtataattagaaaacaatcttaaagatacaaatctcggaaataaattccgtttacttgtcttcttctttcggaaagggatcggcctcagcatcgacagtccatcctcccatgtcacttccattgagttgcaaggccttgtctgctgtgccttctcccacaaaataaataaaagcatgactccagagagaagaattgcgagtttcgggaatatgaacatccgtgatctctccacatggagagaaaagttttttcaactcactctcgacatgttcacgaggaagctcaatgtcatatcccgtaacgctaatcctctcaatgtcactgtcactacaagcaagagatcatgatcaacatatatacatatcttactcatacaataatctcaaccaatcaatcaatttaccggatttttcgactacgcttcacttcaagcccctaaagatacaaaaacatctatcagaaattcgaaacagatcgtcaaagagtgaataagaagaaaggctataaggatacgaagaagattaccttgttggcgatttcgtccatggataagttgacaagagcgccggcgataacccttaagagatattttacggttttagagatttaggtctgatttgaacaaggtattaataattgtgttttaaaaataaaataaaaaatcattactagcttgctatgcacggacatagtatacttgttattttctttttatagagaccgaaatatttttggtatcaactaaatattttaataatttgaaaccaaatgaatcatatttttatctctttaacttttaaagacaaatttcatacagttaaacttttttcataaagcaacttcatacatttagactaaaaaatcattataaaattattatgattagctaacagatttaaattgtaaaccaatttaaaaaaaaaattaagctagtcttttcatttttacaaaagattttggtggatcaaacgtgtagcccttaaaatctatttttgttgtttggtactaatacgttttttcttggttttatatcaagccaatctccgtcacttatttctgatatcaaaaatcacttttttttttaacagtttaaaactttattatctcctttttcgcaaatatatgagttgtttttatcaaaatagtatatggaatataatggttctgatgtttagatctaatcatccagaaatttatgcggtcgtgatagtggaggtacaaactacaaagcatgtcgcggaacgcaacttttctctatctttcggaatatggtgtttgaacatattttgatcgtaagcttcatgtaattgctaattctttattgattattctccaaagcagctagtgtctgaggcaataaaaattttcgtaaatgacttttaaatacatatataatctctcagatactaaatataatatattcttaatatgaactaccctcacaagcatggatgtcgggaacaacaacatttcgacgcacctgaatcaaattccattttcattcgaacaaaaactggagaggtttgatcccagtcaccaaccgactcatccttgtaggctagatcccaaacactacttttctcaaccttccatttctgaccactcaaaccggttcaaaacgccctacgacgaccaacggttcaattcggcaagaattagcttctacaagaagcttacgatctaaatctgctctaacaccatactccgagaaaaagagaaaggttgcgttccgcgacacgctttgtacgtccgccatcaccaccgcaccaacgtttgtacaattggatctaaccatccgaaccattgtatttcgtgtaattttttgaataagaacaactcaagtatttgtgagaagaggagatactagggtttagatttttagagaaataagtgatttctaatatcagaaataagtgacggagatgagcttgatataaaaccgcatgtcatgcgtgaaatcttatcatgacaaatgtatattatattgacccatcataaactttatcgccaaatattttttctttttatccaaaagtaatattcggtatttttttagggtgaattagctcaataaccatattccataaaaatattaagtaactaacaccataaacgaaggaattgagagagtgacgctacgggtatgtgaagttacaacccactccctaagccacgtttctgtgatttcttgtacgcgcgtgagggtaagagcgagcttctttctaccagctgacgtgtctcctttcgaagccagtaaaaaaattatcctagcaccgcttgagaattgtcccatcagtaacataacctgcagatttttacattaatttgaataaaatattccccccaaaaatatcggagcagaagatgctctgttttctatttattgccagtaaatgctataccttttacgcagagatctaacctgcaaaacagaacagt

SEQ ID NO: 15013 - DNA, 3000 bp, Unknown; identical to SEQ ID NO: 8932
  misc_feature (1)..( 3000): cDNA_ID_1989272_gDNA_ID_2684240_Annot_ID_192542 3000 nt of promoter + ATG

SEQ ID NO: 15014 - DNA, 3000 bp, Unknown
  misc_feature (1)..( 3000): cDNA_ID_2731393_gDNA_ID_2684240_Annot_ID_137763 3000 nt of promoter + ATG
ctggtcgttaaatttagagtggaaggtaacgttcacatgtttaaaaggtccaaagtcaaaaggtacatgcgtggcatagatttgccaataaattaaagaaaaaaaggtaaattcaagaaaggcttatcgagctaatttaagcccaataatactgaactatttgggcttgagtcttaaaggcccaatttgtggaggaggcgtcatcgtcttcgcttttccttttcccttgagaggtcgtcgacgaggtttaagatttttaagaatgttgtagtagcttcgcgaataatctcaggtcttctataaaaccaaactagcgattagccgactcttcctctttattattacaaagacgaaaaggcttcgagttttgtaatttcttcttctgttacaagttcttttcactgtgaaagtaattcttcaatggcgaaagacggacctaattgggatggtttgcttaagtggagtctctctcacgccgacggtactcgacccactcgccagttgaggtacggacattcatcttgtagttggttttttaggttctgtcttttgatttgtctgaaactgatgggatgcttggtgggtagtttaggtatctgtgtggctatgattgagctttcacttgaggagatgaatcttatgagtgaattcgaatctgggtttgtttaaagtagttttcttttttgaagatatctgttcagttcatcggtttggttaagattcaattatcgaattctgctgttatgtaggtgaaaggttatctattttctcgtttttacatgaaactctgttaattttttttaagggaattcacgatttgttcatgtcaaatcattctgtatgtgttttattgtggattgttttgttgatttgagttgttttaatgagacagtgaggaggatcgaaaatggtttatggaggctatgcaatcgcagactgtagatgtagtcaaacgcatgaaggagattacactagttatgcaaacacctgaacaagttttggtggaacatggagtaacacctgaagatatccaaggtgcgtaatttgtggctataatacatagcttagatctttatcttttgccattgtgtgtagggtactaattgagtttattattctggtagatttgctggatgagctgcaagagcacgttgaatcgatcgatatggctaacggtacattatctctaacttggactttgctttttttttttttttttttttctttcctgttctggttagctcaatttgaacattgcttgtaacaacttgtttacttactattgtgtagatcttcattcaattggaggcttggttcctcttcttagtttccttaaaaactctcatgctaatattcgggcaaaagctgcggatgtcgttagcacaatagttcagaacaatcctagaagtcaggaacttgttatggaaaccaatgctctggagtcattgctctcgaatttcacttcagacactgatattcacgctcgaacccaggctcttggcgcaatatcatgtaagcctgcttctgatagttcatttttagtaaagattgagatgatcaaaagcttttgtgatttctattttacttggtttgtgatactaaaagagacttatcttttcaatatgggatgtagctttgattcgccataacaaaccaggagtaacggctttcaagcttgccaatggttatgctggcctaagagacgccttggcatctgatagtgtgagatttcaaaggtaacccacacaaatattcttatcatctgcggatataaaatcgtggaagattcttgaattgttgctcattttctttattcaaattctccaggaaagccttaaacttgttgcaatatctactgcaagaggatgattcagaccgcagtattgccactggacttggattcccccgagtgatgatgcatcttgcctctagtgacgatgctgagatcagagaagccgctcttcgtggattacttgagctttcaagagagaaaaacgatggaagtagcagcatagataaaagcgatgagaaactgaggcagctactagaagaacggatcaaaggaatcaccttgatgtcacaagaggatcttgaaacggttaaagaagagagacagctcgtggatttactgtggagcatttgctacaatgaaccttcttctctgagagaaaaaggacttgtcgttcttcccggtgaagacgcattgcctcctgatgtcgctagcaagctctttgagcctcctcttagagcttctgcagcaaaccgtaatgctactgagaagaaagatgaacctatgaaactacttggaccatagacgagaaatcaaagctaaaactttttattacttttccttgttttttatgttttgtaacttttcaaattgtcagaaaagtttcatagatatatgtattatgtcaatgatcaagggctatgttatgttaatttttgttttcatcattcgagatctttagtcttgttattgttgagattaagaatattcagcttcaatgctttttcaattcaacaagtgttctatacgatttcggtttagcaacagctaatacggacccgatctaattgatcggttaaaattggtaactttgaattgcggtgaaccgaagaacaaaaccaaagcgaacgtcacaattactttgcaatccctaaagggacagagttcgaatcaaggcagtctcacatatcggagaaatctctcgtcacgtctctcagcttcgccttcaacaccgtcgtcgccgtcacggccaactccggtattgttatatagatacaattacagtgaactagataatctcatcaaaccctgattctttccacttcctcgcacgattgtgtgaaaacagttactttcgctataaatagtctgatcttctttctattgagcagtaagattggaagctgttgtttcgaatcgattcaagcctcgaatctgagtttcggatcgatattagaagctaaggtaggagctttttgagtgaaggagtt

SEQ ID NO: 15015 - DNA, 3000 bp, Unknown
  misc_feature (1)..( 3000): cDNA_ID_2731389_gDNA_ID_2684240_Annot_ID_137764 3000 nt of promoter + ATG
gttcacttctgcttgtatgatattataataaaatctttcttgtgccgaacttttaacagtcagactattgcagtatgagcaaaaggggaaaacaatgttctggtgagtgcaattgttttctatcagattaaagttcttcactatcgtttgagcacttgagaatctatttgggctgtgtcgcagagaaaggtgaaaaagataaagatggggctgaagaacatgctgatacttcggatgaatcagacaacttttctgacatcagtgatgatgaggtcggtaattgtttagtagtaaatgctatgtcaaatttccaacctcgaatatggaacatgaaataaagaagaattctcaacagtttcaaagtcttgttttctcactacagtttcccttgttatatttgatcgtcagtcatagtattttactgttgctcaggtaaatggctatatcaacaacgaggaggaaacgcactataagacgatcacatggacagaaatgaacaaagattatcttgaggtgatttcagaggctatataatatgtatcttctcttggattccttttgatttatcacctaggagatcaaatcacatacaaaattatgttgttttgtaggagcaagctgctaaggaagcagctctgaaggcggctagtgaagctttaaaagctagcaactctaattgcccagaagatgcaagaaaggctttcgaagctgccaaagctgatgcggcaaaatctagaaaggtgactcagtttgaactttgaaattatgttcctgatcaagcatctgacttttggagaataacatgatacccattgatgacatatggtttctcaatcaatttctgattcttttttctctctcttcatataggaaaagcaacaaaaaaaagctgaggaagcaaagaacgcggctcctccagccacagcagtggaggcggtacgccgaacgcttgataaaaaggttagaatgtcagcttctttgataccttgatacttgaaaacgaatatgcaaaaaaagataaaccgagtatgccatgtatcatctgttaaaaacctggcctggaagtacatagtcaacaacatggctgtcgaaattattagcattgaagaaactttagagtctgtgtttcttcctttttcctgattttgagtgttgactcttacagagacttagttcggtgatcaactacgatgttttggagtcgctatttgatacatccgtaagtttttgattacctcttcttgtatcctcaattctcatcactttttgaggtctttacaattttgcttctcttttcttctttcaggcacctgagaaatcacccaagaggtcgaaaacagagacagacattgagaagaagaaggaagagaacaaggaaatgaagagtaatgaacatgagaatggtgaaaatgaagatgaagatgaagaggatgaagaagaaggcaatgtagaatcatacgacatgaagacagattttcaaaacggcgagaaattctatgaagaggacgaggaagaagaagaggatggtaatgattttggattgtattgatgatatgtattgtgaaacacaagagttttaatttcttttgttttgccggattagttgattttatttgcattaatataggagaaccccaactaaatttattctttattatcagtaacaaatatttaagatttaaaagaaaaaaaagttcacacaaatgatctatttatttttacaattcaagtggtactgactaagaaatgaaaaaccactaacttaattaatttaataaaatctatatgtatttaattttgataattttattttccttgtttatgataattctaatttctatcagataacaactaacaatcactgaacttatctcacctatttgatgagctaaatgtattttaaatttatttttctataaagatataactgaaacaaaagtgatgactttttatgaaaattcccaaaatcaaataccagaaaattcaattttaaacaaaatgtgtcggtccggatgatcttacatctagcttggttttacaggatagtatttaagaagaatcataaagttcatctcaaaccaaatccgacggtccagagtcacctgcaaagcttggcatcgtatacgtgttcagtggtcaacggatcagctacgagtgccgtttgaggttcaaacttctgtttctgaggttaactctctaccgttaacgtccgttagtgtaccttctaaccttgacgacttttccactttccaaaagataacgacggcgttaaattggtctattttactgaaccagctttaaccagaattagattgcattacattcaactcgtgcttatggataaatatcagttcggtttggagaaaataggttacttaaggtaaaaagaacggcaagtaacggtgtgacgtcagcagaagaagtattcgttataatagtgagagagagagagataaaacttagggaacccttttttatgttttattttctcgctttgtttcgatcaagtcttctctttctctctctatccctctctctctggttcaacgggcaaagtatttttcgaataaagttttggttttttttttaacgttcctttcgccttctttcttcttcttctgctggtgaattcgtgtatctatctatctcgatgagctccacttttaatccagccgcttcttctccagatgaggttagtttttgtgtatcgaatctgaatttttaagggttttgttcttgtgatcagattctagtgaaattgagttctttgttgtttggctctgattcgaaacgaatttaactttattgaaactataaatttttgtgattacaattgttataaaccctaattttgctgtggttggtgttaatgttgagctgtttactgaattcgtgatttgtgagatctgggttctgtctgctttgtgttttacgatgattgcttttttagggtttctctgtttcttatcaaagtctggatcttttttttctttcattgag

SEQ ID NO: 15016 - DNA, 3000 bp, Unknown; identical to SEQ ID NO: 15003
  misc_feature (1)..( 3000): cDNA_ID_2685913_gDNA_ID_2684240_Annot_ID_137766 3000 nt of promoter + ATG

SEQ ID NO: 15017 - DNA, 3000 bp, Unknown; identical to SEQ ID NO: 15002
  misc_feature (1)..( 3000): cDNA_ID_2731384_gDNA_ID_2684240_Annot_ID_137767 3000 nt of promoter + ATG

SEQ ID NO: 15018 - DNA, 3000 bp, Unknown; identical to SEQ ID NO: 15001
  misc_feature (1)..( 3000): cDNA_ID_2731376_gDNA_ID_2684240_Annot_ID_137769 3000 nt of promoter + ATG

SEQ ID NO: 15019 - DNA, 3000 bp, Unknown; identical to SEQ ID NO: 11001
  misc_feature (1)..( 3000): cDNA_ID_2724771_gDNA_ID_2684240_Annot_ID_137771 3000 nt of promoter + ATG

SEQ ID NO: 15020 - DNA, 3000 bp, Unknown; identical to SEQ ID NO: 11002
  misc_feature (1)..( 3000): cDNA_ID_2731368_gDNA_ID_2684240_Annot_ID_137772 3000 nt of promoter + ATG

SEQ ID NO: 15021 - DNA, 3000 bp, Unknown
  misc_feature (1)..( 3000): cDNA_ID_2035675_gDNA_ID_2684254_Annot_ID_138074 3000 nt of promoter + ATG
agccagacttataaacttgcacgacaagacattcatccttttttaattaatgaacaagagtaacgacttttacacttctcttgtcacaaaattattgaacagtatttacaagtattttataaaaattgctattggttgatatttttattggtgcatgtcaagatatttctggcaacaatcattagaacgcgaccataacatgtgctgcaatttgacaattctttatatctaaaaaatgacaatttgacctcgttggaatcttggatttgtttctcccaagcacaatatgttcgagctatcgtaccatttctgaaagtgtaattataaagactgcaatcatatatgggctcgtggagctaaatcatggcctaaagtttttttttaatcaaatggattttgaacttgtggtaaagttttcggatctacgaaaaattatgcattcttaatcaaacctctaattcgataagacaattgttttccaacaaagaatgtgtcaaaactcaaaaactcttaacaattgttttgaatgttttccaataataccacatcggtttatgtatcaattaatattccaaaagttgatactcccaacgatattcctatgacctagaatttgatccatatctcaaaattttacgaccgacaaatatattaatgttcttttattttattttatatagattaatggtttagtcatctacatgtattcattaatacacctatatactgtaatattttcacgaaacttttaaacatttacaaaaaatgaagagattaactttgaaacggaagagtgttaattacttaattatgtatgttttgtttgtttgtcaacgaagagtattatttttttatatactaatatgaagacaaaacatataattccatgtcacctcgtaatctcgtatgttgtaaaaaaaatatctctatccaatagtatttcactacctagtttaaatcgcattctctataatacgttaccatattccccaaattacccttagctatgaccatagtcgctggctcgctgcaaaaagtgaaaggggtatataggtaaaaaaggataaattaacagagagaggaagggctttggcgtggaagctcagcttttctccgagtcgggaaaatgtctttttctcgaaagaataaatctttttctcttctctctgtgttaccctcttgaaattttccgcgaaaaatctcaacttttccatctgaaaaccccccaaaatcaaacaattggatcttgatttttagctgtgatttagtgattaagaggcttagggtttgtggcgaaatgttggtacagagaagagtaatgagttggagaagagtctggaagtcgtttcaagcggcttctgcgcattgtttactcttctccttcacgcttcttctcgctttgaagcttgatcatgttgtttctcattcatggtggtcagtttttttcttcttcttcttaaagtttccgtctttggtggcttgacttctgttttgtattgtgaaatgtttgaattgatcgattggattctcaattatgcaaattctcttcttgtaaaattggatttttttttgtcttaaagttaaactctttcttaggtttatcactttgaatctttggtgatgtataaagtagaagtagtatcttcaataccatccttaaaggttaagactttgatgtggatagctttcactcttctttaagtatgtgttgttttgtctgtttttacaggtttgtatttgcacccttgtggttgtttcatgctgtgattgctcgtggtagattttcattgcctgctccatcaatgcctcatgatcgacatgtatggcatttttatgattctcttgtttcattttgaacctttgattctttgttgtgtttaagtcctaacttggtcttgtggcagtgggctccttttcactcggttatggcaacaccacttcttgttgcttttgagatccttctctgtgtacatcttgaagataaatatggtattttccatgacttctattcattgaatcacggcatgtatgattggtgggtttattataggctttggttgtgctcctctgtttgcagttgttgacttaaagattgtctttctaccgttgcttgcatttgaggtagcaattttgatagataatgtcaggtattccattcaaagcttttttgattttgttcacccttcttactactcttagagtacggaacaattaaatcttttttgcaactattcctgcagaatgtgcaggacgctcatgcctggagatgaagaaactatgagtgatgaagccatatgggaaacacttcctgtaatcaaagctcgacaagtttaaaatatgatcccttatatttctcttttaacttgtctctgcaggttgtctctgacattgtctaatggttttgtagcatttctgggtttccatatctatggttttcttcattgccgcaacaaccttcactcttcttaaattatgtggtatgttacgcttttacttaactatcttttttggagttagtgatcttctcccttccaactgcaatcttataggtgtcacttccatgtccttagttcaacttaaaagattaaaagaagaaaagtaattttaggttgttatgatatctggtgactgcatgttctaacagttagcgtgcgtgtgtgtgtgtaattttgtaaaatcgactgcatactcataactgttgttctgcttcataatctctctatctcaatctgtttctgaatctgttatctttcgagtccttatataggtgacgtagctgcgttgggatggtgggacttatttataaacttcgggtaaactactttttctctttaagatcttctgcctcttaaaaatgtcttctgtgccaggtttgaacaatcttctttctcctcaattcacagaatagcagagtgctttgcgtttcttgtctgtacaaagtggagcaatcagtcaattcataggtattcacatataccggaacctagctcatcttcaatg

SEQ ID NO: 15022 - DNA, 3000 bp, Unknown
  misc_feature (1)..( 3000): cDNA_ID_2183105_gDNA_ID_2684254_Annot_ID_138075 3000 nt of promoter + ATG
aggtcggtcaaactttaaaccctataatctactcaaaaactataaacattataattaaaattatttgacaagcttttctctacacatcttcttttgtattgtcaaggaattcgtacgttacaatataaaaatcgcagcttctttcttacaaaagagttcaaattatatctgaaattattgtgaaccgtgtttttgccattgctggttttggtcatgacattctaatagagtcagatagagaaagtagcatccatcaaaattttcaaatacagtatatatatatatatatacacacacatttttctcataaataaaaacctaaaaatatacacataaatacgcacacgtgcatgtatatttgagtgtatacatgtcaatttccaatgtcgtatattagacttccatctaaataaactactaataaaaatttggtaaagaggaatatttaaggtaaaaacaagaattattaaaaacacaaaattaacttagagcttttataatgaaatgaaagtgctaggaaagcaaaagggctttttgattgcaagcttgagactaaggtcatgatgatacggccagcctttcttgagtctttggtcggtccgacaatctgtgtgttttgtgttcactctctgtttttctttcatttttttcttatagtttatttacttatatttcggttatagtgtttctcaagctctagctcatatatcctataactataaggggatgtgatttaaagcaaattttggaccaatcactatgaaataaaatattactaattttgatattttatttccctgatagctacactccttagttgagctttccgtaagttgaaagcaaagacgacttgcagagcaactttccaagttgcaaaccacacatccatctatagagacatatcatataaacaaatttatttaggaaaaatcctagaaattgtcaaggtttactcattagatgatactctaaattacacccataatatattggcttgctaagttgcaaactatccatacatttatccatatacatcgtaagaataatttatataggaagacctagaagttgtaaaatgtgtatgaataaattccaaatgaagacctagagcttgtaaaatataaattttaaatctagatatatatatatatataaaatccataatataaaccttttgtaaattatgttataagttataacaattgtaactttaagacgagtttactattagcacttgacactagtattttgcaagcatttaattttatgttaaattttgtttatttataggtgacaatatgggtaatccagtccaatttgatccataatgtttatggggtgaatgttaactaggtgaacgaagaacgtaagccatttagtaaataggttgaccatataaaatgttctagtttctggtatgaggggaggtaaatgcctattaatctatctaatttgatgggtcgaaaatcaaaatgataaaatagttctacccataaaatatttttgtaataatttatcacatattttcataattaatagttattacaatcggtatcatatgtgatacgttcattgtcttcacatcatcatcgcattatcatttttatcatcatcataacataacgatcatcatttcataccatctccattatcatcataattttgaaatcacctttatggcacaaaattttggaatcgtgcttttgcaaaacaaaacaaaaatatagttttctctgcaaaaatcatgtttttacgaaacattgaatatagcggaaaattgtggatttgtgtttttagcaataattattatgaaatacttttagctggaagttgcgaaattacataattcacgattcattgaaattcagtttttgaccaaaaaaaacaaattgtgaaattatatgatcatgatgatgataatggggtatgatggtgatgatatgataatattatgatatcatgaatataataagaaacgaatatcatttacttttttttttagtttttaacaaaatgtgggtaaatattggtgaatcataaatcttttacaatctaactcatttagcccattaattccttatggtcagaactcatttgccttatcaatataatagggtcataatatttagttatgaggatttgaattcggatgatgacataaggaaacattagtatcaattattagattacatgaatttggttaatatttgttaattagtatcatggttttatatcaacgagaaaacaattgaccaaaaaaaaaagataaccaaatcactatcctacacaatgttatgtgctctcccataactagttagtggtctaatagaagacaaataatcaattttttgttgatacctacaaatttgtaacgtatattatgtggtctctaatacctagtttagtgctatagcgtagattttatttatataaatcaattaaatctgtatagtgccgactcatatattttcgatgctctgaaacaaatttaaaagatatgtattatgtgtcattttgtatatataaattctttttgtgtctttttatatatacaaattatttttctgtgtatggatatttggcgatcgcattgcttgtccatatacttattagaaatagaaatagaaatagaccgtgaagtactaaatgcgtaaattaaaagatagataatctaaagaatcttaaacccattacctttttttttttacctttttaataattccaccacaacacaaaacacaagttgcaaactccacatatcctgcaaaccattggtaacaaacaaacgcatgagtttcctatatatgtctgcgtctacaacatttgaaagcaaacttttgtctctttttaactctcttaactttcgtttcttctcctaccttcttttaccaacctttcctttctcttacacacatatatatatacatatatagagagagagaagaggacaaagagttgaaagatgaagactctcatgtcttcatagaaacaagtgatatg

SEQ ID NO: 15023 - DNA, 3000 bp, Unknown
  misc_feature (1)..( 3000): cDNA_ID_2731454_gDNA_ID_2684254_Annot_ID_138077 3000 nt of promoter + ATG
cgtgaattactatttaaacataaaaattcaatgcaaatttaaatttcctttaaaagaatcaaaactagttcttaatgatttttttctaatactatacgaaatggtacttaacacatagataaataaatgaattcactaatagagtaatattgtacatccatattttattattattaataaatctgttttcagaattgcaaaatttctttctaataaaaaagataaacgcaaatatacacatcggtctaaaatcgaaatctctatgctagagaggagaactaattaatataaacatgtttaggtactaggttcaaaaatattatgaacctatttaagacttgcaagctcttggtaaaaagtaaaaacaaataatataccgatcataaaactgcaatctacgacagttttgactaccgccaaagctaacaaaatatcagccagtaggcaaaattttgacgcaaaaataagctggacagttttgtaaaatggtgtacatatgtcatatgataaagcatcttgcgttgaaaagacaaaatccaactctctcgcatctcttgagctttacattttgtcaactatatcatatataaatatagatgagtcctttcatactctcttctaaaccgtccaacaaaacctttttagtcttttttccaaaaacatacaaaacataaaaaaaaaacaagaatttagttttgtggcctattgattagcacacccatatgcttagaatttcttcatcatcttccatggccttgaaattttctcaaattctcttcatagttttatggctatctctcttctttctcctcctccaccacttgtactccctcaacttccgtcgtctctactctctaaacgcggtggagccatcattgttgaagcaacactaccgtagctatagattagtgagcagaaaagttctctccgacagattcgacttcacacctttccatagccgagataacagccgacataaccatcgttccggcgagcaatacgacggtgatgagatagaccctcgttacggagtggagaaacgccgtgttccctccggacccaatccgttgcaccattgatgattacacgtgtatggtatgtgttgtaacattaaagacaaagatcagatcctttgcctagctagcttttttttataaggaagaaaattaaacgttagagcttttttttgaaggtacatttctacaatttgggtgttcatacattttattttatttttcttattattttgacgattgtattcgtgaatatgttgatatatactagagatattgacatcttgattattgttttctactgtatgtagtaatgttggctgctacgtatattgattactagtaggagtattagtttaatagtataaataaaaaaagattggtcgttgattacaatgatgaatgtttaaataattgctttgactttgggattagccaaccagtagctgcgacggcacgtcacaactcagagatattctagatgcattattgtaccaaaactaaataacaataaatggtaatgaacaataataatttttgtttcatgtgacgaaaattaggactacaagtatatatttaattcccttttataatacgcaaacaatttccatcgatcgtcaattctcattttaacaaaatgtaattgcagcaagagtattgatttcttttaaataaaccagatcagagaaactcagccgttttttttcttacaaaaatatatagaaattgtaaatttgtaaagctatatcgtaaagaaaattggtttaaaacgttaaagacatttatttggtacgtctaaacatgacttgagacgcgtctaacgttctgtcttttcgatatgaataaggaaattgtcattttgcaaaagcttcactttctctcattctcaagatgtgccgactttttactatttgatttctacaccaactaaatattattataaatttccttttgataatgacatttcacataatgcaaaaagggactaagaatccaaaggaaatggtaaacggcctgattaacaattttgagtaaattaagtgcgtcttgtatcagtaaagataggatgaatttatgaaaattctaaggatttggagaagagtttctattgtttacgttccattggtaatgctaaaataaatatttttttatcaactcataaagtatactttgtgttacacaaataagtttatgcaataatgtaaaaatgagctgactcatatacgttcatgtttcagtcaattcaaggataaaactatctatgtttgttgaaactacgatttactaaatgaaaaataaattcatattatttgaacaaaaaaaaaaaaaaacccaaaagattctgttcatctaatagcctaaaagatttatcgtatttttttccataaaaagttattagatagataaataaaaaaagtcgcccttacacaatagtgtagagactcctgtagtggttgggtgtccatcatttttcaatggacccctttcagatacattaggttctgtgtggcattgtatttataaatttgtacaatgttttgaagaaaaagcaattcgaattagaacaatcaattactttacagaaacatactgtaatcaattatttcaaaaataaagtttattttaagcattatgcatagatggagttatctcgttgtgaataatacaataaaagaagcccaaaatggaccaataattaaagtggataatataagaagcccaataggcccaataatattttccaggagctaacgtcgtttgcaacttgcaagtagcaccgaagagttttgggggttggagagtgacgattacagagtagttttgtagcggaggagagaattgttcacgacggcgcgtgtcacaaacccacgaagaaagctttcaaatttgagcaatttgatttcacgagtcgaaagttgtgaaaatggtgttggtttctcgtcccctcttcatttgatgcatctgggtctctagggttcgaacggaa

SEQ ID NO: 15024 - DNA, 3000 bp, Unknown
  misc_feature (1)..( 3000): cDNA_ID_3609868_gDNA_ID_2684254_Annot_ID_138079 3000 nt of promoter + ATG
taaggggaaaaaacatcaactttattcagaacaaaaaatttttatgtaaatgaacaagtaaagatttaatagaaattgaagcatatatttacccttttcaagaattttatcagctaatcttgaaaacctatcactgcatcgatccgtagataattcaaatcttaagctatcaacctctcttatgtacaaatcaatagccatccatctagacaagagagatacttctttcgtgacctggacaaatgatatcacaacattcaagtgtgtgttatatatcaagagaatatgtgacaatcaaattttctgattgcagttttaaaagatcttcttcatcaaaaagtaaatgttaagaatctcatattacaagtgagatgtgacctagagtaatataataacgaccatggactaattttcattaccggttggttttgagttcaaatcgtaaaatatcaaaagactaacctttgccgtgacatttggatttccatctctatcacctcccatccaagaaccaaatttcataggagtgcatgttagtggaagtggcttccctgtaaactaaccaagaaaatacaaaatatcaatattatcttaagataaagtataacgattattcatatattctagatacctaaaggtaaaataataccttcttcaaggaattgctgacacgacgcaggtattgtggtactgctttccaaagggattgctccactatgtttagacctaaatgaatgaaaaagaaagagaaatagttttttagagtgaaacttttctgtactttacaattatatttaaaataccagctctagcttcatcaactggagtaggtttctgacgtctaagctcatcagtttgccacagtgaagtaatctctctaacctttaagtataagtaactcttagtttataagttactctgctgataaaatttatatggaagatattgagatggagtgtaccaaatcttcaatgagcgtttcgcgatcttcaacgcttagatctgatctagtgttatattctagaagatgctgcaagaaccatatacttttaactctctcaagtaaaattaagagatataatccatatatgttaacatcattagaactaacttacagcaattctaatatgcttgtactgcaaggttcttcgatttatttgggtaggatgagcagtaagaacaatttcgacctcctaaagcgcgataaacaaacaaatatcaaatagagaaaacaacactcagatacgacctttgtgttagataaaacgaattgaaatgtttctaaaatgatacaatatgaagtagctagacctgtttgcaaacagttttataaagttcgtctggagagattccactttgcaatagctggctgaatatatcatcacaagatcttgcaagttgtgtaacgttatggactttgtgcattctggaataaaaatgtttattattagaatccacaatgtttaagtttagaattatctattcatgtttattacttgtaatatttttgttgtaatgtgattacaaaaatcatgacctgtgatgagtgtctgcaatgcccattaagttaagagaatgagtgaatgtacgagccaacgttaaggcttcttctagtggcattttggatatttcactagtcaattgcttctccaaaaggtttgcggtatcctcaataccagccatacgcaaatttaacgcactctgaaacatttaaaaaccacacaaaaataagtcgtatcattcatatttgtttcgataagttgattgatctatatgactatatctcttattactacgatgtgagattcttatcaaatgatctaagcatatggaagcgaatagacagaagatgaaacctgagcaagaatccgaatgcgttcgactttttccatgaatgggttgccaacttccctttgtaacacatcatggaagagactaccgagcaatttgcagtcatcttcgaagctttggaatgagatttcctctgcgatatcgtctgttgtgtccgtcattgtatcaatgaacaaggtgaaggaatgaataattgcagtgatcaaagttaaatattttgaagagtgattatatatggtttgttagctatggtgcttaattactaattatggtggtcaacgcagtaaattatggcgtagttaaatttgtggtgctagtcatctttccccaaaaaaatatattcttatttcttaagctaattttcttcctttccaaactaaacaacaaaacaaacagttgatatattataattaagaagaaaagagaaggaaattctacgatttttttttttctttttttgggtaaaaattctacgaaaggagtaactggttttaactaactctgttttatctttggacctacaatttattttgtgcctctttggtgattgttattttaacatacattcttatgatcggaaaaaaaaactaaagtacagtaaatgacatataatttggctaagtcttactatctaacaaatgactactccttctattttttaagaaaacataataaatgttgattataaatacattattttttatgttttacagttttctataactcaaaaaacaatgataattaattttttttttttaattacaattcatcaatactaaccaataaatattgcataaaaaacttaaaaaaatcaatattttagaaataaattttttctaaaaaaataatcatttataaacagaaaagtatatgtatatgttattttttacataatcgttctcgttatggcaacatcataaagaacatatattatataatatcatctaaattttttaataaataaaatgaaaacaagtgcaatggaaaaagaaacagcgataattgtgtacagccaatcacaccgacacggcgacacatttgccaacacgtatataaacgcataaccgatacgacatcgttttaaactcaaattaagtcaacaaaactaaaacacgacaagaaagggtttcactgtgttcgataataatg

SEQ ID NO: 15025 - DNA, 3000 bp, Unknown
  misc_feature (1)..( 3000): cDNA_ID_2035675_gDNA_ID_2684254_Annot_ID_193069 3000 nt of promoter + ATG
gaggtaatcaattttttacttaaatcgctttttttttcttactttcggtgtatctactacgtgtgttgtttgctggttatggaaatgaatgttgtacgtcacgttatactatagatatatgtgtgtttgtgtgtatgtataacggaagtatttgtatccgttgtggtcttggacttttggtttggttctaagatacttatttttaaaaacttgtatcgttgagttggttttctagatatgcttaatgggagtatgtgacgaaaaaaaagtatgatttctgtaaggcaatgcatgggtttggaaaattcgttttctcttgtcatgtgggaggatttgaatttaattttggcttatttttgcaattgtgtgaatgagaccaaaaagagacaatgaagaagaacaggaaacgtaccaaagatgatgtgtatcattaattgatttagtcgggttctgtccgggggaaaaacaaaaagagacaaatttgggattctgagcttcgtacgttgatgcttctctgactcttttgccttgtgtatttatgtgttctgtagaatctttttcgtgtaacgatttacatatattcaaatattttgctttatataaatttgcatcatggactggtatgaggtaaacatcgggaccaagactaagatataaaggacgtagccaattagttttttaggttggtccatgaaatttaacatggtattctaaccagagttttattttgtaagtgtgttatgttttatgtgttgcacatgagcacgtccttgatcgaagtatttaaaatttgttattaaagaaatgtgtaaatttatagggatgataagtgattgtgattgagattggtcatgacgaggaacatacgtaattgacgtcgtatttgtgttaagcttgcatcatgaagtgaagtacgtcgacgttattaataattatgatcatttagtactacttacgtactattgtaccctaactgccatttcatttgtcttttaacatttttacctaagtgacggtcatgtgaattgtctagtagactagtactgactcctcttttggctttctctatagacaaccttgaatttaattttaatttatgttaattacgtcttcattatcaaaccaaaaacttagaagatttctaagttttgtggagacttgcaattagggctcagctggtcatgttgttagagcgacataaaatgagatgaattttattagtttgttggattctacaaagatattggactacctaccatttgcattgaaaagaatatcccaaaagagacttttggttttactttagggatctctttttattttattttatttttttataaagaagagagtattgggaaatctttaaaggcccaaaccaaagctcagccatatttctacagttaagcccagccatttttttaccaaagaatgctaatatcatttttcagcaagattttattgaatcattcaactctctaattattgattagtcgcggtattaaaattgtgcttccccttttggaaaaaaatagagtaactgttcaaatccttatcatcctgattcaggatattaaaccttaaatattgtttgtcaaactcaacttctatcaatcattttttatattgttttaatgttaaacaactgtccatctatcttatcaacaagaagaagaatttctagccagacttataaacttgcacgacaagacattcatccttttttaattaatgaacaagagtaacgacttttacacttctcttgtcacaaaattattgaacagtatttacaagtattttataaaaattgctattggttgatatttttattggtgcatgtcaagatatttctggcaacaatcattagaacgcgaccataacatgtgctgcaatttgacaattctttatatctaaaaaatgacaatttgacctcgttggaatcttggatttgtttctcccaagcacaatatgttcgagctatcgtaccatttctgaaagtgtaattataaagactgcaatcatatatgggctcgtggagctaaatcatggcctaaagtttttttttaatcaaatggattttgaacttgtggtaaagttttcggatctacgaaaaattatgcattcttaatcaaacctctaattcgataagacaattgttttccaacaaagaatgtgtcaaaactcaaaaactcttaacaattgttttgaatgttttccaataataccacatcggtttatgtatcaattaatattccaaaagttgatactcccaacgatattcctatgacctagaatttgatccatatctcaaaattttacgaccgacaaatatattaatgttcttttattttattttatatagattaatggtttagtcatctacatgtattcattaatacacctatatactgtaatattttcacgaaacttttaaacatttacaaaaaatgaagagattaactttgaaacggaagagtgttaattacttaattatgtatgttttgtttgtttgtcaacgaagagtattatttttttatatactaatatgaagacaaaacatataattccatgtcacctcgtaatctcgtatgttgtaaaaaaaatatctctatccaatagtatttcactacctagtttaaatcgcattctctataatacgttaccatattccccaaattacccttagctatgaccatagtcgctggctcgctgcaaaaagtgaaaggggtatataggtaaaaaaggataaattaacagagagaggaagggctttggcgtggaagctcagcttttctccgagtcgggaaaatgtctttttctcgaaagaataaatctttttctcttctctctgtgttaccctcttgaaattttccgcgaaaaatctcaacttttccatctgaaaaccccccaaaatcaaacaattggatcttgatttttagctgtgatttagtgattaagaggcttagggtttgtggcgaaatgttggtacagagaagagtaatg

SEQ ID NO: 15026 - DNA, 3000 bp, Unknown
  misc_feature (1)..( 3000): cDNA_ID_1989410_gDNA_ID_2684254_Annot_ID_193084 3000 nt of promoter + ATG
aaatgtgatttgagaaactaattaacgttttagatttagacttctctgtctttgacattttctttgcagcgttgatattttcttcttactaaaataagaatagtttattagttttagtagatttacctaagattataggttgtaatcgttaactaatattttcatataaagctataacaaaagaataattcattgcttattactgaagttctttagtttatagaccaataattgtactacttttgtaacctttaaattgtcaaatcctattttaccatacaaattttagtggaagattgtcttcataaatatgaaatatcatatcaatgatctttactcttttacacatcccattccaatactcttaaggacaccgttttggttaggacaacatctttgctctttttctttttcgttcttcttccttttttatgcaattatatatatttactcctgtttcattttctttttgctattctcttcccgtttttttttgttggtgtacattttgacttgattttcaatgaatccaaatgatcaaatgcttattttgttatcgtaaatttcaacgtaataccaaggatatctttaaacctaatttgtataactagaattatctttctataataagtggaaacactaacccaaaacccaaattttgtggtcggaccaaattaagaaattaccttataatatagtatagtttattcttcagcccctagctatatcttccaatcttattttttctcgcatacccaataatacatctatgtaagacatgaaataatacaaaaaacgatttactgtactacactcaattaatccattttatgatttaacattttctttctaaaactgttagtcgatctgagaaaaaaaagttgctatcttatgttacacaccattgaagagctttaattcttttagaatatatatagaaagatttgaacagagcgtctgttcaataaattgcaaatctcgaattgatgatgttcacatatcacatgtggcacagttataaaaaaaaacgaatcaaatgtctttggagaaaagagaacatgttagcaacttaggataataagtcacggacatctccacaagtaaatccatttttctccttggaataaatagaatccttatcgttaatgcactatggttttgtcctagatacaacaaagtataaaagactggtcctgattgttcataatttcatttgctgtttgtgttaaatgtgttatgcgtatcttttcaaatttaaaccataaccataaaaatttcagaaaaaccctattgcctattgtaaattgcacaccagggaaaacggaagaagaatatttcatttgcataaatcaatgttgtttttatatatatatatatatattttaaaaaaatgttgtttatattttttagaaaatagttattaaaattaaagatgttcagcatttaaaaattaattttagaatatatattttccacatataaacgcaaacacataattttaaataattgagaccctgccatctacaaccaaatcccatttttgataatatctacaagactacaactttaagatcctccacaaccaaatttgaaacaatttgataaaatcccattttttatcatgagaaatttgtagcatgttctaatgagtgttacctatatgttaggttaaactaccaaatattgatggtggtctaaatttgttcaacactagaatgaagatccatgttatctcgcctatatagaaatatgtatatgtagtcgtctgaaatatttaaaaatttcacattattatattttggtttctatttttgatttcttaaaaacttaattttttgtgtgttaattccatccaatatacaaaagaaaaactaagttgcagatgaaagaaaatgaatcaacacaagcgtagacaatggaccacacatacacacgcacaaaggcaaataaagacaaggtaaaagaagaaagaaaaagagagcaagtaagaccaaaaatggaaaaagaaaacaaaaaagaaagagataagaaaaactttgccctttggcatagaaatggagagggcaaagagaggagcccaataggctagtgtccaacacatgccattacctacaaaaccttacctgtcccttataattagctatcttctacctctaaccaactttttaagtactattatccatacatacgtacattagtacatgcacataagtcacgtaacaacactattaatatacataaacgacgtcactatgttattatattatgtcttaatggaattatcaaacatcattagtttagtcacaatattataacagctattggctcaataaactgcgttaatggatacaaatacaatcaatcattcaagatattttacgtaccagttatcgtttactttttttgatattttttttaatcatttttttttctttttaaaatagtaaattcatatcgtttaattaatatcgttttttaaccgttttaaaatagtaatttagtgagaaatgagattataggtttggaacagagaaaattcatattttattttaaagatctacaaaaattttattcgattttacggtttttgtaggtcttcgattttggaaaacagaaaatttgtttcttgtaaatttggttatagaattattcaaaggaaaaaaaaattgtataaccaaatttacaagaaacaaattttctgttttccaaacatagctaaacgagtttatctgaagaagcccaacatcttatacaggcccaatcttaatctcgaactcggtcaaatcaattttaccaactcaatcaaaccggaccggtttattttacgactcgctcttgtcttgtcttcttcctctgcaaatccaacacacaatttcatattcatctccaatgttaaatctcatcgaagatcacaataatggttcccttcgtttcaaaatgaaatttcaatagattcttctatgtttgaaacaaggtacctcttctaattcaacaaaaatg

SEQ ID NO: 15027 - DNA, 3000 bp, Unknown; identical to SEQ ID NO: 15024
  misc_feature (1)..( 3000): cDNA_ID_3609868_gDNA_ID_2684254_Annot_ID_193078 3000 nt of promoter + ATG

SEQ ID NO: 15028 - DNA, 3000 bp, Unknown
  misc_feature (1)..( 3000): cDNA_ID_3042149_gDNA_ID_2684254_Annot_ID_193059 3000 nt of promoter + ATG
tggataaaattgagtcagtttatgggaatgtgataaatgatttgactattgttttagaaattttacaatagtcgttgattgagccgaatctaaatatcgttagtagataaagacttgtcagattatatatgaacactttcttttggaaatatttggtttatagacccgtaacaagttcagacagggatcaagaacatttcgaaagagacaaagatgatgcatacatcgatatggacctgtttatttattagaacatgaaaatatatagtttttatttttttgtaaccaaaaagttttggaccataggtccgaaattcaaaacagagcaaagtcccctgaacacccccaatgacaaaattcgaacctgagatctaaagaacactctctttaggttatatttttggtaaaatatatttgattatattgttatagattcatttgagatgtttgtataccttggtcctcttctttaaataaacaacaaaaaaccaacaagcttacgagacgattagaaggtccagatctgatcggcctctacgctaagaaacctattaagcccgatctcaccaatcatcttcctcgacttggagttttcctctcgaagtttcatgttctcttctataaccttctcgtaacattccctggcttggcttagctcatcgactagagatttgttcttattgatgagttgaacaagcatggaccacagttcttccatgtgacgctgtttccgcatacgcgatctccgagctgactcgcggttcgataccttccttctccgcttcctctcattatcttctgcagtccggctagagtcgtctgacgtggcaggcaagtttgaaagtggtactcgatcaacaaagatttggaataaagactgtggattagggttttgacttggaaggttatagacagaaccagccatgaaaaaaacagttatgcgttctttaagaaaatttttgttgacaagtatgatggtatagatcaatgaaatgcactctaattttggtttttatagatgaataaatcgaaagtagtgttaccttacactaataactaatccaagtggctgaagcatacgtaaattttaataaaatagaaggagaagaaaaagagaagttctaatcgtgagattgatgagtcatgaagcacttgaaaggtgaaagtaagtagatggcatgaaggggaccattgcggagaaaatcaaagactatattataaattattcaaagaaagcgtgagaggtagcgactcgtcgacgcaccatgtttcttttcgagcaaccatatctaatttttttaagagcgtactttattttttttatatacgtaattattcgataatccaatggtttatgaaatttgtgggtaatgatgtagcataaagtgactttagtccttgtacataatttatagtgttaaagagttgacaatgaagaaattttaccaaaaactactatagttcctgaagcctaattgcgagagttgtggtcggatagctaaaatgtgcttttagaaattttgcattaggtaacatgtttttaccaagtcaaataaagtctagtgaatgaaaataatatcttatagctgggatgaaatatattggcaattttttttttggataaatactctaaatatattggtatttaccttcaccatttagagtgaatgtcacttggggttggggtatcagattggttaaatttgctttattaggcggtaatttttagtagcagttataaataatattttatctaaagtaaggattagaatattgatgttttctgctagtaaagaagtttcctagatccacttaaagccaatcatcttagtggcgtgatggtatcaaacatatatagatgaatgtttgaaaaactcgagagtgcgagacgcatcaaattgcaaacgagtctgttcatattataatgacatgttgaattatcttaataagacaattttagccatctagatgttaatcggctaactattttgctatagaataaggattcatccaataacatcaaaatatagccctgttattcataatttatgtaagaagagaaaatacttttctatgacaattaagcgaattaatccattagctgctccaaggggtaactaatgaaagtcaattaaagcttcaagtgacgtatcacatactcacaatgaaacacttattttgctgatgttatggaccattatggttttattgattagaaagcaaatattataatgtgaaactctagtggtagagatttcttgcttgtcttttactagtttccagctactcttgttttgtccgttttggctattccacgatctacaactttcgggttcatatcaatgtccaagaggatattactagcaattcctcctatgatgtgaaatcgtctagtgccaaaaatatatcagttttaaaagcattggtttaacttaccaagcataaagtaatgaagacattacttttttttggcacaaactcatagaaaagtattatctatgattcttcaaaataaaacccaagtagttttatgagaatttatattttgaagctttgtcatacaacaacttgttgtgataaacaaccaactagattttaatccgcggtacaccgcatgacaatttattttaaaaattagtttatataaaaatttgtaaattatatttatttataaaatttatattttatagtttatatttattattaagtgaaaatataccataaatttatgagataaatattaataaattaaagatttaacccatatgttaatatttattttgaaattatataaatacaaaaataaccgaacggttattgctttagaccgatttcgtaaacaattccacaaacgaaaaacaaattcgtaataaaggcgttgtgggttttggttaacacccggtttgtaacggtctttgcgccttatccaaaaaaacctcctaaaaccttctcaccagccattgattcacaatctcaaaattcatcacagcgaagaagatg

SEQ ID NO: 15029 - DNA, 3000 bp, Unknown; identical to SEQ ID NO: 8365
  misc_feature (1)..( 3000): cDNA_ID_1989412_gDNA_ID_2684254_Annot_ID_138082 3000 nt of promoter + ATG

SEQ ID NO: 15030 - DNA, 3000 bp, Unknown; identical to SEQ ID NO: 15026
  misc_feature (1)..( 3000): cDNA_ID_1989410_gDNA_ID_2684254_Annot_ID_138084 3000 nt of promoter + ATG

SEQ ID NO: 15031 - DNA, 3000 bp, Unknown
  misc_feature (1)..( 3000): cDNA_ID_2729691_gDNA_ID_2684256_Annot_ID_138085 3000 nt of promoter + ATG
ttaggctctttgcattgcagaaagaagaggcttggaccttaggtacagttagaattggaaagaaatggttaggacatggattgaagaaagtcaaagagtcagaaatcaaaggtttggcggatagtaactctaccttgagtcaaatatcttgccacagaaaggcaggcatggaaacagatcattggtataagatcttgcttagaatatggatggaggacgtgctaagaacctctgcagatagaagcgaggagtttgtcttgtccaagcatgttgtagaacctactgttcctcaagaactaagagatgcgttttacaagttccaaaacgctgctgcggcatatgtttcatcagagacggctaatctggaagcgcttttgccatgtccacaatctcatgatagacctgttttctttggtgatgttgtcgctccgactaatgctataggaaggcgtctttatcgctacggattaataacagccaagggttatgctcgttcaaattctatgcttattttgctagatactgcccaaataattgattggtattcaggacttgttcggcgatgggtgatttggtatgaaggctgtagtaattttgatgagataaaggctcttattgataatcagatcagaatgtcatgcatccgtactttggcagcaaaatatcgaatacatgaaaatgaaatagagaaacgccttgatttggaactgagcactattccctctgctgaagatatagaacaggaaatacaacatgagaaactagattctcctgcttttgacagggatgaacatctaacatacggcctttccaatagtggtttgtgtttattgtctttagctcgattagtgagcgaatcaaggccttgcaattgcttcgtaattggttgttcgatggctgcacctgctgtttatactttacatgcaatggagagacagaagtttccaggttggaaaactggattttctgtttgtattccttctagcttaaatggaaggagaatagggctgtgtaagcaacacctcaaagatctgtatataggtcaaatatcacttcaagctgttgattttggagcctggagatgattactactctccacgacaagagtcttgcaagtgtttgattcttcctaggtcaactctgattcgttttaggcagttgttgagctttgtgtatctgatgtctagcaaatcatatgtccggtgattatcgttcttcaaatgttttaatttctagaggccttgtgcagtagcacagtttgcataccctcagaacataaaaccatggcattagctggtctaatgggaaaagtctaggtgaaatggtctcattgacattcacaatataacttccttcacttttgactgtatcttccaatgcttagcttcttgaatttttctgatttttttctcacaattgatttgcggtgctgcaggttttgaacttgacaaaatggaattagcggatcgagcagtcgggcttctactatcttcaatcagcttgtccatattcacgtactatactttttgggtcatcatcctggtaagtgacaacatctcccccaagttccttaaaaagacattgtcagtttgatgtaccaatgtcatctaatgtttaggatattactaggaaaaagctgacataatagaattttcgttttgtacagccatttgtagatagtgatcacttcatccacaagtacttcttaccccaagactatgccattctcgtacctgtctttgccggcatagctcttctctctctcatttccgtattcatcggcatggtcatgctcaaatccaaaaagaagaaggcttaatttcattcaactcttgccgtaagacaaagttctgtccttgtttcttaagttgtccctacattgttttggtctttcagaggtttagtccggaaactttaaatgggtgtcgttgaaccgtacgagactatatcttattgactctaaatacatacacatgttaagctcaaataaattcttgagagaatatatactaatgatgatggattttaggctccctgacaattcaactaaaaaactatttacagaatatacgaatgatttagatgaatgatgcatttcacgaatatatatatttgtttcttattttgtcttttgtgtattctccatatggcagttactgatctattttcttttctggtttcgtcttttttagagagaaaaataaataaaattgactgataggaattcagtttgttagcaatataagcaccttaaatcataattagtgcttttgaaagttgagaaacagatatattatgaaaaatatcagtagtagtagtcatcataggctaagagctggcaaagcattagagacacaagtgagttttctctttgcaattattctatgtctgtaatgaattttggttttgacttatcttatgaaatttaatcatagttttagctttttctaatctcattagcactacttagtgcttatggataaatcatttcaagtcatcttcgtacaattaataaaatcaatagcccattcacttgtactgtactagagaccaaaacttaatacatacaaccaaaaatcaatttccttttttattttattttccaacacgctttgaattctgttctaccacatttgtatagtcaattctttatttcaacaaaaaagctgtcattaactatttgctaaaataggtttcaaaattttggaaggtgtagattcgtttttttggaccagactaataaatgcatgttttctttttgaagtaatgtaccgtcttcttctgataaaaaagtgaagagcctaaaacattctcttctgaaccttcattataaaaatatatacgaaacctctcaagttttcaggagattcactttggttccggatccgaattacggcgacggatcttatcgtgacggcgccggaatatacggatacgaaatcagctagtcacttgtggtggttgtgaagttacgaactaatcggaattctgttaaaaatg

SEQ ID NO: 15032 - DNA, 3000 bp, Unknown
  misc_feature (1)..( 3000): cDNA_ID_2994977_gDNA_ID_2684256_Annot_ID_138093 3000 nt of promoter + ATG
tatcttgcgtcatctgcattcacttggagtgatcaacaaatttgattcctttcttctacattttcacaccaaatcgcttaaatctaaccacactttgaagcaatatcttgaatctggggaaccaatcaaagctcttttagatttccggcaccgattcagacaaagtcctagttttgttgacagtttttctgttttgtttgccattaaagtttcgtcagctcagaaagcttcctcacttgatggtagacagatccacgctcttgtaagaaaactaggtttcaatgccgttattcaaattcaaacatctttagtgggattctactcttccgtgggtgatgtcgattatgcacgccaagtgttcgacgaaacgcctgagaaacagaacattgtcttgtggacagcgatgatttcagcttacactgagaatgagaactctgtggaagctattgagctgtttaaacgaatggaagcggaaaagatcgaacttgatggagtgattgtgactgtggctttatcagcttgtgctgatctcggggcggtgcagatgggagaagagatttattcgcgtagtatcaagagaaaacgaagattggctatggatttaactctgagaaattcacttcttaacatgtacgtgaaatctggggaaactgagaaagctaggaaactctttgatgaaagtatgagaaaagatgtgactacttacacatctatgatcttcgggtatgctttaaacggtcaagctcaagaatctttagaactcttcaagaaaatgaagacgattgatcagagccaagatactgtcattactccaaatgatgtgactttcatcggcgtcttgatggcttgtagtcacagtggcttagtagaagaaggaaaacgacatttcaagagcatgattatggattacaatctgaaacctagagaagctcatttcggatgtatggtggatttgttttgtcggtcaggtcatttgaaagatgctcacgagttcatcaatcagatgccgataaagccaaacacagtgatatggagaacactgctaggcgcttgcagtcttcacgggaatgttgagctcggagaagaagttcagagacggatctttgagttagatcgtgatcatgtcggagattatgttgcgttgtcaaatatctacgcttcaaaaggaatgtgggatgagaaatcaaagatgagggatcgtgtgaggaagagaagaatgcctggtaaaagctggattgaactcggaagcattatcaatgagtttgtctcaggacctgataataacgatgagcagctgatgatgggagagattagtgaggttttgagatgtttagtttcttgtatgacaagttttgattgtgtaatagggaaaaaaatgtagaccaaaagagtctagtggaagttaatcaaagcccacttgtaggagcctgtggcccaacaaattaaatcaaaattgataacttaaataattttaagttttcacttttatcaaaaaggggcctgggaaaaaaacaaatatcaaagaaagcccaaaaaagacggagaaatcagatttttttgaatttaagaaattaaaaaaaaaaaaggagagctccgtcttcgttgctttttcgagcggtgcctagtctcaacttccatggctgacatcttaccttcaaattttctcaaaccaaccaaaaagcttcttctccttttctaaaatttcatcaaaccctatagggttttctcaatacaattgattttttttttcttcttcttctctatggatacgaccctttctcccgccgtggaggcggaacaaatcgccgactcaacgatcgacactgtttctcgtttgatcgccggcgttttctccggcgcacttactggaatcttcgctatgggtattaatatgttttgccgttttgatcatcttttgtttgtgcatttgagtagaggaaagttttcccttttgtgagaattgtgacgattttgttccctctaagttgttcgtttctatccttttggtcaactcttgatctcttgcaacaaatatttcttgtgggcctgcaaattttgtgaaaaaggttacatttttctgtcttgagagatttggttgaacatcgttcagatcattagtcagattatcatacgtgttcaacatcttacagctaatgattttgaacttaattctcactttttagaccaatcctgggtttaagattaggaaagtgtgatgttgttgtctctaggttatttgaataaatcatcgtctctgcatgatccctataaaccattttgttttttaatgttattgtagctggagcttttactggagctgtaactggtgcggtggcaggaagagctgcacagtatggagttctccgtggggctgcacttggcgctgttgctggagctatcctctctgttgaagtgttggaggcttctcgtgcgtattggtatttagagctgtcaggatcaaggggtccatcatctatggttagtctttaattctaacttctgtgcaatcttacacgtttgtcaattttggagatggtttttggagtttttcgactgactttatgatcgagatggtgaaatgattctgagagaaatgtagtttggtggaagaaataatgagatagttttgacatgttactggtgggccaactaaattatgggatgacaggatggcttggtttagtcccttggtaatggtaataggaatgattttgtgttgctaatgccacgaggcagtctaacaaaggatttttagctcgacaaagtctgagtctgttttttttaattgttttttttctgtgggaaggacttgaaccaattgcacggtgtttttgcaatgctggacaagtggacagctctgtctttttttccacctactgccaaatttggtagtgatgactgtttaagtatgagtaagctgagcccttggtatttttgttttggatacaggcagattttgtagagcaactgtttcgtgggagactggtagatgaacaactt

SEQ ID NO: 15033 - DNA, 3000 bp, Unknown
  misc_feature (1)..( 3000): cDNA_ID_1989204_gDNA_ID_2684256_Annot_ID_193146 3000 nt of promoter + ATG
acgctcactcactcctcctatgcctccttagacggcgttctctataaccaactcttcctcgaaaaaggaaactatcccaaagtcttgattatctcttgctgtatgatcggggaaagaaaaatgattttcatttacaatgggttgtttccatatcagacatgattttctttcagttgaatataattttgtttagttttaccttaataaaaactacaagaaataaccaaacatcccacgaattggtttaataatttcaaacaaagaaatcaaaaacataccgaaagactctcgagacgattataccccacagaacaccaattagatgagataacctcccaaaagatgactaagccttgcggctaatgttctatgaggtgtatcattgtctcgaaactcttttcgaagggttttgatttctttgcttgaaattgttaaactaataagtgcgtggaatgtatacgtgaaggaatattaacatacttgtgagaaattatcagcatatatgtcaatataaatattatatgctatgagtctatgacaacgaatatatatatatatatatacatggttaattaatatagaagataaatcagaaaatatgataattttctactttttagggtgtttagtatgcattcccacgtgttgaatatgcatgatcaattacaaaataacacgacaagtggaacaattatgtgaatttgaatatagtcatggaagattgtcatttattattgctaatttcttttgaaacatacaataaagcaaaacacctaagttcttttgctaatatttcactttttttctttcttttttcaatataatcaatatttcacttttttttatttattaatggaagattgtcatttattttgcgatttatcatgtaagttcaacatgtgtgaatgcatactaaatcccataaatatatgttttgctatgtttatacattttaattcatggatataagaaaaatgcaatcatatttattatttctgatttgattaaacatgtgtcaatgtactttccataatatctagtggaaattggccaacaacaaaaataaatcttacttacaaaatagattcccacagatgttattttatttaaacaaaatctatgttttaatacatttttatatagatatactggatttatttatatcattttccatatttctagttagtggaatatgaaaataaccatgttatttaattattatcattaaattatttgataatatcattttaattgcttaataatttaaatatattgatttcccttaaatatatccaatcttttgtaagaaaagaaatttaccctgaagtttatcacctaaaatttagcatgcttgtcttttaagggttgtcgaaaacaagtttacatagatcttcaattattaattaaataacataaacttgtgtttgtaaactaaaatttagatctttaagtttctgttatttaattaatatttgaagatctatgtaaaaaaaaaatttccctttagattttttgaaccttgttaaatcaaatcatttataataattatttaatatttcaaaatataataaaaacttataaaaactagttttatacttattatctgtaaaagctagaggaaacgaaggaagaagagaagaatcatgctgagattgtgagtgttatatgttgatttagtattttaatcatacatataaccaaatgttgtattataatataagaaaccaaggtttgaataatattttcgtggtcatgacagccagaagtggagaatgtactcacaattcatgcacttccaaattgcctacactattttcctccttaattttgtgcatatctgtggggatgtcattcgtatccggcctaagttcggtctactctacatcctttttattttaatcgaagtgctactaaaacatctttgtccatccgacaagattctttgcagctttgtcgaatttttaagccattttagtggagctatcactatcgggctggtgagctcatgttgtaatgtcttattttattgtgttggtataccttgggttttgtttgccttcatactctttgaatgtcttgttactgaagactgaagaacctaagacgcatacaggctcttcaagagggaaattttaaaccatttgcttgtgaatcgtgttacatatcttcgtttttagcatattttataagctttatagtttgtctttcttggactaccatggctttcctagtctattatatatctatgtgttatatgaatctcatggtggattgatattattaaatgaataatgttttctgtaagctctttatttcatccaagacatttttcatatctatattgaaactgaaaggcttccaatcgctaaggttttctatgaacgagttatctcccgtttgacaatatgtttcttcttctttgaagtgtcgtttaaaagaatctacaaatcctttatcacttcattaattccaaaagtgtcactgtttttatcgatgtcaatagactgattgctttttgctttcgtattcgttttgccatgagatcaaacaattgtaatttctaactatgaacaaaaaagaaagatattttagggtgcccttcataaatttggaaatagtcttcaccaattgtcctgaacagagagaaatgggtatcaagtcaactctgaacactctatgactaaaagaaaaaatcattcacctcgataccagaaagaagaaaagtcatcgcttttgggaaatttgatgaacaaagaccaaatcttaaaactcgaattcttctggttcctaaaaagtggctgtcaagaagagtgagacatgcatcaaactctctcttctcctgccatggcgtcaaacctccggaaaccctatttcctcaggtacttaactattcttccccaatcgatgatggtcgaaagctgaaacctttttctgcaaatcgattaaccgacaagaaaatccaacccaacccacccactttgttttgtttggatgataaaa

SEQ ID NO: 15034 - DNA, 3000 bp, Unknown
  misc_feature (1)..( 3000): cDNA_ID_4254758_gDNA_ID_2684256_Annot_ID_193144 3000 nt of promoter + ATG
acgacgaccttggttttctttcttcgctatctcagtttttagtcaggatcgtactgtagagttaatttcatcattgtattataaaaattaacctaaaagacaaaagtgtaattaggtctgcttttatatatttttaaacggactaacaaatatgaaattacgaataaagagagagatagaaagatgagagactattgaaaggactctatgtttctcaccaaccgtgccctactcgtgtagtttagagtcatataaaccccttaaaaattgacttattatttgttgatttatatacatattagtcaaaatgttgtctttccaacataaattggtgatcaatatcagagtgagactagtaaattgtttataatctcatgtttgattgtagatacacagatatttatctaaactagcagcaatgaaaaatcagaagattaaacgtgaaagggcacacaatgattattaaacaattgactagaattaattaaaacactaactaatatatgggaaactaaacatcaaatctacttttttcagtgtccctctgtctgtcacttgtggaaataaaaatgaaaaatcgcaaaattaaccaaacattaaacctttttaatttgattatgttactctttgtctatgtttccatatgtccccttttcaccgtttgggtgatatggatatcttaaaaggtattgggctttactgtcctctctttcagttctttcggccttcttcctcagaattattatatcaataaaattcattggatcacacttcggcttgggcctttgttcattcatgaacatcttatcgagtggtatatttttggtaaagggtttatcaagtaagatttcttaaaactacataaatcttctatccttaaccaatagtaaacaaatattcggaaataactctaaaaatcataacgataaacaatcatatttgttggaacccatttaaatttcatgacaacaaggaataagaaaaaataattagtataagcttaaaagttatgaaatttcgccgtgaagtaaataacacaatgaacaaaactaacgtggttaaaccatctccatcaatggtttctcattgagaaactgtttaatataaaaataaaatataattaaaatgtatgagagagagtagaattagtctctcaaatgagaaactctgagaaacccataagaacacttgtatatttggtcaaatattattttattattaaaatttaattatataactaatatttattaaaatactaatatttcttttttttgagaaaccaagaaagtatctcactgatggagatgcacttagtataaaattcaacgttggaataatacaaaacgaaataaattaatacttatagatttcagcttcctttttaaaatgcttagattgataaattttctacttttttttcggtgtgccagtctttgtttcagtttcagtgaaagagaaaaaggttatctcttgagcggtgtaggaaggtgaagtaataaatgaagaggatacatcaatcgagtggacacgtacttgaagttgtctgatccacttcaactttgaattgtgagtgtcgtaacaagatgccgtatctattaaaacgttaaacacaaacaatttttaatcacaaatgctattttattggacgaccaaaataactaatgaaagaaaaaactagtatcctgttactagtttgacaaaagttattcagagatgaattgtctgcatgttggtttatactacgtcttaaaatttatataaagatattaaactttgtcatggatatagtaattgtgtatccacaaaatgcaaagatagaaaaaagtcgttatgtttgttgaaagcattagatagatatatgtctcccatgtgagtgcacatggagttatgcatgcacgaaaactgcctctacccttttgtctctctctcgattcttcaatcaattccccaccttaagtttgcatgatctctatatccacctctgagatctagacacgttgctcctcctcttcatcgaacggttctctttgatcatcttgctaagagataagaggaaaagtggcataaatccatgccgagattgctcttatcggtccctttatttgttggttggtcccaatcacttgcactggatatgtaactgtttctccatgttactccttctcttttaccaatatacccttcattttcttcaatttgggtgtagtcccaaatgtgactcttttggcctaattgtatcaacttgtttactttttcttatatatgttcatcaatgttacgacgaatgtaaaaaaaaaaatattatttggaatttgataccgaatctcgacactattagtatattattggacccgtcatatgtatttatcaccagagagatgtgagttttacgatacatagtttttttctttcatctgaaaagaaaattaaacacatgtaaaataatttctgcctgtagtcttttaatcactgaagtaactcgaatttgatgttagataattttttcacaaaaatattcaaattcaacagattaagttgttgatgacagatagctctctgggaggaaaaaaagaagaaaagataatggtccgtattaatatagttgaaaacttgaaactactttttagtttgtatataatacagtagactagggatccagttgagtttctttctttattttgagtttgtgtttatgtttgattttacgtttttatatgtaaataagatattttacgaattatggttttatttgggtagaagttgtagaatgacttaaacaatcaagtggcagaatgagatatataaagtaatataatatatgtaccgttattaacttattgtacatgtgaatgaggaagcttacacacacacaccttctataaatagctgacaaaactggttgttacacacaacacattcataaatctctcaaagtaagaactaagagctttactacagtcctactctctacacatcttctctctctctcaagagctagtc

SEQ ID NO: 15035 - DNA, 3000 bp, Unknown
  misc_feature (1)..( 3000): cDNA_ID_4266672_gDNA_ID_2684256_Annot_ID_193136 3000 nt of promoter + ATG
aggctttgtaatctcagaacaacaaaaattctacaagcccatttgcttagacgatatcttctgccatttgatgttttccttactaaatcattgcttagctggtactcaaactcgggttccatggctgatgcagctaagttgttcgatacaattcctcaaccagatgttgtttcttgtaacattatgatctctggttataaacaacatcggttgtttgaagaatcgttgagatttttttctaagatgcatttcttgggttttgaggctaatgagataagttatgggtctgtgatttcggcttgtagtgctttacaagctcctctgtttagtgagctggtgtgttgtcatactataaagatgggttatttcttctatgaagttgttgaatcggctttgatagacgtattctctaagaatctaagatttgaggatgcttataaagtgttccgtgactctttatctgctaatgtgtattgttggaacactatcatagcaggggcacttagaaaccaaaattatggtgctgtttttgatcttttccatgaaatgtgtgttgggtttcagaaacctgatagttatacatattccagtgttttggctgcttgtgcttcccttgagaagcttaggtttggaaaagtggttcaagctcgggtgatcaaatgcggagcagaagatgtatttgtttgtactgcaattgttgacttatacgccaaatgtgggcatatggctgaagctatggaagtattctcccgtatccctaaccctagtgttgtatcttggacagtaatgctgtctggttacacaaagagtaatgatgctttctctgctcttgaaattttcaaggaaatgagacactcaggtgttgagatcaacaactgtaccgtaactagtgtaatctctgcttgtggtagaccttctatggtctgtgaagcaagccaggtccatgcttgggtctttaagagtggtttctatcttgattcctcagtggctgccgctttgattagtatgtactcaaagagtggagatattgatctttctgaacaggtttttgaggatctggacgatattcagagacaaaatatagttaatgtgatgatcacttcgttttcgcaaagtaagaagcctggtaaagcaataagactgtttactagaatgcttcaggagggtttgagaaccgatgagtttagtgtatgcagtttgttaagtgtattggattgtttgaatttaggtaagcaggttcacggttacacccttaaaagtgggttggttcttgatctcactgttggaagttctctttttacattgtactctaaatgtggtagtttggaagaatcatataaattattccaggggataccttttaaagacaatgcttgctgggcttccatgatttctggtttcaatgagtacggttatctaagagaagctattggactattcagcgagatgctggatgatgggactagccctgatgagagtactctagctgctgttctaactgtgtgttcttctcatccttctctgccaagaggtaaagaaatacatgggtatacgctaagagcgggaattgacaagggaatggatcttggttctgcactagtaaacatgtattcaaagtgtggctcactaaagttggctagacaggtctacgataggctccctgaactggatccagtgtcatgttcatctttaatttcgggatattcacaacacgggttaatccaggatggcttccttctatttcgtgatatggtcatgtctggttttactatggactcctttgcaatttcatccattcttaaagccgctgctctctctgacgaatcatcgctgggagctcaagttcacgcctacatcacaaaaattggattgtgcacagagccttctgtaggaagctcactactgacaatgtattcgaaatttggaagcattgacgactgctgtaaagcattcagccagatcaatggcccagatttaatagcgtggacagcgctgattgcaagttatgctcaacatggaaaggccaatgaagcgttacaagtgtacaatcttatgaaggaaaaaggattcaagcctgataaagtgacttttgtgggagtcttgtctgcttgtagtcatggtggtttggtcgaagaaagctatttccatctcaactcgatggtaaaagactatggtatcgaaccagagaaccgacattatgtctgcatggtcgatgctttagggaggtcaggaagacttagagaagctgagagttttatcaacaatatgcatattaaaccagacgccttggtctggggaacattgcttgctgcttgcaaaattcacggggaagttgaactcgggaaggtagctgcaaaaaaggctatagaattagagccatcagacgctggagcatatatttcactctcgaacatccttgcagaggttggtgagtgggacgaagtggaggaaactcgtaagctgatgaaaggaacaggtgtacagaaagaaccagggtggagttctgtctgatgttatatatttgtgaaaagccgtgaggtgcagaggtcttgcttcgagttaatgatgaaggaacagttgcaacttgaaactgattagagattaaagttggaattgctttcactgtaggagacagctctaagaacaaaaaattatccctcttgaatggtcttttttcaatagtagatatttcgtaagatcattccagagaaaattcgtcgtaaaatagttactaatttccattttcttgggcggcagtaaagtcaaagataattcagtttttatctcttggctctgttccatcaatcttgatcatgaaataaacaaatcgttaatgtaatattaattggaacattcaaagttttgacttttgaccgaataataagacaatgccccttagtctctataaaacaatttgaacaatgaagcacaaaaatcataatccccaaagagattttaagaaaaaggtgtaagaaataaacaaccgagttttgagatatg

SEQ ID NO: 15036 - DNA, 3000 bp, Unknown
  misc_feature (1)..( 3000): cDNA_ID_2729634_gDNA_ID_2684256_Annot_ID_193131 3000 nt of promoter + ATG
atattgactcttttatttccatatataatagctacatgttattgtatgaaactatactcaaccatgtctcaaatcttgcaatgcctcttgggttttacatagctacatcttcgtgtccattatgagagtcttcatggtatatggattttgattatcttatcttatgtgtctgattgtttatctattttaatctaaaggtaaaggtattgctcttgcggcagctctcggcaaagctagagcctgcaatggagtcctcatgttacaaagcaatccaggattctcgctcatgtcaatcctctctccaggaacaggggaactccatgagaagcaatgcaacaaatttcccatcaccaatgtcatcaagttcatgctgagctgtgccgctggacacatccgtcttcctgatccaaatggaagaaccctaaagtctcgacctttaacatcggtttcttcctgaaggaaccgctctggtctgaactcatatgggtttatccagtttgcagggtcccgcccaatcgcctgcacattgacataaactgtggctcccttaggaaccttgtacccacctacccaaacagtttcacttgctttgtgtggaagcattaatggtgttgacgggtgaagccggagagcttctttaaccacacattgcagatatggcagtatggggatatctgattcagtcattaacctttcggatccaaccacagaatcaagctcctgttgcgccttttcttgcacggtcgggcatttgatcatctctgccatagcccattcgataacaactgcagttgtgtcagcacccgcggttaacatgttccagactagtcccccaaccgtctcttcgctcagctctttctgctcttttaacaccaacaatttccgaacaaatcccctgtgatcctctatttctatatcttcttccaccataatagctcctctaaaccactttgttctccgatccttgtgcgctaagaattccttatcactaaagaaccaagaagaaacccatttgagccaccagacgtgatcaagaatcgtccctgagccactgagaagatgttctttctcaacgatggctttaaactcttttccttcctcagacccgaactctttccctatcattaaccttgagatggtattcaaaacaaccgcagctaggtacttcctcacaatcaccggttttcgctcctgatcatcccctgaattgctcattaagtccttcagaatcgacacaaccatcgatcttgcttccatctctctcaaggacctgaaattttcgatgcttttcagagagaagagctcgagtgtacagagtttcctcagtttcacataatgtggactgtaatcggaccaaacaagatcagtaccggtctgagtcatccttgcgatcctgtgtcggttagacaactgatggtctttgtctctcaacacttgtctggctagatcagagctcgagaccacgacagtgagctgtgaccctatccacaccgatatgataggaccataagtctctgaccactccgagaaagaatgcgtccaaagtggtttcatttgatgaaggtttccaagcagaaactttggttttggtcccggcggtatgttggatctccaccatcgttgataaagcatgagggtggcgacgatgatagggagtaatgaaattagatatataatcatttttgcttcgacgatgtgaaacaacagttattgatgtaagtttgatgtacattgtaacatctaccttacactgaagtttttatacgcaaactgtaaaacatagaagaaagtttttgatatttacttacgtaagtgtagagaaacacaactttggtatgcgcatgaaaataccatggtttggccccttaatactctcacactttttgcattttctgtttacttaccaaaactatttcttgtgctttagttctcatgttggacatttgtgaaccaaatgtagaatttatggattaagaattgtcatttgcatataaggtgtgactggactttggttttgataaattttatgagcatgaggttatatgcatacatagcaaatctagaagtcattttgtattctatcatggattgaattacagtaaatgacaataatacataatcggtttagtatgatttaatgttggttgtggtttctagctcacgtatatatttggtttagtattataatgtaggagagggatttttagcacctctcgggttctccggcagcccatgagccaaaactcgacgagttctacaccgtcccacatgacaaaaagaaaagaaaaattaactcgaatctaatgagataaaataagaatccaaaaaaataggaagaaatggagattttatataaatagagaatcacatctggttgaaatcctccttaaatcccactatgtttatcatccgatttactccttgtgatatcataaaaatgtgagtatataaaggatagcgacaaggaggttggtcattttctgtttttgcctatgtaagttttctgaaacatacttgtctgtattctctacacaaactcccacctcgtagtagaagaattatttggtagaagaccatcaccaatcatcttcttataaagatgagttcaagtaagtttttcttcctttcttaatgttttgcaatgctacaattagtagtagttcttggacataaggaagtaaggtatgttgccacaacaacactcactaagcccaatatgaccacgaatgtagaatggtgtgttattattatacggatttaaacggattcgaaattttggtgaataaggttaacggaaagtgttatgcagtttattgttacataatttttttttttaattcaacataataaataaatattgacagaaaaatatgatgaaatcgagtggcaaaactagatgtaaaatagccacacaaaaaaaaaggaaattaaaacagagcttgacgttaatggagaaaagactaatggagtttcccaggaaacaaaacaaaaggagaaatg

SEQ ID NO: 15037 - DNA, 3000 bp, Unknown
  misc_feature (1)..( 3000): cDNA_ID_2686032_gDNA_ID_2684256_Annot_ID_193130 3000 nt of promoter + ATG
aaaactagatgtaaaatagccacacaaaaaaaaaggaaattaaaacagagcttgacgttaatggagaaaagactaatggagtttcccaggaaacaaaacaaaaggagaaatggcgacatcgacaacgtctgcgattagggcaccgaattggagaaccgctgtgttgttctggaccatctctctcactatcttctactctcttttccaaatgggtattcgaaattcgccatccacttcatctccttcatcaggtaaaaatcatttttttaagctcttgagggttgtttatttatcaatcactgacttttcctttccttgtctcgaaattgagtaccttttgatgttttaatttttctaaccccgatctgattaattaactaaattgtgtgtctgtggtttttttaatgaatatgggtttcgtaaatggaagatcgatgttgacttgctaactgaagggttcatcagcactgtctagttatggttgcgtaaagaactagtttttaattttctatgttttttgtacttaagattttgagtttgctattggttctttaagccgaacttagtttttagggatcaaatgggtacttacatcaccgttctttatttgttcatcaacatgtttcttattgataaaagcaaaacttggtatgcttctagaagcttcttaagccaacaagattagtggttcaaatgcagaacattctagattgaatatctgatgcaaagggaaatgcttgatttggggatctagtgcctttgtttaagggttttctttatctgtatcaagattgtatctgaggtaaatggttattcatagcaataattagtcggattggtatgtttcagattcctttgtctcctatgcggagcaaagtactaggttgtacaataagatggaacaggatttacaagaaaacggacccgtgtttcttaaacaaggtgaaacgtctcagtcattgtcactttcagatctcttcacactgaaagatggaaagatagcacctgtccttaaggtagaatgttatatccttacttttactattgttagaatggaataatggtttgtataacgatagctaaatatcatgtatgattgtataaaatattcaggttgcgaatccccctgtgcgagctaatgtattacatctcagcacagaatactctgtcccagtcttgtgagtgtgtaacttgccccttctcaatctcaatgcaaatttaccctcttttcaaaatgttctactgctaaaaggtgtccttctatgttttattgcagggaagtcgtaaaaaatgtgttcagtccttacttcgaaaatagtaagcctgccgctattaccatatatgtgaattatatataatgccgttaattgtattttcttctctcatactttgtttttttttagcaatttggtttcaggactctaagatgtaccacttcagcatgtttcatgcatcgaatcacattttctctgttccagctactgaagttgaggtctgttgtttttactttatcatttatcttatcatcagtccacttttatcttgtgaagattctagtctctgaatctctttttcattatcaggttgaagcagaagcagctgctgttaaagcagttgctaaagagctttgccctttggagattatcttggatagagttctattaacctcgactggtgttcttcttggatgctggaaggtatttttgttgctttctctttgtttcaataaatgcgagtcagatgtccattttgttttgattataccactttgggaatttcatcctccataacaaaaactatgctaccaagttctttagaaatggctaaatcagatatgtgggactaatatcctgtttcatgtttcaccaggttaattctggagatgaccccataacaatccgcttgaaactgagatctgttcttccacgtgcaccggagaagcaacttgtaatatctatttcctaaaatgtatatatctctcaatgaacatgaaccacttgtctgatacttgtgttgatatttgtttcagtatgatgctgcaattcttcatacatcattggcaagactgcttggtccaccaatatctccaactgaggcaagtgtttcacttattgtcaacaaactcagaatccaaagttgcagaatctccatgacttagtggttgtttctttatgtatcaggctggttctgacgaccatctccagcttctccatgagttggtcacaagactaaacaaccaaatccgaggattcaaggtaaaacttccaacaaaagcaaagttttcttgaccaagaactgagaaatctctctgttgttgatacaggcaatagtatcagaactgtggtatgtagaagagttcgatctgctggcgctcgccttgggaggaagaatgaatgttcgatcattcccactcggctgtgcaaagagctaatacttatttcatctttaagatcatcaaaaccctaatgtcatcttcatgtatattttcttcaacttcatagtcaagaaaaatatcttattcaagtcaagacaaaagttctttttaacttgttgcatacatcaaaacggtattttcttatgtcggcaactgaaaaactacttacagtatttcgagagatacagtacattgtaattaacctccccaatacaaatattttgttttccttctatagttaaaacttccttccatatagagaattttagaaaaagattactactttattttcttgtgtcaacgtttactttaagctaatttccattttcgttttggtaacaatttccaaaaagcttttgattattccgaaaggaaagaaattaatgggtagctttttccaattcatatcgttttcacgacatcaattaaaaagttaaaaactttcaacaggtctaccacacaatcattcgttctctctctcaaagtctcaatccatctccagagagtagtgtgtttttagtggaggaagaatcagattcaaaagccaaaatcaaagcttggtgatg

SEQ ID NO: 15038 - DNA, 3000 bp, Unknown
  misc_feature (1)..( 3000): cDNA_ID_4254807_gDNA_ID_2684256_Annot_ID_193124 3000 nt of promoter + ATG
tattagcgacgagttcgttagccttatcggtgggatgatactcatcccaaaacacatacttacttctgtctttacacaatgtcgacgctggaatacacgttagcgcaggccggattctgtagaacgagcaacacggcgaatccgagttatcaaaccctataatcacacaaacatttaaacaagttaatccaatgatcaaagcgatataattaaaaatgcctttattaacaaaaactatccagcttaatttatgtgaggaaaatgaaacttctgattgtttaaaaaaaaaaaaaagatgccgtttgtgaatgcttcttttgattttatcaaagttttatattaccgtatttttttgggttagtgatgacgtcgttgacgaggtcataggcttcaccaaacctgtagcttgcgttagggagcttggtctcgagatctaggagcattgtggtggcagctttgttgaatctcttagcaagattactcgctttgttttgacaatttccatccaggcttagagctctttgcagtgggatacaacccattggtcctaaaccaaacaccattagcttcctcgctcctaaactatgtaacacctaaaacattacatgcatcacaaatttgtatcagttagatcattatatatatgaaagataaataggtacttgaagtgttgaattagtttagaaaataaaccttgagttgagattcaagtgtttccattaagtagtcgacgaaggtttgatcattgtatttccaagagtcgctatagacaggcatcaaatagttgttaatgaagtcattgctgcctaaagcgacgacgtatcgagcatcttgaaagaacttgtctgcttcttttttccctatctttgccacaactacatcttgtgtcccttggaataattctatttgcttccacagcgaaaatctttggatcttcacaaatacaatccccatgaaaaagaaataaacatttttagaaaatcattatcatttctttgatgaatcttattcatttatttttatgcaaataataatgaaaacttattatttcatgagacttacgaaataaccaccagtttcgttcaagattccaccacctcctgaagcatagttcactccattttcaagtattacatcttcattcattgatggatccaagaaggctactggtcttggcaatccaattttatcacctttaaatttcaacaaacccattataagcttgtactaaaacgtaattcacatgatatatatatcattgactaataattaattccatactcatgacttacctataatgtctgaaacagtgcggccattagtgaaccttccattaggcaaaccattgccaaaatcaataccgtaaaagggcagattcgccgtcgctaaactcctaggtagattcttattgttgcctacatcagacaatgaatctccaaatataaattggactatcttgcaatcgtagccgttgattgcaagaacgatgaataacacgaatatcgcgcagaacttcatgtcgccaaatttgaatgtgtgttgattgaaaaagatttgtttgggtggtttttaaaagggttttggaggtgaaaaaataaggactaagtaagaaaggtggaggagtagtgtgagaataaagtggtgaaggtagattttgagttgatgaaccaactgattttgtttttttctttttaattattgtttttggtttatgtttgattcaaacctacttcaactactctttcctcgtgttggtatcgtaagttgtaaccgtttcttgtccgtaaacttgaaattttggtaatattaaaccttgccgtttatgagctcatattatagcgtaaaaccaaaaaaataaactttacctcaatacggaatatttccttgtagtgaattaaataaatttagacctctatcaaacacttgtagtgattttcctcctgcatgtattcttcacttgctatttcgttactttggcttctcttactaaaaatatctaaaatcatatgtaaattgaaaaatactattcatgccgaaacaaaataaattaaaggaaatatttttgttttcttctaaaatttgcatgctcgtttgtaatttgttttttctcatgagctcagattgggtcaaatatgtttaattatgggccaatttcaagcccaatgcaccaaaggtggaattgctcggactggaagaaattcaggcagatgatcgagtggtatactggtaaatgaccaccaaaagtactgtttaagccgttggacactgaagagcagtttttgtaggtcagaggctttttctgactgaaacagagtaacgtgtctaaaacagaggtagttaatattttgatcaaaatgtgatttgaaatccacactaaatcggccggttatactggtaaacccacaatttgaagactaattcggtctgattataagccagtgtttttttttttacctgcttaaacccgatttagcggtttagcggatcaaattaattttggttgaaaacttcttctactttttattttattttttatacagtaaaaaagtaatagagtaaaataaactgaaatatcctttcttcaatcctttttttttttttttttgagcaaaaaaaaaaaatactgaactatccattgaaccatttttgtgtgaaccagaaattctacggatgttttgagcccataaaaaataatcaaaagacaacaaaatagttacataactaacctacgtggtcaaaaatcagccgattgctccaccaaatgggcgccacagataaataaatacccaaacccgtaactttatcctcatctcatcatcaccgtccatttctcaatccaacggtgtacatccctcggaaatctccaacaatatctaatccactaaatcaaaaacagatttaaacaaaagaagatttcacaaactcaaaacacagagaacagagagagagagagagactccattgttgaagtgtgttcactgaactcctcctcaaacaaca

SEQ ID NO: 15039 - DNA, 3000 bp, Unknown
  misc_feature (1)..( 3000): cDNA_ID_1685621_gDNA_ID_2684256_Annot_ID_193122 3000 nt of promoter + ATG
tggttaaaggttgttaatataaaagacaggagatacaaaccactccatttttccaatctttgttgtttatgtataattttctcatcaaagattgttaattatgaataaggttccattttatacggatcggaacttgcattacaatttaaagatatttctttctgatcgattagataaattgtctgtttttgattatagtcgacgtttcttaaagaagaaacacaattagaatagaaaaggcatcatgaattaaaaaagatatacaatcagttacatgttatgaacgctatattatgaagttacaattgtcacaaaaacttggagcaatcttgagagcttgtaacccttctatggacacgccctcctgcaaaaaaaagaattgagaacgaaagtccagatgtgatacaagatcatgatatcgaggccttcatatatagtcaagcaagatgattacattgggtaagctttggagcccaaaacaaaatataggctacaacaaaacaacccttcatatctccgttcttagatgcaatcatcaggctcctaaagaagtaaggtgatagaaaccaaaatctaaaaaaaaaaaacgaatcaagaatatgcctcagaggtagtgacaattgtgatataattcatcactatgaaaatctgatgaaaacacatcaatagatatacatcaccggcacaaaacaaacatcattaacaatttaaaaggtgcatcagagagattcccatctagacttaatcatcattatacttctcccaaaggagaatctgatgtccctgtctttttatcatcacttgcacacacactaaacttgtaataaaaactagaaaaaataaacctattcacatccaaacttcaaactggatttcataaccaaagaaaaaaagaagattctaaatgcctcagatttgttttgttttcctagagacaaagctctcaaagtatatttaataccatcacaggcatcaaaacaaacatacaattaaacagaaataaccacgacacagacaaaagactgaatctttggaaagccctcgaatcgatgagacaatttacagagatacaagactagggtttcaagagaagtggctcccattggagctttaatgaaacgcgatggctttatataagataagcagaggcggcgaaaattagggcaaaaataaggaactgaaaagatatgactgggctcgtaggtaaatatgaatagcccattagataaatcaaaaaggcccaataaaataaaaaagaccattcgtttggataattaattaaacgaaactgcctagttgattaaaggcccaataaaagaacattctctgttttcttcctttacagtggtttctctcttgtctaagagactctgtcattcttgaatcttgagaagtttatttttaagctgttgtatcgtttgagcatacatttttcctcaaatctcaagtacatatgaagtcatgtacttatgttataaaacttatatctttttgttttgaacttagccgaaaacttgagagccttgaggtaactctcttcctttctcataatattattggttttgggaaacatattgagctgaaacatttacttattgtatagggccataggccctcaagaagacttttatgaaaatggatcgtgatgttaatataaatgagttcttcttaggtgcaaggtacttgatacatgagttctatctatgtaaccttaaattcagtaaactatttgtcccgtttggaaaacacttgaactgtggtccttaatttgttatcctgaaggaatcaaactattgaggtaaggatgatggatcatcatgattcttttggatactactaagctcttgacttttgatagctaaaagtatgtattgacatttcatgaacagggtctgactaaccaagtagcattttctcttgttcaggttatggagtgtcataggagactgaggtggaacttttcggttttaattatcattttttttctatacatttgcgtttcaaccgtcttaacttactatggatacctattgcgtcttcttctgttgtgtacttttcagtttttaggcatttggagcatttggaagaatcattgagaaaatcttttgaaagagttaagattcacaaggtatgtcatgacttgatcacacacacacactgacacatatatgaacatgttaagagttaccaatggaggcagcatttgtcttgcgggaacatttcagaaaaaatcaactcacgtcattagaatgtacaacaacacaggttatgtataagttataacagttgcccttcttttctctctcacattcttaaaccagaccaaacattctcatgcagtttcagagcgggctatcatcacctttggtaataaacggtgttcaagaaaaccatttaatctcatggcttcctattaacaataaccagcaaatgatcatacctgctgactcaagttttcatcctcatccgtgagtgaaaactgttaatgcacttaataattaatatgctttggacttatatgctatattcaattgaaagttttatgatcagcagaaagatgaaaccggtttttgagttctggttaaacattagttttgagtaactgtagcaatgtgcacgctagttttcttgtatatacagtgtacctgtctacgtatgtgtgaacctacatgatattcagcagatttgtatatatctttgtgtcagtgtgtgtattgtataatacaacactagtgaataaaaaagaagagttttaattgtgatgagcatcatctgatgtctccaactcaaaaggcttatttccacaatcaacggtagagatctaaagataatgagaaaatttgcacaatcttctttaatatcgatatcttcttccacgataatcttacagatccagaagaagatcacacatggtttttgtataaattagacaaagctttacttgcagaacagagcagaaacagaacatatattctctgtctttttttgtggcaaaagtaa

SEQ ID NO: 15040 - DNA, 3000 bp, Unknown
  misc_feature (1)..( 3000): cDNA_ID_2729657_gDNA_ID_2684256_Annot_ID_193119 3000 nt of promoter + ATG
gacctgaaatgcccgattgttcggtgatgaagctgctccttgttccttccaaaagaccggttacgatgctgagacgacactgagctagaagatgaatccttctcatcaagcataccaatagctaactcaatcaaagtcttcctcgcacgacgaaactgaccttctccaagaggtctcttgccactacttcctcctccattgttgttgaaagcacaaattacaatctcgataagtttctgccattgacggatctgttcaacaccatcacgaatcgcgttacaaacatcaagagctttaacacttctctcgaagtaatctgaaaccaatcgatccatcggtggtttagtaatcatcgaacgatgattgatgactatggaacgaaactcttcttgacaagatagaaacgaatcaagaagcttcccaacccattcgagagacagtagatcttcacaactagacgcattgagatcgataaacctctcagcaacttttctctgaaacgaaacaagctctgcttccatctgagtcaactcgggggtaaccgtcgttgactcaaccgagttcaccgccgtgtctcgccgtaaattcagaaaagacctcccgaatgatctttgatattccgttgctggcatcctcaaaatgaaaacacacagatgaaatatgtgatcgatcaaattcgagagaaaattctcattcaccggaaataaaaatcgttcctttttttctgaatttgggagcagagagagtgatgatgatgatgaaaattaaaaaccctaatgagaaagagattgtctttatattgatagaattgagagagaattttgaccgcgtctatttttttttagtatgtaatttgtgataaatatggaaaaaggatttggactaaagttttatttttttcattccaacgaaaaagatctcttttgtctattttgattttgtttatttttaatttcatgcgttgttactcgtccgaaacacgcagcttacacgtaaattaataatataccaagtaggagaaataaaataaaataggaagatgaataaatctcagccgttggattaagaagtgattcgcgcagacatatatggctgtgagaagagacatgacagcacgtggaagatgtaagaacggaggccacgtggcgagacgtgagatggggaggagtgacggagaaggtgtcaatataacacagctcagtcttagttggcgtgtcatagagacttgttccctgtgattcgttttttgcaactttttctagaaactttaatcaagccaatgacaatttgcttatttatttcttgtggctttacttgctaaataaatactactactacaccaaaaattcaaggagcaagtcaaattaattgtaggcactattacctggttgatatattgtgtgtataatataaagtatggagaccgattgctttgtcatataactagactatagtactaaattacaaatggattatggatagttggatacattaataattgaatatgatgttttcaacttgtcataatagaaattgtgtgtttaagagttgaaaatcatgtttgaaccattctttaagttttgaacgctagcctttttatatatattttaattaatactaggcgtaagttgcacactagactaatgagagtatattttgtaatcaaatactcttatgtatattctgtattacgtaaaatccccaatatctggaaaccgtacctaatttgaataaatttatgatatcaaaagagtatatgatagtattaaaaagagtgaattgtatactaagaaatctgaagtagagagcacgtgtggattacaggttccaagagacatagaacgttggaagtcatgaaggaaatttataaacaaagaagaatatgacagacaaactctcctttgagttttgactatttcttgaaatttggaagttgttaaaagaaaccaatttaaaatccttgcaatttggtgcttaatctctttctcccccgactaagttctacaatttagttatttattaaaaaaaaagaatatttcttacatcatttcctattaagtttttaaactggtgaaaaactaacatggtccaaaacaaaaaattatgtaaaaggcttaataaaaacaaaatggttcagtttcatcattttatgtcgaacaaatatcataaaacagagatacaaaaatgggttacatcatagtttcttaattatacatgaatcataactattgcaaaaaaaaaaaaaaactgcatcttaatttcttagaaatcggaactacatcatgatggctgttatacaaacataagaagatcgtatatttggtcacagaaagatttgttttgagatatgaaccaatttaaaatacaacatttagaccgagattaaaggacgtggtccaggatttggaaggcaaccgtcacaatatctgaagtatatagctgcagccatcactagattaaacggtttttgctcttatattatgagattatcttatacgttaacgtataatgaatattattagctgatggtatgtgaatatggtggcacttgtgcctactttcgtcatttatttggttagagtttttcttttgatgatgactaaactacggtagaaatatgttggtaacataacatgatatctttgtgattttaccgagtttttttaacccacgtgaaaaaaatcatgaattatatcctattgttttactattgacaattctaataaaattacgaaatgaatcacaatttcttattgcttcaaccgctttaagctactgaaattcccttgattattccaaaatcaaaacgcaatcgcaatacttatgacttggtcaacgatcaccacaaaaaagcgtacattagtttgtcaaatatgcgcatgttagcatactctaggtgacgcatcttctaagtaaacgccaataatcccaaaagtctcttcctttcgtctttccaagaaagtctcccactaaagtgtttagagaaaactttaaaccatg

SEQ ID NO: 15041 - DNA, 3000 bp, Unknown
  misc_feature (1)..( 3000): cDNA_ID_4254766_gDNA_ID_2684256_Annot_ID_193118 3000 nt of promoter + ATG
atacaatatatcatctcgtccgaccaaatgattttctaatcgagaaaacaaatcgaaacatgtattcaatcaaaaaatttaaaagaatacaaaataaaataaaaacaacaatgccatgaaatagtcgaaaaattacactagctaatgaataaataaaaggatagatgatatttatgtttgattattgattttgattttcatcggatgccataattgagagaatatggttacaatatattgattagtttttttaataaaaataagatatataaaagattagattaatttaattatagtgattatggtttgggtggaagccataattattttaattaattaaaaaagattattttttttaacctaactgctaccgcccgcgaccgcaaacgcttgcgggaaagagctttcaaaaattggcgatttcgaacggtccaaagcgatatctagcggtttctatgattggtgtcaatcgctaacaaccgttaccaactgcaaacgctgggtttgcgggtggtagagggagaaccaatcaaaccctaaatgtgtgtgaccactgaccacaccagccaaagaggtccccgtgaagtgaaaccgtagcacggccatcatgataagatatcaatataaaatagtaagaacatcgattttttatatcattttgtttaaagaccccatgaaatatatagatagcttttacgaaaataatacttaacacgtcttttggacaaactatcttttcatttatttactaataaatacctaaatcaatttaaaatgtgcattgtggtccgacacaacaacaatccaggatacaatgaaagaaagtctacacataaaaacaaaaacgcgcgagccatgtatatacacacatggtcttgactcttataacctaataataaatttatatatatataaaaaataaatacattgttatataaaaaaatcaaaataaattccgaacataacaaaattgatattgcgtccgatcaacattagctccacaggccacaacatatggatgtcatacaaatatacacataagtactctgagtaattgggtagcaacaattacttcttggatgattcagttctctctctaacaattgtatttttgggtctaattacaatctcacaattgataacattttcattttacctatgtgcaaacaaatttgtgaactattccatgatatattttggtataatcatttctttcaaagtgggattacaaaataaataaataaataagttctccgaaaagacatattcacattaaattagtcaaaagatactgcatactaggcataaagacattatgctaactcaaataaaatcagctgcttaagtaatgtattgaggaggacatatatagcaaaacagttagaatccatcaaaacgaacgtacttgcggataacaattctgaaggttccaattttcttatgtctaaaatggattagggggggtttgggatcgagatgggaaatcaaatacggtatcaccaaaccaccacggccataatatgttttgtagctttcgtaaaagagcaattcatcactttcagtaacattattaatttttgtcttaatagaaatagaggaacaatgttgatcacacaataaaaataatagatgatcatgtaaaaaatctaaacgagtgtaaactactaaccacgtcaatatcaaaaccaaagcaaaaagatgttcacaaatgaagactcaaccgagcgacagtgtcttttgaatgagccattttcccttcttttttttaataaacatattatgaattataaataacagaaagaaaatatcaattcttgagaaaaattcgtaaatgtgtaatcaataaatgttggaaataagttattaaaattatagactggggcatatatagtcccagtgccgcgtaaccccacaaagaaactgtagtatactaatgctgtctttcaatcatttattacaattaagggtcctactatttttgcgtatacagataattgcatatttcacacttaccaaagtacatactttcttcgctattcaccaacgtgtatcatatatcaccttttgaaccggcgttgcctctacaatattgtgcttaagcaatgctacaaaaagaaaagggactattgaaatcgaaatgtaataaagattatttgtttagggctgtttctaaattttcaggaactctcgaggtgaaaatttcatacaacaaaacaaacaaacaaaagtagtacgtagaatttaaaaaccacatgtgttcttgttcgagtaattctgtaaattaaatggtgtgaaacgatttctgtaaattaaattaaatggtttatccaagcataaaataacaattttagctaaacagtatttgtactagtctttgtgctattcctaaacaagtcagaaagttgaagaagcaggaaacaaacatagctttactcaaataaattaaacaataaaattatatattgctctacataacaataaaatttgttaatatgtttaattcttgttcaaatactaagcttgaaaatgagcatttgtatcatgtgatgtgaaattgtgaatacgctattatatgtgtgacttaaccccttggaataagcatgtttgcatattctgaatatatataaaaaaaacgtacaaaataagaatcaagatatgaaaaggaaatatcagcatcaagaatccaacggttgaaataaatcaccaaaaaaaaaaagaaaaaaaaggaagggactatatatacacataaacatcccccattccccactttataaaagaccattctacttctatatatatatatagtgtgagtgagacagagcctcacataaataaaaagtctcctaatctgaatacaactattactaacaataattcacttatctaaagaccatcatctgactgactctacgctgaatcatcacgaggaagacttgaatcgaccggagaagagatacgtgtagagatctgattggctcaccggagagaacaaaacaagaa

SEQ ID NO: 15042 - DNA, 3000 bp, Unknown
  misc_feature (1)..( 3000): cDNA_ID_2994977_gDNA_ID_2684256_Annot_ID_193116 3000 nt of promoter + ATG
attagccactaacttcccattacttcgtgttctgggactttttcgtggggaaaaccagctcatgtctgtaagaatgtcaggaacactggactcctgtaaacaccaagtacttaagctcagtgattttctgttatcatgtcatatgacaaagtatactgcagtcttgcagatcatgttcagggcttggaaaagttctggtctgcgaagaaacatggacacaatttttgcaaactataatcctaaaagttacagtttatcacttattcaagaaatgagaagacatcattaccagaaacaagacggttgcacagtacttgacaacttcaagattcatccggacatcatctaagctcctggtgaatcatatccattgtttagtcccatattgaaacaactgttgaatcgctaaaaggctcagggcatcgtttagatttacctgtgagcttgatctcctagcccgaagtatgtagcaagtgatgccatctacattagttaaaaggagtaaactttagcaactctgatgtgaatctaacaagaaagctacaggcattgaggtttatcattgagaatcgggaaaaagagagaccttcatgtcaccagctctcttcccaaacttctgagacaacaatgaaagcgaatcaattgtagctttcggctctggcggagagagaccaatttctgcaaatgcttctcttattcttacacaatcgaatcgaattatgttatgtcccgcccaaattcgtcctacaaaaacaccaaaatcaacacttttagcttcgtgagaaagaaagcgaggaagagagagaatcccttaccgtgaagaatgtcatagaccttatcggcgatttcagagaatgtatgtgcagagagaactccgtcgcgcgtaatgccgctacgtcgctttgtgagcgtagagattaaggaaagatcagtaggtcgaaccaaagtggagtaactatagagctcctctagcctccttgggcaaactaagatggccccaaactccaaaatcgcgaaaggctcccctgatttggtcggaaccgccgtctcaaggtcgaaaaacgctatctcgcttctctcatcgccgcccagactcgaagccattgttgaaaagtgaaaactgatagaaagaaggagaagctaataggtgggttttaaagcgaatgagcttcacgcgccacgtcctctttttacggaaaaaatctaaactttgagagacgcaactgtagaatgaggtttatcttgcgtcatctgcattcacttggagtgatcaacaaatttgattcctttcttctacattttcacaccaaatcgcttaaatctaaccacactttgaagcaatatcttgaatctggggaaccaatcaaagctcttttagatttccggcaccgattcagacaaagtcctagttttgttgacagtttttctgttttgtttgccattaaagtttcgtcagctcagaaagcttcctcacttgatggtagacagatccacgctcttgtaagaaaactaggtttcaatgccgttattcaaattcaaacatctttagtgggattctactcttccgtgggtgatgtcgattatgcacgccaagtgttcgacgaaacgcctgagaaacagaacattgtcttgtggacagcgatgatttcagcttacactgagaatgagaactctgtggaagctattgagctgtttaaacgaatggaagcggaaaagatcgaacttgatggagtgattgtgactgtggctttatcagcttgtgctgatctcggggcggtgcagatgggagaagagatttattcgcgtagtatcaagagaaaacgaagattggctatggatttaactctgagaaattcacttcttaacatgtacgtgaaatctggggaaactgagaaagctaggaaactctttgatgaaagtatgagaaaagatgtgactacttacacatctatgatcttcgggtatgctttaaacggtcaagctcaagaatctttagaactcttcaagaaaatgaagacgattgatcagagccaagatactgtcattactccaaatgatgtgactttcatcggcgtcttgatggcttgtagtcacagtggcttagtagaagaaggaaaacgacatttcaagagcatgattatggattacaatctgaaacctagagaagctcatttcggatgtatggtggatttgttttgtcggtcaggtcatttgaaagatgctcacgagttcatcaatcagatgccgataaagccaaacacagtgatatggagaacactgctaggcgcttgcagtcttcacgggaatgttgagctcggagaagaagttcagagacggatctttgagttagatcgtgatcatgtcggagattatgttgcgttgtcaaatatctacgcttcaaaaggaatgtgggatgagaaatcaaagatgagggatcgtgtgaggaagagaagaatgcctggtaaaagctggattgaactcggaagcattatcaatgagtttgtctcaggacctgataataacgatgagcagctgatgatgggagagattagtgaggttttgagatgtttagtttcttgtatgacaagttttgattgtgtaatagggaaaaaaatgtagaccaaaagagtctagtggaagttaatcaaagcccacttgtaggagcctgtggcccaacaaattaaatcaaaattgataacttaaataattttaagttttcacttttatcaaaaaggggcctgggaaaaaaacaaatatcaaagaaagcccaaaaaagacggagaaatcagatttttttgaatttaagaaattaaaaaaaaaaaaggagagctccgtcttcgttgctttttcgagcggtgcctagtctcaacttccatggctgacatcttaccttcaaattttctcaaaccaaccaaaaagcttcttctccttttctaaaatttcatcaaaccctatagggttttctcaatacaattgattttttttttcttcttcttctct

SEQ ID NO: 15043 - DNA, 3000 bp, Unknown; identical to SEQ ID NO: 15041
  misc_feature (1)..( 3000): cDNA_ID_4254766_gDNA_ID_2684256_Annot_ID_138095 3000 nt of promoter + ATG

SEQ ID NO: 15044 - DNA, 3000 bp, Unknown; identical to SEQ ID NO: 15040
  misc_feature (1)..( 3000): cDNA_ID_2729657_gDNA_ID_2684256_Annot_ID_138096 3000 nt of promoter + ATG

SEQ ID NO: 15045 - DNA, 3000 bp, Unknown; identical to SEQ ID NO: 15038
  misc_feature (1)..( 3000): cDNA_ID_4254807_gDNA_ID_2684256_Annot_ID_138099 3000 nt of promoter + ATG

SEQ ID NO: 15046 - DNA, 3000 bp, Unknown; identical to SEQ ID NO: 15037
  misc_feature (1)..( 3000): cDNA_ID_2686032_gDNA_ID_2684256_Annot_ID_138104 3000 nt of promoter + ATG

SEQ ID NO: 15047 - DNA, 3000 bp, Unknown; identical to SEQ ID NO: 15036
  misc_feature (1)..( 3000): cDNA_ID_2729634_gDNA_ID_2684256_Annot_ID_138105 3000 nt of promoter + ATG

SEQ ID NO: 15048 - DNA, 3000 bp, Unknown; identical to SEQ ID NO: 15035
  misc_feature (1)..( 3000): cDNA_ID_4266672_gDNA_ID_2684256_Annot_ID_138110 3000 nt of promoter + ATG

SEQ ID NO: 15049 - DNA, 3000 bp, Unknown
  misc_feature (1)..( 3000): cDNA_ID_4254758_gDNA_ID_2684256_Annot_ID_138117 3000 nt of promoter + ATG
aatttcatcattgtattataaaaattaacctaaaagacaaaagtgtaattaggtctgcttttatatatttttaaacggactaacaaatatgaaattacgaataaagagagagatagaaagatgagagactattgaaaggactctatgtttctcaccaaccgtgccctactcgtgtagtttagagtcatataaaccccttaaaaattgacttattatttgttgatttatatacatattagtcaaaatgttgtctttccaacataaattggtgatcaatatcagagtgagactagtaaattgtttataatctcatgtttgattgtagatacacagatatttatctaaactagcagcaatgaaaaatcagaagattaaacgtgaaagggcacacaatgattattaaacaattgactagaattaattaaaacactaactaatatatgggaaactaaacatcaaatctacttttttcagtgtccctctgtctgtcacttgtggaaataaaaatgaaaaatcgcaaaattaaccaaacattaaacctttttaatttgattatgttactctttgtctatgtttccatatgtccccttttcaccgtttgggtgatatggatatcttaaaaggtattgggctttactgtcctctctttcagttctttcggccttcttcctcagaattattatatcaataaaattcattggatcacacttcggcttgggcctttgttcattcatgaacatcttatcgagtggtatatttttggtaaagggtttatcaagtaagatttcttaaaactacataaatcttctatccttaaccaatagtaaacaaatattcggaaataactctaaaaatcataacgataaacaatcatatttgttggaacccatttaaatttcatgacaacaaggaataagaaaaaataattagtataagcttaaaagttatgaaatttcgccgtgaagtaaataacacaatgaacaaaactaacgtggttaaaccatctccatcaatggtttctcattgagaaactgtttaatataaaaataaaatataattaaaatgtatgagagagagtagaattagtctctcaaatgagaaactctgagaaacccataagaacacttgtatatttggtcaaatattattttattattaaaatttaattatataactaatatttattaaaatactaatatttcttttttttgagaaaccaagaaagtatctcactgatggagatgcacttagtataaaattcaacgttggaataatacaaaacgaaataaattaatacttatagatttcagcttcctttttaaaatgcttagattgataaattttctacttttttttcggtgtgccagtctttgtttcagtttcagtgaaagagaaaaaggttatctcttgagcggtgtaggaaggtgaagtaataaatgaagaggatacatcaatcgagtggacacgtacttgaagttgtctgatccacttcaactttgaattgtgagtgtcgtaacaagatgccgtatctattaaaacgttaaacacaaacaatttttaatcacaaatgctattttattggacgaccaaaataactaatgaaagaaaaaactagtatcctgttactagtttgacaaaagttattcagagatgaattgtctgcatgttggtttatactacgtcttaaaatttatataaagatattaaactttgtcatggatatagtaattgtgtatccacaaaatgcaaagatagaaaaaagtcgttatgtttgttgaaagcattagatagatatatgtctcccatgtgagtgcacatggagttatgcatgcacgaaaactgcctctacccttttgtctctctctcgattcttcaatcaattccccaccttaagtttgcatgatctctatatccacctctgagatctagacacgttgctcctcctcttcatcgaacggttctctttgatcatcttgctaagagataagaggaaaagtggcataaatccatgccgagattgctcttatcggtccctttatttgttggttggtcccaatcacttgcactggatatgtaactgtttctccatgttactccttctcttttaccaatatacccttcattttcttcaatttgggtgtagtcccaaatgtgactcttttggcctaattgtatcaacttgtttactttttcttatatatgttcatcaatgttacgacgaatgtaaaaaaaaaaatattatttggaatttgataccgaatctcgacactattagtatattattggacccgtcatatgtatttatcaccagagagatgtgagttttacgatacatagtttttttctttcatctgaaaagaaaattaaacacatgtaaaataatttctgcctgtagtcttttaatcactgaagtaactcgaatttgatgttagataattttttcacaaaaatattcaaattcaacagattaagttgttgatgacagatagctctctgggaggaaaaaaagaagaaaagataatggtccgtattaatatagttgaaaacttgaaactactttttagtttgtatataatacagtagactagggatccagttgagtttctttctttattttgagtttgtgtttatgtttgattttacgtttttatatgtaaataagatattttacgaattatggttttatttgggtagaagttgtagaatgacttaaacaatcaagtggcagaatgagatatataaagtaatataatatatgtaccgttattaacttattgtacatgtgaatgaggaagcttacacacacacaccttctataaatagctgacaaaactggttgttacacacaacacattcataaatctctcaaagtaagaactaagagctttactacagtcctactctctacacatcttctctctctctcaagagctagtcatggccaaactcataacttcttttctcttactcacaattttattcactttcgtttgtctcact

SEQ ID NO: 15050 - DNA, 3000 bp, Unknown; identical to SEQ ID NO: 15033
  misc_feature (1)..( 3000): cDNA_ID_1989204_gDNA_ID_2684256_Annot_ID_138118 3000 nt of promoter + ATG

SEQ ID NO: 15051 - DNA, 3000 bp, Unknown
  misc_feature (1)..( 3000): cDNA_ID_2783357_gDNA_ID_2685554_Annot_ID_138126 3000 nt of promoter + ATG
agtgtgtgtgtctatcttaacagtgatggttttgatgctatcaatttctaaagttacgaaaggtaataatgatcatgcgccggctccaatgtcagagaaagggttgctgccaaatccaatatcatgtgtagcggacgcaagaaaaattccagattgtgtagaggcaataaaacagggccatttgaaaattataaaaaaagaatgttgtatcattctactcagtcttcccgaagattgttttgggattttatttcctatacgtttctactatcgtatcatacttaagattacatgcaaattaattggcatcttttaatcacaatttttttttaatctttagatattttttcatgtaacggtattcatattatttcataataaaaccatttttctttcagtgatttgttaataattacctaaatgattatgttaaatataaaataatgggttttctatactaactaagaattaggctagtgttcgtgagacccttcgtttggagctagaagattaatccctagttcggttattggttgggaaggatttcatattccgggccaggagatatatgagtctcacctggtaattccttagagttgtagttaattaacgaatcaaaaagaacatgcattgattattttattggccctttgttatatgttttcttaaaaatgtgtaacgcttaaaatttcttgcaaattacttgtagtttcaatagtttaaaaattttaaagacttattgaatgactttgtatcacttcattttatattcaaagactctgtatcaatatgagattattattttttctttattttgtggtgtctaaagaatcacttcaaatagatcttcattgtaaatattcataggtgaaaagttagacatgctcgagcaccactgaattattttaagatcatatccatgtacttttaatttgcaatataaaaggaaaaatattagttaaaaaaaaggaaaaagtatttctataagtcttcaaatgcacaagattttctgaattgaatgttttatgattagagtttttctcccattttatcatatatactgataatattaataacaaaatgatttgaaccccttacatgtgctcgaggagctgatgcacatggtccatccaacatttttttttataagtaaatctgttacaattagggtccaaatttttattaaaaaataaaatataggaaatgatgaccaattcttttttttagcacatgatttttaattattttgagccagccctaagtaaaaaacgtataggcttttgtcgacgattatgttataaacttataactagataagaactcgcatctagtgtgggatgaaacgattaaaataaattatttgataaaattattgatatttaatatttgtctgtatataataaaacatgtaattaatgtttttattttattttaatttatgtttgttttgtgtaaaaatacgtttcacccgtgattgttaaagctctaattcttgagtgggtcggaacttggtttaatttgcaacataatacaaacatcgatatatcagatcttttttagtttgtgttatagtgtgctcagtggggcggctgttgtacggatagatttgaaaggattctttgttatgattccaacgtttttgcaatcactagagaaaaccaatgagattgtaaaagaaaaacggaaacaaaacaaaacaaaagagaagaaagctagagaacaaaaaaatgatattcactagacatggtttcgacgaagaaactggaaaccagccatcaaacaaatacaacaaagatgatctgagcttagtcgagaaaaaaggatcctgaattgctcggatgataaaatcagacgtggttgggatttctctctaaaatgttctcatcatttaatttggccatttggatatgatttaaatcctaatttctagctttagtttcttgtttttttttttaaattaatcaagcacaataaaaaccttagacttagaaccctccattttttttccaacaattttgaaaactatataagttcattatttttatctctatatatatatataagcttaagaaaatgtacgtataattatgtttgttcaaatgttcatccagaatattttacgatgtcatattggttttgttttgttatcatgttgtgaagtaagtaatcattttttttattgtcatttccgttcttgtattaaaaattatatattgatgtggttgttaaaccgaaaaagaaggtgaatttggtagatcgcaatatttattgatgaaattaagaaaatatcaataatatgatttgggttcattacatagtttttttttttacatgtgtaaccccttctcacggccacggtgaaattttcataatatacacaaaaagggcaacaaataagaaattttcattacatagtatattccttaattttgtttttattctcatttagtttttactagaaacattaaaatgaacttatatttgtaacgtgctattttgttttctgaactatcaaatgaacgtctaacaaaatcaaactcaaaaacttataatttataactctaatttccatttaataaataatatacccactaaattaaaagttaaaagttaactagtaaaatcgactataattgcagaaaattagaaactgttttatcctttctttacattgtcggttttcaccgtccaatactccaatccatttttagtttactaactaaaatttttttattttaatttacttatcaagtttacccaagaataatattaagtcttaccaagtcaagacagggcagtacgtatgaagtgggacttgggatttaatgtcacatttaaagcttaaacgtcagtgtttactagaaactttgacaagttcttgattgcaacacaacaatgattgcgacaatattaatagatatatagttatattttccaccacatatctaattcttcatcttctcaactaaacaaatcagtcaccgggaaaaatataaagag

SEQ ID NO: 15052 - DNA, 3000 bp, Unknown
  misc_feature (1)..( 3000): cDNA_ID_3080366_gDNA_ID_2685554_Annot_ID_193346 3000 nt of promoter + ATG
cattctgtgacgctttagctgaagagagtgctagatttgtctcagttccaccagcacccgcatatttgaacaatgccctggatgtggaagtcaaccatggaaatatcaaccaaaatcatcaacaacgacagcttaatactacttcgtcacaattggaccaacctggttttaataccaatcgcaataacattgcctttttgggacaaaccttaccaaccaacgtttttgcgtcctcatcatctccatcacctcgtagtgcatccgactcccttcaaaatctatggcatttacaaggacaatcatctcaccaatggcttctcaacgaaaacaacaacaacaacaacaacattctccaaaggggaatctccaaaaatcaagaagaacatgagatgaagaatgtgattagtaatggttctttgttctcttcggaagcacgaaacaacactaataattataaccaaaacggtggacaaatagcatcaatgtcagccacggcattgctacaaaaggcagctcaaatgggatcaaagagatcatcatcaagctcaagcaatagcaagacttttggtctaatgacctctatcttcaacaacaaacaagcagagaatatcaaaactaaggaagttgatgaaagaggtttcacgagagactttcttggtgtgggaagtcaacaccgttcttggccgttattgatggtcaaccataatcttccagactcgtctcctccggcctccacggacggcacaccaaccgccgacatgaaccagtaatcttgtattgttcatgtatactataaggtaaattacattatgttatatgagttttgagaaatatcgagattcctctgtttatgatattctctaagtgcagagacgtgaagtatgagattcaagtgacgagaggatggtttaagcacggcgaagaaaacggtgaaatatgagacttttgactcaggagagaatctctgagtcaactcggtgttgcagatgggtccactcggttgatgaagatgggaagctattcgggtccacttctgcatgcatgacgaaacctctgaccatgcatgcacagcaaaacatacgctatgtcttttcttattcttcttattcttctttttctttttcttgtaattatttcatgttttaattttgaaagaccctaaaagaaactatgaaaagttcgtagtttgttactttttattttttcatcgtagaaaggttaaacttttttttgaaactttgatatctaaaatttttttttttttttttttaataaaatttaaaatttattcgaaaaacttttgtacaacaagtgcatcgtttgagtagaaagtttgtatttaaaacatagaaatcaaaagaatagagactaatgagctacgactctattatgatttatcttgaggagaaccatacgctcatgcatgcatcgtaggtgcgattcccttgctctcttattgatgagatgcggttttgaacttgcttgccaagatttcggactagatggactgatggtgtttcagcttcaccatgttttcgacaatttctttctttccaaattgagtaaatcgccaactgaaagacataccttattaagaagaggttgatttttccaatggttttgtctatgagtgtcttgtggacttcactccatcttgttgtgaattttgtgccaagaagagtacgacttagcccggaccacacctcctcagagttcttgcatctaaagaaaagatgatctcggtcttctaatggtgcttgacagagaacgcataatgggcactccagtccgccaacgtagcattctgtcacctgtggccaatctgttccttgttgcaagccatgagataaaagagtattttggggttgaatgggcgaaccatatacccttataccattctgttcgtggcttggcttctcggattgcgtcccaagtttctctcgtactaaaaaccggtttaaaccggtcgtctctccctttccagagtactacatcattttctccagcgactcttttttgtcgtgtttcctgcaacgcagtctcaatatcattcaaataaccaagtctgtgtcgccttcttcgatgacattcaaatgcatctgccaccgaggagtgaaggcttatccccatatctatgcatcctctatgtcccgcaatgtcaattagtttcccaagtagggaccaattgtcaaaccagaaagaggtgccaagtccattcttcactgttactctaacaaaaccagccgctgaatcacgatacttaagcaactttttccacatccaagatcccagtgtagtagtttcgcttattgaccagaaagaagccctcttgataagataaatgtgtatccatctcgcccaaagagagtttgatgatagtaacctccagattagtttatagcagctgaccttatttgcctcattgatcgatcgtaggcctaaacctccctgctctttaggtgtgcaaacatcttgccaggctacttttgcttttttttggctgagagcgggtcccgaccataagaaagcagagcagagttggtctatctgttttgtgcagataaaattacgagttgtgccaggccaattcgcatggctttttatgagtatgtccagcccaaagtctcttatgtatatatgtcctacttatataattaaaatattttttattcaaaaaaaaagagtgctcaaggatagacccaacatttgtgacataaaccactgcaccataagacttatcataattgatgcatagagcaccagtttgctgaattttatataagggtcaaacctgcttacgagcttttagtatattggaaactccgtaagggccaaacctgcttaagagcttaacaaaagtattccactggagacagtttttctatgggctcttaatatatttttttatgattaaaattcaaaaaaatagttgtaagatagcttctttttttttttttttttttttttttttttttttttacgggtactggattgagaatg

SEQ ID NO: 15053 - DNA, 3000 bp, Unknown
  misc_feature (1)..( 3000): cDNA_ID_2783365_gDNA_ID_2685554_Annot_ID_138128 3000 nt of promoter + ATG
ctttatataaagcaacaagagggtttaacaaagatggtcgtcttggaagaggaggttttggagaagtgtataaaggtactctgcctattctaggagatatagctgtgaagagactatcacacgatgcagagcaagggatgaaacagtttgtggctgaagttgtgacaatgggaagcttacaacacaagaatctggttcctcttctcgggtattgtaggcgaaaaggcgagttattgctggtctctaagtacatggaaggaggtagtgttgatcagtacttatttcacggtgataaaccgcctctttcttggtctcaaagagtatcaatattgagagatatcgcatctgcgctctgttacttgcatacaggagctagtcaagttgttttacaccgagatatcaaagcttctaatgtcatgttaaatggaaatctccaagggtttttaggagattttggaatggctaggtttgatgatcatgggtctaacctctctgcaactgcagctgtaggaaccataggctacatggcgctcgagctaacgtcaacaggaacttccactagaacagatgtgtatgcatttggtgcattcatgcttgaagtaacatgtgggagaagaccatttgatcctgcgatgccggttgagaaacgacatttggtcaagtgggtttgtgaatgctggagagaaggttctctagtcaatgctgtggatacaagactgagaggtaaatttgtacccggggaagttgaaatggttctgaagctagggttgctttgtacaagcattataccagaagcaagacctaacatggaacaagtggtccaatacataaacagacaccaaagattgcctgagttctctccaaatactcccgggatcggagtttcaactccggtgttaatgggtttaccttccttggcaattacttctagttcagtgacttcatcagtttcaggaccatcagcctctccttcctctgctaacaactcaatgttcatttctcacaccattatatatggtgatggaagatgacattggacaatgtgcttcacatttctttattaatgtttaaactttctatcagttctgttgtaaacaagtttttatttatgtaacactcaagatgtagcagaaatgtctaaatattttttttgtttatacatggtttttgtgtctgtgattaaaagagaataaggatcatgttgtaataacaaatcagggctcttatgaaaacagaaccaaagataacaatgaatattattgtctttagagtagtgcataatgaaagagagacaaataaaaagcaaagactatgactataaggatcaagtggatccatttgtgagcagtttagtcttatttcttccttcaatttccatgagcatgcctaaagaacctggagaggaaccctctcttttaccatcagcagcgccaatcacgatcctaatcgcaatctcttctgcatcactttccttcaaaacttgacaatttgaggaaggagaagatgtaacagaacaagtaccagctttagtgtgatcaacaacttttttggctattgttggtgactgaacaatccacatgaggttgtaacctttggtcttatgcagaagtattacggtcgtggagatgagaagttggatgatccaaggtaaggtaatgagtactgttccggaaatggcaaagaagtggatgaaaccggacttgtggccattggtggttgcgagacggaagaagaggattccgataatagttgtccaaagagagtggaataggattgaccagaaagagatgccacgagaaccagaggttctactctccatctccattttttgtttttagtctaacgttgagagagatgtgagatcatatgaagttaaaggttaagagaggtatgtattgttggagagatcaatggtgattttgattttgttagttatctagtggatttgtttttttctttgttcatttgactaggcgattttcttgtagtaattaaactattttttttttctaacaaagttattttcgtaaaaataaattttactttaaattttgaaattagaaaacatccatttgatgtttaaaaaaaaaaaaaaagaagagtttccatttaaattgtttcggaaattcttaaaatttgtttaaatcttctcagtgtgtatttagaaatagggttgtctgcccagttcccctgttatatagtgtttcaactaggtttactctatacttttattctctatccttttcactctatacaatttattttcttgtgtgaatggcaattgtcgaagccatataaattttaaattagaaggttattacttgttatgcatattatgtttgttatatggattcctattataagtccaatagaatattttataaaaatttatattacttgtttcgcaagctaaaaatcctaactttgtatctcaatgtataatgcttgtttgggttaactgatcgggtttattatgattgtttactatttgtcattcgttttgaatacatttgttgaatacacaaaattcctatcttttattgatttattatttatttgattcacatatcaatgtttagcacgttttgaacaagcaaagaaataacagcaaaagctggtcaagagggctttgggctctatcattcacctaaaatctctcacacaaaagatttgacaacatataaaattcatggtctccactgaacatgtacctcactattaaatgatccaaaaaataacagaaatatttggtaaaattattttttattagcccttattttaatttatcttgtcacagattcctatttccaacacgataaagtaataactaaacaatgttccgttataaatgtcaacgtcacaatacacgtcagtaatccaattattaaagccaaaagtttaaccaataaaagctcaccacgtgtaaactggcatcttcttcttcttctacttcttgacttcgaagcttttgttagagtaaagaaccagagagaagccatg

SEQ ID NO: 15054 - DNA, 3000 bp, Unknown
  misc_feature (1)..( 3000): cDNA_ID_3080363_gDNA_ID_2685554_Annot_ID_193347 3000 nt of promoter + ATG
tctagaaggatcacatcccgtcttcggcagcaactgaagatacaggggagcatgataagaagccaaacaagggagatgtgtcaccgtagcctcctgccatttcagcctaaagtgagcacaacatagaatccgatccaatcttttagcaatgtaaaactgttgggatttccctctcttccatgtgaatcgatttcctttaaatcccatatctatcagggacaactcgtttatccaatctccaaatgctacagaatccggggacaaacaaccattaccgcccgttctttcatcaagtcggactattgtgttgaaatctccacctatcaccactggtccatctattcccctgattacttcacgaagcttctcccacaaaccactccttcggctaaccgtaggagcagcgtacacaactatcaaattaagtatctcgaactcattctctatacgcgcatagacgaactgctctgaagactccttaatctcaactttcccaatttccgacctccatagtacccaaatgccacccctctggccaactgcgtcgattctgaaactattttcaaaccccaaaccatgacaaatccgatctgctctcgcccctcctgcgtgcgtctcaaacaccgccaacaaatctgtcttgtatttcttcaaaagataacaaactgatcttcgaaagttaggtttattcgccccccggcaattccacataatgcaattcatcattaataatcgataaagaaaaagaataaccggggcaacccgtcacagaagagtgagctccgtcgataacgctggcgcggccccctgagtccctcccgccacaaccactacattatcctccaaactcggcctaatctcctccgccacttccatgccgaccaaatcgggtttctcatgtccaggttctccgtcaactccattgaagaatgaccctcctggtcgacccagacttatctcttctatcctcacacgtttaccgttggccgaaagctcattactctcatgggctttatgactccaggcccgcctatcccgtagcccttctctaattactcctttcccttttccctccgttgtagcgacaaatttggtaaccttaacttgctccccactcctatcttggaccactgaattcatgggatattcattctccttattatccgtaacaccaataatttctttccttctcccctctgtttccacatcctctcccaacttaccaaatgagttcgacgtcacaaccaactcatttccttttttcctcacatgatcccttgatttgcgattcacattaactctagccccaccttgtgcattcacattccggttaacctgagccaccgtcttcctttgtcttaccggggtgaatccatccccatcatgtgtaggaacaaccggattctgaacatttttggtcacttccacactcatgctctcctcccctattccatgcgagacccccctaggacacttatgaacaaggtgcccatacataccacactgtgagcagatgttcgctaacccctcgtatgagacatagaatctctccccgttaaccaccactgttcctttaagaggtttctgcagatttacttctacacaaatcctggcaaaacgtcccctttcaaaactgagtgtgtttaagtccaccttaataggtttccccaagctattagcaatccctagtaggatgtacttatgatacagattccatggaaagtttgaaatccgcacccacaccggcgtcgtaacaatctcatcccgcaagggatcaaaatcaggcgaccaagcttgtgcgatgagatagttcccaaacgccttccacgggcccccagtaagcgctgccagatactcctcttccatctcaaaacgaatcatgaaaaattgtcgtggaagatccatgacgtacattgcaccgcaaggcttccacaattctcttaactttcgattcaacaccggcaacgaaatatgacgacccaacactttcactaccatacaccttttccacagaccattcatcgcatccaccacttcttgaccaatcgtaatgaccggctcaccatcctcaccattaggaaactccacccgtagtctctctgcaacaaactcctctgagatgacttcttctgggatcgggactcctcccacactagtccccttaactttctgcacccatactcccggatcatctggtggtgctcccggtggacgagacttcacaccaatatccaccatggtagcatcccgctcccctgcgctcgaaaccctagactcgcccattctcaatccagtacccgtaaaaaaaaaaaaaaaaaaaaaaaaaaaaaaaaaaagaagctatcttacaactatttttttgaattttaatcataaaaaaatatattaagagcccatagaaaaactgtctccagtggaatacttttgttaagctcttaagcaggtttggcccttacggagtttccaatatactaaaagctcgtaagcaggtttgacccttatataaaattcagcaaactggtgctctatgcatcaattatgataagtcttatggtgcagtggtttatgtcacaaatgttgggtctatccttgagcactctttttttttgaataaaaaatattttaattatataagtaggacatatatacataagagactttgggctggacatactcataaaaagccatgcgaattggcctggcacaactcgtaattttatctgcacaaaacagatagaccaactctgctctgctttcttatggtcgggacccgctctcagccaaaaaaaagcaaaagtagcctggcaagatgtttgcacacctaaagagcagggaggtttaggcctacgatcgatcaatgaggcaaataaggtcagctgctataaactaatctggaggttactatcatcaaactctctttgggcgagatggatacacatttatcttatcaagagggcttctttctggtcaataagcgaaactactacactgggatcttgg

SEQ ID NO: 15055 - DNA, 3000 bp, Unknown; identical to SEQ ID NO: 15051
  misc_feature (1)..( 3000): cDNA_ID_3080351_gDNA_ID_2685554_Annot_ID_193351 3000 nt of promoter + ATG

SEQ ID NO: 15056 - DNA, 3000 bp, Unknown
  misc_feature (1)..( 3000): cDNA_ID_2783413_gDNA_ID_2685557_Annot_ID_138141 3000 nt of promoter + ATG
acctaaattgacatacctttacttgaatctctttcctctagcatcgtgcccctaaaactgtcatattttttgctcaaattataatgtctcttcctcatacgtaatgtacaagttaacttgtatttttccattttagtttttagggtctgacggataacacaaaaacgatataaactgtttagcggcaaacgataaaaaatagttaaaaacgttacaaagtagtggtgtaaaaagccgaaaatatcgattttaataatgcttttatgattggtaattatcaaaacattatacttcacattccatcgatacagtgttatatcaaactgtaaaccctgtttttttcgcgactccgtttcaagcttatttcttttcttgatatttaattttagttcttaaaacaacaacactacatataaatacctagataggagagaacttaataaattagatttttaattaagagttgacccatgatgaaggtttgatttttatttttgctagcagtgtgaaattagtctcttaggtgtgaaattatatgtatgaagtcatcaactttgatgttgagactttaattttgttcaccacttcaatgcaattgcttctccttttcctttttgttttattcttagaagaaaattgacgcaaaatagtggtggagctagacattaaaatttcacttcaagacaaacaacggtgaaaaatcttccatgcaacaaccttttttgttgttgttaaagaccatggaacgctctttctaggatcaacgttctcgatcaatatagagagtcagcggtttgtgtcaatatattcaattcttaagatccttgctcgtcgatgttactggccagttggatttttttcatttaatataaggattttccggaaaaaaaaaaagctttcaaatcgtcatattttacaattctacctttcatctctaataatatatcaatcacaatgtaaaaaataaatacacaatataacttttataggtcatttataagatggacttgaactcctcgttacaaaacttcattttgatctattatttttatcaaaattttaagaaaagaatgacaacagacttaattgtgtattattttatattttatgtgatttatcttcatttcagaagatataataaaattgcaaaatggcgatttggagggcttcaattttacttcacatgtttgtttacataaaaacaatgttgtagtaactagacacaaatatgaaatccgaagacaaccttgttatgaagttcttgtgaataggaataattgtattagtatattaaaaaaaatattcaatattattgtgtgcaaaaattacaggactcacttagttttgccatcgtggtgtggtttcgtaagcacatagtatcatatgctaaacaaaaatcgtggataaattgacggtgttatgtgtggtgtaattgtttgaatgcagaattgcgtatgcatgatcataatgttaacttcaaaatttgctcgtcatagatgccccctgacctcttaaatattttgttttttatgcactgtcacaaaattctagatgggcaatcatgtcaaaattcggttttgaatttagattataacgtgttttcagaattttagtgcctagaatgttcatcacccatttttcgttttaaacttataaaagaaaagacttttgtgatcgttcaatataatcgtcgacaagaaagaaaacaataataataataataattttctatataaggtacacttgctacattgatatatatacttgtctaatattcatatcttttggttcattcttcatcttctaccttgtctcacatattgttaaggtaaaaaaagttcgtcctcgtcttcatatctaaatccttaagctttaattcttagataactaggctagctggcaagaaagaaaaaataacttcgatgacaagtttatgctattctccaaagtgtcaagcttttttggcaacatctatttttaaaataaactttcatttctataatgagtagttatttacaaagtggggaaaacaaggaacaagaattgataaaatatgtaaaacagagatcttgttttgattctttgttaaggaggacaaacttgaaaccatatttatttgcagtatcccttttaatattatttctagaaaaatatcaaacgataagtatttcaataattaaattagcaaaaaatttacatatatttaaatgacctgcatgacattgttttctgactgttttgttcgcggttacaatagaagtaataattttaaatacgtttttaggaaaattttacatctactgactactagaagaatatgaactttattagcatactactttccatatagaaaatgtattatttagtatttttctttcttattttatatcatctttataaattaaaattttattagatgtaaatatctattttaatatatatatatatatattaaagcctcttttgaaaataaaaagtattcaactattttgtttgtttttgtaaaacattatcgtaaatacaattgttaaacgatgtatttgatatatatatatatatatatgtacatacatgatatataaaatgatggaatactatttttgaagagaaacaaaatgccaatagataagtgtggaccaagatgaccacgttctgttaactttagtgctaatacatacaaaagagtatactacaaattgaatttagaaaatatatagtaaatgtttaaatgcaagaaacaatgattaaaaatttagaatgacatcttaatcctgcataataacattaattaaatctaacttcaattgatttttcttttctgttttacgatttcattttgatttattgtttatgcttttacaatagtagatatgaatttaaatttttatatataaattatgcaaagacacattatatttcctcatgtgctttctagaaagtgttagccaacttttcattaatagttatgcatctaacaaaggatgcatgaattttgtgaag

SEQ ID NO: 15057 - DNA, 3000 bp, Unknown
  misc_feature (1)..( 3000): cDNA_ID_2783420_gDNA_ID_2685557_Annot_ID_138143 3000 nt of promoter + ATG
tgcctgtcattgcaagctgatgcacatgcatgcttgattacttattgtctgatcacatatttcagttatgtaaaacataaatattctcacctaaatttctttctagctgtaacttgatcgttttgtcatttgaaagccactttgatccacaagagttcaaagagagatacacattttggtttattgttcgatcagtttagatgaacaattaaaggatcgataggggtatattgcaataattataattcaattaaatcggctctacttatatatatatatatatatatcaaaacttcgaaactacaagtgtcatttcaaaatattggtagagttcgggtgcagtttaaatgggcttacattggtaaacttggaagaatatatgcaaaacattagttgttatggaattcaaatttggcacgtttgataattaattaagggttttccacaagagaatgataaaaaaaccattacaatatctttataccaatctggcataaagataggcaagcgataaactctcctttctatcgatgttagagcataatattatcttggtttataatggaaaaaggtcttcataaatatgtgggtaagtgggttcaaagacttccatctcaatttggagaaatcaatggatccccgatgattagacacggtcgacacaaagacgggaacacatatatccccccgagtcttttagcatatcatatgatttttgatcaattggcaaaagaatagaatattaacatgttataaaacaatttctcactcagcagaaatcttgctgattcgtggaattctgattattaaagtttataaagtagataaaattagttacacgtttaagaaaataaataaattctatagtcaaatcaggttactgtgtagcacacaacatacactaattttatgataactgacatcaggttgcgttagcggtaaatttaagactataatcttgaagaatagattgtgatacacaatttatgatatgtggaatgggggaacaaatcattaaccatgccttatgtgcatgcttaccatcactacaaaacgtaccccgtggcaaatccgagcttggtaactttctccgcggactattgtcgagaactgaatatatttgaacgttattttcatgttactttttaacgattagtctcgctctattttggggctactatatatgaaaccaatcatatcaaagtatatcgttggtaacttagtgacgatttaacataacttaaatatatatactttgatatgatttactttgatatatgaaacatcaaaatatactttctgagataagatagcccagaaaggtgttagaacactctgggaggtaactcggatcatgagagggatcataatgagtaagatagagaacgtacaaaaaggactacgagaggtctcacacatccttttattttcaggtgtagagtcgagagtgttgagtttgttaggtcttggagaccaacaacttggtcatttcttggtccacaagcaaccaagctctcctcctcaacttcttgatatttagagtaccgaactagagggtcgggtcatcctataggtgtaagggctataattgtgaaccgtgtgctactggttgtggtgatgggactgaacatcgatggttgacatgcttcgccaagatggaacgtcatattttggtggagtaacatgcgaaatttgtggctggcacaattgttgggtacagaatgcctttttggtcttgctttgtctcaggttgcgcctaagttgatagctggcccggttcaaaacatcatcctcttgtctcccgggattctattctatgggaacttacaccgtccaattcatgatgaagatgattccagatgactctcttgaatcgtttcatatgtggcaaagacacatgtcggtttcttatatggtaacggaaaatcacccaaaacaaaatattagtataatactaatattagttttcagtgtcatttcttaacggaaaataaaataaaatcattcttgcattaccatccacatgtttttgtttactcatgaatttttgaactttatctctctaaattattaaataatattcataaaacaataggattttagtttaaaagacttaagtttacaatttcttgaaaaggtattagttcacaaattcactctaatttaagactattctactatttgttttttggttttatttattctactaatttttccttgatgttttgcagggacgttgtagagttgacatttaacttagactaatcaaatgatataatataatttttacaaaacaaaaaaaaggttctcgcgttacttcttcagccgcaggacaaggtagctagcacgattaatcaaaaaagatagctagctcaaatacaaatgtacttgaaaccaaactcgtcctgtcctttcttattcgtttaccgtttccgttgtcttatattatataataacaagcaaattacactattacaatatcataacaaactcaaatggctaagaaataaaataaatgtagtttccactgaaatctactaaatatcaatttgcgtttgttgcacatattatttggcaagccatctcctatttaaacttatataagatcatgtattatcttgtccatttattctcagttttgtccttctgtttgtgggctcaacttgatctgtttggtaagaaaaatatgagtttccgttgtgtgctacttatagttttcaatatatctttccattagttgtatgtcttctctcttaaacaatcttcaacttgatctcttgtaatgaacggaagttttctcaactgtctccgtatgtcaaaaggataattagctgtaagtatggattattagctccaaccaaggctcaaaattttcacgatttctaaacacaattacaagcatcaccaaaacttgtgatatgaaatagctctactcttctatattttgtagggaattaaaatattttactaatacaaaatttgttttttctttttcagatg

SEQ ID NO: 15058 - DNA, 3000 bp, Unknown
  misc_feature (1)..( 3000): cDNA_ID_2783434_gDNA_ID_2685557_Annot_ID_138147 3000 nt of promoter + ATG
caaattttaggtacttctgaataaccgatgctacatatagttgaaaaaaactaactccatattggctatggttgttgatacaggtctgttcgatctgtctgtgtccgctgaatatctcagtcaggaaatcatcaattgccttgttcttgcggaagatggactacatgctgtggtgttagttctgtcggtgaggactcggatttcgcaagaagaagaagccacacttaataccttacaagttatttttgggagtcaaatcattgactatttagtagtattattcactggtggtgatgagttggaagcaaacaatatgacattggatgattacttgtccaaaggttgccctgaatttctgaaggtcttatatatccctttgatttaatcttaagaacttggatagtgccaatagaggttcaacatcacttatatgtttttttttaataaaaatattggattgtgcaattttagacagttcttagattgtgtgggggcagaaggatcctctttgataacaggacaacggacgaaggcaagaaggtcaaacaagttcaggaacttctcgcccatgttgcagccattgaaaagagcactagtgggattccgtttacggacgaaatgcaccgtaaaatacaggtggatatgcttaccatctacatccatttttagtgtgctttgcgatagctagaataattgttatatgattaaatctacggggtctcagaaagaggcggagacgcttagggagcagcaaaaagaggtcgaatctaaggaccttgcagctgccgagattgaaaaatggaagaagcattatcaaacagagcatgacaaaaatatgaacatgatggcagagatggtaattatcttattcccccctaatctttgtatattggcaacaattgtttaatttaatccaaggagacgttagtgtcatgaagtttgaaactctcctataaagtatatttctaactaatcggttcttgtttctctatcagctagggaataggctaagagaggattccgaaagacaggagaaaatgttgcttgcgctgagagataaccttgagatttcacaaagacaaaacaaattgaacgaacttactgataatgagcctgatctcatacattgtggggtttcacttaggcggatgccatgcaacatgttatgattggtgtatccatttcaggtgaggataagctaaccaaagatttaagcagacacggttcacatcatcatttcgtccaaaaggcctggtcgttatttctttcctctttcgtttgatttacgtttgcttcgtggtttctttatttaataataaaaagaataagaatatgtatcattgttgtatgttgtaatctttgagtttcttaaactctcatctttgtactcgttcttctttggttgaatgaaaacaaggtttgacaaaaaaaaaaaaaaaaaaagaatatgtatcattgttgtattaatataaaactttcatggtgcatggcaagcggaacttgatagaaaccttgtctcgttgattctgggaatagccgagagaagggtttgtcacttgctcgtttattcttaagaatggccgaacaatagacgaacttgaagatcattgattcacagtgaatggccgattatcaagagaaagaagaaaagcttaaagctctgaatattattcaataaaaggttgagttctgcaactacaaaagagcctttatatagaggcaacaagaagaaaaaaaatcctaacacgtttgggaaaaaacaccgactaagacatagcttaaagcccaaataagtaaaaggagagaaataaaagaaagcccaaaaagaaaattaaaaacagagcataagtataaggatgcgctgcatcagtgcataagttttataacgagatgttaagagcatcctcattggtgacctttttagagatgtctttactatactttattataaaaattaatattattttaatttgagtcatttattagtcaagtgttttttttttgtgcaatgaggatggtcttatagtgattgagtagtgatttcttctactaaaattgtaagcaaattgaacccaaaaaaatccgacctaaaactaggtcattttatttgctaaaacgttagacgatttaacccgcaaaagggtcaaccataaaaacattaaaagactcgatttttattatttgatcactctgaatatattaacaatttcatatgaaaatattaataaaggaataaaaaatttgatgaaaatgttagtaaataaatatcataaaaacaaagaaaacaaattctttcatatgatcatattggagaaggattaatcatagaaaaaaaagagacatatatatatatatatatatatatatatatataattatatttaatcaactacattcattacaaaaacatcaaaaactattatatttcttttaccgttgatgtatgtaatcaaaaacctcaaaaacattttatagatatgctcttctccgccgatatatgtaattttatttctttttaatatatagtagatgccaaaaattatcaaactttaagaactttgatatgcgggtagtcgtaataatatagtttaatttgagttgaaactcgaaaactattatatattcccaaaagacttcgtcagttaattaagaatggaaaagaaaagaaacaagaaaaaaaaaactcaagtggaacacgaaaagatggtaaaatttaaacttaattcttaaaaatttcaaaatgacttagcattcaagagaagatcgcacgacgagaaaacgtgttgcacaggtgatcttcgtcaatcattttgagtttgtcttttgtcattttttgatatttgaagaaagtttcttctcaattatttgagcttccccgggtaaatatgtatgaataattttgctcagagttgttccctttcttgatcaaggcttttatgttgacctaacaatctgttatctaatatttacatgtaatttgtttgtcaaagcagctaaaat

SEQ ID NO: 15059 - DNA, 3000 bp, Unknown
  misc_feature (1)..( 3000): cDNA_ID_2783436_gDNA_ID_2685557_Annot_ID_138148 3000 nt of promoter + ATG
catgctaatatatcccttatgaggatttgtgatgcgggatggtagggctagaagtatgttttgaaacatgtgggtaaaatggattattttcactgagtaaaattatttaattatgtcgtcatggatgcatgtttcttttctcaggagtaatagtacacaaaagcactgcttattggtaaggtttccgagaggcacacatggcatgccttgtgcacaaagtcagcgaatcgggtgtcacaaaacaaaccaaattgataagattcaattgtctttagttgcttcatctctctattctcatcaatccttgtcaaaatagggaacacgcctttggtggcaatgagctacattagctattgtagttaagatgttgaatgatatatttgatacaaatgaaactacaaactatatatatatatatatatatatatatatatatatattagaaaattgtctacgcaatacgtagattatatattcggttttggttttgaatatagaataacttatacattaaattatatataaatttatctataatgttaatatatcgcttgaaaataattgaaaatattaattttgatgtttacaaattatgatgggtttaaaaagacactttagttaattagatgttttcaatgcactcaatttttatttttggtgaaaacggtatgttttattataaaaaaaaacttaaaatattcagtgtttttatttttgatgaaaattgaaatgcatgtattaccaattattttgaaagtctaaacaatagataaaacttcttcatatttaaaaatttaaagcatgtgatttaagatgattttcaatggaaaaccctccaacttgactaacgatctcagaatgtcggttcaaaaaaaaaaataagtcatataaaatctgataaatgtacagaacaacgtcaaattatatatataacttagcattaattgttaatatatggctcgaaaataattaaaatataaactttgatctttataaattatgatgtgttttaaaaagacattttagttgattaaaagttttcaatgcactattttttttttttttttgtgaaaacggtatgttttactgtaaaggaaacttaaaatattcagtctgttttttctttttctattttttgttgaaatggaaacacatgtattaccaattgtcttgaaattcaaaacaatagatgaaccttcttcacatttaaaaatttaaaagcctatgatttaagataaaaatcaatggaaaaacctccaaactgactaaagatctcagaatgtcagttcaagggaaaaataagtcatataaaatctgataaatatattcaaagacgtcatgtcactacccaatgtttactcaatgaacaatactttatgtaaatgtaagataaattaaagtaaataaaatattctctttaagaacttaaaataacaaaaagaattgatattatatatccatataatgcataacaaaattaggagtttaaagttaacatatcatattattgagttttttccttaaatttgatttgtatataatgtaaaaaaaattaagagcaaataaaacagttgtcacctcaaaagtcttttttaacggattttccctcaaaagtcatgttaacaaaattaatacataacatgtataataatactttagatacataattttgagttatacaaataaaattctttttcgttatggttatttgcctccaacagtttaagattaatgttataaaaaaatttattagatatttacatgaatccattacacatgagtttcaatatgggttaactggaaatatatattcttgtttttcattataataaatgaaatgtcaaacaacttttattattagaactccaaacagataagccaatgaaataaaattaaaaaacaaattgaaacttgtttgatttatttttgacttcaaatgatggaaaaagtagagatatatgtctcgaagttaaatattataagcttttataaattgaaaccttaattttttatataagcaatttaagattatgtaagcaattttttatataagcaatttaaactaatctcaaacatttactaaaatgtgtgtctaatgctccgactggtaacacgaattatcaaaattgagttgcagtatatgtttaaatttgatataacttgcagtaaaaattatgtggtataactgcagattgatgtagtgaatttgctgtagaaatatgagttaataccagtaaagaaatcagtcaaaactttagttaggaatgatgaatagcaaactcatcatcgctctggtattcatggtcttcgatcctcatgtaatccaaaaggtatcctacagcatagtgccggttttatcctaataataagaaagttttcttggcctaaaaatcgtctttcttgtgttgattttttttttgagataaacaacattttattttgatatgccatttgagtttctttatgtgtattgtgctatagttaattaatttgtgtgaaactagcaaagtcaaccctaaaaagtcgtctcattcagaaacatgtcttgggcttctggttcgtttaccgtgtccagttcaacataaattatacagaataatattctatggaaattaacaaactaaacacataaacaaacgcaaatggcatataaaacaatattgtttatcttaaacaaaaaatcaaaacataatgttgggcaggtaatcgtccatttagtcttgaattgtttggtttcgattcttcttacaaaaaaaaaaactttgtcaattcgttttgtttcttcactcacaaaacgataagagagcttgcaagtttccatttggtacgatactatttcacatttttgttcgtcatttttgtttggagtatataatttgtcaacaacaaaactgttctttattgtcggtttttaaaagctatgtatcatttcatgaattgtttctttggtcaacatgggtacgtccaggaatttagcaaataattgctggtgatcaaaac

SEQ ID NO: 15060 - DNA, 3000 bp, Unknown
  misc_feature (1)..( 3000): cDNA_ID_3080397_gDNA_ID_2685557_Annot_ID_138149 3000 nt of promoter + ATG
atgccatttgagtttctttatgtgtattgtgctatagttaattaatttgtgtgaaactagcaaagtcaaccctaaaaagtcgtctcattcagaaacatgtcttgggcttctggttcgtttaccgtgtccagttcaacataaattatacagaataatattctatggaaattaacaaactaaacacataaacaaacgcaaatggcatataaaacaatattgtttatcttaaacaaaaaatcaaaacataatgttgggcaggtaatcgtccatttagtcttgaattgtttggtttcgattcttcttacaaaaaaaaaaactttgtcaattcgttttgtttcttcactcacaaaacgataagagagcttgcaagtttccatttggtacgatactatttcacatttttgttcgtcatttttgtttggagtatataatttgtcaacaacaaaactgttctttattgtcggtttttaaaagctatgtatcatttcatgaattgtttctttggtcaacatgggtacgtccaggaatttagcaaataattgctggtgatcaaaacatgggtacgtccgtgtctaagccggtttctgatgataagaaaaaaggtacgtcagtgtctaagccggttaaaaacattgttctagtggggcgttctgtcaatggaatatgcaccactgggaacaatatcctcggtcaaaacaagttcggctccgaaggtgctttcatgcactgtcagatgtatagtaccacgacaccagatggtcaaatgatcaatgtaattaaaactcctggtatgtgctcaattaaaacttgagatttagcctaaccactcataatcttccattgtatcttttcttacccacttcccaaataactcaacaaaatcattaataggaaataaacataaatggatatccttaacaatattcataatatagttaattctaagagtttccttactgaattggccaaggttaaattgatcaaagtcttgatttattattgtatgtacgtgatacaggtatgttcgatttgtctgtgtccgaagactacataagtaaagaaataatcaattgcttaactttagcagaagaaggcgtgcatgctgtgttgtttgttctatctatgaagaatcggatcacacaagaggaagagtatgcacttaataccctacaacgtatatttgggagtaaaatccttgaatatttgatatttttgctcattgacggggaaaagtttgaggcgaaggagttcgaagattattttcccgaatgttgtcctgaatttcttatggtctgatttctttcaaaatgaaaagaattccttgcccacacacatcatttcttctttttgatttttgttttccttttttattctgtcttgagtaaaaatttttttggaatttcagagagttctcaggttctgcaatggccgaaaggtcttgtttaataacatgactaatgatgaaggcgtcaaggctgaacaagtcaatcaggttatggcccatgttgcagcaattagcaagaaaaatgatgaaaaaccatatactgaagatatgtatcgtaatataaaggtaaacacatttttctctctaattgcattcatttaaaattcatagttattgatacaatactatgacctttttaaagagagatagaggaattaaaaaaatatatatatacacttagtctagttcatgagcaagaaaagatgatgtagaattagctaatggagaatagggagaaagctagagaaaagcaagatcattagagatccctagtggtggttaccatgactgcctcaaccaccatggtcaattgtccattgcatctcttcttttttgatattttgaccagttgtttctctctctctctcaagaaacgctgagcatatttggtatgttgaaatagctttatttctctcgggttctaatgtatcaatagattagttttgtaaagtagttatatacttttactataatacatatataccattacttatttatccatattttgtttttgctgttattgtttaacaattcggttaagcaaataatttgtttgaaatcatatgtgttataacagagtgtagcaacaaatggagaagagtttcattcgctagacgacacatttcagcatgatccatatttgtctccattccccatatcaggtacacaattcaagtgcaacaatgttttattgtcaatagtaacatatgtgatgccgggtttgaatttgattatcaatactttgaagcttaagccatctccattggtgagatactttgaaagtttctaaaaaaaaaatataataatattttattatgatttagtttctgtccaattataaacacacacatacacacatagtctctcaatcattactctaaagtttctctgcagagaaactattctcattctctctcctatctctctcctactttattattattttatattttttagttaatgagaaactatgtgagaaactactgatggagatgctttaatatcacatacgatttggaaatatgtcataatctaaatatttttgggtctgcgacggtggattgttatctaccccaaaactaagatattcaagtctgctaatcgtttagtctactatgtctccaagatccgttaaagccatagaaatatgagaaagtcaaataagaaaccaaataaaattcttacaacatctttcacattaaaataaaatgactaacacacctacgcataatcttaggcccgagcaagcaatctaatagtaaaactctaattacttggtcaattattttgtcatttattctaattcttctttttctttttctttacttagaaagatcaaggaaactcgtgagtttgagtttgcctttcgtatacactgctaattaacattttcattctcattttcaatactgtcagagccagttaaaaacatagttctagtagggcgtactggaaatggaaaaagcgcaacagggaacaccatcctaggtcagaaa

SEQ ID NO: 15061 - DNA, 3000 bp, Unknown; identical to SEQ ID NO: 9082
  misc_feature (1)..( 3000): cDNA_ID_2180117_gDNA_ID_2685557_Annot_ID_193384 3000 nt of promoter + ATG

SEQ ID NO: 15062 - DNA, 3000 bp, Unknown; identical to SEQ ID NO: 15059
  misc_feature (1)..( 3000): cDNA_ID_3080397_gDNA_ID_2685557_Annot_ID_193381 3000 nt of promoter + ATG

SEQ ID NO: 15063 - DNA, 3000 bp, Unknown; identical to SEQ ID NO: 15058
  misc_feature (1)..( 3000): cDNA_ID_2783434_gDNA_ID_2685557_Annot_ID_193380 3000 nt of promoter + ATG

SEQ ID NO: 15064 - DNA, 3000 bp, Unknown; identical to SEQ ID NO: 15057
  misc_feature (1)..( 3000): cDNA_ID_2783420_gDNA_ID_2685557_Annot_ID_193375 3000 nt of promoter + ATG

SEQ ID NO: 15065 - DNA, 3000 bp, Unknown
  misc_feature (1)..( 3000): cDNA_ID_2783413_gDNA_ID_2685557_Annot_ID_193373 3000 nt of promoter + ATG
tgtcagttttgaagaaaacaaaagtcacataaaatatgataagtgtactaaaaaaacaaactatatataaaatttatctataattattaatagaaaactcgaaagtaattaaaaatattaattttgatgtttacaaattgtgatgtctttaaaaaagataatttagtttttaagagttttcaatgcactatagtttattttccgttttttcgtgaaaaatgtatgtttttttttttttaacttaaaatattattttttgtgaaaatgcaaatacatgtattaccaattgtcttgaaagtcgaaataataaataaaccttcttcacatatgaaaatttaaagcatatgatttaagatgtctctcaatgaaaaattctcttacttgactaaagatctcagaatatcggttcaaagggaaaattaaatcatataaaatttgataaatatagtgaaagacgtcatgtcactacccaatttccaaatgatcaacaatactttaagtaaatgtaagttaaattagaataaattaaatattctttttaagaacttaaacaacaaaaataaattgatatttgatattacataaaaaatttgtcaccttgaagatttttttttactggatttttcctcaaaagttatattaaaacaattaatacgcagcatgtttaataaaacatttgattcatgattttgaattatacaaattaaaatttttcattatggtaatttgctttcaacagtttaagattactgttaaacttttttttatttatcttttattagatatttccatgaatccattacacatgagtttcaatataggttgaatagaaataaatatttttattttttattataataaatgaaatgtcaaacaattgttattattagatttccaaacagataagacggtgaaataaaattctaattgtttttgttttattatttagcataaatatagttttatttatgtttaacttcaaatgatgggaaaaagtagggaaaatatgtctctaagttaaatgttataagcttttataaattgaaaccataatgtttttatataattaatttaatattatataacaattgttattatttatatgtgatgtaatggcaacaataaatgaaaccaaaaacttaggaatcatatatataaaagtaaagtttcactctttccttaatggtccacttggcaatataagtttttttaaaatttatataaataataaataacttatttaacacacagtttaatataaaactgaaatcaaaaaaatatgtatcaactatatttttccactctactttattcaacacacaattaattaaaaattaactaccacaatttatttacaaacctgaaatcataaatatatataaattaattatatttctccacaccattttattcaacacaaaataaattaaaaattaactcccacaatttatttttaaattgtaacttccatcacttctcatcctataaatatatacattctctcattctctcatttcttcatccccttccaccgtatcttaaatattgttttgtttagttttaagtttttttcttgttgttgttatgagtttaaaaaatattattgtaaacacttaattctaaattttaattttagattatgaaccttacactgttattcttttttgtttaaatacatctcgataatcaatttttcattaccatcttataaataatcattctctcatcattttgcactatattcatgtatatatatcttatgttgttatatgggtaaaacacaataaatttaaaagatagaagttgtccttggggtttaaaaaaaaaaacttttatattaaaattcatatgattttataagaaaacaaattagtttgtcacttacaaaataaaatgaattggaactattatgtatgagtttatatcaacaaattattttgtaatttactttatcatacatttattttgtaaaaataagatatgatatgtttattaatatatacatgcataaataacatagaaaaagaaaaactgttaaaatatgagcaaaagtaagatatcaaattttaacatatttttaattttttaatcatataatattgatacaaaattattttaattaattaaggttttaaaaaaaaaaaactaaagatggaaaattttcttataaaattggaggataatttatagtagtgaactattaatgtgcagtcttattggttcctaatttacaaggaattttgatgacttcaattaaatccttgaaaataaagaaatgaaagattttaaacgattgttagagagttttttataatcttgttgattagtttttcataatcttgtaaagtttctcaaacaatctctttattttgataatactttccatgacttttcatgacttcattttgtgaagaaaaatgtaggaaatcataaccaataacacaataatttaaatcattaacaatcattaacaatcaaagatttttttgttttaattgaataacacaaaacttttaatgactttataaaagtatgaatctaataacccaaaatttatgaagagtttagattactttttacaaatcttaaatgaataacacaaaaatttaacatacttttaaaaaatcttgattgaataacaacagattttacatgacaatttaaatcactaaaactcttttgaaatcatacacgaataacaccccctaaaacataatatcatgtcaaaattttaaagatttgattttgtaattagttaagggagttgcaattatgctagaagaaaattcatttcaaaattgtagtttaatatgaagtaatttcaaagtttaatgactatttttctaaatatttaatatatctattaataaattattttagtcaaactacaattaatgataagtacatgtgtcatcaaagtatagtgccaaatgtcgcattagtaggcaaagttaggaaaaaccttctcttattatataagattttgaattacaggaagtg

SEQ ID NO: 15066 - DNA, 3000 bp, Unknown
  misc_feature (1)..( 3000): cDNA_ID_2783451_gDNA_ID_2685557_Annot_ID_138153 3000 nt of promoter + ATG
gaaaagctcaaagcgtttaagatattgaaagctttggtgaaagttattggatgatatatatagaacctctggttcgatagattcaaattcattcactatgttatctattttatttctcaagtgtatgtctagtgtctttatattgtaattcatgttaaatatatcttgactcaatttcaatagatgtaatagaaacaacctatgtaaagatttaaatattgaaaatccttggtttttcaggaagagaatgataagctgcgggaacaagaaagtaatatagatgctaagaaacttgcagaagaagactcagcaatgatgaagcagaaattacgagtggatcatgatcaaaccatgaacatgatgattcaaccggtaaaactatacacataaaaaagctccatgctaatattgattacgtaatgcatgcagttaattcaatattgaattgttatcatgtatgtgaagattatgttaaaacaaagtacaacgacacatgaaagagagatgactcatatcgaagacacacaaaccatgaaaatgatggtacgtatggtaaacttgaattcataaactttgaaaacttgaatactatttttccaacattcaattaatttcttattctctggcttccatataggtggagaatgctttaaaacaaagtgctatggcacatgaaagagagatgagccagcttaaagacacactcctattgaaagacacacaaaccatgaacatggtgaaacaaatggttaattcgtgttcataaacttgtagacgtcaattcttattcttatctccatgattttttttagtatttatggttatatttcagatggagactgcattcaaagagaatgcgatggtacatgaaagagacatgtgtcaactaaaagacacactccagctgaaagacacacaaaccatcaacatgatgacgcaaatggtacattcttatttataacatttgttagtatgaatactttttcatttcacgcagttaatttagtattctttggttttatttctggtcaaaatgtgttaatacatgcagagtgcagaaacatatgaacgacagatgcgtcaaatgaaagacattattcaacagaaagacagactaaccatggaaatgatggaaaaaatggtaatttcatatagattttctgtaatcttgaaatgtttatctttcactggatactattaacttgatatattttggttatctttcagatggaaaatgcattaaaacagagtgaaatagcacatgaaagaggaatgcatcatcaatccccccgaaagggtaagacatgtggatgcaacattatgtgatgtcgccaactctattaataaatatcaagaacaaagtttctgtgtgattgattcaaaacttccagtatccatactttcattttgtgtgctatttttatataattctctacaactctctcatattgcaagaaacgaaggacatatttaacacatgtgcaaaacgtttttccaatattgtgtgtataaatgtagttatacattatttctcttaataaaggaggaagacatatggatgatggtaattttgtggtatattgtgtggtgagcctagtgtcacagacttttcttagaataccatgagactgtcgacactctccacaattgaccatcttcgactagttttaccctactttgggttcatcaggtgatcggctccaacaaaacagacttacccttgataacttagtagctatgttcgacatttataataataaactcgcaaaagtaaaagtgaaagaacggaacctaaatatattcatcacagtggcatatttagtcatgttcatcgtaaaccctaaaagtcaaatgtcaactctttcctcgttgcctttttaggctcttaaaacatgcagatgcatgagataagattaaattaaaaatttcatataatgcaacttgaaatacagattcgttttgtttgagaaaataatcggacttcacataatgcaacttgaacaaagtttttaaaatagggtctatagctatccagtagctagttttaacattcttacaatatatatgtaatttcctgaccgcccatgctagtgagcacctacgtcctttctcgggtccatgggtcctatcctgtctgacattcggtccgctacgtccaaaaggttttaaagacttggtttcagaccctacaaatcaatatatgatttttctttgtgttttttcctcacttacacagttccgacaatataatcgcaaaaaaatgattttcttttgaaaaagatgatttaatagtgccgaaacagttagtacaaatttacgaaatggtctatatatacatatttatgtttaaacttagttaacaacaaaaaaaattactttaataaaacagtagataaatatttttgcgaaataagaagatgaaataacagaacctaaatattcaatgcagattcattaagagccatgttccttcatgttcatcctaaacccttaaaagtcaaaaatcaaatgtcaaccctctcctcgtggccttctcagacacctaattgatatgccgatcaatatgtatgtgacgtagtgtttttagtgttttttaattgtttttaagattacaatagtgacatatccatataatgaatgcaattggaaagaaatattcattctttttctttgaaaataaaataatataatgcaacttaaacaaaaaaaactcatacaatgcaactgtcttttggccacgaaaagttctacatatggctagcccatgttccaagttagtttaataactaaatatattactcaattggaaacaaagtaggagcttattgacatttctcgagcagctatttaattgataaataaatttctttgtatttaaacaatagctcttagtaaatactgattacatactttttcgataaattactggtgtttcggacttttggtacataatctcgttcattatccggagctaccctttagtccattcctatttaatga

SEQ ID NO: 15067 - DNA, 16 bp, Unknown
  misc_feature (1)..( 16): cDNA_ID_3080506_gDNA_ID_2685558_Annot_ID_193393 3000 nt of promoter + ATG
gaattcagctgagatg

SEQ ID NO: 15068 - DNA, 3000 bp, Unknown
  misc_feature (1)..( 3000): cDNA_ID_3080487_gDNA_ID_2685558_Annot_ID_193399 3000 nt of promoter + ATG
ggcttgtgagagtattgtgagtagtgaccccttttatctaaaggggttgctgaaaacatttagatcttcttgtctcagcagtgtatgttgaagtgaatctccccacatggtttttatcgtataacctgtagtagtatatagcaccattttatattctacacatagattcgtatagttcaattataggagttacagaattttgtcaggagaatatcatcataactcttatgttcttaatgaaaaaaaaactggaccaccagggagtgacaatgagaactgaaaaagggttcctttccgaatctcatattgggagatacaaatacatacatacttaaaatgtgtaatgtatgtcgacagatcgatatgtgtatatgatgttattgatatgatatggatgtgtgtggttggtattgtgtaactactggtgtttgtatgtgggagattattgaataagagagacatgcgtcattatgagtctctctctctctgctttttgggcctttggattcataggataaaaggaaaaagaatctcatgaaccaaccaaaagctggaaaaagaaaatagaagaagataagagttctagaagaaaattacaaaaacttttaccgatgatagagaccagatgattatcattttcgatattctaagctttgatacccctgaatattttattttcttactgttaggtttctcactttgtcttaaaaggtaacccaaaatttttatttggaaaggagagaaatgcttgaatatgtatttttaagtaaataatcaaatcttggacttactttaccagataatttaactaaggtgagagatgggggttggttgcacagtaaaatccaataattcaggcattatccgagtcaactgaaaccaagataatggtgaaatatttggggctatcgatggtgaaaatggagatgattactaaaaggtggcattcacatggcagccattgtagcatatgatgggtcaagagagaggtgaaatcatcactatataacttttttggattaaaaaataatttacttttaccaagacaagtgttgattttccagagagtatgaagatacaacaaaggacttaaacttgtttctacatacgagtagcaattagggaaatgtttagaggattatgaaagattattagttgatagtatgtgatagtaagtacttgaccaataattagtgccatttattttcaaaactactaaattaatggtgtgctagagaaatgactctaatctttcgagtctcaacgagtagtaacaatgattttgtttgtgtactcttcgttcttccccttttctccatgtaataatctgcaagtgggtctattattgagtttgattatgccacctttttgctccttttatattctttttttcttaatgatttttttttggtttatttatctagtagatatatataaaaaaaaactaatataaatattataaattctgaatttaggcagtaaaacacaattaaacgatgatttttagaatttgtcttaaatatacagtatatgacaaatcgaaacaaaatgtactacttaaaaatctttttattgtttgaatagtaaacttgtttgttttcaatagagttacgaattaatcgagatggaaccctacccataactaccttcttttgaaaaagatgggagtttgattagcttttggatttgtttggttatgaaaacataaaaaaataaaaaaaatctcatcaacttctaattccgtaaaaggtgtcatcgtcccaacgacaaatttgcttctcttcttttcgtttattccacagttaactaaaattacgagtttatttgactataaattaacgaaataagtgtctaaaatggggataacaaatttttgacaaaaaaaataacatgatgtgggaataacaacatacgtatttgatgcagtacgatacgacagtacgttggatattatttagtttcttcttattgtactttttaacgaattaaaaataccgtattatattagattaaccaataaatattaatacacatcaaatatcattttcacgaatacttttcacattgttgcactttctaacaaccgtgaaagattgattatacgtaatcaaaaacgattaaaaccaataataaattaattcagtatggaacatattatattttcctattggccatgaaagcttttacatggcaatttagtaataacataaaaagacaagggcattgtacatgtcccttgctctgacactaatgcatcacttcaccctttctctttggcgaaaggtctcgtaaaccagtggtgagcaacacatgccataaccaattaaccataccactcctcaacggtcaagattcctttttatgctatccattgaaccattctcctccgttggatcatccaacacccaacaagctttaacttaaccatggttagttttttggtcagctaggttaaagcttctctcctcttgattaaattgttccattacagagtttctggttttttttggcttgcgtgatctctctcttctcttctctctctcactcatccaaatctttgatcatctcatcatcattggacttgaagctaactccagagttttatccagattcatcattttccaacgtttttcttcaatcgaatcatcagcgagtttggttccgacgacgatcttagtagcttcataagctcaaggtctcgaaactctttctagatctagctcatttactttcttgtagatctgaatcttaatctctgtgtttagtttatcgagtttcaggatctgttgtttctaaattagtttgtataatttgaatctcgctttgttgcagattcttcaggtttcggtggattttcttgagctcttctaagcttctccattttgtgagcctccgatttcgaacctggtagtgttgtggatctcactggaccacgaagctttcttcactgagctaagcttgaagtcaattcctctgttcgacaatcaatagaggaagatg

SEQ ID NO: 15069 - DNA, 3000 bp, Unknown
  misc_feature (1)..( 3000): cDNA_ID_3080498_gDNA_ID_2685558_Annot_ID_193396 3000 nt of promoter + ATG
taaaaagacaagaaccttccttagaagatcagcaaagcactcagagaactaaatctaaggattaatacgaatctcttgctctaaaatttcgataattggccaccaaacaaaatgataaagaagtcaagtcagggttcacaacggaactcttgagtttcacattatggcttatccataaatcaactcaaaggaatctggttctgatcaggatcatagtattcccaaattccataaaccaaaacactagttcaatgaaccctgagcattaatcagtgatccaacataaaagctaacaagattgaccaaaaaaaacacagagaatcgaatcagtgcactcacaacaatgaaagtaaacgaaaattaaaaggcggcaagtggtagagaaagaaacgaaccagccacggatgaaagagaagcaaccagagtcagaatcttggtaatggtgatgatcatgatggcagtggtcgtaattttgcggcggaggaggaggtggtggtccgtgatgctgatgaggataacctcctccggcgaagtagccttgataaccgccttcgtaaggacgtgaagacggtggtggatatcctccgtaaggctgaggtggaggatatccttcgtgatgcgacggaggagaaggatatcccggcggtggcggtgctgatggataacccggaggtggatagtgagattggtatcctaattcgtccgatcaaaaacaggatcttagtacttttagaatagatcaaaataagagaatcagaatttagaatcgaagagaagagaatcataagaaggagaagtgattacgaacgaacctggaggaggatacgattccggtgggactctgtcgtagctcattttttttttgtcaaaatcaaatttcacttttcgaatcagagagtttttttttgagattattggaaaatataaatatattttaagtgccaggcttttcttttcatttaagtaaattcacgtgtcactaaaatcatgttgctcacgttcttattggatttgggccgataataatttttatttattcgtttgtttgctattgggcctatccacttatttggtaaacatgaaattctatccatcattcagaaaaacagtgttaagaagaattattttttcaagtaaatgttagaaaaacgagagctacaactaataaagttcccatgcatatactattgcgcatgcattttgatcgctaaacacaaacgctttgttttttttacggcgagaagcagtggaacacaaaggcaaagctatcataaacacccccgccagtgacccggaactcattatctggcggagattccgatatccgagggtaactatttctcttctctggtgtcttgcttgaagctgagccaaacctcatgctttttccggcaacggtggcagcttttttctccaatctccggcggttgatatactcttccgatataaagacatccatttgataaaaagggatttaagaagtggaaaacctttgagggtgtaatttatggaaatgattatgaaataaagagatatatgttttgattcatagtttgttgtttgttgagctagggaattgaagtgaaaggctgaaagtacatatattttatagatggggaaaaactgtgggcgttaggttccatgttttggcacatatattaactaacttatacatatttattttaaatgttttccataaaagtttttttccccccgttatagatgtgtactcgtgttgaatgctatatggttattagttttgtgaaataatttaatagataactaattagtagaacctagttttcgtggattcgatggattctctttttggtgcaacttttggctgaatacatattaaaataactttattacatcacgtgtatgcatcatatgatgatgtgcatgatattggtaatctcgagattcgagaatctatctactgaagtatgtgaaaatacaaatagtcattatttataattatataaattcctcaaaaatccaaacgaggagccgtaaactatgcaagccacagattatatcgaacgacaattgtatgatgttctcagcatgaaaaccgctatagaacgtaacgcctatttatactttcagctctttgtcccttttctcgtctcacatgtgttcgtccttgctaaactacacttttgccactgtactaacatcgatttattgtatggaacgagaagaataaaatggactaattcatagtcgatatttgacaatcagtggattaaccaattaatgttcgttaaagtgcacgagttatttgatgcatgcgtgaattcaacttatttaaaactttaggtagagccgatatgcaaaactataactctagctagtccgtttcctttttcaataaaaaaaaactctagtcccttttatgacgaacccacaaaatccaaaccctaatcgatatcaaaataaataacaatgttaagtaaactgaaacaatgaaatagcctcagtgcattagatatttagatatatcagtgtttatctatatatacagatataataaacttctgcatacataaaaaaacatggattatttggtagagttttcttctttgagtttctttcccatccttctattgggccaattttaggcccatgatagcccaatcttacgcgtgtatgaaaagatttgacgttaaagcaaatttcaaaaaacgacgtgtagttcatctctaaaacgaaacaacggcaagacgttaaaatgcaatcttttttttgtagttgctccttcatcaaccacgtgtcttcaccttactggttcaaccaggaagcgaaatattgagctaaactgataaagctccttcctccgccatagccatttcttcctctctgtagttcacatagggggagagtaagagacagagctcaagcaacagtctcactcgagataaaataaagtcgtgattttgattggacccatgattctcattcgtataaattatcatctttcggcttaatcggaaaatg

SEQ ID NO: 15070 - DNA, 3000 bp, Unknown
  misc_feature (1)..( 3000): cDNA_ID_3080438_gDNA_ID_2685558_Annot_ID_193415 3000 nt of promoter + ATG
tctccatttacatgatcccacaaatctttgcctacgctatcaacttcccaacggcgaagtttttgcaatcacaaagcaagatcatggtcatggctggaatatccggtgtggttcttgtgatccatagtttcttcacgtggctagtcatgtctaggttacactggggacttcctggtttagctttagtgcttaacacgtcgtggtgggtcatcgttgttgcacaacttgtgtatatctttaattgtacgtgtggagaggcttggtctggatttacgtgggaggcttttcacaatttgtgggggtttgttaaattgtctttggcttctgctgccatgctctggtgagtgcaaaccttttttctcttccaattattttggtccgatttgatccaaccccattaatgaattcatattttaaatacaatttatttacttttgtagtttggagatttggtattttatggcactcgtattatttgctggatatttgaagaatgctgaagtctccgtagctgcactctccatatggtaaaatttgttatatctcttaaactaattaacatctttacaacatttaaggtttacatgatttgttatttgattcatttatttattatcagagagattctctgaataaagactagacccaacgtgcgtagtagtctcttgttttgtttaataatcaatgtccttaatgtattaagaattcaaaattttgaatacttccactgcaaagaaatttctaatgatttgttttccttaattaatggtgtgtggaatatgaagcatgaacattttgggatgggcagctatggttgcgtttgggacaaacgcagcagtaaggtaaattctagcgtgtgaaataaaactaactctttacaaattctacacatctaacaagtgccaagctaataatacatttttgttggcagtgtgagagtgtcaaatgagctaggagctagccacccaagaacggccaagttttctctagttgtggctgtgatattgtcgacagcaattgggatgtttatagcagccggcctactcttcttccgcaatgagtacccggttttgtttgtggaagatgaagaagttagaaatgtggttagagaactcacgccaatgcttgccttttgcattgtcatcaacaatgttcaacctgtattgtctggtaatatttgtttagtggactccaatagtccaatataatatggttgtacataacgtaaaccgaatgtatatgagattatgataaatttgataacgcaggagtggctgtgggagcgggatggcaagcagttgtagcgtatgtgaacatagcatgctactacttgttcggagtcccatttggtctattattgggatttaagcttgaatatggagtaatggtaatgaaattcacatccttttatctaaaagtaaaacctttatcaaggaaagacgaaagaccggggtttttgatgttttggaaacctattttgatcagggaatttggtgggggatggtgacgggaacttttgttcaatcgatagtcctgacttggatgatctgcaaaaccaattgggagaaagaggtaagaaaccaaaacactttaagaccgaatagtcacgacctcgctcaccgagtttattgttctaatcttttgaatgatatatatatttgtaggcttcaatggcagaggaaaggataaaagaatggggaggagtacctgcagagaaagagactcttttgaactagaaagagttattacttcaagacatattgatgagtctttcagatcacatttttgtatacgaaccttaaaagcaaaatttggttctctctttctaaaaaatctgtaacttgttatgtcatcaaacgctgacaagatatgttataacgctgataattatctataaacaatttgacttttgagaattggggtcttaatgaaaagttaccaaatcatttagaataatactactcgcttgtcagaagttgcttagtatagtagaaacgtgaggacaacagcactaccagcttccttaatcttcttttcatctgtattcgacacaagcttagccttgacaacaacaggtttattctccggcaagaaacctttccctaaaaccttaaaatatccaaattgagtaacatcaatcatagacacatagtgtttcgttgcttagtccataacgtcctgaggaaccatcgaccaaagcttgtcaagattgacgatctggcagtaaaacttgttcctgagcttgtggaaatacctcataccaactttaacaaaatatccaggatgatacttgtcgaagaggatacggtgtgatgcataccaccggcgttaccacgacttccgggaagcttacggtgctttccaaaacgaccatgtccaacagatacgtgttctctaagatttcttgtcttcttcctgctagtcgtcatttctcaccgattgaaattagggtttcacaagaaaaaatgggtattaaggtttatatgtttttacgcggcaagtaataatgggcttatcattgggccttaagagcgagaagagccagaagaatccggttccgattttttagtcaaaccaaataaagccgaaattaaattctgctggatttggtttgaaaattcgttattttaacaggaaataaaaacggtctaataagaataaaaatctattcgaaaaataagaacaatttttataaaataaaataaaaaaatatatttagaaagtgttatcttaggaaaactattcgaaaaaaatatttaatcaatcattatctctgcctgattttatatgattttcacttttctataaatatttgacatttcattgtaattatccaattgttcatcacattaattgtttacaaaatatttcttaccctttttatagataatgagaatgatctagttttgttgtaatttcgtttctttccttcttcactcgttaaattttcgtttaatcagacatcgatctcaaaagctctcatcttcaatctcattgaga

SEQ ID NO: 15071 - DNA, 3000 bp, Unknown
  misc_feature (1)..( 3000): cDNA_ID_3080443_gDNA_ID_2685558_Annot_ID_193413 3000 nt of promoter + ATG
actttcgtctcgactcagttctggatgagctccatgttctctggacccgtcgtgggttcggctaacggaatcgccgccgggtggggtaacctcggaggaggcgcgacgcagctgatcatgcccatcgtgttctcgttgattcgtaatatgggagccaccaagttcaccgcgtggaggatcgcttttttcatccccggtctctttcagactctctctgctttcgccgttctcttgttcggtcaggtaacaaaccaatcacactcaccggttcagttattttggttttttcaactaatccggttttgagaatttatcaccaagttattttttgttttggttaaatttactttctttgtatagtcagtttatcctgttctatataaatgattaaaccgattcgtttaggtgcaaacccggtttattgataccggtttgggtcgtctagtagagtctttagtcggttaatcatggtcgagtttcagtggatatggacaataactgtttaatcatctaagttgtgtctattacaaggaatagtaaaaggatacatttgttttgtcttatgtttgctatatgtttttggaaatgagtaggatcttcctgatggagattattgggcgatgcataaatctggagagagggagaaagatgatgtggggaaagtgatatctaatggaatcaaaaactataggggatggataacagcattagcatatggctattgttttggagtagagcttaccattgacaacatcatcgcagaatatttcttcgatagattccatttaaagctccagacagcagggattatagcagcgagttttggactagccaattttttcgctagacctggaggaggaattttctctgattttatgtcgagacggtttgggatgagaggaaggttgtgggcttggtggattgtgcaaacatcaggaggtgtattatgcgcatgtcttggccagatttcttccttgacagtgtctataattgttatgcttgtcttctctgtattcgtccaagccgcttgtggacttacctttggcgttgttccctttatttctagaaggtaacatacattttggtattgagttgcttgattggttattcaacatttttgcttacaaaagtttgtttatgcagatctcttggggtggtatcgggaatgactggtgcgggaggcaatgtaggcgcggtcttaacacagttgatattcttcaaaggatcgacatacacgagagagacgggtataactctaatgggggtaatgtcaatcgcatgttcattaccaatatgcttgatttactttccgcaatggggaggtatgttttgtggaccctcttccaaaaaagtaactgaagaagactattatctcgccgaatggaacgatgaagagaaagaaaagaacttacatatcggaagccaaaaatttgcggaaaccagcattagcgaaagaggtcgagccacaacgactcatccccaaacttgataaattcatggtgttttttttgtttatatgtatcgactgttgactatgtttttgtcttcttctcttttgtttttcttaagagttttcaagaactcaatttcttgattttatttataattgtgtgataagttgtgtatgttatgtaaaacctactactggttactgctttctttgtaatggaaggcttttgtaaatgtttgttcatcatggaatgaacaaacgtattttcatttagtatacatattttgttttttagttatcttttgttgatcgtgataataatgatttgaccacaagaatacaaaccagtagattcataatttattatacactgttagtctgttaaccttgtaaaccaaaaacgtttcgatattcatatgctcttttacatcaaacactcggttatttgttttatccaaataactatgacaattacatagttactaattggtactttatttcattatcagatattaactgagttgaaaacaaaattagatagcagttgaattaaactttctattagtattacatcattaagtgtttttaggtgaccaaaaaaaacaacaattacattcttcccactttacaaatacttttaaaacaaaacagcttgtcttttatgtcaaagttcattgaaagatgaacttactttggtatattacagataccatgaaaccttaaaatcttcaatagatcacatctttttagcccaacatctttattttatttacttttgggcatatttagcccaacatctttggcagggaagaaaaactttgtaatcttctcgctatgccattgggctagaaaggccattatgggcctattcttatttcattatgtctctagtgggcctactactgtctttactatcttggccaattagaataaaatctttattgtatgtttcccaatctaccacattgtcacaaacactcacaataattgctccgcacgtagcaagaagtaggccatatggagtccacgacacaaagatttgaatggtcaaagatatataacaaaacaaaagaaataaaagagttgtcgcatgttcttatataaacgatttatatattataactgcattttacattattgtattgtttagccgagtcgtgcgaatggaatatcaaatcgtcatccttttgattttgaatgacaattatacagtaatggagacacacacacaaacatataaactattaaattctactgtgaaacgctaagtcaataagattaactggtgtaaagctgtctgattaacaaaaacttaagtgtgaaagctgtcttttaccactcttccaaacactcgtaagtcgtaccaaatctagttctttatttattttttaatcgttctctatattatataaaagagaaaataaaactattaacttctatataattcataaaccattgattcctaaagattacaaaatcattgatctccttcttcttctttaactttaagcactctctttctctctttctctttctcttgtcgtcggaga

SEQ ID NO: 15072 - DNA, 3000 bp, Unknown
  misc_feature (1)..( 3000): cDNA_ID_3080455_gDNA_ID_2685558_Annot_ID_193410 3000 nt of promoter + ATG
tgttcatacacaaaatggtttagtaacatcgatacgcatcaagccaatgaataattaatagttttccccattattattggttttgggtcagaaaccaaatagttttcatctaaaagctttgaatgtgaaaagtgctccaccacagcacgcagagatgaaccctcaaaggaggataagaatacatgttggatatgaatgataactaagccatcttagaaggatttatataccgctcgttttgaagactatcatattatatagtcagctattccaacataagggggagaatgtatacagctggtgaaaaagataaatagaaatgaattatcaatgatcctcggagtaaagaatgtatattaagagtccaaaagataattcaattacagaatttagcgttgtaattgccagacgcatttgctgacccaaataaagtgatgaagtcacttatatcagttgtaaattaaatgctccagaatataatgaatgtcctgtaaggaccaatttcaaactgcttttgagtcttaagatcgcatgaagcgtaatagaccttggttccaaatataaatatcctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctagctagctatgtcatgtcaaaatataatggaatcaaaagcaaatcgacatcgtaatatatttgcatgctatgagcagttgatattatagacaaaaaggaggatcatgaaagaaagtctattgaaaagtgtacacaaagtaatgattagcaaaaaaaatggaaaagaagaaatagacatataattataatctctagtagagatatttggactagtaatctatgcacatgatgtgtaaaaccagtggaaaataaatgagtctttatgtgaaagaatagtgaaattaatgagattttcacaaagataagaaatgtattatgaagagatatattctcttgtggtggatgtaatattttttttaagtatctaaagtctggcaataagagacggaacactggatatgacatttatataaaattcttgaaagatataatctctgaaggattaattatatgagaattatgttctctagaactctactcgatcgaataaaaagaaatatgtaacatgacatataatcatataaatgtatatttacgttgagtttgtcaaaatatattgatcaaactaatatttgttttgaaaatcattaaaactcctacagagttatcataagtaatacgatgacaataatctatgataaaatatcattagataatgatatttataagtctatatgaaaaccatataattttgatcattaagattatggttattaattccaacgagatactgtatttgattgaaaatcatctcctgaagaagatgtttccgagggggagattgaatgatatgcgtagatgtaccctttttcgttatcatagtttttatcccacatgatttttctatgacaaggtttttaacgagacattaaagaacacgcaaataatacacttgatgaatattaagaaattctatcaatcatccaaatgaatattatacactaatggtatttagagaaataaataagatggtcaagatgaatcatctaaaagattcatgagcagaagaatggcgttgtactttatctaaaaatttgttcaagagaagatttggcagacttattctcaaatactgtttattctctgccacatcttctaattatgcagagattttaccaattcatgaagctagccgcaagtgtgtatggctaagatccatagttcaccatatacaagaagactgtggtatatatgcagggaaaaagactccaaaattatgtacgaagccaatgcagcatgcatcgcacaactcaaagacggatacatcaaaggcgatagaacaaagcacatcctaccaaaattcttctacacacacgatctacaaaagagcggcgatgtacgagttctacagatccgttcgaatgataatctggctgacttattcaccaaggcgctacctactgctactttcaagaagttagtctatcgtatcggattacgccgtctcaaagatctcgacgaatatactcataagggggagtaattgtatgttgcactctttttcccttaaccatggtttttcccattgggttttcctagtaaggtttttaatgaggcaacatttcaaatagtttacgagttatgatactataatggtcatcagggagagtgttatgaataaagatggatgcccattatgaggcccatcatctaagcccatcatctacatgtttttagggttttaccctttccttatacttctatataaataacactttatctcaatggaataacacactcatttcttctatctctttctttggttataacattaattagcattgtagtctatttatgttttaacgtaaacataatatcaactaaaccattatttttatgaaacgactgtgaatcatatatgcttcactgtggactattataacatcaaaaccaacttatagtttttatgaaccaaaaacaaccagctaaaagtgttataattttaaaataagaaaatctataatttctcatattagtttataattttcaaaattttaacataagttttaaagacacttttagagatcctttatctaaaaaacgtacataagtttttttttttaatataatgaattatcgaaatcgaatccaaaaaggaagaaaaagagcagaaactgattggattcttaaaaaaatattaaatttattttactttctcaaaaaacattaagaaaaataaaaaaaattccgaagagtcgaagaagaagaagaagaaaaaaaatagagtggaagaagagagaaagagaagagagtggaatgcaacaaaagaaattgagtgagaatg

SEQ ID NO: 15073 - DNA, 3000 bp, Unknown
  misc_feature (1)..( 3000): cDNA_ID_3080459_gDNA_ID_2685558_Annot_ID_193408 3000 nt of promoter + ATG
tgtctaatctggtctatgctctacttggagttgcagctatgtcaagggtaagatttttgagtaagatctctcaaaaagtagttgatggattatgatatttgattctgtttttgttttaggtccataagtgttcaacgatactgcaacaattagctgcaatctgcagtttatgtgagaggacttcatggaaaggaatgttgtgttggaaatctctccaaggatggctaaactcagcggtttctctctttctcttgtgatcacatcaacaccaaactccgcctctgtgttgtttattctaatggcttttttttgtttgtttgtattcaggtttgggcacttccgagcgagtatctaaagcaaggagaagcagaaagcatagtgagggaatggtcagaagctctaggaggtgcagggatcgattatcttgagaacaaaagctgcaattttggaagcaataacagttcaggaggacatatgcaagggaaacacggtcgaacattgaagcgattagtgagagattttgcggattctcatcgaaacgatccaaatccaaacatcatatgaataaatcaatcgataaactttttttttttgtaatgtttattttattttgttgccttaataatgagggcaatgatccatcatcttcttcatttctgtcgatgctctgtttctaatgtacagtaggagaggaaaagaaacctcatgaagaatcttgagccatttcttttagattcatctgatgagaaggataataatatacatcccattgttaacatttaactctcatttatttattttgaatctatgaggcaaaccaataaacggcacgcagtttgaaggcgtcttggtaatgtagactacagccagttccacttttcacgtaattgggccttttgagttaagataaagcccattagctcgctttccatgtggtttgccacgtgagtatcacgtgattgggttgggagttagaatttggggaaaaccctaggccagtcaattctgggaggagagaggccgccggaggagagagaaaaagaggtacgagcttacgttttgcttgctcgatttcaatctctctgcataatggattcaatctgttcatcgtaatcgtttattcaaaagtttcgatctttacttcacttgaaaccaaaattcgtagtgttgtgtccgaaattcacgctgttcaaagtactcatttttgaaacttgattttgttcttcttgtgtagttgggggattgctttttgatttctccttctccatcttcgacctcgagagaagctaaaaatggcagaagaagcggatacgaacatcgagatctggaagattaagaaactaatcaagggacttgaatcagctagaggtaatggaacgagtatgatctctcttattatgcctcctcgtgatcaagtatctcgtgtcacaaagatgcttggtgatgaatatggaactgcttcaaacattaagagtcgagtcaatcgtcaatctgttttgtctgccattacttctgctcaacaaaggttgaagctttacaacaaggttcctactaatggtcttgttctctataccggcaccattgttaatgatgacggtaaagagaagaaggtgacgtttgatttcgagccctttaggccgattaatgcttccttgtacctttgtgacaacaagttccatactgaggcattgaacgagcttcttgagtctgatgacaagtttggtttcattgttatggatggtaatgggacactgtttggaactttgagtgggaatactagagaggttcttcataagtttactgttgatctcccgaagaagcacggaagaggaggacagtctgcacttcgttttgcccgtcttaggatggagaagagacacaattatgttaggaaaaccgctgagcttgctacacagttttacatcaatccagctacgagtcagcctaatgtctctggtctgatccttgctggttcagctgatttcaaaactgagctcagtcaatcagagttgtttgatcctcgtcttcaagctaagatattgaatgttgttgatgtttcttacggaggtgaaaacggtttcaaccaagcgattgagctgtctgctgagattctatccaatgtgaagttcatacaggagaagaaactgattgggaagtactttgaggagataagtcaagataccgggaaatacgttttcggtgtggaggatactctaaaggctctagaaatgggtgctatcgaaacccttatcgtgtgggagaatctggacataaacaggtatgagctaaagaacagtacgacaggagaaatggtggtgaaacactttgggaaagatcaagagtctgatacaagcaacttccatgattcagagactaacgcggagctagaagtacaggagaagatgcctctactcgaatggtttgcaaatgagtacaaacgtttcggctgcactcttgagtttgtgactaacaaatcccaagaagggtcacagttttgcagaggttttggtgggattggtggtatgttacgttaccagcttgacatgaggacatttgatgagttatcagatactgaagtttacgaagattctgattaaagtgggaaaacttttggtgatggtttcagatcgatacagtgagggaaaatgtggcataaagatggtcttttatcaacaaagaagagagatttaagtttcttgttttctatagaacattaaaaagcttgactctttctttctgttagacaatttgtgttgtaatttttgaggattttaaacatctttttgttgttcttctggttttatattttccgagaaaatcattggtgaagaagagacggagataacgatgttagccatgttactctgttttccttaaacggtgtcgttttcgtcaattattaaaataaactggatgactggaatatccatttgcttttgagcgagtgatagaagcggaggcgattttctagggtttttgctcggaatcgatttcacgatg

SEQ ID NO: 15074 - DNA, 3000 bp, Unknown
  misc_feature (1)..( 3000): cDNA_ID_3080467_gDNA_ID_2685558_Annot_ID_193406 3000 nt of promoter + ATG
aaagaagaagagataggatcagcaacaaaatggttgttttcaaaaggctgatcttgaagaagacagagactagaagatccccaagtcatatgaggctccaaagactgttgtggatgtctttctaaagaggtgttttcagtgtagaagaagtttgttgtagctagagagccgctgatggatcgagcagcaacgtcatatgcaaaagcagcttcttcggctgtatcaaacgttccaagccaatgtctttctttagtaaaagggtttctgatttcagctgcatatcttccccatggacgtctcctcactccaaggtacttcccttcttgtaacttcttctcttctttgctttttctcttgttacttgatttcaacatgttcacaatattcagagatcaatgtttctctctctttaagtctcttgagctttgaggttccttatgctgctatataaactctatattgagtaagaagagcaaaagagtgtgtgaacttgattgatgcctttttggatttggcattaaatttaaggaaactgttgggagttcaaaaatttaactccaaagacttatttctccttcgtaaactgtgtcagcagaaacaaggaagtgtttcatattttctctatttttgtccttttgcttaatattttccacactttagtctgtgaggtgattcatattaaggaatgtatggagcaaagccaagttgtgacaaggacattgtcattatagactcagacaaaaactgtacaaatgtcaagaaacctaactaaacatgtgacataagcttagggatttggattcttaagtgtattcagttgattttgaagtcaagccttaagcattgatttgtgtgtgattaggtaatttcttctatgtcctttgtctttttgcatttggtgtcccaattgcatataaagacaactctatctttatcacttcaaacagacagatatcaagattcaagacagatgatttgagattatatcatgtcacatgtgttgcagtcactttacttctcattttttcaatttgtttacgttagctaaagaatatgaaaaactagttaactacaaaacagtaccaaggatctatttgactctcctcctctagctttgaagaatcatgcactgtctcttcctctgttctcaatcttctttcatcttccattactctcaaaaactcttcaagtgctctctgcatccactcataccgacaaagctccaacgcttctttaacagtcaactgcacattttcgagtaatctcagagttaaaacattgtacttacttatatgaataactacacatttgaatcttaagctttacccatcttcgttcacgattctttcgctctggccaatcctcgagttcttcggtaacttttaatgcaaacatatatcctttacatccacctaaacattcatcctccactgtgctacttttgcttctaaattcccaaactcctaaaggaagttcctataaacaaaaacatgaccaaaacacatctaattcaaaaaactttaaaatagctttcttagtgttttgtttaataaaggtgtaaacttactctaagtattcctttaactcctgcttcttcaatggcttcacgagaagcagcttcaagaacagtctcatcatcttcccatcctccctgataataatatacacaacaaattaacatgagcaattacaaatgatagtacagaggatgatttttcaattcaaaaaaagacctttgggaagacaagatcatgacgattaggagatgaaaccataagaacttcaagtttgtttacaaagtcaacacctgagtcttcttcagtttcgtcagctttcatcagcctataaggaatgcatctgttcataatgtatagagaaacaaacaacaagaaaatcaacaattttgttttctgatttttggggtttcttgaaaattttcaagatttgcaagaaacaaaaaaacaaaacaaaatgattttttgttgtgtaagttgttggtacccagaaacgagacggaagttgttgtcgtaacgttgacgatctcgtcctgtccgagaagaaagaaccgacatttgatgaatctgccaacacaaaaaaaatcaaaagggattgagacaacagaaacagagaatgctactttcttgaaaagccctgttcttgtttgtatgaaacatgttgatcatagcctagcttttatgacgaatccatattcttgttttgaaaataaacaaattttccagaattaacgaatctcaaaagtcacaaaaaaataaaatcgtttatatgaatttttttgtttgttaaataacttgctatttttgcggagaagaatgaggagttgtaccaacgagcattcactgctaactatcacctgtctctctatataatcagttttaatatttatacatgaaaataaataaattatttttgttagagctcaaaaacaagaagaaccttaagaacgcaaattcgaagcaagtcactaaaaggatctgattctgtatttgacttattactgttttatctcacgagtattctccactatagagaagaactattcgataattgattctataaaacttatcttgagacgtgttttaaacaagactgctgaaaaccgaattcatataggttcaaactttcaattcgtttctagtgtcttttttttttttttttgttgggtcttggttttagttttagccaatcagaattgtttgttagcaaatcttgtatttttttcgtttttgctaaaatcactcaaattagagaataaataaattgtttctgaaaaaaatgtatttccatttccttagtcgaaattggcttttatttccttttctattattttaatttaaacataaattttgtgggatgataaacttcctttttcataaccggctaatccttatcaatccttaacagagtagaatttggagataagtgtgtgtataaaaagacaaaaccaattcactcgtatcaataagaagaagaaaaacaatg

SEQ ID NO: 15075 - DNA, 3000 bp, Unknown
  misc_feature (1)..( 3000): cDNA_ID_4254342_gDNA_ID_2685558_Annot_ID_193394 3000 nt of promoter + ATG
tactcaatcgttagagtctaggatttgcaaaattttggtgtcgattttatagctgtgattcaaatcaaatctaggaaacttgaattcgactctgtatctgctcaatttcttatgtagaaatgtcgataagttctcaaattaggcgatatgtgttttgatttgattactgcgaaatttgaatgatgagtctaatgtttagtagattcatgttactgagaatctgcgattggattaatttacgataatctctgacaggaaatgttgctggtgtttgtataatgagcaatgcatggaaagttgaacaagaaccttcactgatcaatttcatatctgcgtttcttagcgcaaactctttccgccttaactttgtctctatcccccctgtatgtgccttctttctctgtttagattcttttggagaattggattatctaaaatttagcttaaagaattcactttatgctgtgataggatctcatcttcaattgtggaggtgtttctattgcttttgtttttgtgactaaatgggatttttccaatgttgcttccatcttcagcaggtctatataataaagtttcaagctctctctctatcgcaaactcctatatgtcttctgatttctttgacttaaacttttttagagtaaagaggctgaaagggcaatttgcgcaactttatgttgttgctacactttcaactaaagagcagagtgattcttttatgcgatcttacttccagtgagtggtcttctactcttcttttttcactttgcatcattttgcttatctgtgttgtcggaaatgaagctcgataaatctttttcgtagatatgagatggagtttgggaaacctgcgtttgtacaagtcactgatgctgagatgggatttgagaagattgttaagattgctcactctcgtggaggtataagattcatttgttttgtgttagttaatatactctacggtttttttagtgattgactgataagatttgaaacttgagcttcagtgtgcaagcaacagaaggtggcctctaagctcaaggttgaggtaggttctcatttgttataatgatctgtctcaacatttgtttttgacaatctctaaagcttctttcgttttctttcatgtgaagagaaagcgaactgtgcaggatacaaacatcttcatcagatttgtcacatccatacccaatattaacaaacatgatgcgaacacggtaatgtttacttatgagcaggttcaagtggtaaacttgcacttttgatactattaaaatacaattccaacttcaaacttcaaaccttattgtgaatcatgtcactgcaccatgaattctacttgcttgcttatgttctcatcggttacagctgtaccaggctattggttcaattgaagcaatcgctaaagcatccaaagaagacattttagcaaacacagatctctcttctaaaaaggctgatacactcaccaggtttttccaagatcctgagttctacctcagtcccaaattcaactgacgactgcagaaatagttgtaagatactaagatcacaattcttataaaatccgtaacgtcgtaagacttatctatcttattcttggccgtaacagtttctaaaggtaccactcaaagacttttcgtagtcctttgctatggctacaagactacaatacatacacctataggagccagtaccgggtaagtaaaatggctcacttttttatctttgctagctctgtctgaatactagtacttttattacatccgttcctgttaaagtgtttagcatctgaactttaatcaataaagatcggtaccaagactttttttgatgtttgcagtaacaccaaactgcatcgtgaaaacgtttggtagattgattgataagtttgagggttaagcacaataaatgaccacacttgtttttcttttggttgatagttacgggtttttgggtttctttgatcttaagcaaaaatgacaagctaacaaaacccatgtgaaatggctttgcatttataaattcttgtattcttacttatgttatccggatttaaaaatcatctacatcacacattatcttaagtaaaagattttacccgcaatttgtgacaaatcgaagaatttgccatttctacttgcaaattgatgcaaaattcatgttatgaatatatttcaaaatttatctacataaagacatattttgttataaaaaaaaacatacgaaacatatattccttctcaaaacaaaatcctattagctaactctagtaccaaaacatttcaacatttacccaaattggatacctaaataaagttgtagatacacgtcatcaatttgatcataacgttatcggtaggtctctgctgtctctgtcacaatcttaggtatcgttaaaagataaatattaagtggacaactttaacgaaaaaacacaaaaaagttgattggacaacgttactatccagtttttagcgtgttatccaacccatagaaaatttatctctctgtattcccataatcctcgtagattttggtcatcactagtcatttatttacaaaaataggttaaaaatgtcattgcgtaaaaaaaaaagaagacttaatcttacattatttcccttttaattattaaaatccgccgagaaaagtttcaccatcaatgcgtaactgaaaatcgacgaatcaaagctataatacacttaaacggatcatcatcatcatcatcgttgtcatgatcatcactgccgtatttatagaaaccaacaaaaacatgaaagagcccactcatttttcctatttttcgctttgcgtgccttcttatcaacttgtaaacaaagctacaaatatctttaaataaggacccaactctttttcaattcctcccatcaatcttcttcatttgttcttctgttggtggtggtgatctagttttcaaagaatcgattttgccaagtgggttcttcttgataacctttcttcttctttgaaatg

SEQ ID NO: 15076 - DNA, 3000 bp, Unknown
  misc_feature (1)..( 3000): cDNA_ID_2783455_gDNA_ID_2685559_Annot_ID_138156 3000 nt of promoter + ATG
ataaatagtttctattttgggctaatttgcagtgaatattgaataaggtcaggagctgcatatattcatgcagacatatatgataataaaaagtaattaaggacctaccaagtacccacccttcgccataattatataactgaatagacatcttgctgaaagatttacgaacaggatcttctccttccatgtctccatagcaaccttctgttcctcctcttcctctgcagtatccatcttcccacatcaacatcctgtagccccaaacatcaatatatcaatacgtagcgcatatttgtaaatctactcatcataaatcattcattttcattttcattaatttatttattaattaaaggaagcaatggttattagacaagatcatctaaaagagatgacttgatgtgtttttttccagcaaatcatgattcacaacttaaacgaatggtagatacagtctcatcgcatatatatagatgcatagagctacgtgatcatgatcatgtctaggatctccatgcaacattttttggatttttgttttgttttgttaattcaagcctagagtactaatactagtctgtctagttagtttctttccggggaaagtttccggtgactataatacgataaaccataagggaaaatgttgactttttaatcatgtttcataaagactaactatagtacgctaagtctcttgactatacgggtaacctaatttttttttgtaagaagtgtaacttacaagcttccattgtcgtcgccaactttgcagccgttgccaccgcctcgaactctcctgaagaacaaaaaagacatcgttttgaggagagatagatagatcatgtcaataaaaaaaaaagagaggagctgaggagagagatacgtacggacggggacggatggaccagaagacagagtaagtccagtcggtgttgagacaaacagttctcagggcgtcgtggagagccaccatccctaaagcttctttgctcctttgttgctgctgctgatggttttgatgatgatgttgttgatgatggtgatgatgttccgagcccaccatctatatgaatatgtcggtgtgtgttatatgggtttctcctctagttttggccttctaggttttctttgctgccttccttgctcaagcttctcatggactcttttatgttctaaatttcttttattttcaatgtttataatttttttttctaatttagactaattatatgattaccaaaccaacatttactgtttgtctacacaataatatgctattttagttcttattacttttttgataaaatcttacaatcttgtggcaaggatacgaatttcttggggtttggtatagttaacaataagtaatatataattaattatcagagaaccaattgaacacaaggttaaagttttttgcatgtaaaagttttttatctcttaggccaagaaagtcaaagatacttgaaaatcttcctgaaaaaatcattttagttcgctttatatttgtttgaatggaatccaattatcaaccattgattttctatacttcatattgcttttctgaaagagaaataatcatatggtttcgagtggataaactgttgttgttatgattaaagatacaattacaatgacataattagtcagtcgacatttttatccactaaaaaacacagtcttttagttttagtattatatataactctagtgatacaattaaaaccatgaaatgtgaaagtgttttttcttaagaagaaaaaggcttttatttagttgtcgtcaaacttgggattcggtttaggaccaagattcatattactacgggtgtgacacgcacgcaaattaagggggcacgacaaagagaatatataggaagaagagatttaggagtcacgtgtgcacgtgccgtgtgtaagactcgagtggctttgtcatcaaccatgacccagcgtctggttttgacctcgtggcgcgtataaactacgcatagaaacacagagacaaaccaggaagaagaaacaaaatcgtctgatgaatacaccaaagggtggcgagtgagaagtgtgagtgacgtaaacttaaaaaaataggacaggagtaacagagagttggtctggattgcatcagtctgaaaccctgacgagtcttagctccgcattgaccggctctgttctttacttacaatttttcttttgcgggacccaccgtttattaggaaaaagaaaaacaatttgtgggtaaagaaagtcgaatatgagatcatgttaattgctgcaaaggccgaaacaatggttggtttctagttctacttcctagtatatgggccgttaaatgagcttcaaagcttattgggcttttagtgcttttaacagttgggttgggttgttcttcgtaacaaatggtttccataatgaaacttggaaggaaaaacaacatgaaaaataaattcgacttcatctcccaaacagtttctgtcgatctctttggtgctcgagagagtgctttctggcaaaatgacatagcaaacgaaaggaaagagcaacagagagatctgtagtatcccatttcgtcttctctgtcgaattaccaggtaatttggatcgatcccttgaactttagagaatttgattatgattattttcgtttaagtctgattttgatcgaacgggagaaaaacatcagtgaagatgtttctcttcagtgtcctagagtgacgaatattctcggctacttgcaaatttttattggtcagctgtcacttgctccaatccacctaacttttttgctgattttgtttgctttgagtataagggatttagtttaagtttggtgctttcttctgggtacttatttatgaggggagagtttagatgtaatgaaaaggggagggagtggtaaaaagtattatagtttgttctgactctgttgttatcttcgtaatatagtggttggagcgggagagaaggtggtttttccttgtatgtggagatg

SEQ ID NO: 15077 - DNA, 3000 bp, Unknown; identical to SEQ ID NO: 8743
  misc_feature (1)..( 3000): cDNA_ID_2178530_gDNA_ID_2685559_Annot_ID_193440 3000 nt of promoter + ATG

SEQ ID NO: 15078 - DNA, 3000 bp, Unknown; identical to SEQ ID NO: 8745
  misc_feature (1)..( 3000): cDNA_ID_2105435_gDNA_ID_2685559_Annot_ID_193433 3000 nt of promoter + ATG

SEQ ID NO: 15079 - DNA, 3000 bp, Unknown; identical to SEQ ID NO: 8741
  misc_feature (1)..( 3000): cDNA_ID_2178556_gDNA_ID_2685559_Annot_ID_193446 3000 nt of promoter + ATG

SEQ ID NO: 15080 - DNA, 3000 bp, Unknown; identical to SEQ ID NO: 8742
  misc_feature (1)..( 3000): cDNA_ID_2178541_gDNA_ID_2685559_Annot_ID_193442 3000 nt of promoter + ATG

SEQ ID NO: 15081 - DNA, 3000 bp, Unknown; identical to SEQ ID NO: 8739
  misc_feature (1)..( 3000): cDNA_ID_2178537_gDNA_ID_2685559_Annot_ID_193441 3000 nt of promoter + ATG

SEQ ID NO: 15082 - DNA, 3000 bp, Unknown
  misc_feature (1)..( 3000): cDNA_ID_2178493_gDNA_ID_2685559_Annot_ID_138158 3000 nt of promoter + ATG
tacgagtataatggacgaacagaaaataaaaaaaagtcaagagtgtgataaatacttacgctttatagacatcaccaaaagagcctcttccaatcaactcaatctggctaaatctggctccagctgcctcttgtaaacccgcaacatcgtccatctccacatacaaggaaaaaccaccttctctcccgctccaaccactatattacgaagataacaacagagtcagaacaaactataatactttttaccactccctccccttttcattacatctaaactctcccctcataaataagtacccagaagaaagcaccaaacttaaactaaatcccttatactcaaagcaaacaaaatcagcaaaaaagttaggtggattggagcaagtgacagctgaccaataaaaatttgcaagtagccgagaatattcgtcactctaggacactgaagagaaacatcttcactgatgtttttctcccgttcgatcaaaatcagacttaaacgaaaataatcataatcaaattctctaaagttcaagggatcgatccaaattacctggtaattcgacagagaagacgaaatgggatactacagatctctctgttgctctttcctttcgtttgctatgtcattttgccagaaagcactctctcgagcaccaaagagatcgacagaaactgtttgggagatgaagtcgaatttatttttcatgttgtttttccttccaagtttcattatggaaaccatttgttacgaagaacaacccaacccaactgttaaaagcactaaaagcccaataagctttgaagctcatttaacggcccatatactaggaagtagaactagaaaccaaccattgtttcggcctttgcagcaattaacatgatctcatattcgactttctttacccacaaattgtttttctttttcctaataaacggtgggtcccgcaaaagaaaaattgtaagtaaagaacagagccggtcaatgcggagctaagactcgtcagggtttcagactgatgcaatccagaccaactctctgttactcctgtcctatttttttaagtttacgtcactcacacttctcactcgccaccctttggtgtattcatcagacgattttgtttcttcttcctggtttgtctctgtgtttctatgcgtagtttatacgcgccacgaggtcaaaaccagacgctgggtcatggttgatgacaaagccactcgagtcttacacacggcacgtgcacacgtgactcctaaatctcttcttcctatatattctctttgtcgtgcccccttaatttgcgtgcgtgtcacacccgtagtaatatgaatcttggtcctaaaccgaatcccaagtttgacgacaactaaataaaagcctttttcttcttaagaaaaaacactttcacatttcatggttttaattgtatcactagagttatatataatactaaaactaaaagactgtgttttttagtggataaaaatgtcgactgactaattatgtcattgtaattgtatctttaatcataacaacaacagtttatccactcgaaaccatatgattatttctctttcagaaaagcaatatgaagtatagaaaatcaatggttgataattggattccattcaaacaaatataaagcgaactaaaatgattttttcaggaagattttcaagtatctttgactttcttggcctaagagataaaaaacttttacatgcaaaaaactttaaccttgtgttcaattggttctctgataattaattatatattacttattgttaactataccaaaccccaagaaattcgtatccttgccacaagattgtaagattttatcaaaaaagtaataagaactaaaatagcatattattgtgtagacaaacagtaaatgttggtttggtaatcatataattagtctaaattagaaaaaaaaattataaacattgaaaataaaagaaatttagaacataaaagagtccatgagaagcttgagcaaggaaggcagcaaagaaaacctagaaggccaaaactagaggagaaacccatataacacacaccgacatattcatatagatggtgggctcggaacatcatcaccatcatcaacaacatcatcatcaaaaccatcagcagcagcaacaaaggagcaaagaagctttagggatggtggctctccacgacgccctgagaactgtttgtctcaacaccgactggacttactctgtcttctggtccatccgtccccgtccgtacgtatctctctcctcagctcctctcttttttttttattgacatgatctatctatctctcctcaaaacgatgtcttttttgttcttcaggagagttcgaggcggtggcaacggctgcaaagttggcgacgacaatggaagcttgtaagttacacttcttacaaaaaaaaattaggttacccgtatagtcaagagacttagcgtactatagttagtctttatgaaacatgattaaaaagtcaacattttcccttatggtttatcgtattatagtcaccggaaactttccccggaaagaaactaactagacagactagtattagtactctaggcttgaattaacaaaacaaaacaaaaatccaaaaaatgttgcatggagatcctagacatgatcatgatcacgtagctctatgcatctatatatatgcgatgagactgtatctaccattcgtttaagttgtgaatcatgatttgctggaaaaaaacacatcaagtcatctcttttagatgatcttgtctaataaccattgcttcctttaattaataaataaattaatgaaaatgaaaatgaatgatttatgatgagtagatttacaaatatgcgctacgtattgatatattgatgtttggggctacaggatgttgatgtgggaagatggatactgcagaggaagaggaggaacagaaggttgctatggagacatggaaggagaagatcctgttcgtaaatctttcagcaag

SEQ ID NO: 15083 - DNA, 3000 bp, Unknown; identical to SEQ ID NO: 8744
  misc_feature (1)..( 3000): cDNA_ID_2178501_gDNA_ID_2685559_Annot_ID_138159 3000 nt of promoter + ATG

SEQ ID NO: 15084 - DNA, 3000 bp, Unknown; identical to SEQ ID NO: 8738
  misc_feature (1)..( 3000): cDNA_ID_2178493_gDNA_ID_2685559_Annot_ID_193430 3000 nt of promoter + ATG

SEQ ID NO: 15085 - DNA, 3000 bp, Unknown; identical to SEQ ID NO: 8744
  misc_feature (1)..( 3000): cDNA_ID_2178501_gDNA_ID_2685559_Annot_ID_193431 3000 nt of promoter + ATG

SEQ ID NO: 15086 - DNA, 3000 bp, Unknown; identical to SEQ ID NO: 8745
  misc_feature (1)..( 3000): cDNA_ID_2105435_gDNA_ID_2685559_Annot_ID_138161 3000 nt of promoter + ATG

SEQ ID NO: 15087 - DNA, 3000 bp, Unknown; identical to SEQ ID NO: 8739
  misc_feature (1)..( 3000): cDNA_ID_2178537_gDNA_ID_2685559_Annot_ID_138169 3000 nt of

SEQ ID NO: 15088 - DNA, 3000 bp, Unknown
  misc_feature (1)..( 3000): cDNA_ID_2783486_gDNA_ID_2685560_Annot_ID_138173 3000 nt of promoter + ATG
agcgtgatttgggttgtggtgtctaaagaggtgaatgtagagaatattctagatgaaatcgctcagaaagttcatattagtggagagaagtgggacacaaaatataaataccaaaagggcgtttatttatacaatttcttaaggaaaatgagatttgtattgtttttggatgacatatgggagaaggttaatttagttgagatcggagtcccctttccaacaataaaaaacaaatgtaaagtggtattcaccactcggtccttagatgtatgcacaagcatgggggttgaaaaaccaatggaagtccaatgcctggcggacaacgacgcatatgatttgttccaaaaaaaggttggacaaataacactaggaagcgacccagagatccgtgaactttctagagtagttgctaaaaaatgttgtggtttaccattggcgctcaatgtggtaagtgagaccatgtcatgcaagaggacggtacaagaatggcgtcatgcgatatatgttttaaattcatatgctgcaaagttttctggcatggacgataagatccttccgcttttaaagtatagctatgatagtctcaaaggggaggatgtcaaaatgtgtttgctatattgcgctttgtttccagaagatgctaaaataaggaaggagaatctgatagagtactggatatgcgaggaaattatagatggaagtgaaggtattgataaggctgagaaccaaggttatgagataattggtagtcttgttcgtgcatcattgttgatggaagaggttgaattggatggagcaaatattgtttgtctgcatgatgttgttcgtgaaatggctttatggatcgcatctgatttgggaaaacaaaatgaggcgtttattgtgcgtgcaagtgttgggctacgtgaaattctaaaggttgagaattggaacgtcgtgagaaggatgtcattgatgaagaataatattgctcatcttgatggccgtcttgattgtatggaactcacaactttgctactacaaagcacacatttggaaaagatctcgagtgaattcttcaactccatgccaaagctagctgttttggatctatcaggcaattattacctctctgaattgccaaacggaatatcagaactagtttccttgcaatatctcaacttgtcaagtactggtatacgtcatttgcctaagggtctacaagagttgaagaaactaattcacttgtacttggagcgaacaagtcagcttggaagtatggttgggatatcatgccttcataatttgaaagttttgaaattatctggttctagttatgcatgggatctcgacacagtgaaggagttggaagccttggaacacttggaagttttaaccacaactatcgatgactgtactctaggtacggatcaattcttgagctctcataggttgatgagttgcatacggtttctaaagatatcgaataatagtaatagaaataggaactcatctagaatatcacttccagtaactatggacaggcttcaagaatttaccattgagcattgccatacctctgagataaagatgggaaggatatgcagcttctccagcctcatcgaagtgaatctaagcaattgtagacgcctgagggaattgacatttctgatgttcgctccaaatcttaaacggcttcatgttgtctcttcaaatcaactagaagatataataaacaaagagaaagctcatgatggtgaaaaatcagggattgttcctttcccaaagctgaatgaacttcacttatataatctacgggagctgaagaatatctattggagtcctctaccatttccatgtctagagaaaatcaatgtaatgggctgtccaaatctgaaaaagcttccactcgattctaaaagtggaaagcatggtggaaatggactcatcataacacaccgtgagatggaatggattacacgtgtggaatgggaggacgaagctactaaaacccgcttcttagccaacaggtctagtttctcatcttctcttatttgtttttcaaatgatttagtttctcgtgatatgaactgcttccatctttaatgtctctgtctctttttgtgtgtgttaggttgattatagtcagaactcacaaggttaaatgggcttctcaggcagaaacttcaaagtggatgatgcaatttggattgtgtctttttgtgtttaagtctttctctatgcgttgtttttctgtgaactattttttagatttgtgtcggcactgaactctactattgctatgtttggaatttattggaatatatccatgtgccatttgcaaatttgtcctttaaagaacttttctaataacagaaatgcggatacgattaaattatgttggattccttgtgcttcaagtattgcgtataacgttttgatgtccgttatcatcatatcttatttagaattaaatgtaatccaacttaacaaaacactcgcgatccacttgctttgcagctcaattataggaaacaactcaatcatatgtgaaatcttcatgttgaagccaaattaaactagttattttgcatctattttctaatgaaaagctgtctgaattttccgacagaatattagagtttgtttccttgcaatatctcacttgttacttgtcagatgacgaaactataggatttggaggaaataagtcatctcccgagtattgtgataggatatcaaatttgaggatattgaaattttttgttctggtaagcagggtgaaaataggcataccataagatactgcagactgggaaaatggattgatggtgtcttagcttcatctgaaatatgaaatttataatattttaaggggatcagctgacccttcttctctttgtgggtccgcccaattgacatcatctccacaaagtctatatgaccaaagatttgaaaacactttataatcacatattaattaacatgacacaaaaatcccattacatatcctaactaatt

SEQ ID NO: 15089 - DNA, 3000 bp, Unknown
  misc_feature (1)..( 3000): cDNA_ID_3080566_gDNA_ID_2685560_Annot_ID_193474 3000 nt of promoter + ATG
tacttttataagcaattcatattggttggtaaaataaaatcaataactattctctgtaactgatagtagtatattatatattaacgcgtaaataattagatgtcaagttaaataaataattatttcgaagagccaaattatttgagagtcaacggtgtgatcacaggaatcgacggatcggagagacccacgcgagcactccacccgtttcggctaaataacaatattacccttaaatcatgttcccatttgtgaaaacgtcgtgacttctgtttctcactttaccaaaacgataaaacatgctccacgatgacggtgagactatagtaaagaggaataatcaaactcattgcaattgaagtttgatttacgaaaagaaaaccctaaaacacctcagcaaaaattatgttattaatcaacacactaaatatagacataaagttacttttagtgtttttcttcttatatttcgttacttaataatagaaatttgtgaacttggaacgatgaagaaaaagatcatggttatataataattacgtataaactaaaaaattgtattatacgtttgaactttcttatagtcaaaggagaggttagtttcgtcaatagaggttaccaatatttaatggacttgagagaaatttcgttcgtttccttacaagtccattgtcacgatcccgtaattaatataaatcttaagcttaactcatcgacatcaacaaaagattagtcaagaaaaaaaaaaactcttacggagagaaaacattcaaaacaaaatgaaagtttggagccaaagattatcgtttctaatcgtcatgatcttcattttggccgggcttcattcctcttccgccggccgcaagctccctagtatgacgacgacggaggagttccagcgattaagttttgacggcaagagaatattatcggaagtgaccgccgacaagaagtatgatcggatctacggagcttctgctagattagttcccaaaggtcctaacccgcttcacaacaaatgatatatttctatactattatagttacattttgtcgccaataattatactatcttaattaagtttgtttagggttttgtttagaataatttaatctaccttgtgtctcaacaaattctgttattgctggttctttaatttcttgtattttgtagatatattgtatgatagatatacgtacagagacttatgtaactttcttttttcatatttacatttatttatacgatgttgaaaatatgtatcaaatattgatttgcacgagatgagaggggtgattattttatattttgattatagttcattataataaatatgacatgttactagtttgacagagttattaatatattcaattcagatcatgtacgtatttctgcagtatagtttccgttcctaacacagtaacatgacatgatcaaagttatttccgttgttacgagtctatctatggtatatcttctcaaataagactagctagactattgaatttcgattttctttgcagtaaatcgatccgtcactcatatcagaaaaaaagacaaaaaaaaaatcgatccgtcaacaatcaacatgtatatatatgatgaaaacattacgcaaaagaataaattcagtcgtccattcaacaacgatagaatcatagaatataagtcaacatctatacttgtaaaataaatttatttttacaacaataaaatgataataatgagttttatgagtcaacagaaggggtaggcaaggaacgacacggcaatgcgttgaccctgttttatgttctatatttaagaaacgaaaaatgtaaacacatctctaaataaaactgattttttttggggtaaggtctgttttttgaaatgtttatagacgcttaggacacttagagcctttcaggtttaatgctattggctgaacaatctctcttagattgcttcaagttacagtcttttttagatttcaatgttgcagtttgttggttctcaagttggcagattttctaggataggatcaatcttcttttactaggttcaggtctcttcacactttggtaagcaagaagctctcttaacacaggcataaaatgcaagttttaagttcagttacgaagctttgttttcgtttgctgtttttattgagaagttaagaagattgactttcaaacactgctaccatggtttggcctcttctctggtggttgatcatcgagcatccagacttttcccttttgatgtttatagtcttgattcagttctttttaatttctttctttagacgtctttggattgtataatatgctctctgtatcatgaatggtttgtacgatatgtttcatataaataataataccctttggcaaaaaaacaaaataaaataaaactgattaaaaccatttacgtaccgatttaatatattgatggtcatcaatataaaaacaagagtgcaaaagagtcaaaataaaacaaaaataaaccccatcacaatcaagataaagacaactaattttctgtgtttcttcaacaatcatagctttattaatgtaaaagatgtttcacacagacattcaacaaaaaacacaaacatacaatttttaacaaaagggaaagtaaatacaaacaaatacatagaacaaatataaatgtttaattagccggcaaaaacttatcaatttgacttcattttcaataaaaaaaccacttcaatgtcaatattttggccactttctttccaactcgatgggatggctaaagcttatgaccttgacattccaataacaaaactttggggttaataccattaaaaagcattatttagggattaacatgcaaagttttcagatattatgtcacgtgtcacgtaaaactccacgacaacgaaatgttatcacttcttcttctgtcgttctcagaaacacagagtgtcaaaacctggtcaccggaaaaaaaataaactctgttttcagaccgaattttctcaccggaaa

SEQ ID NO: 15090 - DNA, 3000 bp, Unknown
  misc_feature (1)..( 3000): cDNA_ID_1015175_gDNA_ID_2685560_Annot_ID_193469 3000 nt of promoter + ATG
gtgagtttcttttttttctttctttcgcttttatgctttgacagtttttgttttcacaacgttcaacattatcatagcatcttggcatcttggagaactaaagatgtgtaaatctcatcatttcatatcaagaaaataaaaggagaaaacgtgggaacattttacctttgtctaataatttgataaagaattgcatacataacatagacggttatatctacaagaaaaagaaaaaacacaacaaatagattttagtaagttagattttactcaaaattaaattacaacgtaattaaatgttagctgaaacatataaaatctaactttgtattctcttaagcagcaattgtgattgtgatggaaacacaaacaaagggagcatccataaaagccattcatgcttaaataagaacacacgtaaaacttcgacgtcataagacatgcataacggatacaatttttgaatggagttggtaatagggatttggaaaattcaaattatatagaaacttaagtgacatgaagtagagagaaatatgattttaattacacatgtttcaaacatatttagtgaaaagatcatatgtttatcctaaactgataacgatttagatatagtttcatttttggaagcaaatatgtaattttaaaatactaaatttctttttcctcatatctatcttacactttttatttcttattttgaaactgataacaagataagtcgttccaccagtttagttttggctattataatttggtaaaacatattttacacatacctgaagtttttatgtttacaatcttaatccaatttctatacaaaacttaagattcctttatacagtacgaactgaatcattaacccagtacttggagcttcctttaagcacctttttgtgaatatattaactaatcgtaaatgttttccattcacctaccataaacagttaattgattacttggagtaaaaaaaatcgatgacatacatgtaaaatatatgtaatatattgggcatcagggcatgtatatattgataagattcgagcataaaactcccacacctaactcaaagtcatcatcaaacctataagatcttcacttcttttaatttccttgtctttaatttatctttaaaaggtaattatatttctatctttctgtttaattatgccctttcaatcatttgagttactagtttctactaactgcagtttttacttttatttttctgtaaaaatctcacaaaagtacaaaggaagaaggacggacgagaagagaaaccctaacatgcatatgggacaaaataaaccagtccagaaaaagtctccattatatgaagaaagtactatcatttttgcttcaagtcaaagtatgtttgtgtgtaatatatttatacatttatagtaagtttctttcttggttccaaaattttgctaccagaaaaataaaggactacaattttttgtgaacaagtaaacatgaatagcgtcatgactcaacgacctattaaatatacatctctttcactaatattacgcttataattaacaatgttcaagggtggaattggatttttgcatttagattataagttctttcaaataattttattttgtatgtagatgaaaaacttgttgagatagagaaagagaagagacttgcgttaatagatgcatgggaagagaacgagaaggcaaaagctcaaaccaagtaagatttgccaatccaaatatatataatccttagttattaatgaggctagctagaaccataaagatcaacattgttctgcattcaaaattactaacaaatatctcacagaaatattgacgtgaccataattaaactcaaaacatacagttatatatatgtcgcaagaaatgcgagattacccgtttttatactttatattatcaatataatatttacattttgttattttgaatcaatgaaagcagggcttacaaagaactttgctcgattgaatcatgggaaaacaacatgaagacagctctagagttagatttgaagaaaatggaggtatatagagaattttagctatatcaatatattttctctttaacttcttttagctattcaatttatttaacgtttatagtgaaatacaaacaatatcatagaaaagtacttttatttataacttttattcatatagtctctcctctatgaatgcacatgtgtctatgttatatagttttactacgataatttatttctgttgatttttttttcaggagaatttacaagtggagaaaactgaattctcaaaaaaattcaagaaaaaaatacctgaaattgagaagattgcagaagccaaaagagaaaaaatagagaaacaaaaggagcaagaatctatcaaagtcgaaaaaataagtgagaagctaattgcaactccaaatgcctatccacccaataccaaaacttgtggatgtttctaaaacattttatatcctcctttcatgggtcaattctcggcccattaaattatcttattgggctttacttgtacccaaacatattaacgaaaaaatctgtgtaatgtgtgaactttcaagcatcaatgatcaatgttatcattcatgtgtgtatttaatatgactctatgcattcatatgcccaattaactcacaagcatcaatgatcaatgtatcattcatatgtgtatgtaatatgactctatgcctgatgcattcatatgctcaatttctctactaatacctttagttgttgtagataagatgttcgacaaaatgtgtaagtgaagttcttagaagtggttatgtattagtttgccttggtgtttggtgccacgtcatcaggtttggtcgtatcaagctagctgggtcgggttgagattcgggttaacgggttgacccaattacccattggtcgctttttctgatttcttctcttctcacagtgctctcacctaacgcagattcttcttctctaccatattcgttgaaaccagagaag

SEQ ID NO: 15091 - DNA, 3000 bp, Unknown
  misc_feature (1)..( 3000): cDNA_ID_2783498_gDNA_ID_2685560_Annot_ID_193466 3000 nt of promoter + ATG
tggaaaatctatgttgtaatcaccgatttaccgtaatttatcaaaattataaattatctacacgcatactgaaataaatgtatgtgaagctcattgtttgaacgatatagttacaagactaaaaacggtaaataacctcttttacagatttacatataacttgtaaatatatataacttcttttagataagcatataaaattaaaacaatatttacattacagataaatgtatgcgaacctcattgttttatttatatatttttctctaaaatggctccatctcttataaattaatccattgatcaagttggccaaataaaaaaaggcaaagaaaaagggggtgtatgagtaggcacgcatgagtggcacgtgtgaagaacaaataaagcaatggctaattttcaaagccaagtatgctcctcagaactaacaagaacaaggtgtgtcaaagaaccattacttttatgtaccgtcaaagaaccaatcttgcatttacacaagttcttactaacaaacaaaacaaaaaagttcgtactaactcaatatggtataaaccatagtaattaatacgtgtatatatactatatagatatcgcatgaactatattcgttgttaagttctttagaatgtagcaagaagaacaagttctttcagaatggtttatcatacacgggcgcacatttggaattacccttacgttaatgaggaaaaaataactaatactactaaactgaaaagatacttcgaaattaaaatttctgatgtattttgttttgatgttgataagtacatgtcaataagacaaccattgtagtttgtactttgtactttgtagtaccatttcatatatcctggttgaaccaatctcattttattttttcccctcggtaattaatcaacaattcgtttcaggaaaaaacgaaaaaaaaaactatattatattaccactttctttttatcattggtaatgaatttacatatcaattaaagtaacattatgtatgtttggtatataagttaggcagatatatattgtatacgtattcaagttgttagttttatttcaaacacactcgaacaaaccaccatttcgttacgagagtacccaatttggtttgatgtatctgtttttgattgtgatgtacgcatacatgttgtacatacatataaaataatgtgcatactgatatacatgtataccggtatacgttacgcataatctaatttctagggtcagtaacaagaaaagactaatttataaaattgagatagaaaaagtaaaaacatgatctaagctaaggttacagatatataaatgataaaatgtatgctttttcatggccatgtgtaacatatcttataacgtagttcaaactcataaatgttaaacaaaaattcaaactcatggtggtttgatttttttttttctagctgtttggtcctattgaatattgatcctattcttcatcgagaattcctaacaacgtaaaatctaattattcttataccttaaaacaaatttaggaaattatataacatttttggtgatgagataatacaataatagtatatagtacataggataccattttttatatttccacaatctcaatggacctaatcagaaaaaagaagaatgaatttgtttttattttttgcttttctaatataagctaacaaaatatacagcttgcttagatatatccgcaatagaagcttcaggtggggactgtgtaaggacaacaagacatatacattaaggtgtttagtttgattttcgaaaacatattatgaaattcgcatgttccatgcccgaggatgaaatttctattttacaattattctttcatgacagcttatatatactgactcaaatagatggaccggcgggcgatcggcatcatgtcctacccacgtcaaaattgagtgaatatctaagattttgaattgaatctaataaacatgtaggttcaatatgatactttgttatacgataaaaaaagtgagagagttttgaagaacattatgataaaaaatagtatctataagttccacatatttttctttgatttaaagaataaggctatatactgattcgttgagaaataacttttgttaagcaatacatttgttggttaaaacatcattttctcattctcagctacatttctaagtaaataagtatcaacgtcaaacttgaccgttggatctctactttttatattatctttagtttatcggggactcagctttgtaagctgtgacctatttattgactataatacccataaaaaggtcgcgtatcactcataactgaaggagggcagacatgtaaatttaattgcgtatcgatcactgttcccaaacccaaaacaaactttttattaataagatcatgtttacaaatttgtcggactatttttcattttaattatgaaatgcatttaataaaatgtataagatataaaagtttgatcttcttctttaatatactactaactgattactgatggagtacttttttaaggcataatagcacaactatgaaaattatattagtttttaacatatcataccaaattgaaacgtaaagagtttcctatacgatacagacaaaaattaattaaccgattaaaatatacactactaattaataacaattaacgtatagtccttttacttttgctaaattgtttattaatctcatctctcttttagatctctctacttacttttcctttttgtcccatttatataaaaatccaccgctcaagcttaacgttcgcgtcttcttctttcttcttcttcttcgccttctctctgagtcgaactcgctccgatcgactgagccaactcgcccgccttctgtaatgatcatttcctctacattgtactaaaaaagagtgttgtaatgactcgttccgggagacgatggtcggagcgacggtgagagttacagttttctttccggcgaccaatactctcggcggcggagatg

SEQ ID NO: 15092 - DNA, 3000 bp, Unknown
  misc_feature (1)..( 3000): cDNA_ID_2783494_gDNA_ID_2685560_Annot_ID_193463 3000 nt of promoter + ATG
taaacattggaacaaaatattacgcatatgaatgtctatttgaaacattttaatgagactttttgtatgagtaggtacaaatattacttcccatttctcgacacgaaaggcgaagtgaccgttgaggataaccgtgttggaccattatataagcatgttttcccaccagctctttctccgggactttcattcatcggattaccatggcaggttaatgatttttacaattgtgattagaatatgaagtaacaaactcttgatgtcaatcaacttattggtcaatgattcggatatttataggtcattctttttccaatgtttgaactccaaagcaaatgggtagccgcggttttggctggtagggttttattcgaagctcgaagcctcatgtattcccaaaagatacacacatcttatggcagaattagattctcaggttcgtactgtattcctttccataacatgtatgaaaacattatccaaaaagaaagcatacattaatttgaatgtgtttttttggttacagtttgtatacgataattggcttgctgatcaatgtgactatcctcgtatcgagaaatggagagagcaaatgttttacaaggtgttcaagagaatacaatcccaatccagtacatataaggacgattgggacgatgatcacctcatcgcagaagcatatgaagatttcgtcaaattcccatctaactatcccagttctttaatcgaaagagaatatacaagctgaaaaacatcacttgaagtctctgaaatgagggtatgtgggtttattacatgcgaaataatgcatattgtattgtaaacatcacttaaggtctctgaaatgttggaaacttacatgtaacaacattacttgaagtctgaaatgttcatgataggagcgagcttcttgtctttgaaggctattcttgtctcaacaagacaacaagtgattgcatcaacttctgtaacctagcaagaaaataacaaatagaattagtcatacagtattttatagtgaccagacattaccacaacgcgtcattagagtaaaagcaaaaaacgttaattcaactcacagcttttaccctcaaggatgatgcaagtgttttaagaaagcatatcgaggaagcttttgtctaatctcccatcatgcaacatattagcgaccaagccaatggttgaagcatctccaacaaacctgcaactcctcatttctctgatgagttcagctgatgctgctttgtcaccatctctcagatgtgccctgataagtgtattatatgtaccactatctggaagaggcccgtcttctttcattttttttagcaaggcataagcttcctgtaataggcgtttactacacaagcctgagatcatggtattgtaggttacaacattaggcttcactcctttaaggctgaggctacaaaatagatcccacccatcatccaccttcccagccttgcacatcccttcaatcatagtagtatatatgtaaatatcaagttttatctcactcttttgcatatagtcgaaaacctccaatgctttctctagcttcccgttattacagagtccatctaacaaaatgctgtatgtcattatatcaggaggtacaccatcagaaaccatctgtttgaaaaccttttgggcattatcacagtcgccatcatgaaaaagcccttggataagagtggtgtaagtgactgtatcgccaaccaatcctctatgagacatctcgcggaagagttccgtaccatcttctactctcttagacttgcaaaatccctttatgagagtattatatgtatctaaatctgggaaacagtccttgctaaccatgaactcaaacatctgcttggccttgtctagacgatcatgcatacagaacccgttgatcaatgaattgtaagtgaaaatatcaggatctatagaccttttgatcatgtcatcgtgcaatttctcagcctctacaaactttccttctttcacaaacgcatcgatcaatgcattgaacgtgactaaattagggttgattttcttctcaatcatatcactcagtagttgagaggcatcactccatcttccataactacaaaggcaacttatgagggagctgtaggtaacaacatttggtctaattcctttggtttccatttctttgaataggttgagtgcatcatccacatgtctatatttgcagagactatcgatgattgtgttgaagataacaacatccgcctctattttcgcagcttccatcttgttgagcagattaaaagccaaatcaatatcacctctcttacataatccatttactaccactccataagtaaccagatttggttgacagcctctttgaaccattcgatcaactaacgccacagcttcagaagctttgttgtggagaaaaagcccatgaatcaaagttgtaaatgtgattgtgtcaggtctataccccatttccaccatttgatcaaccaaagctacagcatctgaaatcctcttaccgtgacagtatccattgagaagagaagaaagcgtgacaatgctgggctcatagccgagtttcatcatcttgccaagaagagctaaagcaagagagatttgagagcgtcggcagaaacagttgatcaaaatattgtaagtatatagattatgtgaaattcctaacctctgcatcttctcacctagagagatgacaagatcaaactttttcatcttagcaatggcactcaacagtttattgaactcaaaaatggaaggtaaaggacgtgacttgaccatgccaccgaacaaaccaattgcatcatctaacttcaaatcctgtaacacttttctactcaagttctctctgtaatcaccactgctaccagaaaaagctcgtccccagcaacagaaaccgtaaagattgaaggagtaaggagcagttggatgattacctttccccaggagattccgacgaacagacaatctcttcgccgtggatgataatac

SEQ ID NO: 15093 - DNA, 3000 bp, Unknown
  misc_feature (1)..( 3000): cDNA_ID_2783490_gDNA_ID_2685560_Annot_ID_193462 3000 nt of promoter + ATG
cttcatcgtattggctaggtcctgccttatctcctcccatgtgggttaaggaagagatcatgttcttaagctcgtgctcgaaatgttgttgtcgcctgtgcttctctgtttcgcctcttgactcgcttagcttcattctttatcacccaaagcagatacgccaaggcaaagcaatccaactatgcatatataagctatatgtgattttatataatctttatgggaataaattatgagaacattgccttgtgttgcaattaaagaattggattttgtctgttactaaagttatagaatgactttccattgagttcaagaatatttttttttttaccgattgtaaaaaatgtgaaattattattataatttaagttgaaattatttatttattagttgaaaattgaaattattattcaagttttgaaaacagagttttgttccaaaagaaaaaaattcccaagctgatgccttgttcagaaaaatgaaagaagatgggcctcttccaggtttactggagatgcctcaacaataagtttggtgactaatatgttaaatgatgggagattgggaaaaagctttttttaaacagtttcatcatcctcgagaaaaacgtagtgaggtgaattaacgtttttgctgctattaatggaaatttctgttttgatggtatgacttagcttcatggaatctgtctgattatatttgttattttcacgctaggttccaggcaagaattgatgatgcaaacactctttacacacaagaatggttgtcaaagtcagagaagctgcgatcatgaaaatttcagacttcaaataatgtttgctatgtaagttctaagcttttcatcttttttgggattgcagtcttgtagtatatattctgctcggtagaattttatagcgggaagtatctctgttacaatcttattgttcaagatcttctgttgtttctcaacggttttaactagcggctatccgctcgttctctcgtctgtgtatgccttatcgatactacgttcccacatcattcccttactcaatcaacaacaacaaaaaataaagtaagtatgatgtgaagaaacacaacaacaacaatagattcatcctgaaatgtaagtcaggatatagtaacatgataagaagatactctactagaagcttgtcggcaacagaaatgacaatgtacttcgacataatcaatttacaatgctagagaaccaagttgtgccctataaaatggaaagtactagcatggaagtaagaatgaaaatttagcagcagcgaggccttcatcaactcgaattaatggagtaggagatacgctggtctctggaagcatgagcaatttaccattcttgatgtgggtctagaactgagcttcattttaaaacaaaaaccacaattatttacatctatcaaattttgtaatttgtgagctttctttatctcctacaagaccaccaaaacagttgtaaccatggttcaatacgagttaaaaagcttttgcagttcacaagaagttcaccaaaaatttcgttttttttcaataaataagcatttgacattacaatgccacatatgaggggagctttgggaagaagaaggaaggtgagaaacaaaacaaaagtctccctcgagcttgaagagagctccttatcaagttattcgcaacctaacggggaaataacaaagattagtatcagtcatgttcaattgttcatgaagcttttacaaaaccgtaaccaaaaatagacacatgagaacacgcgttgagaagtaatcaacagaaaagcaatataaaaagttaatttacctctcaaatgctgctttcaaaggaacatggtttgtccgactattctcacgaagataaactgacttaagaaagcatatcaaggaatctcctatcatgtaacatattagtcaccaagccaaaagttgttagggcacatggttcctcaacaaggataaactgtttaagatagcatttccaaaaatcctttgtccaatctcccatcatgcaacatatctgtgaccaagccataagttgaagcatctccagcaaatctgcaactcctcatttctttgatgagttcagctgatgctgctttgtcaccatctctaagatgcgccctaataagcgtattataagtaccactatctggaagaggcccgtcttctttcatttttctgaataaggtatatgcttcctccttaaaacctttcttacagaatcctgagatcattgttgtgtaggttacaacattaggcttcactcctttaaggctgaggctacaaaatagatcccacccatcttccaccttccctgccttgcacatcccttcaatcataatattatatgtgtaaatataggttccattttactcttttgcatatacccgaataccaccaatgctttctctagcttcccatttttacagagtccatctaacagaatgttgtatgtcatgatatcgggaggcacgccatcagataccatctctttgaatatttcttgagccatatcacaatctccagcttgaaataacccttggataagagtggtgtaagtgactgtgttgccaaccaatcctctttgagacatctcgcggaagagttccataccttcgtctactctcttagccttacaaaatccctttataagagtattataagtcactacgtttgggaaacagtccttgctaatcatcaactcaaacatgtattatcatccacggcgaagagattgtctgttcgtcggaatctcctggggaaaggtaatcatccaactgctccttactccttcaatctttacggtttctgttgctggggacgagctttttctggtagcagtggtgattacagagagaacttgagtagaaaagtgttacaggatttgaagttagatgatgcaattggtttgttcggtggcatggtcaagtcacgtcctttaccttccatttttgagttcaataaactgttgagtgccattgctaagatg

SEQ ID NO: 15094 - DNA, 3000 bp, Unknown; identical to SEQ ID NO: 15088
  misc_feature (1)..( 3000): cDNA_ID_3080583_gDNA_ID_2685560_Annot_ID_193461 3000 nt of promoter + ATG

SEQ ID NO: 15095 - DNA, 3000 bp, Unknown; identical to SEQ ID NO: 14715
  misc_feature (1)..( 3000): cDNA_ID_3018719_gDNA_ID_2685560_Annot_ID_193456 3000 nt of promoter + ATG

SEQ ID NO: 15096 - DNA, 3000 bp, Unknown
  misc_feature (1)..( 3000): cDNA_ID_2783490_gDNA_ID_2685560_Annot_ID_138174 3000 nt of promoter + ATG
cttctttccccttgaactcctcgcaggtatcttcaccgaaggtttctccacatcgcccgaaatgtcaagatgaacgccaggatcatgagtctcgtacttggcccctatcataatcgagttgttcacagcttggaagttgctattaacataagtgcttaggaaatcaagctcgtggtcgccattttggtctctgtctccatgattgttgtcaagctcggtcttcatggtggctccaaggttggatccagaaagtgtgatgactctgataccatcttcctcttcatcgtattggctaggtcctgccttatctcctcccatgtgggttaaggaagagatcatgttcttaagctcgtgctcgaaatgttgttgtcgcctgtgcttctctgtttcgcctcttgactcgcttagcttcattctttatcacccaaagcagatacgccaaggcaaagcaatccaactatgcatatataagctatatgtgattttatataatctttatgggaataaattatgagaacattgccttgtgttgcaattaaagaattggattttgtctgttactaaagttatagaatgactttccattgagttcaagaatatttttttttttaccgattgtaaaaaatgtgaaattattattataatttaagttgaaattatttatttattagttgaaaattgaaattattattcaagttttgaaaacagagttttgttccaaaagaaaaaaattcccaagctgatgccttgttcagaaaaatgaaagaagatgggcctcttccaggtttactggagatgcctcaacaataagtttggtgactaatatgttaaatgatgggagattgggaaaaagctttttttaaacagtttcatcatcctcgagaaaaacgtagtgaggtgaattaacgtttttgctgctattaatggaaatttctgttttgatggtatgacttagcttcatggaatctgtctgattatatttgttattttcacgctaggttccaggcaagaattgatgatgcaaacactctttacacacaagaatggttgtcaaagtcagagaagctgcgatcatgaaaatttcagacttcaaataatgtttgctatgtaagttctaagcttttcatcttttttgggattgcagtcttgtagtatatattctgctcggtagaattttatagcgggaagtatctctgttacaatcttattgttcaagatcttctgttgtttctcaacggttttaactagcggctatccgctcgttctctcgtctgtgtatgccttatcgatactacgttcccacatcattcccttactcaatcaacaacaacaaaaaataaagtaagtatgatgtgaagaaacacaacaacaacaatagattcatcctgaaatgtaagtcaggatatagtaacatgataagaagatactctactagaagcttgtcggcaacagaaatgacaatgtacttcgacataatcaatttacaatgctagagaaccaagttgtgccctataaaatggaaagtactagcatggaagtaagaatgaaaatttagcagcagcgaggccttcatcaactcgaattaatggagtaggagatacgctggtctctggaagcatgagcaatttaccattcttgatgtgggtctagaactgagcttcattttaaaacaaaaaccacaattatttacatctatcaaattttgtaatttgtgagctttctttatctcctacaagaccaccaaaacagttgtaaccatggttcaatacgagttaaaaagcttttgcagttcacaagaagttcaccaaaaatttcgttttttttcaataaataagcatttgacattacaatgccacatatgaggggagctttgggaagaagaaggaaggtgagaaacaaaacaaaagtctccctcgagcttgaagagagctccttatcaagttattcgcaacctaacggggaaataacaaagattagtatcagtcatgttcaattgttcatgaagcttttacaaaaccgtaaccaaaaatagacacatgagaacacgcgttgagaagtaatcaacagaaaagcaatataaaaagttaatttacctctcaaatgctgctttcaaaggaacatggtttgtccgactattctcacgaagataaactgacttaagaaagcatatcaaggaatctcctatcatgtaacatattagtcaccaagccaaaagttgttagggcacatggttcctcaacaaggataaactgtttaagatagcatttccaaaaatcctttgtccaatctcccatcatgcaacatatctgtgaccaagccataagttgaagcatctccagcaaatctgcaactcctcatttctttgatgagttcagctgatgctgctttgtcaccatctctaagatgcgccctaataagcgtattataagtaccactatctggaagaggcccgtcttctttcatttttctgaataaggtatatgcttcctccttaaaacctttcttacagaatcctgagatcattgttgtgtaggttacaacattaggcttcactcctttaaggctgaggctacaaaatagatcccacccatcttccaccttccctgccttgcacatcccttcaatcataatattatatgtgtaaatataggttccattttactcttttgcatatacccgaataccaccaatgctttctctagcttcccatttttacagagtccatctaacagaatgttgtatgtcatgatatcgggaggcacgccatcagataccatctctttgaatatttcttgagccatatcacaatctccagcttgaaataacccttggataagagtggtgtaagtgactgtgttgccaaccaatcctctttgagacatctcgcggaagagttccataccttcgtctactctcttagccttacaaaatccctttataagagtattataagtcactacgtttgggaaacagtccttgctaatcatcaactcaaacatg

SEQ ID NO: 15097 - DNA, 3000 bp, Unknown; identical to SEQ ID NO: 15092
  misc_feature (1)..( 3000): cDNA_ID_2783494_gDNA_ID_2685560_Annot_ID_138175 3000 nt of promoter + ATG

SEQ ID NO: 15098 - DNA, 3000 bp, Unknown; identical to SEQ ID NO: 15091
  misc_feature (1)..( 3000): cDNA_ID_2783498_gDNA_ID_2685560_Annot_ID_138177 3000 nt of promoter + ATG

SEQ ID NO: 15099 - DNA, 3000 bp, Unknown; identical to SEQ ID NO: 15090
  misc_feature (1)..( 3000): cDNA_ID_1015175_gDNA_ID_2685560_Annot_ID_138178 3000 nt of promoter + ATG

SEQ ID NO: 15100 - DNA, 3000 bp, Unknown; identical to SEQ ID NO: 15089
  misc_feature (1)..( 3000): cDNA_ID_2783514_gDNA_ID_2685560_Annot_ID_138183 3000 nt of promoter + ATG

SEQ ID NO: 15101 - DNA, 3000 bp, Unknown; identical to SEQ ID NO: 1384
  misc_feature (1)..( 3000): cDNA_ID_2134913_gDNA_ID_2910745_Annot_ID_193739 3000 nt of promoter + ATG

SEQ ID NO: 15102 - DNA, 3000 bp, Unknown
  misc_feature (1)..( 3000): cDNA_ID_3081395_gDNA_ID_2910745_Annot_ID_193752 3000 nt of promoter + ATG
aaccaaagcaggtctttttaagtaaagtgttaagagtagtcagtgagatagcaatagcagaaaaaggatgtgaacttatgtacgataataatacataaatgtacaatattatcattcccttggactaccagtactttgataattctaataaatattgtgtaatatagtagtctgttcttgttttttggtagcaatactataaaaacctaaaaacaattgaagcacctttttggctgtcaatatgtcataacacgggatcgaatacatttgaataaaccatatgaaaaagtgagaaaccaaaactcttagctatataatttccagccttccttcgttttccatttcaattgtaatttttgtcacagtcattaaacaaaacgcttttatgacgatatcaacggttatagcattcatgtccatgttcctagtatttgttatgtctggtccgatagtggtggagggacgtgcttttttcgtgttcggtgactcgctcgtcgacagtggcaacaacaactatctggtgacaactgcacgtgccgactctccaccgtatggaatcgattttccaactcggagaccaaccggccggttttccaacggtcttaacattccagatcttatcagttacgtttggttactaatctcataaaccggtttagagtaatcttgattcagatgagtatacaaatatttagtcataagaagctatttatttaccaaaaagacataataataaactggttaaatattggttaggtgaggcaatcggtaacgaagagccaccgttaccttaccttagtccagagctaaggggccggagtcttcttaacggtgctaatttcgcctccgctggtatcggaattctcaatgataccggatttcaattcgtaagtatatatataaccgagtctgacatcaaatgaaaattttcatattagtttccggttatttattagatataaattttggcatgcagatcaacattataagaatgtaccaacaactcgattacttccaacaataccaacaacgtgtgagtcgcttgattgggaaaccgcaaactcagcggctcgtgagtcaagcgcttgtattaatcacggtcggtggaaacgattttgtgaacaactatttcttgtttccatattccgctagatcacgccaattcactctaccggattacgtccgactcctaatttctgaatacaaaaaaatactattggtaagtggtaacagtcttattataatttgcttcattattgtaagaccaaaattgaattggaatgatgatatagtcttaggcagttgaactcatatgatttcaagaactttcactctcttgcaatgatttgactatttgagtattgttgcaaacaatttaattgtgtgttatttgtagaggttaaattcacttggagtgggtcgagttctagtgacaggagctggaccactaggatgtgcaccggccgaactggcgagatcaggtacgtcgaatggaagatgctcggccgagctacaacgagctgcatctctatatgatcctcagctacttcaaatgataaatgaacttaacaaaaaaattgggagaaatgtgtttattgctgctaacactaaccaaatgcaagaggattttctaagcactccacgaagatatggtaattaccactagttttccctttctaattatctactttttgtcgagaagaaagggttataacaattatttatttatgttataggatttgtaacatcgaaggttgcttgttgcggacaagggccgtacaatgggatgggtttgtgtacggttctatcaaacttgtgtccgaaccgtgagttatacgtcttttgggatgcgtttcatccgactgagaaagcaaaccgcatgatagtccgacatatcttgaccggtaccaccaagtatatgaaccccatgaaccttagctctgctcttgccctatgagccacacacgttgaagtgggaaactcggttttgtttatttcactcgcaagatatatgtatcgactaccgagtacaagagtatgaaataagataactcagtctcaatttaacttgttctttcttaaaattttaattggataaacttgttttgatttgatttacttatagagtatttgcattttgcacccaatgacatagaatgaaaaacaggtaagtaaatatagcaatgattaaaagaaatttggttaataatagcaaaaaaaaaatatattcttaaagtgggtttattaaatagttgttaaagtttaacccgtgtcacaatccaatcaattaattgacaagtactagatcatattagttaatactaactttgagaaactaaaatttattcataagacacatacatatatcaatatagtttccaaaataaagatattagttttaccaaatttaaagtgactttaaatatgacataatttatttatattaaatatattgtgtgacggatatatcaatgaaaagacattaatgtcattttgcataaaatcttataaaacacgtaatcatttttagaaacgacaaaagtctttaaaaaatatgacaaaaatcataaatacgtaataataaaagtagtctaaaatagttaatcttaaatctagtttaaattatcaaatcttaaaatctaaaaatgtatatatttcttgttatttactttctgattttttcagatttaatatttgtcaaactccctattatatgaactaaatatattcattttgatttaatcctttgaatatatttccaaaaacatagatattactaagtttacaaaactcttaaaaacctttacaaagttaataaagctgtgaggaaaagtcaaattaccaaaagtagccttcccaaaaagactcgaaccttctcactgagaaagaggtataaggtctatttcagagcatgaaactttgaaaacaaaatccctacagagagatagattgggaattgaatttgggaatccaggtttagggatgaatcgatcaacgatg

SEQ ID NO: 15103 - DNA, 3000 bp, Unknown
  misc_feature (1)..( 3000): cDNA_ID_3081387_gDNA_ID_2910745_Annot_ID_193754 3000 nt of promoter + ATG
atatattttttttttgctattattaaccaaatttcttttaatcattgctatatttacttacctgtttttcattctatgtcattgggtgcaaaatgcaaatactctataagtaaatcaaatcaaaacaagtttatccaattaaaattttaagaaagaacaagttaaattgagactgagttatcttatttcatactcttgtactcggtagtcgatacatatatcttgcgagtgaaataaacaaaaccgagtttcccacttcaacgtgtgtggctcatagggcaagagcagagctaaggttcatggggttcatatacttggtggtaccggtcaagatatgtcggactatcatgcggtttgctttctcagtcggatgaaacgcatcccaaaagacgtataactcacggttcggacacaagtttgatagaaccgtacacaaacccatcccattgtacggcccttgtccgcaacaagcaaccttcgatgttacaaatcctataacataaataaataattgttataaccctttcttctcgacaaaaagtagataattagaaagggaaaactagtggtaattaccatatcttcgtggagtgcttagaaaatcctcttgcatttggttagtgttagcagcaataaacacatttctcccaatttttttgttaagttcatttatcatttgaagtagctgaggatcatatagagatgcagctcgttgtagctcggccgagcatcttccattcgacgtacctgatctcgccagttcggccggtgcacatcctagtggtccagctcctgtcactagaactcgacccactccaagtgaatttaacctctacaaataacacacaattaaattgtttgcaacaatactcaaatagtcaaatcattgcaagagagtgaaagttcttgaaatcatatgagttcaactgcctaagactatatcatcattccaattcaattttggtcttacaataatgaagcaaattataataagactgttaccacttaccaatagtatttttttgtattcagaaattaggagtcggacgtaatccggtagagtgaattggcgtgatctagcggaatatggaaacaagaaatagttgttcacaaaatcgtttccaccgaccgtgattaatacaagcgcttgactcacgagccgctgagtttgcggtttcccaatcaagcgactcacacgttgttggtattgttggaagtaatcgagttgttggtacattcttataatgttgatctgcatgccaaaatttatatctaataaataaccggaaactaatatgaaaattttcatttgatgtcagactcggttatatatatacttacgaattgaaatccggtatcattgagaattccgataccagcggaggcgaaattagcaccgttaagaagactccggccccttagctctggactaaggtaaggtaacggtggctcttcgttaccgattgcctcacctaaccaatatttaaccagtttattattatgtctttttggtaaataaatagcttcttatgactaaatatttgtatactcatctgaatcaagattactctaaaccggtttatgagattagtaaccaaacgtaactgataagatctggaatgttaagaccgttggaaaaccggccggttggtctccgagttggaaaatcgattccatacggtggagagtcggcacgtgcagttgtcaccagatagttgttgttgccactgtcgacgagcgagtcaccgaacacgaaaaaagcacgtccctccaccactatcggaccagacataacaaatactaggaacatggacatgaatgctataaccgttgatatcgtcataaaagcgttttgtttaatgactgtgacaaaaattacaattgaaatggaaaacgaaggaaggctggaaattatatagctaagagttttggtttctcactttttcatatggtttattcaaatgtattcgatcccgtgttatgacatattgacagccaaaaaggtgcttcaattgtttttaggtttttatagtattgctaccaaaaaacaagaacagactactatattacacaatatttattagaattatcaaagtactggtagtccaagggaatgataatattgtacatttatgtattattatcgtacataagttcacatcctttttctgctattgctatctcactgactactcttaacactttacttaaaaagacctgctttggttttatacaattgtttgttgtatgttataaactaaattacgaatcatcaaatactagtgttaaacattttcaagttagaaccatttttttgtttgttttccttgtgagattatttctctttttttttaacataatgatgagatcatttccatccaattgttatttaataccacctatatccacctctcaagtttcacaagaaggaacgaacgtaagcgttgggacacaaatgacaaaaccctttactctttaacaagaactcacatgaggcttgcgtaatgtttatgacagaacaatgatattatactgtcctagcgatatttgggtttgattgagttaccaatataacccaattggcccacaagtatccaacattctggcccatttgacgttcagtatattatcagcgtggaccatcaatctgactccgcgccacgtcttcaagcaaattaaccggtttggttcgcggtttaattatgagaatgagatatacaaaacagagtcttcgatttcagagttgatttaggtttcttgattctttcttctttcgcttcaacacagtcgagtgactcgccatagcttcaacgccgacgaaacccactattcaaggtagccaatttcttctacagagcaacgtatcgatttgatttcgacctctttttgtttcttcttacttgcccattatctcaatttgtcactgaacagagatttaagttttagagttcaaaagcaatcctaaaaccctaaaccctaagctgagcaaaatccttcata

SEQ ID NO: 15104 - DNA, 3000 bp, Unknown
  misc_feature (1)..( 3000): cDNA_ID_3081421_gDNA_ID_2910745_Annot_ID_193744 3000 nt of promoter + ATG
  misc_feature (1352)..(1352): n is a, c, g, or t
atcagcttgcgaatatgcgatcttacctggtgcagaagttcctgcacacttcactgaccaagatacttcaggctccctaacgatcaacataactactaagactcttccttcacgcttaagatataaagcttgcatcttgctgtcaaaaggcaatataaatcttgaggatgaggatgaggattcgtttatgtctgtgtcttgtcacgtcacggggaaacagaatatccttattctcccttcaccagttctacgtggatatacagatcacttgtatatatttgattattctttctctctacatgaggatttccctgaagccaaagaagccactttcagcgagcttatgtttgacttcatagtccacactaaatcctggaacgtgaaaagctgcggtgtacatctttttgaggtccctcaccgtaggaaaataaacagaagaagaagactgtctggacagaaacatggagacatataatgaaactgaaggagaagaatctgccggaaaagaatgaggttacgccttgtgtatgtgtgatgtgagtagattttctgattccgtgtgatgtatttttccaagaagagcagctccatgccatccggcacaatcaatctggggtttatccaggtttcaagaatgtcgttagatttgagcagtgatagcaactagcaatcttaagcgtatttcagactgcataaaactcagtttctcgatatggatcaaccaagcactacttacaagctcatcttgatttgcttctgttctagtttttttgataaaagttgtatttaaattgttttgttttttataatggctgccaaaaaaaaaaaaaaaaaaaaacttcaaacatatgtaaaaaatctgattgtttctcctttctcaatttgcaaaagattattatctgattgtttttctttagcctcttagaagtctaaagcagatggatttaagtaagtctgagaatctaaaagagattcctgatctttcaaaagccataaatatcgaggaactctgtctcagttattgtggaagtttggttcctcgatcaagattgtatcacacgtcactgcaagctgccttttctgaatttatcaggatcaatctccagcaagaaagagaatgatttcatctggttggataaataaagatcagtgaagagttgcatgataatgatgagccagatgcagtttcatcatcaaaccctgctcattacaattgttaagttatatcatctgacacccctttggacccatctcagggcactgcaactgttctagtgcatatagttcaacatttctgaaattagaatgaaatctttggtaatgtagaaatttaggttcttgtaagatatagncatagcttatagataatttctttgtattatccgtgtaggttaggcaccttattgttattgacttcaaacatatgtaaaaaaaaactccagattttaaaaccacttaaaaatatatatatatcttattatataaagtatggttttcaaagttgctaattcataagattgtgccacgtgccaagtcaaacgatcaggtgtttacatgtgtcattcaaaatttaatttttttattctctaaaaaaataaaaaatctttaactttaacttttttatttacatcatgcaaattaatattaaatgagttaaaattaataaatgaaaataattgaaaagttaaatcctataagctaagctatttttctcaaaatgttttatttttcacttatgattacatgagttaaagacaaatttgttaattttccttttgttgaataaatgttaattgtttataaatatatagacatataaattagtatatgtaaatttgtttactttttaagattttttatttttttagagaataaaaaagttaaattttgaatgacacatgtaaacacctgatcgtttgacttgacacgtggcacaatcctatgaattagcaactttgaaaaccatactttatataataagatagacatataaattagtatatgtaaatttgtttactttttaagattttcaatttttttagagaataaaaaagttaaattttgaatgacacatgtaaacacctgatcgtttgacttgacacatggcacaatcctatgaattaggaactttgaaaaccatactttatataataagatatattttcaacaatgtttggtttctaaatatttttgtggatttttctttttttaattaattattagccttaggcgtttgggtattcggatcgggtatttcgggtcgggtttttgggtttagaagtttagaacccgttgaggtaatttaagattttaggtcgggttcgggttcaaatttatttatatattgaaatattaaattttgtgtgcaaatctattaaattacttgaaaatttcaaaaattcccaaaacaacacgagtggttttgcttaaatatatataaaaatacacaaaataactaaaatatccaaaacatcctaatattttctatatataagtataaatataactaatatatacttatatttgagatatgtttggatacctattccggttcgggttcgagttttttaggttttgaaatttagacccgttcgagtatttaaaaattttgggtacacccgcctatttaggcgggccttatctagtatatatatataaagagggtatagtaggcctaaacatgatcatacgataagcatggatggaatttagaattatactattgatgaatctgaatttccttgaccaatcaaagtgatctgtcagctaaacaaaagaatttaattcccaaaagcgagtatgacgtgtcatcctatatacacaagtggcatacataattgaaacaaaaatgaattaaatcacagaaataaaaagaagcagaggaagaagaataactgatttacataacagttatttcttggcttctctgattctcgaagtttctagtgttctttgcttttatttctctacgtttatcgagaaatctccgggctgaaaatg

SEQ ID NO: 15105 - DNA, 3000 bp, Unknown
  misc_feature (1)..( 3000): cDNA_ID_1012088_gDNA_ID_2910745_Annot_ID_193741 3000 nt of promoter + ATG
gatgaaaaaaaaaaaacgatattgctatttgatttcctatatttttgtatgaattgattgtagaggattcttcttcttctgaacatattgtagtaatatatatatttttaaagaaatattagatcgaatctcacaaacggaagaatctttccacgttttgaggaatacggtctgtcactgtcacctacacatatgaaatataagtctgtttagggtttttagcgtcggtcttcagattttgttggaataggatgtcctaaacatcaaagatctaaaaattaaatcaaaattgaagaaaaaaccttagatacagatctatttttggacatttagtcactcttttggacgcttctttggacacacaaacacacataccttagacacatttttcaaacatttaaaattttagatcctctatatttggatcccatcattggacaatgtcaaatataaatctagttcaaatgtctatttgtaaattttttattgtaaaatatggatcccattgttgtagatgctctaagggaaaatacgtatggtcaattttgtcaagattgagaaagaaaagttgaaccatatataatataacttaacattgattatgtttttcttgtggtatgttttgttgttttgttgtttttagttgtagttttcagtcttactctcttctttgtttgattgtttccctattaatcgctgatgcaattcaaaaatggtataaatatttaacgttataaattaatataaggtgagcaggaaagctttatatttctttattacttgcaagtttcattacttgtatttcatttcaatatttataggataaagttttataacataaaaaatatagtagcttcaacttttgttattatatagtctatgcaaaaccattttaaaccgacagataaatgcacacaactgacaaatttgttgttggttgaggtatggattggcagcaaaaaggaacttttaaaaatgtgaactttgactgtgaatctcccaaaaactcccaacttcttcaccgtcatcgtcaagcttacgccaaccacttaatttattacacatagactatcatttttctagagacaacccataaacaataaagctactttttcaaatgtaacccccatattctttttgttttgctttgtcaataaatgtaaagccattttttattttgtaactgaaacattttcattactatttggctaaattagctaaacttttcttcaatcgtttggctcacgcttctttttttttttttttaacgcgtgcgtttaattaatctaaatgcaaaccataaatctataaatactttttactaaagagagtcagttactcaaatggtgaatagctttatcattcagtagctacaatttacgggaaaagaagtaatggtatccaaatatttaatttatagtgctctgaaagattcaccatatattgaaaaactagaaatagaatttttctattaccattttaattatggtagacaatgtaaagctcatgttttttttcttcccaaatcttgaaaatgagttgtttagatttttaaactaatagatgtagtattttttccaaagtcaatagccatggtttagttacagaaaataaaatggctacgatttggtcaaatgatttatggcttgtagattaatattcgatatttaaaattacgaggatcataaacaaatggattgaataggactataggagtgattcattttctaattttcccattgggaaaatagcaactaggtcaacgacaaagaaaagtcaagacttgtttatttctgaattctgaccgtatatcactccacgaggccaggctcctgcaactcaaacgtctggtttcagtttggaccaataaataattttagagtttatatcttctaaaatcaaatgtagaatttgcatggattatatatggagatattactagtttaagatatcctataataccaaagtcatcctcaaatgtaaacactgaactgtttccatttattagtatagactcattgattgaaaataatggaaaactatagatgatgataaataaggaaacatcaaagagctaagtatttataatagctaataattaaaaattatatccatcataaacaaaattcaggaattcccatgtgaaaagaaaagtggaccgacaatataatagtcaatcatcacaaatagtaagaacgtaacatagcgttagatgcgtattcatataacattatgaaatgctaactgattgattttttctctttttaataaagtggacatctttgtcaacaaaatgggtagatttttttttaatgaactgtaacgtaaagtaaatgtgtcactgacaaaacctaattaataaaagccgtggactatagcgcgtttcttctctcctttttcacaccttcccctgcactcttcacttttggtttttgtttttcttctattataatggtttaataaaatatatatagtctatataatataatataatatgtaacaatgaagttttgtattcgagtttttatccaacaaaaatcaggaaaatagctaactgttttttactagtaaatttctgattacaacttttaaaaaatatataacacttattgtttactttgaattttcatatcaaggtgacctagtagggattgaactgaagtaaacttataaacacataattttttggaaacgtaagaacttgaatttgtgatctatccaattgtttttttttcaatcaatccaacttagaagagactctactctccactagttgtaattaaaaaaacaaaaacaattaataaaatgaagaaataaaactttgtatatctctcataaagtcgactatttagacttttagaggtaaggacaatatcttctttgcttacataccccactcttgttataaaagacagtaacctttcttgagatcactctttcttatttgtgtgttagtgcattgagagagagagagagagatagaaagagaaagaaatcgtc

SEQ ID NO: 15106 - DNA, 3000 bp, Unknown
  misc_feature (1)..( 3000): cDNA_ID_3081428_gDNA_ID_2910745_Annot_ID_193742 3000 nt of promoter + ATG
actcgaatcctgagtttctagagaacatcgtcacagcattgcacatattctcgacttctgagaagaataaaacactagttgctgaaaaccctcttgtgcttcctctgcttgcaaagtatatgaagcaggggacagttctgactcgaatacactctgcagcgactgtgaattcactttcatacactgattctaacaagattatcatcggtaactcggaagtactcaaggctctcatacatgtaatcgaagagggtgattcattagccaccagtgaagccttttccgcgctttctaacctctgtccagtaaaggagatcagtgaaaaggcggtttcagagggtttgattcgtgcggcaatcaaaaagatcaaagcaggaagcaatgtatctatgttgttatctctcttggcatttgtttctacacagaaccaccaaactaccgaagaaatggataatctagggcttatctatgatctgttcagtatcttgaggaactcaaatagcttggtgaatgatgagaacgctgtagtcatcgtctacaacatttgtaaaagttacaaagccttgcagaatgtggtcctaagagaggagaaacgggatgtggtcctagaagaggagaataaacacgggacatttacgaggcttgagaaccaagaagcaggtcgtgccacgagcctagcaaaaaggattttagagtggattttacggtaaagagccgcagagggcatgtagtaatcatcaagctcacgtttgaattaccactagtggagatgagattttgtaccaagcttattgatcttcttaaacccctaaatattctttttcttctttgttgaacactttctgagagcaatttcaactaaatgggtttttctttttcatcttacacgttacttcttgcataatatcaaagaatgttacatattctcggcttcgactataccaaaaatttgttgacttaggttgctcactccgctctcagacgtagactcgaatcctgagcttcaagagaatatcgtcacatcattgttcaacatctcgactgttgagaaaggataaaaaagtaattgctgaaaaacttcttgtgctctctctgtttacaaaatctttgaggaaggggacaaatcaaacaaaaagagtctctgcagcgactttaacgtcactttcaggcattggttctaacaagatcatcataaggaactcggaagcactcaaggctctgatagatctaatcggtgactcatatgacttatcagccacgggtgaagctgtttacgctgttttaaacctctgttttaatgaattggagaacgtggaaaaggccgtttctattatgcatcaatatttttctcaactatgatgtgtctcctttggtttctcgaatattctgcaaagaatcttgagttgcttttgcaagtatactacttctctctatctttttttataaagaatgttttcttggcttcaggtatttattgatttatttaagagattatacgtttcgttgtttgtcgaccgttaaaagtgatgcagaggagttagttgaacattgggaccaaaagtagcataatcatgacacatggccatattaagacaccgacctgtaaatatgagtcgcacacaatggagactgcgtaaaaaccaaaggaaacagcaagtgatcatgtggatgttttctcttgtattcttccaaatgttctgctgttcgctgtcacattcacgaaacggcacacactttgatccctcccacccatttttattccctctcaagtctcaagccataactcatttgactttgacataactttatataagcctttttttcgtttgacatcatatttttagtgtagcttattttatcgtctaaatcgtgttcactaaagcttatattttggttgggataaacgaactaaacttcttcaaactttatagaccacactcatcagcaagctatacaaaaaaagaaggcattttctttaaatactcgcaaaaaggtaacatactccagcatgttgctcatttttcgtatactcaaactataaccacaagaaattcaaatcgtgtgatttacattacatctttaataaatatttagaagttgttatgaatttttattttttctagaagtatgatatgaaataaaggaataaagtataaaattctatttgtatatatcgatagtaataatctaataatataatatgacgaagaagataattgtttgtatacacaaacaacaatatataaaagtttataataactaatctataatgtgaacatgtccctatttagtagaagcaaatccgaaattaagctcttctctaattttcgtttacacatcagaatagtaaaccgcgtggtgtaagtgaattaagctcttctctaattttctctaactaaacattgccaaaacaagcatataaaaaaatagaaaaatatgttaaataaaatcatatacaaaatataaaaaaaaaggctgtgactttccaataaaggaagtgatcttatttagacgagtataaaataaccttaaacattaaggatatacaaattaccaaccatggtaagactaaaaacaatctaatctagtggactaataaagtgacagtagaacattacacggaattcttaattagatcatataccatagcatgcttaataatatacactgaactaaagaatttttattcaccaacgaatctgaaaatttcctaaccaatgaaagtcgtctgttagctaaactattcccaaaaaagaatgcagagaatgcggatatgacgtggcagttatatacacaggtggcgtacgtaattaaaacaaaaatcaaaaattttaattaaagattaaagaaaaagagccaactgattcacatacatatttgagtttcttcgcttctctctcaaattcccctaattctcgagtttctagggtttttgcttcttttgctttgggtttttgtgtatacacgtgtgcgttcgtcgagaattctccggctgaaatg

SEQ ID NO: 15107 - DNA, 3000 bp, Unknown
  misc_feature (1)..( 3000): cDNA_ID_1393841_gDNA_ID_2910749_Annot_ID_193781 3000 nt of promoter + ATG
agacgtgtggagcacacaatacacatacgattttaatatatttgggcttctgtttaaatattttaaaacccatttcatcaaatcggtaattcatcactaatcaagatccaaaacatacatgtgtaaagagaatcctaagaaatcttttatagaaatatgatctgatttatagagatgacttataccagtaggtcaacggcaccggacgacacgaacggctgtacggcgttcgttggaggtgcaaacggccatgatggagagacagattacaataattatgacaagatgtgttagtaaactcgaaccatcatcgccaccaccaccacaacatgacatactcatcccacccattcttcttgtatccttaagatctgattatgtgtttataagggagatgagatgagaattaaagaggaaatgaatgttagctgagaaggatttgtctttcgagtttttgaattggtactttgtttttttaaatggtatttgttggacttgaattattcaacttactatgatgtatagatattttcaaattgttcttaattattttggtgtgttcttcgaaaatgttaatttgatagacatatgctctattcaatgtgtaattaatagtcgtcgacatgcatgttgttatttaactaatgtgttttcacctaccaaaattacttgatgttatgttttcataaaagatgagttaaagtcttgtggatttgggattgtatcccttctaaatttaaatattttattcgcagcatactattattaatagacttcaaattggtattttcggttattgagaaaaaaaaaatttggaccctatatttattatgtaggacctttaagtttcaaaagactaccatataaccaattatttctctcgaatcatgggttgaagtctcttccctttagaccatttctaagtttatagagaaattgcttaggaccactatgtccaattgactaattctatgatgccccttaggcacacagtgtcacaagtgtcgtttaactaatttggacatgaatgtggcagacgtgtggaagcacacgataatacacatacaatcgtcatatatttgggtttgtgtttaagtattaaaaagcccatttcaccagcatactttcaagtattgtttacaaaacccactccgaacattcgtttgtcaccgcccaccgacaataccataaaagaaatttaaatagattaagaatttggaaaatgtgtgaatcgtatacatcgtcaagtcaagtggcaagaaattgttacttggttccaaatgtttcaaactcaaacccacctaacacggacctaaaggccttttgttggttcccaaacgccgatttcttgtcttaattttagtgacacataaagtgccacgacgcctcttattgcatttttcctataatgcgacaagtttataaaataaaataaaattggtacacataaagttgtttctgaatggtttgagaatttgctatgtgggtggttaactatcatcaatcaaagttcaatatatttggctaataacagctatttataccgcaacttgtaaactagataaatgatagtgaaaatatataaattaccgactgtatagtactttatctctcctttggcatctcatatcaagcccatataaattgaaatttctgtgagaaatcatagctattttttgccaacgatatacaatgcagaagatctacaacttgtccactcaatttattatatttttagaactataatgaaaaccacaaagagagaagcagagagaggatgtggtcgatatgcaaatcaattagtcgcagcttcacagtactatagagaatctaaagggaatatacttgcatggacctgagtcagcatgaattttcttaacctctcatgttacgacacgtgttaacctgtctgaacagtacgttaatttaaaagatccacaccttcgtcgatgacaacttgacatgacgtggctttttctcattaccacgttggtttctcgggacaaaacaatattatccacttactgtttccgtttttgacgtaacatcagttttcgaacaacctatgaatatgattgtgtttttccatttgatgcatggagataattaatttgttgttccttacctctagccaactggccaagcccatcatattattggcaatcaatcattcagtattttagtgcatcattcaccaaatcagaacgtttctggatattgttcgttgaatcttgcaagcataggtttattcagttaacttggataagattccaatcgtctcgatattccaactatttgaacagattggcaagaattatgatggtaatgaaaaatgagtagatcaccgtacgctactcttcttaaacgatgtgatgatgagaaaccataagttgtcattgacgaaggttattaaaactaacataattacatgtatctttacattttccgatttcacgtaattaaaaacgagcattataattgttccatgatcgatattgtattgtcgtttttctcgatttgaactataccactagaaaatactttttaaagtttttttgacaacgatatttttttggatcctccgttgacgaaaataaactaagttttaaatttccttaatagtttcatttttcgtggtcacacttgaagattaaaattgtcattaaatgcaaaagcataaaaatgaaaaagtgaaatattaagcggctacaagtatgagagcattgtggtaacgacacgtgtaatgtccaaataggcaacgtttatccactacctttcatcttatataaacagattaacgtttcttttcttttcttatataaaccaaatccataatcctcaccatatccacaatcctcaagctatctcctttgtgtccataatcgaaacgctttttgcgatttatcctaatcttttttctatcttctgctacaaatttggttcttttttggttgaatttggataaaatcataatctcctcttcaattttcttgtgaaatg

SEQ ID NO: 15108 - DNA, 3000 bp, Unknown
  misc_feature (1)..( 3000): cDNA_ID_3080627_gDNA_ID_2910749_Annot_ID_193786 3000 nt of promoter + ATG
tctaaggcttatgatagagtagaatggccttttttaaaaggtattttaagggccttggggttctgcaaccaatggataggttggataatgggatgtgtctcttctgtttcttattcagtactgattaatggtcaaccttacagtcatttcttaccacaaagaggtataagacagggagatccgttatcaccttttttgtttgtcatctgtactgaagctcttactcatatcttaaaccaagctgaacgatgtggaaaaattactggaattcgatttaatgatgcaggtccttcagtgaatcatctattatttgcggatgatactttgatcatctgtaaagcaagtcaagaggaatgttctcagattatgcattgtttatcacaatatgggcatatttcaggacaaatgatcaatgtggaaaaatcttcggtcacctttggaaacaagattgaagcagaaacaaaagattggattatgcatagatctggaattcatgtggaaggaggaactggcaaatatctaggactaccagaatgtttcagtggctcaaaacaggttttgtttggctttcttaaagaaaaacttttatctagactcaatggttggtatgctaaaaccttatctcaaggtggaaaggaagtgttgttgaaatcaattgctatggcatttccagtttatgccatgtcttgttttaaacttccaaagagtctatgttcaaagttgacttctgtcatgatagatttctggtggaatatgttgcctggaaaaaaaaaaaatacactggattggagctgaaactttaatgctaccaaaagttctgggaggctttggatttaaagatcttcagtgttttaatcaagctctgttagctaaacaagcgtggagactgcttagtgataaagacagccttctttctcagatcttgaaaagcagatattatctgaattcagagttcctatctgcaacaaaaggcacacgtccttcatatgcttggcagagtatcctttatggtcgagaattattgagaaaaggtctgaaaaaggtcataggaaattgagaaaaaacattggtttggatagacaattggctttttgagggtaaaacgagaagacctgagagtgttcaggtgatggtggatattactttaaaggtcagtcaactaattgatccagtttcaaagaactggaacttgaacatgctcagagacttatttccatggaaagatgctcaattaattcttaatcaacgaccaatgctttcaaaagaggatgcttattgctggtcaggtacaaatcatggtttatacacagttaaatcaagatatgatttgagcagtagccagaatcataaggagatgtttcacaaagcacatgaacaaccttctgtcaatcctattttccaaggtatttggagtctatacatagcaccaaaaatcaaaattttcttatggaaagcagttaaaggtgctgtcgcggtggaagagagattaaggacacgaggaattctaatcaatgatggatgttctatttgtcctgaggagaatgagacaataaaccatgtcttgtttcaatgctctttggcccgtcaggtatgggctctatctttgatgcagtcaccaccttctggatttggaaattcgatttttactaatatgaaccatgtgcttcataactgtaagaatcaaagtatattaagactcatgcgatatgctagtccttggatcatatggactctatggaaaaatagaaataaaagtctttttgaaagtgatgtgtctatctctaatagcatagtacagaaagcatttgaggattggaatcattggttatctgctcaagatccaaagactcagtctgaagacacaaagaaagaaatgaaatggattcctccgccttggaatgaattgaaatgcaacattggtgtggcgtggtcaagtaaaactcaattagctggtgtttcatgggtagttagaaatgatacaggagaggtgcttatacacagtaggcgatcttattctcaggtacattctaactttgaagctaaactgaaaagctgggaatgggctttagagagtatggataaactacatgttgatagagttacttttggagcttcttctcatgatattatcaaagcaatgaataaaccaggagagtggccagctttgagaggacatttggatgcattgctagatctcactttggataaaccgcattggtatatggcaatggaattaagacagtgtaacacgggagctaatgagatagcaaaaagcgtgataacaggattgagatggcagagttatgttgctaaaggacctccccaatggctacattatctttttgactctgaattaattcatcagaggagtcgatgtttgtctcctttataggagaattttgtgctgagggtctaaagagtaagtctagttcatacgaaggacttcttgtcagatagtcaacatcagagtgttgatttgttgattagtttgagttgaaaagtgtcttattctacatctccacacgtttacttcagagtaaggaagggtaagatatttgaaatatttagcatgatccattagcttctaagttccctattggaaaggaagtctggctgtctcagaaatgactcagcaaaaaagctaatgacttagctattcagagttcataattagtgacacatgtttgactcaggatcatggctaaataaacgtggccgttggttagaatagctaataaggaggttagtggttcaattatgggggtgatagggatcgggaatttcctttttcttgtcttatatatataagtcggttatgttaagtcctatcatctcttagtatccaaattaggcgagagttctttttaatattttgttagtttaatattattttagtcggttctgttatttctctaagtctttatatatctttcctgctctccttagttagtctatttcccatccctttagttcctagttttcttctctcttatcactatg

SEQ ID NO: 15109 - DNA, 3000 bp, Unknown
  misc_feature (1)..( 3000): cDNA_ID_3080615_gDNA_ID_2910749_Annot_ID_193789 3000 nt of promoter + ATG
gtaagttgtttcagagggattgatagttacctgctgcaagtaggatcttcaccagtgttgtcacaaactttctccaaaccaaaaagaacaaaattcgaaaaactgaaatctttcacccacacctgcatcccggaacacaccattactgctttcttcgttttttcagaaagttaataaaccaagcggagaaatttgtctgatcactactgagtattccagatttttgcaaaattaaaactgctattctgataaacatccagtgcactgagaaagtgatgttacctctgttgggaagtggtggtatgttttttgagggaaatggtaatagtaaggaggcagatgaggaaccatatcacggtcatgcgtgatccggaaggtattgggcacaagcaaactgtaataagatgcaaaagcggcattcccaacacgaggttgcccaaatgtcataacctgtacgttttcttcaccttcatttacctgcgatttgtatccaatataagccattaacaactcaaaggacaaaacaataagataaaaaaaaaattcaatgcaaggatgattacaactaggtctagaccacaaaaggaagccatggctcctcccattgaatgaccggtcactatgatgttgatgttcgccccgtagacttttttcactcgtgttattgcatccaaaaccgcaggccgtaaagttgtattgtgataagcactgtaaaagccatggtgcacctgccaatgtggataactattacaaattccaccgtactacaagaccaactcaatgacaaatacttgttgttaaagtgtaccattgcatctggcatgtcagggtaattcagatcgagctgtttccagaacaagtctgagacccaattttgtatgctgcacaagttttggattgattaagcattaaccaagtttatgcgaaggagtagcttttagattacaatgactagaataaaacctgtgttcttgagttccccgaaatgcaataatgatagcattcaaatccttagccaccccaacatacgcctgttgttacaagttacatgtactgatattaataattgttcaatgaagaaacatcatgagttcatgaccagctgtagcttatgatatcagagcagacctgtaagcagtgttcaacgtcaaatatgacctctattacttcgaaatcctgcaccatcctaacaaacgttagagctcaactcaataattgcggcttcaaagttcaaacagtgatctgcttcaacatgtgttttttacctttgtcaaaccattgcatctttcgcacgtccaagtgaagagttttgtcaaatcagactcatagacctgcatacatcttacaaacttgattcactcatcttatgtacgttatcagcatcatctcttttctctagtagtgcaaataatgataaatgaaaatatgaagaggacaagtgtaatttcttctcacttgcagaacactagatataaatgacattcgttctacagggtattacgttttgaagctaaatcattatcaaaggtcttttactacttcactaatctgccattaacttaccgcagaggcatactccacaagcgtgacggcaagcgtatggttgtaaacaggtcgatcatcatcgctcttcaacttgagaactgcagttagaagaaagaagctaacataaatccacttgcttcagtcttaactccttcgtagcctcacaactcataccaagaacatgaaattgtcgaaaacataaagctttgaaatcaatattttgaccttcatggttccttatgtatatgatgatgctacaaggattatgaattgatttgttccaaacatgatagaacatgtaattaggccttaatgaaaaatcactgtagccagattaaatttccaatttcccaagcacttcacattacacagaaagtttaaaatcttaattaagctcagagagactcaggagaataaaaaaactggaagtcccaataaaggaaacagacatagaatcattatagaagttgcattaccacctctaccatatgaagatgaaacaagaaaagtaaaaactgccagcaagaacaacaatctcttttgtcccatgttctgcaagaagacaataaacacatccacatcatcctctgttcatcaaccaatgttaagggcaaaattgagctaaaacaaagcagaattcggaagcaaattagccaaaaatataccttataaaacgagactcacgaaacccaaactaatgaggattaggacaaaacccgaaagagatttcagcaaccaaaagtcccagataaattaaactgaggatccaaagcctaaattggacttcttttacaacaattcggaaatttccgacgatgatcggagattattcccggcaagaaaattatacggcgagcttatatattattatatagaagtcgtgatcttgcgaaacagaagctaatagaagaaaagaaacggcgattaaaatacgaatattcggttttttttttcttaacttccactttcatcctctatacgcaaaggtgcatgagacaagcgtgtaggctctttcaaagggtattattggaattttaggtgtgtagcgtgtcgcaacttcaagtgctgaggtgtcagatacgtgattcgggcggataaatggataaggccgttccgttataagaacgagaagttgacctttttgactttcgctttcttctaagtttaacttcgagcccatgggcctttaaagcccgaattccaaggcgggaatttccgaaactcttacttctcaagtggcgggagaatctttataagtcaagccaacgtggcacatctcagccgtagatttgatttctcgaaatcaacggggtaaaatagaagctacggtcgtttcaaacgtcgggtttgttgcttttaatttcacttttgtttatttactaaccaaagcaaaaaaaactcaggaaccctcgattcgatctctcagacgaaatcaggattcgtagaggcgcgtcg

SEQ ID NO: 15110 - DNA, 3000 bp, Unknown
  misc_feature (1)..( 3000): cDNA_ID_3080607_gDNA_ID_2910749_Annot_ID_193791 3000 nt of promoter + ATG
tacatcacatgattattataaaaatataatagcgcattttattctatatataggctgttcacgacatattcaaattgcatgacaggaaaatatcacctttaaattctaagaatacattatcttgtatttaagtattgaaagttgacattcttttcctatttttattttgtataacatatcccatacgaagacatatatattgatcaccatatatcttatcctataacgtacatattttctttgtttccgtataatctatatacttcccactatacaagaacccttttaacaatatttgtgtgcaactaatgattttggtccctctaaacttaattcatcaatggccagtataaaccaaaattttaggacttcattggacaatagttttcttaaaataattttatgtaatagtactacaacgcgatatataaattaaatcacatcatttttgttatatctatgtgtgatatactgatatatattttgtaaagtttgacgaaaataaaaaagatctatattatatttagcaaactaagaataacatattgtaggcatttccaccatgcatgcatgaaccaaattttggccattggtcttctagcaggccaaactttgaggtccaagagtcgtacatgcaaccatcatcgaatctgtagttatcgttttatgatatatgtaagcaagtctataaaggagcatctgcagtttggaaaaagaaaggttcttttatgtattggataaatgttcttttcgcgtgcttgtagccatcaacacatcccaaccaaggattcggtggaattattaactaaaaggccaattactttgaagaggttataaataaatcctactaaatcaaggatgacaattgttctatattataaatatataatcgtcagaatgtcaatgaaataatagcatcacgtttgcttcttgaaacaagctttgcagtcacatataccctatttataaacagatttagttatttggaaaattatcacataccagttatatatgtcttcttctgttataaagctgttgagtcgaaccattaattaatatttatatgtacatgtgattaatctcaaaatgtttggcatgttgcaatggaccgtacgtctaggtcacgcatcttatccgacatcatgggaccagatcacgacatggtctagtgagaatatatatgcatatctaaaatgatcttggtctgattgctgatgcattgttttcccacatcttaaagatcatgcatgggccgggtctaacccatcgtcggctaccaattgatcttggggtgattttgaaggggaggggtaatgaccatttcttgggttcgagttctaccaacagataattaacattagtaatttctggtccaaagagactataactcctcggttgccgaaaagaacaaaaaatcatgggcacaatgcatgcttttgatgtttgtgtgcatttaaaaacaaaatacacattgtttaagctaaccaataaaacatgattagcgaaatggaattttaaatagatctcgtgtttgcctgaaaaagttatttaaaggggacctcaagggcatatatacatacaagtctgtatgtgtttttactttcatacgtattctcgattcgttgtccttaaaattcgttagtcaccatgaaagcaaatgaaatgcttagctcatacgtagaatctttctctcttcctctcacttataattattacttctttttttttgatgagttacaaaatgtggaagtggcgagtcgagaatagaatcctcacgttggagaaggggacgtggcctaaagaaaaaaagagccctcgttttggataactatttctccaactcataagatgccttctgataggctttacatattccgtttttagagagaaagaaagagagagactcaaatctaacaaaatgcatatgcaagaaatccaacttaattagctctaaaccttatagttagtaattatggtaggaaacattcggaaacttataatgtttttcgttggtcgtgaaacttaaaaacgattagaggatcctaattagatattaacttaattcgaatttaaagtgcagaatcaaatctcatgaacactttttgatgctaatcctcaaaggactaggtgggagctaggtatcctaattgtacataaaaataattatcgacattagattgagtagaatgctagatttacaggattactattttaaaaaaactcaactgtcgaaaattacttataaatgcgcatgcatgatccagtgacttatcaacgggatgtctatctagttactttttcaaaaaaatccgtgattttatctgatttttcaatatattgtagctacgaaatctagtaaatttttgttgagtcacaatgagttatagccgagaacaatataaaccttattaacaatacaaaccttattaaaaacaatataaaccaacccttctcctttattaatcaatcatttaggtatttatttaatattacttgagattgactattgtctattgatcgactatagatcgctttatggaaccgtacaaaggacattctcaccttttagagatgactatatacataggtctaattctaaatgccaaatggacaataaaaatgaaaagtaaagataagttcgaaaatcattagattctcaatcacttacattttgtgatccaaaataaaattgaacttgttgtcgctttcggacacgatatccttagaaacaaaatcccaacatatttccccatctaatccaataatatcatcgtcttctctgcctctatataaactaacacttactcacctatttcatatatccacacaacatttacacaatacccttattctccacgtagaatcaagagtacttcttttccttaaatctctacaaaaaaaaaatcgatctatatactaagagatcataaatatagattcatagacctatttaagaaacgacttaagaagctgttggatcatataccatataaaatagca

SEQ ID NO: 15111 - DNA, 3000 bp, Unknown
  misc_feature (1)..( 3000): cDNA_ID_3080619_gDNA_ID_2910749_Annot_ID_193788 3000 nt of promoter + ATG
taactcaagcaaatcaagtacagaagatagtaagaagcatgtctaaggaacacgaaaagaaaaaaaaactaagttcaacagactcaagcaagaaagtagtttcaacataggcagaagcaatctgacagaaaaattgaaggatctaaacaattatagatcaaaagatttgacaagtacctgaaggggggttcccgtgataagaagccgatagttggtgctgaaaagtctcatggttttcgaaaggagtgaattctcatttttaattcgatgtgcttcatcaatgattatatatcgccagctaaaacggcgcaatgttgtcttctctttgatagccatctcaaagcttgttacacaaatgtcgaatttccctgcaactagcagttcttcacgaatatgtctctgcattatttaaaatatatctcagaatcctgccaggtgcatataaatgcaaccattcaaatgtaagagctattatgacttactctttcctcgggattaccgagaaatttcacagcacgcaggacaggacaaaatcggcgaatttcattcatccagttaccaagggttgattttggagcaactaccatatgagggccattaattcccctgtactcatgcaggtaagccaacaaagaaatggtttgaagcgtcttccccagaccctagaccatgaacaaaaacaataaagattagcatcagataacattagagagctgaaaaatcttattatatgctaagataattagtggtttaccatttcatctgcaagaatcccatttatgccgttctcatacagccgaatgagccagtttaaaccagctaattggtaatctcttaacttcccctgaatacctgcaatatgaagagtatgaagatcagatctctaaattctacagaatttatgcagtcctacctagaaattgtgagctcgcaactgaagaatatatcaaacaactctaccaatcaaagaagtgggcataaggtgtcaaatcctataataacttcgactcgcaataggacttgagcaaacatacgctatatcaagatattaggagcaaaacaaaggtacttacaagcgggctgagtgagcaaccgtgtgcctccagatccaactataccaccctcttcttcttttaaacactcttcatcttcctcttcctcggttagtttggaagaatggcgacccctgacgataaagtgaaacccaataaattatatttctggaaacttaatatgaataaccacaatttattttgagataagttgcactcaacacaccttccttttcccttcttctgggacggagacgggtcacttttagcaaaatgtgcaaataactcagtttgctgcagaagatactttatcctcccctttcctttattgttctaataaatggaatgattgagttatttcaatacctctggatactaaagacaagcagctcagttatttactaacttaccatatcagcatctatggaagcattttgggagtctaagatttgctgaattttctgcttcttcatcttctgcatttctttgagtctagccttctcacgtttgctgatctcagctttctcctcgtcttcttcgtcctacatataaccatcaaattatgaaaagagtgaccaaatatcctcacgagtcacatgaatgtaccatcataatgagcgaccacccatcattgtaagcacttctaagcataaaccttcaaacaaagagagtcgaaaccaaaagacacccaaatatcgaatatacgctcaaaggaaaccctaatcttacttagaatacattcagatttccaaatacagcaatccccgaattcacagccgacatgcgaatgtaaatcgaagagtggaaaacagaaacgaagacatacctcttcagcgtcatcttctacggggacaacctcgtcgtcagagacaggtgcttcgtcgggcgcaacatcttcctcgtcagagcccgcagagcgagcgacggcctcgagctcgtcatcatcttcttccacattggcctgatcgttaacttgctcctcttcctccgacgagtaagcctcgtctgaagaaacttcccgcttcgaagctctagccatcgacgcgcctctacgaatcctgatttcgtctgagagatcgaatcgagggttcctgagttttttttgctttggttagtaaataaacaaaagtgaaattaaaagcaacaaacccgacgtttgaaacgaccgtagcttctattttaccccgttgatttcgagaaatcaaatctacggctgagatgtgccacgttggcttgacttataaagattctcccgccacttgagaagtaagagtttcggaaattcccgccttggaattcgggctttaaaggcccatgggctcgaagttaaacttagaagaaagcgaaagtcaaaaaggtcaacttctcgttcttataacggaacggccttatccatttatccgcccgaatcacgtatctgacacctcagcacttgaagttgcgacacgctacacacctaaaattccaataataccctttgaaagagcctacacgcttgtctcatgcacctttgcgtatagaggatgaaagtggaagttaagaaaaaaaaaaccgaatattcgtattttaatcgccgtttcttttcttctattagcttctgtttcgcaagatcacgacttctatataataatatataagctcgccgtataattttcttgccgggaataatctccgatcatcgtcggaaatttccgaattgttgtaaaagaagtccaatttaggctttggatcctcagtttaatttatctgggacttttggttgctgaaatctctttcgggttttgtcctaatcctcattagtttgggtttcgtgagtctcgttttataaggtatatttttggctaatttgcttccgaattctgctttgttttagctcaattttgcccttaacattggttgatgaacagaggatgatgtggatgtgtttattgtcttcttgcagaacatg

SEQ ID NO: 15112 - DNA, 3000 bp, Unknown
  misc_feature (1)..( 3000): cDNA_ID_3080634_gDNA_ID_2910749_Annot_ID_193784 3000 nt of promoter + ATG
taggttgataccataataccatgtagcaaaaacaatacactgttcatttgttattcccttaatttaaatccatgatcacatatgtattggattcaaccttgtaaatatgtgaatgaatatccaattgctgtggatggtgaatatctgtattatagaatattctgtctctatctctttagtttttaccacttaagatggtattccataataattctttcgtccagtacaccaccataagttacaagctcataaaatatgagctttttgttcttgccacattataacattttcacactaaaacattttttagttacaaagttcattattcattaactttattggttgtaattaagagtaaaagcttatagtagtaaaaacattttccaagaaaatcttgaaagtattaaaagggatgggggatccgaatgtcaagtggcctacaagaataagatgtacacgaaacgaatatttttgtagcctttgactaacattctcaacatccctacgttattattattattattcttttaaaatgcatgtgagttttatctttactctgttatcataataaagatctcaatatatttgcatgatataaactttagcattttttaagatttcaattaactatttttttttgtgtgcaaattttcaattaactatcaaacatagacaatagtgatgaaaaatgtgtacaaacgatgcatgtagaatgctactgcctgatgattaagagtgacaagtaatttgctcttttctcatgtcttatgtttatagtttagaccataaagttggggtttttgggtaatgtgtcttttgtgtgttgtttatgtctagtttgctgaaagtcagatgagatgattgtgaaggtggttgcgaagatatgatatgaatgaaaatgttgttcaaaaattggcctaaaattgtttaatcctctcatagaaaaagagttcaaaattttttagaagaaccctttaggcattattgccactaaaaatagaaatgggtaaatgatatgtcttcttcctctatgggtaaagcataatcttttttcctttttcggaaattcatgtgagtgtttttttaatatatttaattttcatttttaataatcttaaaatgttataatggataggttcgtggtaccgtcacgtggtccatgggcttggtggggtcaatgtaactgactcaagcaacgaacactttaggttgtgattgtgtttttatcatcataaagttgttaatacatttgcataatacacgatttagcatgttttaaaattttcagttaactactaaaatctactaccatttaccaattttaattcaaatttgacatcatcaccaacaaaaaagacatcatccatataaatttgatgtcttttttgttggtaaatggattaacaaaaggattaacaaaacaaaaggaacaaataaacaaatcatataagcttatattgataataataataataactaataactaaaatccaatatagctacaaattaagtaaatttatttgtttgtttataaacttgagcacttcgtggtactaatttaaaaatatttagctagttaaaaaaatcaccaatggtagaagacaaacatctgctatcaaacaactcatacaacttatatttcaatgtctactgtttcttttatgaatgttaattgaaacaacataatcctttccttttcataaaacaatgattttgtttacacatatattaatttcacaaacccgattttatatttactcttataaatttagtatgattaaaattaatatatctattaaaaattggatataagatgttaaatattatggctttaaaaaaagttcttattagttacttgtgtattcgcacatctttttataataggagtagtatagtatactctctttcgagaaatttgtttaaaaaatgttttgaggaaaaaatagaataaaattggggagtgagaaagtaccaactttagtcatcaaaaacctccaattgggtaaacaaaaaggtcatttattatcgttttactaattttacaacttacaacaaaaataaatgtattaaagaaagtgttgggaaataaatagaaatgtctctaaaagataacgatctagaattgtgattggtcaataaatcggcgctctctgttttacggtttgtatccatgtcatcatcatcccatcttcatcacacaactctcttatctctctctctctctttaattattccccatttctttaaagcttcaaatctatctctcacgaactcccaagctaacaacattcacaaggagagagaaacaataaagggcaaggaaaaagatcaaacctttttctttctttctttctcctgctctctgcaatttagaagaagatcgaagaatttgtttgttgtttatcttcttctataaaaacaaaccgtggggtctgttttcatttctggccttgcgattccgataaaactctcagcttcccattcaatccaatccaattccacttctcaaacatatatataattctatatttttgagagacagtttactttttctccttctctctctctctctctttctctttctctgtctctttggcttttctcctcctgttctcatggaagcttcacccaatgatcgacttcattttggcaaaatgggtttcgggtaaaaaaaacattcctctgttttttactctgtttcttcaaatctctgcttttaacagatctcttgggtttgtacttttgtgggtcgtctcttgttttcacgtatggtccacgacgatttgtctcttgttcttagtgatccgtagattccatatgatttgattcacaaagtttgttcctttttccgtttctgattcaagagtcttcatttgtttccggcttttgattcattatagaataatcgattcgtttctttacttcaaatcatagatctgtcctcgatccacataatttgtcatccattctgatccatgtagatccgtttctcttttcatg

SEQ ID NO: 15113 - DNA, 3000 bp, Unknown
  misc_feature (1)..( 3000): cDNA_ID_3081248_gDNA_ID_2910750_Annot_ID_193799 3000 nt of promoter + ATG
aatgttgtaagagaacccatctatctatgcagcaatttaccctttcaaatccgaactttaagaacagaagagactatctttatactaagtttgtattccgcggaaaccgcacaggccgagaggaataacaaatgcacaacaagtttaagcacattgccatcccgaaacccagtatccctgcaaaaagcattgcatagataaccggcacacgaagctgcaacaaaagatatttacatgagaactttttccaattgtaggtatgtgattatgtgttttaagtaattcaaagcctaaaacatacggtttagtattacttactgtagcatataatagatgaacaagcaatgccactagtgcaaactcaagagctgcgtatgtccatatgtattctctgatcgctgcaagtccggaaagtaacagttaacagttttacataattgtgttgggggaagaacaatatagattggaaatttttcttgagggagtggtattataccgaggatgacggcaaaagttgaggctaagagtgcaagggtgaatgaaaatggcgctgcaacaaatattgcctgtgaattcaagtcacgaatctacagaatagataagattccctgttatgttgtcttcgcaatgaaaggtaagatctttgtaatgaaagatgggatatttgttatgaaataccggaatgtatgtgtttttgaatactcggggtaagaaaaaggaagcattaccagtaaatgttcaaggaagaagaagtagcagacggtgctgatgagtacaagcactacaaactcttgcccaacactgcattaccagtcattcgattatcaattgtcagattctttaaggaactttggacaaggaaaaagggaaaaagtttttaaagcgttctgatttacctgatgctttgtggctctgaactctgctgagtgagttcccgtctattggtaagttgattaattgttgggacacggaggagtatcactggtaagttccggacttcttgtctgcatacatcgcagattcgtgttccttttgtactaaaccacttaatggcacaatgctcgtgaacaagtctgaggtcacctttgcaactgcattccattttcagtgtgttaccttcttcgcacacatcaagacaaatcctgcatactgcttcttcttcaggaatttcttcttctgtttcttctgcaggaactggagtgatttgatctgccaatgaaaacagaagaaataaggaacataggagtgtgaacttgccgtttcattgataaaaaaaaacaattttctttgaagtgataaagcttctcgtgaatcaatctattccatcattatccatgaattctaaaagcagccggcaaaaacaaatagagctcaaaacttcaatgaaagttagaaataataccgccatttgcttcatttgaaatgtgatttttgttgtcgtcaaaagagacagctcgtacaatcactctgttcatggacaaggatcttgaaacagatgcatgaagaccatctttctgcatcaaacaaattccaatcttatactttcgaaaagaagctatttgaagaaaattaaaatacttttgcacactacaattaaaatgagactcacattagacttaggctgttcactatgcaccacagcggaaacaggcgttgtagatacaaccagagacagtttagcagaattactagaaggaagtgacaaacaccttttccagtaaggcgatgtgatcggacttgcaacaagaggcttttcactggtttctgaaacactaggacttagtagcaatcttctctcatagtttggtagagaagctttccttttcagactcagatttctcaaaattcctaaactaggcgtcggttttggtggtatttggatagaaacatccaattggcttccacttggctgagatctggatacatcttcaacagattgttctttaacctgataacaatcattgattaaaacctcatactgataaataaaaaaatgaatctttctacagtgaagcaaccaagttaacaatcatagcaatcagggactgaagaacactaagtatgcaattctccatttcctttttttctgattggttaatttcagataccagtgataaaccctagattattcacaaaatgaaattcatgaaacgataccaaaccaattgagcaagaaatgtaaaaccctttagcgattctgaaaaatatacatttaaaatcacactaacggagactttgtattataaagatttcaactttaacctagaatctagcaaaagaattacaaaaatttaagatttcgaatacctgagaagaagaagaagaagaagaagaaccagtagaagaatctttagcgagaacaaaatttctgggcggttgaattgaagagccttccatcataatcgaaccaatagaaaccaaaacaattttgaagaaatcaagtttgatcgacaaaaaaatctgagccagggagagaagcaatcaatctaaagagatttgagaaatttgtcgtttattaatatgtagctaaaatccgacaagagagattttttttattaatgtgtgtgtgtatgcaactatgcatgcatcagaagaatccagcatttttactgctctttaattacccgcttaattcaattaccagtcaaactcactcttcctctgttcttcagttacccatttactttaattcgactaaaccgaactaaaccaaacaaaaatgcttagaccaaagcctgcttaatttatttcccatcaatatcacttaccaaatacaaaataagagtgtattcaacattcatatcaattgggcgccgacccagtctgtgtccggatagcccattatataacttttgggctaaaaatatttatttgcaaaacaaaaaaaaacaaaaaaaaccgcgagcttgtgagacataagagagaagacgaacagagtgttcacaaaccctaacatttcagaaagacgattactcgataacacagaagagagattaaatg

SEQ ID NO: 15114 - DNA, 3000 bp, Unknown
  misc_feature (1)..( 3000): cDNA_ID_3080658_gDNA_ID_2910750_Annot_ID_193802 3000 nt of promoter + ATG
ggcacattactgcttacaactctttgtcttctgtgattctcattatggctcattactctttcttcttgtgcacaagaggtgttttcggttccttctgattcatcaggtccctcatcatcattgttttcatcaaaatcaagttccatatcagtgttgtcgatcttcacttctgcacaattctcgttgctattaggtaagggtctcctatagttttccttctcattttccttttgaagatttgcctttgctatccttgacaatcttagaatattcacctgtctgttagcagcaggacgacctccatgcttttcctcagttgctctactaggaagctttgcttgagctttagacccaccaggggtgccctttatcggcgtctcatggccttttgaaccttgaatggagttctcattttgctttgaacccccttttcgatctttctcccggtactttggaggggtcttatttggtctatctccattacgctcggaaaggcatggctttgtgtttatgccaatcatatcatcaaaagcaggctgagtaggcaactgaactaaatttatcttactcttccaaaatgcatgaccacagagatctgcccattgtattctttgagctgggtctttgataagaagagactcaatgagattgacaaatgaacgactagcatttccagggagtggaggagttggatctgaatgaatagatttcacaagctgggtaaactctcttgccacaaaaggaggtcttcctgtgtaacattcatatagtacacaaccaagtgcccacagatcagaagcaaaagaatggatccctccatcttcatatagctctggagccatataatacggggtaccacgttttccctgatgcaagtcatcacaagatatatagagcattaacgacgcacaatttccaatgaaatttgagatcatagattcactaacactgaaaaaaaagacgcacaaaagtgtttaccgtggaaggagatttagaaatatcatccagcttccttgacaaaccaaaatcacacagctgcgacacagtgttttgagaacatttaaacaatgtaaactatcatcataaactacacaccagcataaaaaagacagaaacacgcataccttaatatgcccattttcatcaagtaagatgtttgatggtttcagatcacaatatataattcctttcgaatgtaaatacctaagaaattcaggaaaaaaattgtccataagagaagagtcagaagacatgttctagatgcacctagaggtattctggtcatgtcaaaatggtttagataggatcttactgcagggctatgacaagatcataagcaagaccatagatagattcttctggcagtttacagtcctgcagaacaagtgaatttcagaaaacctgtgaccatatattatcaaaaaacatagccaaactacaagcaatacctgctgcaataatgtcctgagatcaccaccaacgcaatattccagaactaaccacatgtgagcagaagtttcatacctgggaccacaacaagaagacgacaattagaaacaaatatatggagccaaataattgttgttagataatagctagtaagttttaccaagcatagaacttgagtacgtttggatgatttagcgagtgaaggatcctgacctgaaaaggaagtgcataattaccaaattttcagtatccatgtcacttcaaaaaccacagatggtgaaaaatcaattcgcaaacatcacccagaaatagaaacttaagagcatcgatttgacaaatctaaagtgaatccgtcataatcaagaggtcaattcctttaaataaagcaattcaagcaaaacccaagcattaatcgacactcttgcctgattaaattacctcttgaagaaccttgttcttccgcgacttatcgacactcttgcaggcaaaatactcgatcgtcttcttcttccttcctttatacacagtctacgaaccgatttgaacaataaattactaaacaaaacacttgagaaaggaaaaaagttatcagattcaaaattaccgagcatttgccatgtccaatagcttcgtagatgtggtactgattcatcgtgggagcgagcttcaagtctcctgagatccgattctggatttgtcagctctagagagaatcaatggccgttgttgaatgagtttgggatttggaaagagagagggggaatggtagagagaaggaaatgaacaatttcaaaattcaaaactggactaatttagaataattattatattttgaatccattttgttttgaaggagataagatatgcagtcatatacttatgaaattaaaaatagttagatgggcttcttgggctcataatgatcgttggcccatttatcctcttctcgggtgaaacgtttttcccgccataactatactgccaacagggtttttttaccgccgtgaaatgagaagaggggtaaacttggcagagaaaaagtgaaagagcttagattttccttctccttcagcgacgacgtaacattcgccggaccacatttatctccgacgtcggccgcttagacagagtaaacttcttaatctgctttattcttcgtctttttttttttttttttcgttatccggcgaaactcgctgccgatatttttaaatttattttccggtgttgcataaatccttgattgaatcgttttgtcggtctactttgcatttctggattctcctgctgtgtttgattctcttactgttcgggtagtgttctctctatcacaattcatagctagggttttgatgttgtagggttttctcaaatgtgggttcttttagtaggacactttggaattttagaattttcggttgtttacttcatcttgtcttgcctttttcaaagttttactgaggaataaatgcttagattacttaatctcgtgcatactgttttgacgttagcttgggttttgattactttatttgttcattgttgttaatg

SEQ ID NO: 15115 - DNA, 3000 bp, Unknown
  misc_feature (1)..( 3000): cDNA_ID_3080654_gDNA_ID_2910750_Annot_ID_193803 3000 nt of promoter + ATG
aaagttacaggtcttacatcttaaaccaaagaacaaactttttgacaaaatgcaccaaaagctaacaataaggaatccatctctacccttccctcactttcctccctttgctcaatggtcttaatacctgacgtttctcatcttaatctaaaccaccataagtacctctcttaaccagaaaaaaaaacaaaaaaaagggaactaatcttcctctcccttaccgttgatccactgtctttgtttcagcttcagagtcatagaatcaagttcactggtaatgcctcaatattaggttcatagacttcttgcaaagctccatgtatctcttttgttactttcgaagttggaacttgatgcgagaatctgagtagttcggatttcgggattgtgaatcttacatccttgccatcaatccagtgctcagtagcagctaaatacaccgaaccaaaacctgcacgatctgctaatttaaagccaccatcaggtgccaacaacagaaccttgtagtcctgtttatcatccagaatttccacaagatcataagtttgggattgaagatcaaccacatcaatgtcattactccagtttctgtaaatagcccaaatattaccagtctttggcatgatactgtaattatttccatcctctgagctaatctgacgtgaaaatacatcaagatcagtgaatatttcaagagctttagttgcccggaaactcccacagccagtgggcattctcttgtcaatccactggatgacgcctttgattactgtagcctttagccgacctacatgcaatttaactactggatcctgctcaaatgcctgaacaaatgtgattttctgaatcttgccatagtaccggggcaagtaatcgtcaccactgcaaaatgaccagacttggcctgtttcataagtccttcccttgcaagcaaagtgcacgcattgcgaatacgtattattctcggagtttgactctttaggctctgctagtagatgcaaagggacgtctatctctttgatatttgttggtaatgcagtaggatccagctcataagcacctcgaggcacaccttctgcttctttccagtcgtcttaaatgatggaacacaatgagagaattgataaacatcggaattacgaacataagatgtaacaatttcctcattaaagcgacaaaacaagcttaagaagccttttgctttatgcaagaaaccagcagataaagggtcacttgatccagcatcttctgacacgatttcgacaaatgcgtactgatatttccagggagaaccgggatcagctaaccagttgatgtcaaagctcgtcatgagagatttgtagcgacccttgaagatagcccatgtctctcctattcttgggtatatacagaatttacccgcgctacttcctttattgcaatgaaccaagtgagaaaaccttgtgtgatctttaatagtctcatcttttccaagtttaaacctaccaacagaaacaggcaagtctttttcatacctctgtattggttcctcgtcatatggatcaggctcaagccacgtgacagtaacattaaaaccagaaacaaaaacttctttgatctgagcatacaatctaggcatcccatccactgtatcataaagagcccaggtctggccaacttcaaagtgtacttcttccctcagcttatcaaagtcattgaaagctaaaacctactttgctctttctggttcttctcctgcttcttccttgcccaaagacccttcaccatttctgttgctctgtgcaacgaaagcttgccgcttgctatacacagacttctgagactgctctcctccatcaaaacataaatcttctatagctttagtgtcaccaacaataataacttcttcattctcgctgctgtttccagcttctctttctcttctcaccaatccttctctctttctcttctcaccagatttctgattgagatgaagtggagcctgttcgagaccagatgaaggaagctcttgagcaccatcagggttagtcttttccatcacagctttagccttgagcggctcctccaatatgatctcaacttgatcagggttagtcctattcattaacaacaatgaacaaataaagtaatcaaaacccaagctaacgtcaaaacagtatgcacgagattaagtaatctaagcatttattcctcagtaaaactttgaaaaaggcaagacaagatgaagtaaacaaccgaaaattctaaaattccaaagtgtcctactaaaagaacccacatttgagaaaaccctacaacatcaaaaccctagctatgaattgtgatagagagaacactacccgaacagtaagagaatcaaacacagcaggagaatccagaaatgcaaagtagaccgacaaaacgattcaatcaaggatttatgcaacaccggaaaataaatttaaaaatatcggcagcgagtttcgccggataacgaaaaaaaaaaaaaaaaagacgaagaataaagcagattaagaagtttactctgtctaagcggccgacgtcggagataaatgtggtccggcgaatgttacgtcgtcgctgaaggagaaggaaaatctaagctctttcactttttctctgccaagtttacccctcttctcatttcacggcggtaaaaaaaccctgttggcagtatagttatggcgggaaaaacgtttcacccgagaagaggataaatgggccaacgatcattatgagcccaagaagcccatctaactatttttaatttcataagtatatgactgcatatcttatctccttcaaaacaaaatggattcaaaatataataattattctaaattagtccagttttgaattttgaaattgttcatttccttctctctaccattccccctctctctttccaaatcccaaactcattcaacaacggccattgattctctctagagctgacaaatccagaatcggatctcaggagacttgaagctcgctcccacg

SEQ ID NO: 15116 - DNA, 2562 bp, Unknown
  misc_feature (1)..( 2562): cDNA_ID_2163704_gDNA_ID_2926039_Annot_ID_138186 3000 nt of promoter + ATG
cttttaaaaaatttacaaagatttttaaaagcatttttttggctgggaaaaaaattttacgagaaaacatttttggcgggaaattttttttttggcgggaaaaaaagtttggcggaaattttttgtttggcgggaaaaataaattttggtacatgttattattaaatgagggtaatttggtcattctgttcaatagaagggatatttttaaaaataaacaatataaaatggtattgttacaaaagggtagtaaaaaaagggtagttttgcaaatctccctcgagaatttgcaatttctctctcatagcataacatgtcttttttttagtaaatttcaagatgacaaaaagaaaaaaaaaacataaagaaacaaattgaaagcaacatctatttttctgacttgtaaaaatgtggtgttactagcaaatatcaaatttttgtatctataaactagattttaacccgcggtatactaggagaacgatttattttttaaagttaatatatatacaagtttacaaattgaatatatttataaaaaaaataaattttttagtttacaattattattaggtaacatcccgccaaatctgttccatcaaaaagcttattaattttattaatgttaaccttagttatgatatgattctaaatcattgtctagatattttagccaatgttaggacgttgaacccacatagttttcgtcaattgaataatatatgttcgttttataaatttcgaatcacaatttatgcagaaaatgttttgaaatttttcttaactttacatattatacaataaaaaatcaaacaaagatgataggaaattcatagttttaaatcttaatcaaatcttctaaatatcaatattgttaaatatagaagtaatgagtataagagttgggttttatttgaaccaacccaactaagatttaatgaacatcataaactaatgggtctggtatcaaatgtaatcagatgcattttaacccacaatcaaaaggtgactgcaaaaatactatataagattcatagaagtagatcgtctatataggcctgaaaaatatcagttttaaattaaattatttagagatcttattttgttgggcttaaatactggagaataagactactttagtaatcaaaatatttgggccatgtaactaatgcaaaccaaaatcattattgacaaaagtcattgcatcaaatgattttcttaccaaaatgtctttaaaatatatatatatatatatatatatatatgtaccttcgtacggtacggttgcttttatataaaaaggtgttgtacggttgcattgacttttgatcgtaaatactatatagtccggagactcaaatgcaaaccactttctctatttttttggacggaagttatgttaacctaaattatctaaaatattacacaaataatttttaaacagtttaaaatggcatataattatgttaatagaaatttgacttttagtacggagatacattagctgagaagtttgacctcaccttatttagtgggaaccttgttacttttgaattagtttgaacaatatatctctaattcatataaagtattttgaaatataaagctttataaatataacatattttttggtgggtaatgcttctttttttctgtggcttataactacgtggagatcttatcttctgtccgcttatattagtatttcaccatagtgattttaataaaaatcagattaaacaatatataacagctattttagtttacaggtttaaacttttattttagttctttgattttttttttctttcagaaaatggtggacatcttctaaagtttgttttattaatctaggtagaaactttcaaacaaaagacgaaaacagaaaagttgactttagtacggaaatacatgatatgagataactgataagataacttgttagatggtttccactctcataaacaatataaaaaaattattaacgatagtgaactcgatttttagtaactctatgaaaatcttcttgtgagatcataacattttagaagactaggcttttcgtgtaatatgatctgtagaccattccaatgttatcatatgcagaacagcaacacaatgaaataaattaagagatggaaaataaattaagatcaaataaaatgtggatatacccttaagattccggagacaatacttctccagttctcctctcgtctataaatttctgccgtctcagccaacataatcacaaccaccacctctctcaataattctctctcttgtccttcacaacctgttactacttaggtgaatatcatctacatgtttattttgtcttaatccaaattcacatttaattttgttttcactctttttatcatgtatacttttttaattagctagccgagattatatatgttaaaactacctctatttctaacacacccaagcaatatatcatctttccaatatttacgaaagaagaaatttctatacaaatattaacctttactttgtgcaaaataggagagaagaaaaacaaaaagactgactgagatg

SEQ ID NO: 15117 - DNA, 2562 bp, Unknown; identical to SEQ ID NO: 15116
  misc_feature (1)..( 2562): cDNA_ID_2163704_gDNA_ID_2926039_Annot_ID_196072 3000 nt of promoter + ATG

SEQ ID NO: 15118 - DNA, 3000 bp, Unknown
  misc_feature (1)..( 3000): cDNA_ID_3094250_gDNA_ID_2926041_Annot_ID_196080 3000 nt of promoter + ATG
aatgtcaacaaaaaaaaaaagtgttatacctgatggaagacgaaaaagattcccaagaaaaacactaccgaacccgctatctgaaccagagggactgcaaattccactagccccagttgcaaatcatactccattaaccttaaccttaaatcacataaacaataagcttattactaaaacgtttttcttaatcccccacattggtgaatataaagttatatatatcacacgtagacacatttgagcttacaaattatggtaaatttaactattaagattactaataataatgttactaaattaagcaagcttcttgagatcatttaccggtaatcgattccagctagatgagccacaagatcatgaacattcacggcggttataagaacgagagctaagagaataaggacgaggccggatcttggttcccatgagaatcctgtcgctgtgaaaccgccgatgagcaccacggttgcaaacaagtatagacctgcgttgatgtactcggctctgctcctcccaagccgagggccgtacgttctaatctcacgcgccgtcgcgagtttcaccattttattgtaagattatgcgtttagagagagactgagagagagagagagatctgggagagactcagagagaaagagagagctttacgtggctttgtgcatggcgttcttcgattaggaaagtggaacgtggcagattgtggaaaatagctgactttcgtaccagacgttgtcgttttatcctccagatactattttgaatttgggcttcttgttgggccaatcgtaggcaatcttacaggactcaaaagtaaaaagtaaaaaagtttaagatgttaatggatcatgaccataaattatgtttaaataaaatataaatctaaacataatttatggttattcaagtctgatttaaactatttattaagatcttgtgtttactaaattttgacatctgcaaattactatgttttaaatacttaaaaatatagatttcatatatttaaaaatttgatgtgatctaaaataaattaataacgccattaacatttcttcaactatgtaactccgactcttgcgatataccaaaagccggaaaaacgcaaatagaaataaaaattatctaaacaattggtttaggattacaatatttgactttcaaaagctcaaaaaatatgttaatcggtttataataggctacgtaaacgcttctcgagccaccactttatttgttttgggtccgactgttgctgagaagaccatccacgtgtataattcctgatccacaaccacaagccttgacccttttgaaatatcttctcctccactataaattggccacgtcgtctctctctcgccatctccgcttgtgcattctcgcaaccgttggtttttgtttaaagccttgttggccgttggatcttcctgagattccaaacttatagtttagtttatttacatcttttactcttatctttgagttatttgcacatatagctaaatacatttagatttactcttacatttacgtaaactttctttaaaaacgaattaaaccatgattgaaaaaagactaaagtaaattttgacaaaaaatgtaatctaatcaataaatacgatagatgtgttgattaattttaaattttcaattataaaataatttagacaataaaagttgacaaaaaatcaagtaaatatatagttcacactaaatgttggaacatatattcgatttttaataacatcatgcaacccaataataaaaaatgaacatgtttcccaaaagtattcaagcagtagtggtaaaacctatagttaataacttaaactcaaaaaaaatgaatttaataatgtaatctctcaagctcggatgctttacatggtgtgatggtagccaacaagttaacacacccatcaaattagttagaccttacatgttgatcatttattagttagtgtcgtttaagtataaaactcttttaaaaaaatagtaataaaatgaaaagtgtctttaattttagatttgtatttttttagaaacattaaaaccattcacatcagtaaattttataaagtatctttaaatataatttaatattaatgctgacatgtaaaatgtctcaaataagcaaaatatgtctttcaaaatagatagtttctcttattcactctgttttttcttaacttttattatatctaatgttaaaaattcttattttttgtgatacgaatgttttaaagacacacatgacaaaagagtgtcttcaattttaatactagttaatgtttaaaaaacgcttatagagttgtgggatgaggatgcacttatgctaggtacagatcaataacaaggaagagggtagttcggaaacgtattgtctagctagaaaaggggtttaaattgattaataaattcttttgggggtttataaacagattccaggaaaatacggcgtcacattgttattaatctgtggacaccataatttacgtagttcattgcgacacatattttcgtattccactccaatttttatttttctctacttctatttaaaattcgtgaaccagaatctaaaatcgaacgaagattctcttgctcgaacaaaaaaattctctccgcgatacttacaaaggtacgccaaaagcgatttcgaacattaacttcgtcttgattagatctttctgtgtaaaatttcattcaatttatgatcagttgttgctcacgaaagatttcgactttgcatttgaattctctgttattcaaaggaatctgaattttgggttttcccgatcgctcttaaatttttcagtttcatgttgaaatgttgaatctttgattgaaagtttcaatctttcattttggttcctctcagtgttcatattagagtaagttagttatatctgctaaagttagattcagatcagtgttctgtagtaaaattgatgcaagttattgtcaacaacctgagacattttttatacttatatg

SEQ ID NO: 15119 - DNA, 2267 bp, Unknown
  misc_feature (1)..( 2267): cDNA_ID_3094280_gDNA_ID_2926042_Annot_ID_196086 3000 nt of promoter + ATG
caattttctcttctttaagaactgtaatttgtatgaaacaacaggatcagagccaaagaggggcggctaatggaatagctatgactgcgatgtctctatttaagacagttggaccagctggtgctggcatcttgtaagtggtcacgtttcgaattaacgcataagtaaattcaaagacgcagtaatgttataaacaaaaatctcttttgctggcagattttcttggagtgagaggcgactaaacgctgcatttctaccaggtatctcattacttcttcccatttggtcattatcttatgatgttctgcttaacacaagtaaattgaaaacgtatgcaggatcgcatatggtattcttcgtcttgaatgtgatagtagtggtcggagtagctctgacattcaagccatttctaacgacgagtcgaagatgaaattcatttgaattggtaagatagggaatgtatggacaagttgattcttttcatttcagatacgaaagaaaccggtaataaaatttcactaaccttaggatttcagctccttctattacttgtccttttgttttgctttgtctgattattatacaccaaaaccgctttcataatcgtggatcccatccaaaagtgatgtattaatcggttaacaaatcgtatggtcagtcaatacggcagtaaggaaattagaagatgagactgagaggaacttacttgaaccgttaatttattatttaatacaaaccgtggcctatttttcaagctcttcaaaaggcattactcaacctttacttgatgaataacatttactcaaataaataattttacaaattttctgccgacctctccttggccttattcacagcaagcggagccttatgtccaaacaatttagtacgatttgactgatttaaaataaccttctctattcagctttggctatgattgtatattgttagcagccatgaaacctagtcaaactaactggtttgggataggcagatagtcaaaatggttaaagccggcatgattggcttccatttttcctaaactgaaattgttttaattaaaatttgaaaaataataggtagattttgaagatgttgttaatgaatttgacaatagatttgcttgatggttttaaactcttaattatattatttctaaataactaaatacctcattaattagtagtattggattgagatgctttaacatcaaaattatcagaggaattcaaattgtatactttttactagtgaaaaccaatagaatattaaaagctaacaaccggaaaaacgtggcttagagataataaagaaacttttactcaaaaaatggaactttgacaaaagttgacaagttaaaatgattgaatttctctggtccaccatgaactaccaccgaaaaagtaaaaaaaatcttttggtacaatcaatttctaaacatgggcgtccaacactcgatgaaaaactcttcaaaaggcattttactcaaaccatgtcaactaatttctataacatttgaaagagatagattacattaacaccatgaacgtggtgttatgtttttgtggaaaccacagtacacatccctaatatctgtgcatgagactttactaaaacctaccaagaaacttgaaaccaaaatggacctcttgtcgtattaggtcatccattacatcatattattattggacatattcaaaatttacaataataatcttatcatcatcatattataaaaatggtggtctacaattaatcaaatcaaatttgaacagccacaacaaacgattacagagaataaccctacgaaagacaagttttcacgtaacgaaaagatttacgacagacaagtttataataaacaataatctcggtaacatgactagcagcaaccaagagagaaactataattttcaagttgcatctcaaaaactctgcaagaaaacaacatttttataacataagttattacaatacggttgaaatgtgatgactgacgactgaatagaaaaacaataaatgcaaatgtgattagtaagaggtgacatgtcataagcgacttgtgagggcaaaagacaaagttgtttttttccttcttctctgtctcgcagcagttaaataattcaattgttttcccgtcttttttggaagagagtacgtgaaaaccatatatcgcatcttctcattcttctttcattgccctcattaaaacacacatcatatcgcccccaaaattttgatttgattagagaggtgtgtggaaaatg

SEQ ID NO: 15120 - DNA, 3000 bp, Unknown
  misc_feature (1)..( 3000): cDNA_ID_3094275_gDNA_ID_2926042_Annot_ID_196087 3000 nt of promoter + ATG
ctccgccgccaccacggccgcagacgcctcctactttcgtgccagaagaaactcagccacagactcctccgccgccaaatcaacatcaaactcgttccatcttcacacctacccctcaagtaatttcctttctactttgcatttctgtcgaaaagttttcatttttaccaaggaaattgatagacttttaggcctaaaatttgtactctttattgaaattttttggtgggtttgtttgaaattagttaggatctctaagttggtaagttaaagtttccaaatttatgtttggctgcagcaaacgttggcatcattgaattcaacaaagtacacaaacaagttctttctgctgctcttcatctttcacaaggttgtggctattgggtttgtaggcttccttgtcttcagaggcgttcaaggtctaattggatcaaatggtagcgtcaaaaggaaagagaaaaagatcctcagattcttacttccacaagtcgaagctgcatcgctcttgagcatcattcttgcattcctttggcaaatggcattcaggatttggcctgatttcatgattcacttcatactttggagtacgtttttgatgtctttatcctcaggaatcctcttactgtgtttccagatgccagccactgatgctgttggggtttgcctcattgccttctcaattggcaatggtttatatgcttgctgggtcactcgtagaatcaagttctgttctaagattttggtcaagtcgttagaacctgtttccaagttctcggatttgaatttgcccacctactacatgctagctgctggtttcctctggatgtctatgtggattttcggtgtcatcggtgccttgaacttctattttccgccacttgtgattattggtttggtgttaagtctggcttggacgacagaagtgatgaggaatattgttaatctaactgtgagccgggtcattgctttgtactatcttaggggaatgcagtctagtaccaggtttagtttccaaagggccttgtctcgtaacctcgggagcgcgtgtttaggatctttgtttgttccaacaatagaagccttaagaatcttggcaagaggattaaatttgctaaagggtgaagatgagttcatgttttgctgcgctaattgctgtctcagactcatggacttcatatttgaacatggcaatggctgggcctttgtacaggtactataaactaattctttaaaccatgccactcccactctcttttcttaattctttaaacctgctgcagtcattttgtttctatataatatcttcttacagagaatcagtctagtaatagtattaaaatcaagttgattgtggtgggtcttattttttatatcatttctgatatgagaatcttgcatcatcttgacaagtcgaggcacaaccacatgctctttttgcatttatagtaattattttgaattagaaaaatagtcatattgaatcaatagtattgagctttgagtggtaacaacagacggaacaaacttagactagatcactttttcaccattcgaaagtgttttgtaccattggttgtttacttgtttaaaccgtattgttgttacagatagcggcttatgggaaaggatttgtgagggcatcgcaagacacatggaaactgtttgaggatgaagatatggttgaaatagtagatgcagacataacaagctccatatgcttccttacaggcatctgcagcggctgcgtttgtttaattgtcgcagccgcttggactcacacagtttacaaaccttttacagccaccatctctttacttgccttcttcattggatacctcatggtaaattacactttgaacttttcaactctaaaatgtttgattcaaatagtattctcatcatattttttggattgttggtaacagaccaggatctctatggcattgcctcacgcctgcgtaggttgctactacacgtgctatgccgaaaatccggaaagcagattcttcgaagacaaagtgataaaaactaggcaagatatgatcaaaagtggccgtgttgccgttaccagtaccacccctagagttcgccgtgctctagcttagcctgatcatctttttttccttggtgctaaattttcagaatgaaataactagttttttttttaaaatgtatttaaatttgaaaatgtaatttaattacagaaagagtgaagagccaaccaatatcagtaggggtggggaagaaattgtggatagagataagctcgtgacatggacacaatccaactaatgacccaaaagccaagttggttgagagctttttaactttttattttttcctttgttgttgttgagacccctcaattactttctgtacataatttattcttttgttccttcctgtatatgggtatattcctttcttggttttggaaagtagtgtagttttgaactttaatgaactattagtaatagtggtacatcttgttaaagtacttcaagctttagctagctttctgtatatgggtatatatttctttctcttacttagcttcattgagttcagcaacagtgatctctttctacttataaaattttttagtcttaaaggcccatcttgaaagaatttgaaacttttacaagaatcctatcagttttataacatcttactacaaacaatcataggcccatcagtttttcagttatcaaagcagagaggcccattttacaattatactaaacgtcatatgatctccattcttcagagaaacaagtccaatcttatcatttacatgaaatctaaaacccgccacgtgattcgtcgattacacagaacccatatacctgaagaaaaaagaaaaaaagaaaaaaaaaagcgaaattgttgtttgaacgtgtggtcgaattttatcgtggcgctgaattagcatccacaagtgaagaaaacagagagagaaagacagagagatctctctctccttcacacacacagatacac

SEQ ID NO: 15121 - DNA, 924 bp, Unknown
  misc_feature (1)..( 924): cDNA_ID_1020522_gDNA_ID_2926042_Annot_ID_196088 3000 nt of promoter + ATG
agaacgctctcataaaccacgacagtaaatgcagcctccagaacaccgattcagacacaactttgcaattagggtattgctcttttaagtctatttgctgtcattggttgcattattggaaagctgatttaagataaatataagtctttttcctcctctgttagttatgcatatgccttaacactcactaactggagttataaaattcttactacttgtgttttctccaaggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctactaatgtttcctctttagcaagtatccgattgttttaaaagtaattttagagggatacttgcaaaaagaagagaagattcagttatctaatctctgcaccaactctctttgtccttcttcttttgattatttctcgactgtctctcctataaaaaagatatgcctagctgagagtttgaaatccataatctttacaaggcacagagttatttgacatctcgtatagtaagaaaatttgcggagaaataagcttatagaaagtgaaggttatcggaatcttcctactccattacaatcaaggcccaattggacctcaaatcctaaactgaaaaagtttataatgaatttcattaaatgcccctaaaatataagcaaaagtttcaataaagacctcatatttctctataattacaattcgtccccagattaataaagcccaaaggcattagaccgaaaaccctaacccctctttatccgcgcgagagcaattgagcagccatg

SEQ ID NO: 15122 - DNA, 55 bp, Unknown
  misc_feature (1)..( 55): cDNA_ID_3094296_gDNA_ID_2926046_Annot_ID_196092 3000 nt of promoter + ATG
agactttgactctctctttttttgtgtgtgtggaaattaaggttttaaggagatg

SEQ ID NO: 15123 - DNA, 3000 bp, Unknown
  misc_feature (1)..( 3000): cDNA_ID_2990331_gDNA_ID_2926046_Annot_ID_196095 3000 nt of promoter + ATG
cacaaaatatcaataatggactgtttggctacaagtttgcggcggtcaacgctaaacactgtactaaacgctaaacacactttccagatcgatatttgttatctatttctatttgtacttgatccaatttagccagccatttggtattcacatattcgctaaaattcaaatgtttgatcaaatatcgatcagtttgctaaatcttattggggaaattaaatttagaagagttctacaatttccttcatgttctaaaatttccttcatgttctaaactatatgtgaaattgtattctaagaatttctatagtttctaaaaacattagaaaacgtttatcgacaaattccttcatgttctatagttttttggagagatacttatctcattcattaaattgaatcaaagtacaaatataagagagattcaaatatcccaaaatttatcgacattagatctataagatattctccaatgctaaaaataaaataaaaactatgtatcaattagatccacaagaaattggagaaaaaagtggatagcatcttagtgcaaagtgcaaactagttcatagttaatcaagggttcatccacaagaaatgagaaaatactcagttaaaaaacatactaacttgaagacgattctaaaaccttggttctcaccggcacgagaagttctacacaacatttaacaaacattttttttagcaaacatttaatttatgtttggatttattttttatgtataatgacgtcgaatttcatataatgttttaacaaacatttaacatgtgtttggatttatttcttatgtatagtgattagtgacgtcgaactccatatgaattaacttttaccaaacattttaacatatgtttcgatttattttttacttttacagcaaattcaaagtttttttttttaaagaagattttttagaaaaaaataaaaataatcataagtagctattcatttcaagatgaaatcattaattatagtgttactgtgtaagtttaactaaaatatataactttgtgatattttaagtatagttttcaatagtataactctataactataaacttgtagacttgtatccatagacgagtcacgagagatgatgtgtttctctcaaaatcacacttcaaataaacaaatgattttacattgtttttggttcaaaaagacaaaaagatgtttgtttttcaaaagcaatggtttagtctaaagactccaaaatctaaaccgatatataacgttttgaaaatgtgcaaaaatcagtgatggactgtttggttacggcgatcaacgctagacactttacgaaacgcactttccagcgtttttgttatgtataaaagttttttttgtttaaattcttagttattgtgctttcataaggttttaaagctttaatatatagtttgctaataatatttaccagctggagttgggtatttgatcgaatatttgaattttaatgtatatgtgaaagatttgggttagatacgatcacaaattcacaattccacaaaaccgtataaataataaaactcacaaatattaaattatctaaaaacgaaacaaatcataatttaataaacaaaatcagtggttttaaaataaaagcgaaatttaatatgtaaaaagtgaaacaaatcatatatattaaaataaataatatttgatatatatataaatgtatatatatatgtgtcttgtttatatatatatatatatattgattttgtttcttaattttataaaattcaatgaatttataactaatttgatcactattatattttttatatacatgatattgatcaaattagctataaaataattgaatcacaaaattaaggaacacaatatctatacaaaaagatacacatatatctatatttttcaaagcatatataatcaaagatttttaatttaaatctttgtgatttgtttcgtttttagagatcaatatttcatttgctctgttaacttatgttagccaaaaaaaatgaacaataataacaaagcacataaggtatcgaaactgatatttaagaaatttgacaagccccaaaattaactattcttgtcactatctataataacgactaatagtttaagattaaagtaatttattgtatattccttggatcgactctataatctattgtctagtagtatgatatagtagtatctttttttttggtcctccatagacgaacaatttagacgagataatctaggtgtgaacaaaaagaacggctttcttctccctctttattgttagtcaataaaagataacttataaaccaaaacatagcttatacatcaaagagtcattacatcgacattcatgtatctgaaaagatattaaaacaaaagattccgtgaatatattaattggtacatataaaaatccaaaaacatactactaaattcgaataaataattatgtttagggagcttcacttatttaagtatagcatctatgactaatctaattactacacaactgatctacacaaaataattaactgaacaaaatacttaaattacaaattaattaagcaaacggtcttcccttgttaaccaatcctatttaagttacgaaactagggatagtatatgaaatttaattcataattaaacatttagtggatgaattaattgtaagagatatataattactattaatttataagattctatgttaggttgaatatattagaagagtccagctcataactcttgtgcccatctccacaagtagtttgtgaagtcaaacaaaaacttccacttttaaaattttctcttatttctttctctctcataagtcataatattcaactaattaagtgcatatatatacgatgtatcagtgcttataatcttcatgaggagctttatatatttagcataatatctttcagaagtgtgaggccttgttaattaagctcttcttctctatctctctctctccctctcaacctctcacc

SEQ ID NO: 15124 - DNA, 3000 bp, Unknown
  misc_feature (1)..( 3000): cDNA_ID_3094303_gDNA_ID_2926047_Annot_ID_196099 3000 nt of promoter + ATG
gtaatttgagttaaattaggagtttgttcatttgactgaaaaacgtcggggccaagcaattgatttcaatcccttaccgctactctttattactcctttcagatcaaacgtcttcaccttgttaaagtcattcctcataggatgactcggtggagcacagattcccatattaattggtgctgcggacacgtgatatccctgaccccgagctgatggggagggtacataagttggctgccttggccgagtaactgctacaacacaaaatggaacatataagaatcaatctatttgctacaaagtacaaacaaactagtgcatgagatacttccaagtgcagaattagcacttgagaatatgtgtacctcgattttgtttttgaattgttatagcctgctcttgggttgtaggttgctcggcctgtgtacgattggcatccacgttctctaagcgttgttcaaccgttgatttctcgtctgctttatcaaccttctcggtttccaccacctttaagctttcatcaatggacagaactccatcacattccttgctgccttcccccgtgattacctcttcatcaagcaagctactgtttttgttcgcagcgtttgacttgtgttgaagcgacttgttgtcttccaccaaaaggtccaaaaccatcgttattagaaattcactatcttcctctttatctatcaatatctctgctacttcctcaggttcctcctcactgatgtcttcatccccacgcaagaccccacttgtgtttaaaatgcttgaaccatcatactctacagttgacttgccgccttccccatcctcactcatcatccaacatttttcaatcttcttctgttcctcgttagatttatcttcattttttacaataatcagatccgcctctaccttggtttttgctgctgctgcctctttcttacccgtcctcttacttcgatatatgcttccaaaacttggaaggcatctgtttctcctttcttcctttgtaattttctccatcaacgatattatgtctttttcttaggttctattggcaaagaatctgtaaaaagggaaagtcaaagaacagagataagatatgacttggttgggctgtttatgcttcagcttcattctatgtatgttatatttatagaagttcattagtatgtgtgtttatgtatccagttgatatagagggagagggagatcataatgacatatgccataaaaccgcgtaaacggcaacgacttcagcactgctttgtatcatttctatggtcttctttatgtggccaccatgtgattaactatggcagtttgtttaaaaaacagttctgtatagatctcggaatctctttcgtaatataccttccttccttctgatttccaggaaacatcaactttattacttattatcagaacaaaaatatgtgttctggaaacgatattatattctattaatattggaacaactttccgatcattattatatgaagaaaatttaatcttctaacttctaagtaatgttgaactatatatttttcgtgaactatgtaatatttatcaattatgaagattgacagggagttttttatttatttatttatttgataaagaagattgacatagacagagaatgtacttatgtacatgttctgaatgaaatcatgaaatccaaaactaaaaactaataaatattcattaatttgttcgaagactcgtctacgttgataactttaacccctttcaaaaaaatattttccccaacgcctttaaactcatacttgtgtacgtgtggacttttagatagaagacagagttgcgagtacgcgtcatcattcctagtgttgtaacgtttgtagaatttttttgatgaaatgcctttttaattgttgttccaagatgactaagatgttgtacatacatacataatgagccttttaatttagctgcgacaacaacaccaaaaagccaaacctagttatatactccctatggcaaatcacaaatgatattcaaaaattaatgatgtagtctaagcgtttttgttacgtggatatgtaataaaagttagggatcagtttctattcgaatgattcgacatatattttgttttgtcagttgcatatataacggctatagtctatagattccagatactggtataaataaaatgagtaattgatgtaatatttttctattacagtatgtgatgtcccccattgtggtcgcatatcatcagcatatgagaaactattgctgttttactcaagattttgatacaagtacaaaaagagttattttaatctcatttgaaatcataacacgaacaattatggacttaacaaaatgatgatggatccaataactataaagatctttagataatttgttacaaatatatagtaccaaatttagtagaattgtggaaatttttaattgaataacacaatagtatcttatgattatcattcctttgggtcgcggggtgtttgtttgttcactaccgtttatggtaaagaaaatcatggttttgtttctcttaatgtgaatctctagtctcagatctctttgtttttatggtgatttagactttgtaattttatttttgattttttgagtttggattctaggaaaattggctcagatgcgtgtatttgtatgcttgaatttttttctctttaatttttcttaattagatctttgtctctgagagtctacaagtactggccggcttatgtctctcgaaggttttgattgccttgacagctattgtatgaaaaccttatttcaccattataatctataattccaaaaaaaaaaaaaaacacaatagtattttttctaatataaaaattaaacatattcatcaaccccacctaaaaataaccctaacatctcacggtttcttccacatgtaccctctctgtgcgtctccaattccagtttccgccgccgaagctaaatttcttcaggcttcatagaagaagaccgaacatg

SEQ ID NO: 15125 - DNA, 3000 bp, Unknown
  misc_feature (1)..( 3000): cDNA_ID_3094298_gDNA_ID_2926047_Annot_ID_196100 3000 nt of promoter + ATG
atgatccagattaatgtttcttaatcataatttatcagaacaatcaagttttcacacatttgtaaagtttcacaaaaacaattaaaagattagaaacttcttcttttcattaaatatcaaagtaaagcatacataagctgaattattgtgcttcagaatctcagtatacaaattgcacccaagatcgattcagatgcattgtcatcagattccaatatgatgatcatcagggttgccatgcattaatccaatccgtcaaagtggagacattgttagagatatcttcgattgtgttactttgtagttcagtgacaatttcctcatcataactgtcatgtgcttcttcgagtaggacttgatacatttcgcattgaaggttgttactaagcttggttcctgaataacccctgctttggttggttgagagaacacaatcagaaccttgctaaagcgaaaacaaactaaaactacatttgatggatttggaaatctgacctattcgttaaacggtcatacaaaacggagttctcggttcgaagcacgacaacgcgatcaaaccatcgctgaggaaagaagtcacagccatggtagtccacaatgttccctccttctatcatagcatcgtcaagctcatcaatcacctgatccacaagttcaatacaatatagctaagaaggctaattcttcgaattgaatccaaatctttatcaaactaaagagtgaagcttaagattctagcaacggttcaaagtgttttgttgacaaggaaataaggaggataaagggatagggatggagtaagaaactaaccgagtcttcgttgatgaagtgacactcgagctcattgtcccagccatggtagaattctttctctttgaccagatctccgatgcaaatataccggagattcgtggcttcggctagagcagaagccgtcgtcgatttgccggtaccaggagtccccgtgatcagtaggttcggcctttcgcgccttgtcaccccacggttacgtctcgccatgttcggtcttcttctatgaagcctgaagaaatttagcttcggcggcggaaactggaattggagacgcacagagagggtacatgtggaagaaaccgtgagatgttagggttatttttaggtggggttgatgaatatgtttaatttttatattagaaaaaatactattgtgtttttttttttttttggaattatagattataatggtgaaataaggttttcatacaatagctgtcaaggcaatcaaaaccttcgagagacataagccggccagtacttgtagactctcagagacaaagatctaattaagaaaaattaaagagaaaaaaattcaagcatacaaatacacgcatctgagccaattttcctagaatccaaactcaaaaaatcaaaaataaaattacaaagtctaaatcaccataaaaacaaagagatctgagactagagattcacattaagagaaacaaaaccatgattttctttaccataaacggtagtgaacaaacaaacaccccgcgacccaaaggaatgataatcataagatactattgtgttattcaattaaaaatttccacaattctactaaatttggtactatatatttgtaacaaattatctaaagatctttatagttattggatccatcatcattttgttaagtccataattgttcgtgttatgatttcaaatgagattaaaataactctttttgtacttgtatcaaaatcttgagtaaaacagcaatagtttctcatatgctgatgatatgcgaccacaatgggggacatcacatactgtaatagaaaaatattacatcaattactcattttatttataccagtatctggaatctatagactatagccgttatatatgcaactgacaaaacaaaatatatgtcgaatcattcgaatagaaactgatccctaacttttattacatatccacgtaacaaaaacgcttagactacatcattaatttttgaatatcatttgtgatttgccatagggagtatataactaggtttggctttttggtgttgttgtcgcagctaaattaaaaggctcattatgtatgtatgtacaacatcttagtcatcttggaacaacaattaaaaaggcatttcatcaaaaaaattctacaaacgttacaacactaggaatgatgacgcgtactcgcaactctgtcttctatctaaaagtccacacgtacacaagtatgagtttaaaggcgttggggaaaatatttttttgaaaggggttaaagttatcaacgtagacgagtcttcgaacaaattaatgaatatttattagtttttagttttggatttcatgatttcattcagaacatgtacataagtacattctctgtctatgtcaatcttctttatcaaataaataaataaataaaaaactccctgtcaatcttcataattgataaatattacatagttcacgaaaaatatatagttcaacattacttagaagttagaagattaaattttcttcatataataatgatcggaaagttgttccaatattaatagaatataatatcgtttccagaacacatatttttgttctgataataagtaataaagttgatgtttcctggaaatcagaaggaaggaaggtatattacgaaagagattccgagatctatacagaactgttttttaaacaaactgccatagttaatcacatggtggccacataaagaagaccatagaaatgatacaaagcagtgctgaagtcgttgccgtttacgcggttttatggcatatgtcattatgatctccctctccctctatatcaactggatacataaacacacatactaatgaacttctataaatataacatacatagaatgaagctgaagcataaacagcccaaccaagtcatatcttatctctgttctttgactttccctttttacagattctttgccaatagaacctaagaaaaagacataatatcgttg

SEQ ID NO: 15126 - DNA, 3000 bp, Unknown
  misc_feature (1)..( 3000): cDNA_ID_3094333_gDNA_ID_2926048_Annot_ID_196103 3000 nt of promoter + ATG
gagagtgagatagaatctttgggtccctgggatgggagtactcctgagcaactcagtgctcagattaccagaatgaatcagagacttcatcgagagaatcagcagtgcgtattttaatattgcctttcagcttttttccttcacacagaaacgacctgtgacagtaaattacgtgcttcaattttgttcgtgcaggttttctgaatcaattgatgaccttaggatgatgtatgagagcctagaacgaaagattgcaaagaagcgcaaatcctatcaagaccatcgagaaaaactcatggttgagtctgcagatctgtttatgttaaagctctttgtgttgttatcgtattatcgtttaatgtattcatcactatttgatcaggcctgcaaaaatgctctagattcacggtgggccaaatttcaaagaaatgcatctcttcttcggcgccagttaacatggcagtaagagtcgctttccccattgccacctacatagataaatctgtagttcggttgtctcttgagattagtatgatttttttttccatatggagctttctttgacgttaatcttctaagcagattcaacgctcacttgggaaagaaaggtatcagcggacacatcaaagtcagttatgaaaataaaactttgtccatagaggtaattgacactgccatggtacggtttttgctactagcgtgcccatattattacgtcatctgattgatatcgttctttatgacaggttaaaatgcctcaagacgcaacaagcaatgtcgttcgagacaccaaaggtctttcaggtactgcatccttccacactcttaaaaatcatacatctgattcattgccatataaagacatttcctatgtgtaacgctcttctcattatactaggcggagaacgttctttctcaactttatgttttgcactagctcttcacgagatgacagaagccccgtttcgagcaatggatgagtttgatgtgtttatggtattatgtccttttaagaattctctcttttacgagctttacgttgggatgagactaacatttttaactttctgattctgaaatataggatgcagtcagtcggaaaattagcttggacgcactggtggattttgcaattggagaaggatcgcagtggatgttcatcacccctcatgatatcaggtaaccaaccgatcaatttcaaaaaccatggaactcagtctgtgaagtgaataacttggatgaaactctttatctcttgtgctcttttacagcatggtgaagtcgcacgagaggataaagaaacagcaaatggctgctcctcgttcttgaaaacaaaaaaaaactctccttgtatagctccataaaggtacacacaattttgcttgcatgacccattcaagcattttatgttttgtgtctgcatttttcgccagttctcacttatgtgtttctttacgggactcatcagggcatcctcggctttgagtcaatactacgacgagctgatgggaagtttgagaagagctttgtcatccatggtcatggtgtattgatttgaatttacaggtgctgagtgagacccttttttgttttctctcatttctttttatgacatttatatattgtcaaactttgattttaaaactgtattatatatcatttttattgacttataattatcatttttagatcgaccaagtgtgacagattactttcctagtgataaagactagtgattgaggacaatagcagaaagactaagtaacttttaagcttcggattaagaaatgtccatagtttctgattctttttggcaagtttaagtacatcctgaatgttcgataaaggctagtgtcatcaacatctctaatacatatgacagccaaggagcatccattgaaaaatgaggcaataaaattgagtacttataaactgttcatacttcttttctacctttgacgttgtaaatgttaaatttatgaacttaagaatgtcattgctacaaaaaaaaacaatgtgattgctatgcaatatacatgtaatttgaatataaatcttggtccggttacgctaaaccaaaatctgatattatctgggctacgtgtggattaaaaatccgattagggggagtcgtgcaaagcccactaaaagaaacaggcggtttgttttattttaaataacttttaactcgttccaaagtcccacatcgctaacaatttaagaggtgaagacaagacgagtagtataaataacgaggccacggccacgaacaattcatacctttctcggccttttggctaagatcaagtgtagtatctgttcttatcagtttaatatctgatatgtgggccatcggcccacacgatattaactctattttttaagggagaaaacccactaaggtagcttgctatctgggttttcacgagtcgcccatgcgttgcactactgcacgggcctggctcatcccgccaataaaccagtaaaattataaatattggaaatctgccactatgttgtagatttgggcttagggacctaaataaataacgttatgtaactggtggatgaccgttgaaaccctcatacgcgatgcacatggttaggatagaattcactttgaacttgagatggcttcatgtaagctaatgggtatgagtagtaagttttagttggaagttgttaacatatatatctgaaagaatcaaaacccaaaaaaatcaaaaatcaaaaatcaaagaagcagaatcaacaaataacaaaattattatgggctggcccaaataaacgtggattcaattcttaatatgggctaatcataattgatattgggctatctatgttaatcatactgtaattttatttgttaagcaaaaaaaataaaggaaaaagaaaacagagtatatgtcctaaagaagtcagattgtcggaaacatcaacagattattaatcagagagatcgaaatttcctcttctcaaaaaactcaaaatttgaagatg

SEQ ID NO: 15127 - DNA, 3000 bp, Unknown
  misc_feature (1)..( 3000): cDNA_ID_3094344_gDNA_ID_2926049_Annot_ID_196109 3000 nt of promoter + ATG
ccaacaagtgtgaaatttaagtcatattaagttttaagggaaaacaaaatattttgcaaccaaatcgaaaggtttcattatgtttcgtaaggtttggaattaagctagtttgatgtcggtataatctagcaaaatgccaaaacataccacgctttaggaaaatttgcaaatacctacaaattttatttgtcattgttcgaatgacttttattcatttctatacgggtataaataagatcagaagactaaatttaaaatttgtatattaggacactttgacctaaactaactcctaaaatatattgtagagatagaagaacactacacgtttgggggcattgtctatataaaatactagtattaattaacaaaactaccaattattgtgtaagtctctttgcaaccaagtacgtatactctaccaattattacgtctatacatgcacacacaaattatatgcaaacaactacggcctacctgtaattttagtatctaatagtgattaatctagcggacaccggcactaatcaatacattaacgaatcagagtattaattaacggatcgatatatactataaacaaatgagattcagataaggtggtaccttgggaaatagattcaccgtaaaatgtgggattgtcgacgacgaaacatttcatatcggttagtttacaaagatgacgattactttatctattacgtttatactttatacgttgaatttttgattaatgattgatctggtatacatgcaaccaacgtatgaaattataaatcttttgattgttgccgccaatcaccattatcatcagattatacttgctccattaatatttttttcttttctagaatgctttagctaaaacaacaagattataaaattaaccatttatttatgcatttcctatataataatatagttcaaccaaacaaaatactggaatcatataaatagtttcgaaatataaaaaataatagatcagataaacattttgaaaaactatcaaacagatttaaacaaaaaaaaacaccaataaaacatctctgtgttactgcgctggtttttaagattatctctcaagctttgacttataatatcgttataatagttttttttttcataatgttaccaaacagtaacatatctttgcataatgttataagtccatgttgcatgtaataccgattatagtttggattatggttgagttagggtgttgggtcattttcatcgtgggcttttttttctttttctttcttgtcctcagattaaagcttgagagataatcttcaaaaccagcccagaaagaaaacaaattcatcaaatattaggtaagcttgttatgttatatatcaaccataaataacttgttacgattaaaagttgactttcatgatttgtaaaaactcaaatgtaagcattatagctattcagctcaacattattttcccgttaaaaacgatgtcttacattgaaatagatttaaaaggtttaaatttagacattcattacatgatttttttttggtcaaataacatttgaaaataggtggtcagaaaataatcttcaaaaggttgaaaaacaagaaaaacaaatttcaagtgttcgttcatttacatcaaaatttggtcaaaattggtgatatgtaataaatagtgtttgttgaaggtcagaactcccagaggtaacgcatactgttctgatgattgtgaggcccgttagtgtcatatttcttctaaatcgttcgattctctcgatgttatgtgattggacggcttggatttaatttaaattacagtcacaagttctcttatgataagcgaatatggcaaattcagccgtttaggatttagttttggctttgacttattaaaactaatttcagcctctcttttttttgtgcaatactaatttcagtaatttattaagattaacagtaagaaattaaaactccccaaattcaaatataattatattttgattattttcataccattatagcaattcgtcgtctatgaacttctcatgcatattgggagaatatttttctagtgaaagtggttaggctgtacattttgtcaaaaaggatgggacaaaaaaagatgatacttttgacataggcgtcgtgtcaaatttgtgctcgcaaattcgcatcactccaagttgttcattctctcttaactcttaagcattaattctcttcctttcgttaatttttttttacaaaagtctaccactaattatcgatcaataataataatataagataaaatatttcctttacaaattttatgaaaataaattgctatatattactctacttactttcacaaattgctatattttgtttagatatacacattttgtattgttcatttcattgtaaagtatattttgtggtgaggaaaaagagcaaaccattttccgacaccaattaaacgatcatagtcagaaacattgatgaaaattcagatgttgtacttcaacataatgtttcatttttaaaacgtgtttatacattttgggtaagtttaaaacacaaatacatgatcttactcgtgcatttaattacagtaattttgtaattataacacttgtgaaataccttaaacacaagtgcctagtgtaaagcgcgtgagtaacgtgtctaagcttcaataagaaattgatgacgtggaaatacaattaataaaaaaataacaaaattaagtaagccgggcaacgggtagtagtagctaacgtcgtctaattgacggcgtttaccatcgcgcaggttttttttgaatacatcaaattatatccgaacctaaggttcagacttagcttcggttgaccaaaagtttcttcattttcttcctttctctctcctacccggaaaaaaatagaaagttgcagagagagagagagagaccttagctgtatagagagagaaagggattgggtgttgtgcactgagttcgatagagaagaagaagaagaagaagaagaagaagatg

SEQ ID NO: 15128 - DNA, 3000 bp, Unknown
  misc_feature (1)..( 3000): cDNA_ID_3094340_gDNA_ID_2926049_Annot_ID_196110 3000 nt of promoter + ATG
tcgatgaaacactctttatgagttacgtaagaaggtgctactttagatggtaaaagacaaaactgctgaatgatagtttgatacagcgtgtatttgttgttgcacaatcctagtgcgtacacgaaaaaataaacagtactcgaaagtcgaaagtataaccagctcgaacaagtaaaatcctctagctggatattcgttattggaattttagaaaaatgattctctcaaagtgtaaacttgtggaaataaaatatatagcaaagtcgttgacataaaatatcacaaaagtcattctcgactctacaaatatatacttactagattttaatccgcggtacataaaagtttgtaaattgtatctatctataaaatatttttattttgtaatttacaattgttattaagtaacatcttgccaaacccgtcccgccaacccgtcccataaaaaaaccatttcttttattaatgttaatcttatttatgatatgtttatgaattattgtctaaatattttgtaattttgtagtaattaaatgctatcaaatatctctgcggtttgatgattataatcgaattgttataatcatggagaaaatcaatatcaaaaatgataattttgaagtaattaaatgatagtaaatattttggaagttttattttagtaactaatgtggagagttttaggaaagattgttaaatgtcaaatatttatttcgaagatgttttttttaattattaaaaacaaacattaaaattcagtggcagccattgtaaataagtcccaactacagaatttatttcacaaaataactgcaaaaatgtatatatagattctaagagaaaaatattaaactaacatatatttgtaaattgcaatagtattgacttatccgattatgtaacttttattttttttaattaagtatcttgatactacatatcttatcgatatgggatatgtatgaacgatttctgtttattttgttcttatttatgtgaatgcaacgatttaatttctttatttacggtctttctctcgcaatttctggaattctgcatagtggggatcatcagcctagttgacacggttacaaactgacagtgaccacctacaactattaaagagacttcattcaattctacaatattctagttaaactaaaagtttgcttcacattgtaacagacataaatccccaaaattatgggcctacaatttgcaataacttgtttatattgcacttctgtttttttttgtttatggtataagagttaatcatttggtcaacttcttaattgtatgtgtttgtacattgatctacttgtaatttttagcttattaattattatatggtgatgttggcccaatttcatcatggatagaatttaacctccactttttcaactctaacatcagttataaattgacttaaaaattaactacgtcactttccaaaaatatttttcaaaactcaacgcaaaacacatcatacaaattagacaatgggaaaacacgcgtttataatgacatttttgttcatgaagtgacaaatcatttcttcttcctttactgatctgacaattaaaaagcccgactcatccaagttttataatcaaattctaaacatccaagtttataatctaatcccctagaatcattctaaccgaccaaacttaaccggttgttttgtctcacatattttagttttatgtaattattatcactcgttaaacgcgttcctcgtcgattctgtttgactcgtatctctctatcattcaatcaacacacaataataagttgaataaaatatccaaaaatggtatataatataaatataaagataatggaaaggaagaggattgcatgggctaaaatacatacgatggaagttttagtggtgcacatcacaactttagtgcaagaaagaacatccaaacaatattatttttattatacagcttggaatgataaaaaataataatctaaaagctaagtttgacttgtttgcaaaataaaataactgagatgattacatttcggatcaaaccccaatcttcactttttaaaaaacttgtccaaaatccaacttttatatgactacatggtgataattcgcatgatataattactaattatgcatgttggataatgcagtaaattacactttaccagttaaaatagtttatattataaattactctttcggtttccaattactaaatcttttgagttttcacacacatgacacatcaaaaagaaagttacaataacaaaattatctatatgaattgttatttggtattttaaatagggaatggtagaggtgaaccatgaaaaaacttaagtgaaaatttataaatttgtgaaacttttcaatacattaatcagtttgaaacggaaggaaataattattttatgagtactcgaacaaccctatataccttaagaaaaagcacaaaaataatgaagaaaccctaataagaatttgaaacggaaggaattttaattataactagtagaactatataagtttctatatttacttacctaaataaatttaaataaacactacaataaatagtgtagaaactctctactcttttggttttccctttgtttcgtttctatattttattttttgagttcattagaaatacaaaaatggttcaaatctaacggtgctacaaatttcttcacaaggaaaagacactgtaacaaaattgaaattgccataacagtcgcaggaaaaaccatagtactactagtaacatgaatcatgatctgtctgacaatgacaacaaaagaatctgcctatagacttcatttatatattttcctcttttcacattatcagtctttattctttttaaaaattattttcatacttataacgtcaaattcacatttcttctctctatataaaccacactaactttacatctctcttacaaactccaagagcctcggagcattcgaaaagttcgccggaaaaacaaaaac

SEQ ID NO: 15129 - DNA, 3000 bp, Unknown
  misc_feature (1)..( 3000): cDNA_ID_1822772_gDNA_ID_2926050_Annot_ID_196112 3000 nt of promoter + ATG
ccctttcatcatatctttaaccagctaaaacaagtttgaagcgaattttgcatatatacagtcccaacttcgtcaattatattgaagttcgttatcttttttttttttttttttttttttttttttttttttttgtatgtgtatgtgtgtgtgtgtgaaatatcgcgattaatagtttaagaaaattcttcatcagaataatagattataatattttcaaagatttacttgttttttgattattttgattttattaaaatcatattgttgagacaatggtattatggtcatgaagaacctcaagtgttttatgtatcaattggcaaatttcagcacaagtgaatttttttcttgattattttctactgtctatacatataaaatagagaatataatataacaactttgagctataattagaatctgttggaaaaaaatgaaaaaatataacaaatatattctatcttgatttttcaaagtatagaatctaaaaaaagctatatgatattaattatccaattatatgattgcatttatgagttgatatgatatcttttggttgtttcataaaacagaatcaagaataagatgatcaataccgaaatatatggcttcatcatcaaatattatttcacatgtgattctccaatgtatcattattaagagttgttatacgaggacccatttttttcgcagcaatcaaatcaatttgagctttttaattaaaatcttcaaaaataatctgagaaaatcacagcgtctcattaattattaaaaaagtacttcaaaaaagtggatatacgattttgaaatgataacgatttcctgacgtcagaaaaaatcctataacaaacattaatgtttttttttggttagttaagagacaataatatgttacatctaccaaagaatattccagttaagttagttaatagttggagtcaaacttaaacgaacaacgtcgcctacaaatctgggggtataagttataaccaacggccaccaacatgggttttgatatcgtccacctgatttttatgttaatataactcaatttgattgattaaatattatgctcttatactaatcattctaggtccaaaactgaatcactcattgcacatcatttttatgatttttattttgaaaatctcatgtttcaagaaatatttgtgcattctactagtagcttattttaaataaagtttcgagtttatataataaacaatatgtttatttctttgatttgtatacattttaaaaaaaaaaacaggatgaagatatatacaactaaagctcaattcaactagtaggaaaattgtattctacaaaaaatttgtgtttatgtttttattatgataaccatccaaactcattatttcacccatgatcaaagtaactatatcaatatatctgcaacaatatctgactcaacatttatttttacataaactgcggaccaacacaattatgctaaactatcatcatttattctattggtattggagatcagtctacgtcagtgaataccgcataattcacatgaaactaactccaaaaccctttaaccaaaaaaaaaaaaaaactaattacaactccggttaacctgtcgataattacaagactgaaaacatcctagtcagtaaaaaacatatttgtatgtatccgatcccaccaaataaataagttgttgtcaatgatagaggaagagaaaacgaaaaaaaattgcggaccaagacatttgggactactagagtttagggagcataaatggtcctatttgacttaccctctaccgtataaataaatgtattttagccgtataaatgtatacatacgtagatgcataggtatacaggattactttagacgatttgatgtcggtatgacattacatttgactcccctagctccacttgtctctgttcatttttcttgtatgtcatttccttgttttccaattttacgtttaccaccctattttattttgttaatattttctaagtcaacgtgttgacacttaattacagaatctgataactaaagttacataaaatgctcacagtttttttcagcaaaatactcacattatacgacatataaaattttagcagtctataaatagtaattatttggcattagtattggacaagaagtagaatataaattaatgttggttcttttttctatccaacttcacacagccaattttgtagctgacatcgtgaatggacgactaaactaatcataagcatagtgattcagtttatacaacaacaacaaaaagttaattacatttgaggtttctttttaaattgctatgtttggtccctaaatgatggtcataataaggacggtccggcggtgacggaaacgcgtaaagactaatcattttagtactattaatttgtagaattattattaaatatgcttgaatcctagaaaacgatcaaataaattttggaaagaagctcaaaatgtgttatttaattttgtccctatgtagagctggtttttttatttttatttaaacataatcctaagatttattgctgtatgtgtgaatgcaataataaatagaaactcaataatagatcattcttattttcaaaaagaaacaagaactactgcaatgttttaattgtttattttgtattaaataatatagcttgttaattattggagatcgcattaaataataaaagaagttgtctcacatgtcttggagaatatttactaaaaactatggtaatgtctggacggtcaaaaaagtctctctagtttctgattctgttgtcacattttatttttgaaattaaatgtcgttagattattattatctatatatatatatatcccaacagacccattgcttctccaaccacatctcactcttcaccaacttaaaccctaattcaagatctcttcttttcgttctctccttcacccacattagtcttctctacgaccaaaatctcttgactttaaaaacagagaatg

SEQ ID NO: 15130 - DNA, 3000 bp, Unknown
  misc_feature (1)..( 3000): cDNA_ID_3094368_gDNA_ID_2926051_Annot_ID_196119 3000 nt of promoter + ATG
tgaagaggtaaagaagaaatccgtcaaagagcaaatcatcaaagagccaaccgtgaaaggtaagagaggtagaaaacctgtagaggcgaaaaagttgaccatataactacatcctgctcttgttattaatgagaagggagaagctgatgaaacaaaattacctgctcttaatgtgaagagagagtgttgttgtctccaaaaaagctgaggaagtcactgacaatgatggttagaaggaaggtgacagtgacgtatgagatgtcacataccagtttatcggtgaaaacggaagcacgttccctgagtctgatgatgatgaggattgatataatcgaagctttaaagacgcagagtattaagctgtctacggatggtagtgcattgaatccactctttaatctctcaacacgggtttttcctaatactggagacaacagactgaagtgcatgaggaagaattgtgtgccttcagctggaatatatgatcctctatcaccggctgatacagccaaattgtagaaacttaaggattacttatccccattctagtatgaccctttataccttattaagttgttaattacaacttgttaacattatttctgtatattaacttgtgtttatttgttaggaatctcccattgggcagggcaacaaacgatgttgatttctacagggttatcatctccgaaagaaagcactgaccaaccagagaatatggatggttgttcgatagtgtaagtattacattagcagagttattagtgtgttttgtcagagttttactacattatggctgagttattggtgtgttatgctacattatggctgagttattagtgtgttttgtctaagttatgttatattgtgtctgggttattattttgttttgtctgagttttttttttgtacaacatgtggctgcgttatatagagtcctcaggaataggtacaagcgaaatctctgcccattccacaacaaacgcattgcatttctagacacgtgattcgtgtctttttgggttagagagtatgtacagtgcaaaatataaaagaagatgtttaaattcaaagacaccccgtatgaaaagatagttaatggtttgcttccagataatcaacagacaaatatgaagtgaatagaagatgtgaatcacttgtatttgattccccaaaccagaggcgatcactaggtggcactacacatggaccagattaaggggcacattgattgctatgatatcattgtgggataagttacaagaaactgaatagaattgattagaatgttgtaggccgtttacgagaatgattccagcaatgatgaacgtgctaattcctactacaatcggtgaacataggtttgagcagtttacattcaaaaggagtagtgtctccagggtccctcaaaacgtacaagttggagctgcggcgtgtactcgtgttaattttttgaatgtctaacgcttggtataactttcaatgacatatgtgatttcaacctatacaggttaagatggcagcatatatctacaataaggcacctaatctgcttggacagtttaggattttgacttgggataattatattaacttttgaatcgtatttttttcaacaatccataagaccaatgaattttgttttctttataatggtttgatttcaaactaattttcatatcttggcattttcagataattaaattggaattttacattacaattattcttctcatagaatcaaaatgataaatctatattaaatatgttactatattccaaacttttttggtttagttttatggacttactatattgtgcataactcaaattaaattaagacattttcacttgggatcactatattaatttttgaaccgtatttttttcaacaaactataaggccaatgaattttgttttcttgtaatggtttgattttaaactaattttcatatcttggcctttttagataattttatattagaactattcttctcataaaatccaaatgataaatctaaattaaatatattgcaaatcttccgaacttttgtttggtttagttttatagacttgctatattatgcataactcaaattacatttaaaaactccatttgtcaaacattaggttttaacaaatacctccataatccccatgtggctttctagtacaattatttgtcaaacctacgatctatcttcattttagaatttctgagatttctctcacagcctataaatcaagtacaacattaggtttatagcatgatctccaacattaagaataatcaagtttttaccatttgttgttatttccaacttaacatgatcaaaactaaatgcgtggagtctttatgtcctcgacataacattatgtaaatactttttgactaaaaatagtaccattcacccttctaactctatgtcaatttgactacaaaaacattttgacaaaaaaatgaacgattacaaattacactgatggaaaatatacttagtcgaataaccaccaacggttgaatgtaaatgtggagttccaattattaatcatttttttcggcactcaattcacgaatgtgaatcaccactaacgcatctaggaatatatatagtaaggtatacaacttattttttaatcaaaacaaaaaaatatttgtagatttttgggacctttggttttccttaaaatagataagggaatattggaggatagatatgaatctatatgaattagaatttaaggtcttaaatccctttgtgataaggtttgggatacctatattttaggatctgtgtttatctcctgtggaaactctcttgtataaatacgaacgtgagttcatcaataaaagcaagtcactttgataaccaattctacatggtatcaaagagctgagatcatcaaaatcatcttcaaaaattttgtgttcttaagttaagaattcttaaattgtttcctttctctgttgagttgatagtcttgtgtgtcaagtaaca

SEQ ID NO: 15131 - DNA, 3000 bp, Unknown
  misc_feature (1)..( 3000): cDNA_ID_3094396_gDNA_ID_2926052_Annot_ID_196121 3000 nt of promoter + ATG
ttaggccaaacaaattagtatactattcaggtactaaagtagtaaacacaagggtcaaagtgattattagctaaccacgggacctactaattaattatatactattagaccagattaggttctcaattccgttccttatgtatacgtctaattataaaaatctcgaatgctaacatcatatttttttcatccgcgctttgattgaacaaccgaatataagaatcaaatatataccttcatgtcaaatattaattagaccaatatactgagaacttcgaattttccaataacaaaacaccgaccatttttaaaacattaaattacaataagtactgcttaatttgtgataaaaaaaaaatagtacaagtttaattatatttctatgtcatgccatttttgaatagttttttttgtcgttttagaaaatagttttaaacataaattcgattcatttttcatgtccattacagaaggaaaaagagcatgtgcaagtgcaacggtgataagcgtattctagacaaagacacgcgtatcaacccaacacttgtcatcttcagagtccctatataaaccccttcacacacacctctcttcattattcttcaaagctcccactaaaacctattaagagagaaagatatatacagagagagatcatggacggtaggggaggttgttgcatagccagatatggtggttacggtggtcgctacggtctctccaaagcagatcgaatcatgcttcgttttcgtcccattgctcctaaaccggccagcgacggtggaagtgtctctctcaccgggaagagcggctccaccacaactacaagtggtggaagctccgatctctcaggtaaatctgggagaggaaagagaaagtatcaaaaagattgttccggtgggaactcccgaaggtgcaataagaagaagagagatctaagtggagacactgctactaccacggcggttacattgtctcttttaccagagacgcctgagaaacgagtttttccagatctgaatgcttttccggtggagaagcagaagcgaaacggtcctttatggctgagtttcaacggcggtggtgagattttaacgccgtacaaaacggcggagatatcacgaaggacggtggtggtttcgtcgtgtgtgacggttgagcgtgtgactgacgcttggatcgacggttatggattaggggagacaaatcaggagaggaagatgaatctagtggaagacacgtgtcctggttttatatcggacggtgtagggagagtcacgtggaccaatgaggcgtataagaagatggctagagaagatattaatattccgatggaggaaggtgtaccggaggatattagttacgataattttcacgtgaacgtacggttagtgatgaaggagaggccgatgctaacgtacccagctttcacatgcagagtgagattacagtacacgtgtcaagatcgagaaagaggatccgtcacggtgccttgtgacgtgtggagaatggacggcggtggttttgcgtggaggcttgacgttaaggcagctttgtgtctgtgacgttctttcattcgccaccgttggatttacaatggtgaaaatgatgaatggtcccgatcgtatcgtatcacacatggcccttcgtagaactaaaaatatagcaagtgataaactttggttatttaattttcaccttgaacatatgtttctgtgttttattttttagtttgctttcttctttagttagtattttgtttataaaatgctgttttctctaaattgctaatctcaaatttatgtttttttttgttttgcttaaaaatttcaagaaagttgtatatatgtatgccttttacaatcattaaagtttttctttttcacattgttcgttttcatgtcatttaagcttgaagatgaaattgtcaacattcgtttgcaaaggtgttaacataataaacagtcttcccaagcccatacaagagcattacgtagaaaaataaatagtttactaatgggtagcctcatgatattcactaatgggcctgaaaatcaaaagattcataggcacgtgtaattcaatcgcgctatttacagggcgcgtttagtggataaaatagtcaaaatagtggagacaatgtcggtcggtatccgcgtctattacacgcgctatagtaacacgtgtaatctattaattcttgcgatttggagtattaatactcacgcgctccaagatcttttctcaaaacaattagagatccagattcactagattgcaccgtagccttcacagccgttagatctaaatatcgacggtacatatcgaaaggataattgtagccgtctagatttggttggctggaatttaacggcttagattcgattaaaggcggcgggctgctcatctcttcggatctataagtagagaagcaaattgttcgttattcttcgtaagtctctctctctcctctcacctctttcgttttttcgaatttttttttagttttccattcgaaaagatatccagaagctctcgatctagggttttccaaatcgattttggtaccttttttttgactcagtcgagggtttttctagggtttcgattagcttttttgccaattgccgttgaggaagatacttcttcggtgaatttgatttgattttgacctgagggagaagcaagaagcttagaccaattgggattctcagtttggtaagtcaacgtgcaattcataggaattcatcatcggattgatttggtaatcgcattcttgtgatattttttcggggaattgtgttttggctcgataacgatgaatggtgtctatagattcattgttgaagatatctgcaagatttttggagcaaaggcataaaagcattacttgcttgatttttttttttagtttgttttatattctaatttgatggtgtgaagacgattaactctgaaaagcgaatgaactgttgggtttctggtttatagcaaacgatg

SEQ ID NO: 15132 - DNA, 3000 bp, Unknown
  misc_feature (1)..( 3000): cDNA_ID_3094390_gDNA_ID_2926052_Annot_ID_196123 3000 nt of promoter + ATG
gcatgattcgatctgctttggagagaccgtagcgaccaccgtaaccaccatatctggctatgcaacaacctcccctaccgtccatgatctctctctgtatatatctttctctcttaataggttttagtgggagctttgaagaataatgaagagaggtgtgtgtgaaggggtttatatagggactctgaagatgacaagtgttgggttgatacgcgtgtctttgtctagaatacgcttatcaccgttgcacttgcacatgctctttttccttctgtaatggacatgaaaaatgaatcgaatttatgtttaaaactattttctaaaacgacaaaaaaaactattcaaaaatggcatgacatagaaatataattaaacttgtactattttttttttatcacaaattaagcagtacttattgtaatttaatgttttaaaaatggtcggtgttttgttattggaaaattcgaagttctcagtatattggtctaattaatatttgacatgaaggtatatatttgattcttatattcggttgttcaatcaaagcgcggatgaaaaaaatatgatgttagcattcgagatttttataattagacgtatacataaggaacggaattgagaacctaatctggtctaatagtatataattaattagtaggtcccgtggttagctaataatcactttgacccttgtgtttactactttagtacctgaatagtatactaatttgtttggcctaaaaacagataatcatgaataaatgccaaaattaggttaaaatatagtacatcgaaatgaaaaaaaaaaggtaatgttaggcatggtccaagagatgagggttcatacattatcattgaccgattctgaatttaatttagtggaatataatcttaatcaactaaaggtgatcgtgactctagatctcaaatctttattaacgggacaaggtcgatgatctcatgtccaaagaggaattttgtgccaatgaagttaggccacctcttttatgaaagggaaagaaggaacattggatggcgtataaataaaaatcatgagggagtgacggtatcatggagccatcttaaatataatcatacaattgattcggaaaaagtatatatggacatgagagtcaaaatcttattaaaaatccaatatagtaacatagaaataaagtagattcggaaggcagttcgagatggcatcaagaaaaatctgatgggtttgtgttgcgttgtacgttgcacgcaagaggacacgtagagatatgtaattagcttatcaacttacaactataatttacacaaacaatctcattatttaattaaccaaggcttaataattagtccatatatatttatacattcatgaatgtggacgaaactgatgactgatgttgagacttgagagttaggtttgattctttaacattcgatatctcatcttccatttttcgttattacatattttgttgcaaggaaaacacgatataccgtatagagttgatgtagctaaagttttaattcaacaatgtaatcttgatcattaaagtatagatgattttagtggttctacttgacgtccctacagatagtaaatgcaattatcaaaaacatgtcatagttactaaaagaagaaggatgcacaaatacaatctttttgggttggatcagatcaaattatatttggcttaaagacattgattactacgtatatattaaacaaatgaataaaattgactacctttgctctcaccctcacctgctgattctatacctaattaattatataatacgatagccaacagtttcaacataaaaccaccatcgaaacatactactgatataatatgcatatgggacaaatgaaaaatgaaaaatataacggatgaataacgaaaaatgaaaaatatcattaatgatataatatgcatatgggacaaagcaatcttatccgttacggactatataacatatcatttcttaatcatatattatatacgtatatatataatcgtatatcatcagtaatatatttgttgtaagaaaaacacatactgtatatacatgaccaaaaacatttcgctttatgcattgatgtaaaaaaattaaaactatacataaacacatcaaaaattacagacacttaacagatgtaccatgtttttttaagaatcaatagttacaaaatttgagaaaaaggtgatattttgtcatttcgttggatatgaaggaaccaatgataaaacatcgttagttactaattcaaacaacaaaaaaaagaaccccgaatttaaatgctcaccatcgacaaaccttggctatttattttataaatataagacaagtactaaatcctatcaacactaaacaataaaatcgaacatgttcacccaattataatctgacagctgaagaagataaggaaatactaaatatagagaggttcgatgacagagagaaaaaggtagactgaatcaccatcaaaaccacgcccaagaaccctaattggggaaagtggccaaatgaattctcgccacgtgtggatctgatggtgtcagagtcggtaaagtttaaaaaaggtaatgtgtgatgtctcgataagggcttttaaactggtcgttttgtctgggacacttgtacagttttggaaaggaggacccatgactagggcattctttagttaattttaaacttgataaatcagtatttcgtttctatatatttgtttatgaaattctgtatcattagagaaatcagatgatgtggcaatcattatctgttctctttaatcgaccaaaggttcgaacaaaatatcattgttggttatctgatatagagaaaactaatttagaaacctcgttttgaaaaattccaactacaatatgagatttgattctacaggagtttggaatatgggaaagggaatttacaaaagtgattgttgaaacattaccgattgttaaatggtaatagacagctgaagctgcacaatgacat

SEQ ID NO: 15133 - DNA, 3000 bp, Unknown
  misc_feature (1)..( 3000): cDNA_ID_3094428_gDNA_ID_2926053_Annot_ID_196127 3000 nt of promoter + ATG
ggaatgagatgatttctgctgaacctgagatcagtaatgaggaggttggtcattcatttgaagagaaaccaaaacattcgttgtctataaatgatgctttagcatctgcacttgctgggttattgtcttcacattcgatcaccgatggaaaatacagtcaagccctcgtaattacagccccagaattttcaagtgaagatgatgtggagatagaagagaaacctgggacgagtgcccatccagacgatagccaagttgcagcagaggagtctgaaaacaggtactcttcttccttggagagctctacttcgtcacagaaagagcccggaattactccagacgattctcatggaacgatgtatggagtttttaaaaaactggatgatagttttggaggagatgaggaagctgagactgtggttagcgtcagcgacaatgctttagatgaagagacggtaacatcaagcacaaaagctgattgttacacagaaagggaaaacctcagttataaacccacggaacctgattccctgattcacgagctcgagagttcaaatgtaactaccgcaaaatgcaaaggagagccttcaatggatgatgtcttgaagagtgttctaggttttcaaccgactacttcttcggtcgatttcctaacaccagtcctggatgtgaaatttaatttagagaataaagactcagacagcaagtatttctttgaggtactcttcacagaagaatcgaaaacttatgtagattgcaagaacgatgtttttgatgataacttagtctcagtggaagatgaagaagaactcaaaggaccaccaacagataccctttcgtctgtggagatgaatcactatgcgacgaacgagatgcctatacactggaatggtgaaatatcagaagcgagtcttatataaagggaaaattaaatgcggcatcaaagcccgcattttgttttcttctgatatctacatatttttttttggaactatttttgcaaatatattctctattttgcacttatttacaatgacatactaccgaatttatttacttgaattaaaatcttgcgactaatacttattacccaaaccgattatacccgatatatatggtatttcctttactctagcaacacacaataaaatcatatattctctagcaacgaaatcttaaaacaaccacagtttgaattatttgaattaaatttctgcgaataatttgcaaagaattaaaacaaaatttttgtaacaaaccaaaaaacatgaacgattttgtaaactattattgtttcaaataatgtttacaaaactacccaaatttaggttattaaatgacgtgaaaaaatccaaaacccaagtatatcaatcactaattgtgattaaactaaagatttatttataacattatccatagtaaaaaattgaagtacatttttagagttattatgtcattacctaaaaagcaaaaaaaaaattaattttttaaatattattatttatatatttcaactttataaaacattactaatatttaaatttataaaaagtttaatatatcacaattttttgacatcatcatataatatatagagtttaaaaaaatctcaaaaaaaattccgtcaccaaaatttttttccgtcatattttgtaattcgaaattttaaaaatgaacatatattaaccaattgacaaaaaatgtgtgggttcagcgtcccgcatcgactaaaatatttagacaatgattcacaaacatatcataaataagatcaacattaataaaataaatagattatttttacgggatgagtttggcaggacgttacttaataacaattgtaaactataaaataaaaatattttatagatacaatttacaaacttttatatatactaactttataaagaaaaatcgtccaagatatgtaccgcgggttaaaatctagaatccaagatacataacggctaaaaacacatactactcttaccacattacaaaagtcatgtatttttcacaaattattcagtctaaaatccaagatgaatttttttttagaattttacataatatagtttatcatgcttttattatatacactatacattttaatcgtaataccaactaatatactaagaaaacagatattataaatgtaaacccaccctaccaaaaaaaatatccgtaaacccaaatacataatctacaattcaacaatatgaatttcactcaatatatacattttcttaaaaaattagccccgcggtgtaccgcgggtcaaattctagtatagtttatagtttcaacgaagtttttactctatactctgttgaaagaagttgtaagctttaatgataccatggattactgtgttctatatgcgacaaatgcaagtgtagatattagaaccaattgtggcagaaatccaatgacgtggagaaaaaaagttatgcgctaggactcagaccagtacgttgccactcgacttcttagtacgatttgttaggatagatagactatagcaaagaattgaccatcttgaggaagggttaggggagttggtctgccgcatagagtaaaccaacgtgacttggagctatgagggaacactaatgtgacataaagacaactctcagtgagacctaagtttaagttgtacatattgagaggatatctagtttattgttacaaatctatccttttcaattaatcttttggggttaatggtgataaatattcaactatacataacactttttgtttacgttttttagttttccaaagtaagagcatacaaattgctaagccgaatttctcccactcctacttgtttatatgtacaatgggctgggcctataaggcccaatgttttgtgtgtcacatttcgtcacccacagacatatatacttagattgaagctaaagctgcagtctccgtctcttcgcttctagggtttcatcaaccaaattcgctttcgccgcctttccacaagcaatcatg

SEQ ID NO: 15134 - DNA, 3000 bp, Unknown
  misc_feature (1)..( 3000): cDNA_ID_3094442_gDNA_ID_2926054_Annot_ID_196135 3000 nt of promoter + ATG
agggccacccttgaaacttcaggaagtggtatgtatctccacagcttctctgatcaaatatcaaactaaaagtatttgagtagcgcaggatagtagtcaaaggcttctaagaattttcttttcaatgaaattagtgaattagctttcgctacaacacttatagagaacttccaacacttctacacatgctcgttaatgcagcattacttttatgcgttatataatctgatactgcaatctctttcaggtaagaggtgtaagacctctagctcttccggaaatggcaaatctgttcaacagttttcatgtgacgatatgccctgggcttgtaagtagttgtttacgatctcaaaccttcattcctcatgcacacatgtatacttcaaacttaacttgtattgttttttgtcgtaggatccaaaccctaataatctagtggcaagcacaaccttctactctgaaactacaggagccatgctctgtttggtgagatttcaccaagtttcacttcctggttttggcacttgccactccaatttctaaaatttcttaagacttatagtaatgacgtgtgacattttccttggtttgcgattttcaggcaagaattgaaacagacccagcggacagaacccaactacgattgacagtaggctcgggagatcctacccttacatttgagtatgatatatctgcctcttaatcacaaacccaacctcgatcacagattttcttcatttgcaattgttgaccccttttatctacaggttaaaagaattcatcaaggaacaattaattactattccaatgggatctcgagctctagttccagcagcaggtccagcaccatcaccagcagttcaaccgcctagcccagcggctttagctgatgatccaggagctatgcttgctggcttactttaaattcattgggataaaagattacttgcacatgtcgaaaagtttgttttctgttattgtagaatgtaatggcgaaaatatggaatgatgggagagtaaatgtagagccaagggagagaaaaaagctagttttgattatatttgtgccgtttatccaaagcgggcgggttgcgttaggtaagaaattttgcattcattctgaacatttgtattgtgaggtcagtggttgtatcagcttgttcttgtgcctatatattttcaatctgtttctccatgagttttctgatgggaggtctgttttttcgcaccagccttcacattgagagattttaatgttgtcataaaggggggaaattgcaaaaacacatccaacgcatagcatttcacctgtaaaaacctgatctaatttgaggtgtgaatagagtggggacttggccttggtgggacattcaaccgacatatatacaaccagatttttactattactttgaagaatataattgaaagaaaattttttttttactatttttaattttcttacaaactgcttatggatttaaaagctgttttatcaatttttgcatgatttttttttgtttttactacataatttgtaattgacaaaagtatgatttttttatattactatatcatttgtaattttgcaaataaaaaaaaatataagaaccctagatccggggcttgtgaaacaagagtgattaagcaaaatttgagtaagtctgacttttgcaagtttgcttcaccaacatcaatgtcgctcaagttgaagaagcaacttctcttaaagtatcgaataccctaaaatttgtcatgccttgaagaaaaactcaaccgagatattggagctgttcgaaatacctaagaaatcagccgatgttgctaacgcaaagggacaatatcttccataaaactaaaaatgttcaataagcagggccgacccaaatctaaagcccagcaagctgatgctttatcatcacaatcatataaaagccttgtagtttaatggttggtgcttccattagttatataagtttacgagttcgatactcaaactgccaaacaacaacatcctaggagcatacgctatcgccgtcactgcttttctagctcaacaattcgtcctattcatcgtcttgtagattatgatcttgttatgagacacatttagtatttcaaaaacgagagtagtgacaatactttcctattcaccagagtaatttggttgcaatgattctagcaaaattgttatctgaaatatagagtatctaaaatctttattcaaaagatttcataatacattgagtaaaattataaaatgctcataacaaaaaataatcaaatcagcactgcgtataaaccatttgtttcgttcccactaataccaacaaataccatgtctgacgaaaaaaaaaaaaaaaaagttgggaccagctaaaccattgcatgacctgacctgacccgaattcataaccggattttctcatggtacattttttttgttaaggattttctcatggtacattgaattacaactgaatgcattgaccgcgacagaaaacagtcattttaaaaataaatgaaaaagtgaaaccagaaacagcagtaaataaatattacccaaaaaggcagaaggatacactttttaacaaaatattacgcaaacttataaatcctcaaatttagtccaaatgtctagacgcgttaattctgtttttcgacgggtcaatttcggattccaatttcaaaacagacaaaaactgaattacacaaaattgaatagtcaaagttgtaaataaagaaaaataaaagtcgtctctcgtctctctcccgcaggcgtgtctctcttctccaaagatcagtctctccttttgaatttcttcgattgaaggtgccattttccgtttctagattgggatttcgatctcacctctctcgaattgcttatgcttcagctttagtctgtggtttatctcgtagttagatccggtgccgcgagtttggatctgcgccgtgtgaggcggcggagcacggtggatttgaggatttggttcaaccatg

SEQ ID NO: 15135 - DNA, 3000 bp, Unknown
  misc_feature (1)..( 3000): cDNA_ID_3094449_gDNA_ID_2926055_Annot_ID_196139 3000 nt of promoter + ATG
aagtagtgctaattaatttacatcctaaaattcttccattaattttgtttaccttacttatgtcagttatgtgtcatgccgtcatggcaatcatctctaaattaaatctcacgattatttgtgatattgctctagaacatctttatagtcatgtcttgtagttttttttccccattctattctatggacgaaatataaatataactttcgtaatgcaatattttacgacatatgattgaacaaatttatagtttactagtttctattagaaaacgttgtgttgcatgcattagttaaataattggtaaatgttactagcattgctagaatcattcacattttatgcatgtaaagactaaaaagatgttctagagcaatatcacaaatattagaaaagactattaaaactttgtgaaatcgatgagcatagtggactcatttgtaaaatctaagtttatttggtccatattatatatcgtatacaaaatttgcggcgtgtgaagactgttttggatgaaacacgttttaagacatcaattgttttttttttcttctaaaatttcacttatatctacaaaaataaatgtataggacagacagacaaaattacttgagatgataaaagaagattaaggcttcagtaatcgtgaatcgggtcaaagctaacaaaaatgccaccatttagggatgcgtcctcaaatctcataacccaatcactcccacgaagcttccttctcattcaacatttcaactccgcaaattccaagtatgaaagtattcaattaaccatttatgagtacatttgtaaagattttaattaagcaagtgggatatctaaagatatgcaaatacacacatattaatgtaatgtgtaatgtgtgtaccatacgggggttttcatgctaatttgacgggatgtccctttctccaatcactacaaatcccggtgcatcagctggattaatcctattttatttgatttttgttaaaaaataattagttcatgtaaatattactataaaaaaaagtcccgaacaattaatgtttattgatggaatatatatcaccaactgttatatactgacgttttttctattgtcagtaaataacataacccacacaattaatattagtgatttatctgtccatcggtatcacttgtagtataagactgatgaactgactaacatctgatggaatttttttagtggttcttaattatgtagcaagatatgatgcatgcatcgtggtttcaaagtgttaactttatataatggatttatgaaatgaaatagacataattgttgattgaggccaattattaaaatatgaacatgcatgcatctatatctatcgtttgtccgcaaatgcatgttacgcaaatttagataaatcttcacagcatatccatgagaaatataaaaaaatgttactttttttttaacgtctagtaaaaaaaagtaatcatctttaacatatttcaatttatatgacgaagctgaaatcagcattagaaagaagaaaaacgtgaagttgaacaacaacaaaaaagaacacatgttgatttgtcacttagaaaacaaatcgaagttagagattaatctagaaagtaatcagaagaaatttcaaaaacttgacattctttaggagaaggaatggatctagctgaatctttactacaagagtcaaaaatttattgatatataatacagttatacacttgactaagcttataaggtttagaattttattattttcttattttggtaatctatgtaacgtttgtgatttttgaacaaaacaggtcatgaaaagcacatataagtttttacgaggcaatattacaccaaagtttatcacaaataattagtttgttaaatggtactaataagatttaattctttgttgtttaatgaactgaagtgttctaacttaagatccctatattttccatttgaaatttcgctccaccaataatcgaattaaggaaaacgtaaaaagcgattagtttattcgtcgattatgattaaacgaacaagttccaaaaatgcatatttagaatttctagtctattatggctttgggctataaccttacggaaattatcaatgtaagtttcgtcgaaataaaaatttcacttctctatatatcgtaaatacataaatctccaaacacatgtcttggatttttttaataatgtatatatatatatatagagaaaaaaacacttagaagatttttttgaattttataaagagaaatatatattaagaataagagagaggaaggcatgtaggcatgggattgtgcctcttcattgaacgacaatacttctcatcctcacaaatggttgccttaccattggttggcattcgcatgcatcctccaacttattttaattattattgtcgttaatatattaaactacatagaatcttcattatgtttatcgtaatgccttcgttacgcctttatttgctccccatgtgtttactcttacctcattttcgaactccaaacttagttccatagttttggaagattggtgtaaatggtcaaacgtttttagaatatatatgatcatagttacgtcaagatcttcaagaaacaaatctggtatacaaaaaaaattggtcacaaaatcacaatcaagaaaatgtatgtgttacattttatggatagtgaagaataataaaatagtaataagaattgctgaagaggactctctagttgacatacacatcttacattcattccaaccatttaaataatgtaaacgaataacaaaacgcattatttcaataaataatattattctgatactaaaatttaaaaatctaaagtgtaatgatgaataaaacaccccacgagccattcacacatctcaactttttattctcctagaagaaactatagattatatctctcattatctcactatcttctccatatacttgttcaattcaatcattcctttgctttgctcctaaaccacaacaa

SEQ ID NO: 15136 - DNA, 3000 bp, Unknown
  misc_feature (1)..( 3000): cDNA_ID_3438042_gDNA_ID_2926056_Annot_ID_196142 3000 nt of promoter + ATG
tttttccctttattttattttttgttgtttttttggtttgaggaattataaagtacacacagtaacggctcatcccgtcaaataagggaacacgtgtcataatcgtagtcgacacgctcgacccaactcagactcgcacgcgctttattcactttcttttcaaccgtcagatcttaaaataagtgttgagctaatcgtgatcgttgattacttcgactttgttaacttttttgtttttttgctctttatttataacctctcgtcacgctcttcttctgcgaccatcattacttctcgtgttcaacggtcaaacttcacgttctcaagacactacttaacttttgttttcgtatgctaatgactactattaattgtttttttagtagtattagatttaaagtttgaaaaagattaatagcagttacgtttgagacagatttaaattaattccccaccagttgaaagaatctacgcattacgcatatgcttggtttttaatatgtttttgttggttcttaaatgtttgatggcataatatatctttcatttaatatatattgatgaacattaatgcaccttatctaccaatttgatgataatgtagggaaaaaatagcatcataatagataatgataatatctgacctttttcattggaccgtcttgtgtatcaaattaaaattattaacttgcttttacttaaaagcccataataacaatatttttttggatccgaatattaatgaaaagcccatatctaagttttatgggccaaaacgtataaatcgaataaataaataggaaaaaaattgagtattattacttttttttttcttttttttttacgacagtattattacaaaaacacttagaaaagaaagtgccacatttaaatggggtttgttcctttttctccaaccgaaaacacaatgataatgcttaaaccaaacagtagtacaactctttccatgtttgactccagatcttatgatcaattgctaatccatgtttcggttatttttttgatagatcctgacacggctttttaattataaatttaaattccatacaacatttatataaatcatgattaagtacttacgtcagattatgtaataattagtacgttcatatagtgccgggaggtttattagtaccatttttactctctctctttttcttcaattacacatttactttaaagtcgattatttgattggatgctaagttttagaaaataatgtcaaaaattctggttctcgagaggctacaaaattttaactctcctctctttttttttattaccgtattttctgtaaccatcatatctcccacccatagtgacttttttacatgggactatcaattttacttacaaaagttactggtttacaacggcgaccatggtttgaattcagataaagataaagaaggaaatgcagagaggtggggacaaattacaagaaggaaatgaaaaataagatgtgaaaggtggaaatgagaagtcgctattaaactttgtagtaatctctctcagattcaggcttcgtttcgcttgttaccaatggcttctttcacatctttccctctcgtgatttacttatatcttatctttatatgtctgtcttgactcttgatcatgcattcaatacaaataacatccaaaatattacttgtgtgtttctctttcttttccaataactaacatggagtactaataatattcagattttaacataaatagtactccctctgtttcataatataaattattttggaccaattttttgtttcacaatataaattgttttcaagtttctatgtaaattatatattattttattactttatgattatatatattaatatgcagtatcttttatgattggttgaactttttaatagtaaatattcttaatctgcgtgcttttatctaaaacaatttatattgtaaaacggagaaagtattaatttgatttgttctttctttcgttttcacttctttcatttgaataatatcctttgttgttttgttcaatctttcatttttgtattataacgaaactcaaaagaaggtattttgaccactaatgttgttgttaaagttttaaacatcctttttggataatttaatttttattgtaaaggcaagaaatacataaatatttaatctgctaatcgccttttttttcttgcctcgaatccgaattttaacatataaagaagcgagacaggttcgaattaaataatctctcttttaaagagatctttatagaatacataaaaaaaaatcaaactatttatagaaaaaataaaataaaaacgaatttttgctttcaatttatgtacattggaccacagaatctgcaaagctatgtatgtatcaagaaagacgtgactataataaataccacgaacaataaataattagattcttattacgaatcttttatgtattcccctaaaaaaaaccatgtcataattagtctcattaaaatacgattgtatgtaaaaaaaatcataccgtatgtagaaatatggacttcattctgtaaataaaagaaaaattaacgtgtcaagatctttgttaatcagtaattaaaatctaaaatgacttaactcaatccgcaacacataggactgggagcgtaatcatcacgatccgatcgggacatatgtttgtctccatcgtacggatagggtatatgagcgtgtttttcacgcgcatcattcgcgtgaactaagaatgctaatgaattcgttaattcgttaaaataaaataaaataaattatattagaaattaaaagaaaagaaagaaagaaaaaaaaaaaagacaaggcgtgagataataaaaccctttggctttctcatagagatttgtccggtctcttgttcctctttctcctttcttcactgtagaatccgtcgaccaaacaactagctccaatggcataatgagcattgtagtttgcaatttcttcttccgtgaagaagaagaag

SEQ ID NO: 15137 - DNA, 3000 bp, Unknown
  misc_feature (1)..( 3000): cDNA_ID_3094468_gDNA_ID_2926056_Annot_ID_196144 3000 nt of promoter + ATG
gtggacatgatatattacaaatttgcaaaaagaaaacacataatctttatgcccaaccaatggactgactgacccataaaagcttattgatttgcgatgccaaatgggttttacagtactttttgcttacccattaagggacgcacaaaaccaatccaatgagaataatatctttaagattttagtattattatcatcataaaagtatcttatcttatttttagtaactctcaaattctcttacacgtgatttgctaaattttattccctagcttttttttttacatacttgaagcttttcgagcttttaattttgtgcccaattcctttatgtatctttctaaaaggttccataaaaaggaaaaaacacattactttaagggattttaaaatatatcttcaagaccattacacctctttgaatagctaaataataaatgttacaaaatttattactcgccagaatgtaataactacgatgaatatattctagttacttcttctatagttatcatttttattttttttagtgtactctttttctagtttctaccccttttaaattgttcgattagttatttataaacatagaataaatatgatcagttaaagaagaagaagaagaataaatatctctttatttctgtcacgtcattaacaaagaaaatgccattttaagcttttgtcttttgaaaagctcattaagtaattaaataatcatatgacccatttcacttaatcattctaatcatatgtcgttgttaaaagccactagatagtagcttactaccagaaatggcttcgacatgttcacttcaaagaatcaaacaatctaaatattattggcataatcaaatactctaggaactataacaattttcttgaccgttattttctcgaataaaatcatcatatatttgtggaggaaaagaaagaatgtataaagtcataacagatatcatataatatatccaaaaacacccgaccgatcaagtgacaatgcgcagtgttgtattattatattatcactgtttgaaaaattgtcgaactcaggattggtttataactttgcaagacgataataactttggagttttgcataatggtaagtagaaaacgccatttttcatgcatctcccgtctttgtccaccgccaaactagtagccatcctctaattaataatgtattactacagctttgtatatattcgtattggagtttacagactaatcacatagtggttacgtttaggaagataaaacatacagaaatggtaaatagcttgtgaacctgaatctcgaaacttaccttgtccaatttgtaacatgaatgtcgactataagtaaatttgctctgacaatttacagtcaaactcaactatgagtctataatatcactgtagtgggtattgttcacacacaacgattaatactgtaattaatgctgaaacttggactacacgacactcatatgttttattgtttcacacacagcagaagaaataattggattttttttcggtccagtgattgcactggtttgcagaaaaattcttaaacgataaataaaccatgttcatctcatgattacttaatcgtttgagaaaccgtgacatatggtggtaacaaacaaaaacaaacaaataccaaccggtaaaacatatatacagtattttatacataaacaattttgtgattttggcaatcaaataacaaggaccacaatgacgctcgcgaaatttaattaaaacggggaccaattttaatcaatttgacccggtgtacattaatcttgacatgcatttatttacgtgtgatgttgacctcttggtagatacagtactacatttatatatttttgatgcaacacataactgtttagtgtttttgatatttcctttttttatcagtctaactctcgtgagtcgtgagtcgtgagttgtgagtcgtgatccattgggattattactacgtagtacatgttaaactacatatataaggattccataaatatgaatcaaatcgaattcttcttatataactaagacattaaatgtctacttgcacttcattaaaaagaatcttctgattttatttttggtatatgcaaaattataactgcatttaaaacagagattagatcatgaaacgaatattatttctgaaaaagtaggtatatctagtaatgttaatttattttttgctaaggatatctagtaatattttatatgaaacacttgtttttatttatgtgttttgcgcataaagtcaatattataacgaatcactagattagttttatttttatcttatagattagtttaataagcctatatctataagatgtactatgatcagagaaacattaggtgtaatgagaaaacaataataaaacggtcatatataagtaaatccaagtcagtgagagacctgcaaaaatttcgaactttttgtgaatgtcttatagcaaagatactattctcccatctgatcatgtttccatagatattagttaattggctaataatacaattcttcacacacatcacatgatcgatatgcgtaatctcacgtcacaatttccgtcataatcaaaaggagtaacagaattagtatattatatagtttctgtgatctagcaaagatttaaatgtaaacaaaactatccagatttatatggttttgttacgtttctttgaagatcaatgtaaacaatgatgaaccaatattagggtccacgttgaatataaacgtgaaaaacgacaaagcgacgtcagcataatttacgaataggaaaacagtgttaacttttgttatcacattccgtgcaatttacataggatatagaattttttatttacaaaagttatatttataaagaattactcaaatcaagaattccataaaaagataaacactttcatatatcgttcacaatcacatggccttttcaaaaaatcaatcttttagttctctatcgatgcgtaggcttgaagcatg

SEQ ID NO: 15138 - DNA, 3000 bp, Unknown
  misc_feature (1)..( 3000): cDNA_ID_3094495_gDNA_ID_2926057_Annot_ID_196149 3000 nt of promoter + ATG
gtcaatgaataagctaatgctgttcttggactagttatttaggattgaaattgaatgatcttgttctacggatttaatgcaggtagccatagactcttgctgtgcaacttttgcagaagtacagaagagaggggaagatttctggtcagagtttgagttatatgctgctgatcttttagttggtcttgtggttgatgttgccttggttggacttttggctccttatgcacgtatcgggaagccgtctgtggcatcaacaggtttattcaaggatcttaaacgtgcttgtgcatcccttcctagcaggtaatactgttactgtatctctctcgtttttttcacttttgtgttaactgttcccactgatatctatcgagctggtggctgtgtattcgggatgagatgtacttatacatgcttttttttttgtacttctgaagtgtttttgaagcagaaagaccgggttgtaaattctcagttaaccagcggattgcaacattcttctacaaggtatggagaagaactattgctttaatgtcctttgtggatcttgcttacctttggtttgattaattgatgtgattcttggtccagggcctcttgtatgggtcggttggattcggctgcggcctcattggtcagggaattgcaaatctgatcatgacagcaaaacggtattctttcaccatcgactttatcttgctacttttcaatgatgaaatgaatcttctgactgtttaaaaaactgttcttcactgaaatttgaggttacctttgttaataggagtgtgaagaaatcagaggaagacgtccctattccacctcttttcgaaagcgctgctctctggggtaagctttacttttgatctctaactatgttctacagaatcatcgatgcttttcccctctgatgttcactgaaaacgatagtcttgaaccgtcgatattgtgttgtctactctttttccgagttcttgtgatcagccatcggtttcttaaccgggcttagtttcttagaaaggaaagaacctgaattgccaatgataccaagaatagattatgcttacaattctatgtgaagatattagctacattgtcctgttgttagcaatattagatcaatggagagggtaatttagttgctgagctcagagataaccctgaagtttactctgtgaattgttgattacatatacatatatattcactctcttctctgtattgcgctgttgttcaggtgtgttcctcggcttatcttccaatgcgcgttaccaaatcatcaacggcctcgaacgcgtcgtggaaggttctacagcggccaaacgtatccctgtggtcgctatggcattcacggtgggagtccggtttgctaacaatgtgtatggcggtatgcaatttgtagattgggctaaattgtccggcgttcagtaatcaaccggttcggttttgttacaaaccggatagtaaactagcctagatgtcaatcctcaggagtatgagagtatctctaatctgatggggaagtttagttatctgagtttcattagtgtgattaggttatttaccgagagctacagaaagagaatctggttcatgatacggaccggattcttctaaccggaatactactcgatacaacattttcaatttggttttggaagttgagtttctcatggtatccttgtctctcttattcatttttctgaatcatatacttgcaataatgactcaaactttttatcagccgttagcctctgcgtttttataaagtttataacaatatgatcacaatggcgaattatgtcaactaaacgtcatttttgacgtttgcgttgattcattcttctgtgttttttttttcacttttcccaccgttaaaagtgagaaggggaaaaggagaattgttggtaggtggagatattaaaagtaataaataaaaatatttaaagcaactatgagtgagtatattacaaaaaaatctttcgatatttatttgcaaggaaaatattcttaggatactttgatggtaaggcatcattcgatagatggaggatcttgcgagtgacagcttagtaaccactgtcatccaactgctgcatgatcctcatcttttgttctcttgtttctgttttgtgccccttaatgatattttatttatactcctttacttaatttgaacaatttatattatatgccctatagattaattaatgtgaataccaaatggtaatcaaaagctgacgactgttcaaaggaacattgtcctcccaaggaaggtgaatcatttgattaatcatccctacgttgggaccataacttgacctgaatttaaaatccggttttttcatggtctcatggtatggttatgtacttatgttatactgaaataccaattgaatacataaccgcggtgaaaaacagtttaagattttgagacagattgtacaaacttcgttttaatggtgcagtcttttgagaaatggccagctttcttcatttttaatatataaaattagtttattccatgtttatttttcgaattactcgtttattttttgtatttctcgaacttgtaatcttaaattcgtctgtttagctcgttttaatttttgtttttttttgtaaactcgtgaattctgtttttggacgagtcaatttcgaattttccaaattcgcatgtgttcaaaaatcaaaacagacgaaactgaataacacaaaattgaatagtcaaagttgtaaataataaaagtcgtccctcgtctcttcccgcaggcttgtctctctcttctccaaagatcactctctcctttttgaatttcgtccattggaggtgtcattttccgtttctagattagggtttcgatctcagctctcgcgaattgctaatccttcagctgtggtctgcgctttctgtcatagttagatccggtttcgcgagttcggatctgcgccgtgtgaggcggtggaggacggtggatctgaggactctgttccaccatg

SEQ ID NO: 15139 - DNA, 3000 bp, Unknown
  misc_feature (1)..( 3000): cDNA_ID_3094514_gDNA_ID_2926058_Annot_ID_196158 3000 nt of promoter + ATG
acaataatcctaatgagcttgaactctccgttttattgaaattttctccaggatattgaattgtcaaaggaaatcaacgagtcattcaaacaatcttcccaggccagaacaaaactgccatcgggaattgagatgagtgtccacgttttaacaacagggtatgtacaatgtatcaattttatccaggatataactgctggaatgcggatatcatgacatatataaagcttgttaacttcccgtctataatacaggtactggccaacatatccgcctatggatgttaagcttcctcatgaactaaatgtctatcaggttttactaaaagttcttcttatgtatttttttttgtttcctcgttggacgttttcttacaagctttttctaagctatctgtatgtttcgtaggatatcttcaaagagttctatttaagcaagtacagtggtaggaggttaatgtggcaaaattcattaggccactgtgttttaaaggcagatttctccaaaggtaaaaaggagctggctgtttccctgtttcaggtcagtcaaattttttttcccccccccccccttttaagctctttcctgtcttcccgaggttacagtgttaatcaattgctcttttctttttgtctcaggctgttgtgttaatgttatttaacgatgcaatgaaacttagctttgaagacattaaagattccaccagcatagaggacaaggagctgaggaggactttgcagtcgcttgcttgtgggaaagtccgtgtcctgcagaaggtttggccaaaatctggactctgttaactctcttttcagctaatgcagaaactgccgagattatggctttgcctttttccataaggataagccttattgtgtaaatatttttgcagaatcctaagggaagagatgtagaagacggtgatgaatttgaatttaatgatgagtttgcagctccgctgtatcgcattaaggtacgttggtttttttcttggtctcttcacttaaagtatcctagaatcttgtgatactgttttgtatgtagcttatagtgaagcaattctttcttttgttcctgggtgcaggtaaatgcgatccagatgaaagagacagtagaggagaacacaagtacaacggaaagagtattccaggaccgacaataccaggttggtttctgctctccattttcctttacgatactaatttctgaaatcgttcttacaactttggcttcttaaacaagaaaagattttgacaaaatggttttccccatcacacccttctcttacagatcgatgcagccattgttcgtattatgaagacaagaaaagtcttgagccatactcttctaatcactgagctcttccaacaggtaaatttcactcctgcttgatgattttaaaatccgaaataacatgtcggtttatgaaaaaagaaagcatgaaattcgttactaggtccagtcctattggtaatatactcgtgatgatgattagagttctcagtagtctactaaatttaatataccattgctatgaatggatatatgtttgtgatttgcagctcaaattcccgataaagcctgctgatctgaagaagaggattgagagcttgatcgatcgagaatatttggagagggaaaaaagcaaccctcagatatacaattatcttgcttagaatctctttggtaaacacaccttttgaatattttcctttttgtatatttattgacaaacaaacgatgaccgaaattttcttatcagtttgaaaaaaaaaaagaactctcgatattccaatcatctctattctcgctgttccgcccgttcttatgtacagccttaagttctatttcttactttgattcacttttcctcggttctcactttttttttttttttgaacatactttcttgggacttctttgttttcagatttttatacaacttaaaagatgtttttgtttccctacaaaaataactgatttgttttaaaaaaattcaaacttccaataaagttcctaagataggttatatatcttcgagggttttctatgtgctgattccattttgttttcgtttttgagttttatttgaatggagatagttcttagagctttttcttcgtttttaggcaattaaatcttaagtttaatcggatttttttttacactacattataggcatttctgtttttaccactaccaaataactaaagaaagaacagagagaatcaaattgcttacttgatgaacgtccctaacgacatttaactatggctgatcaatattgtacgcaactgaaagacaattgaataaaattcatactacggtttgtgaaatagttaaatgtatctacacgtacatttaagaaaaatggaaatatattgactcatcgtccaactgcttcaatctagtgactccacagctttttagttcgggtttcatactgtagtaggaaagtaaacgaactatgtaaagaaaattggatttcagaaaaaaataattatttgatgaaaaaaaaattgaatgaaaatgttgtttacgaatatttttgctagtcaaaattaaaatatttataaaatttatttgtctttagctaaagttgatgagacatgagaggtagctaggaagaaggattgtttgcctacatatatgatgaatgtttgtgagtgattttaatgtagccatatcaaaagaaacaaaaaaactaaaacccttaaatagaaattcaattttgaatgaaactgtcgtttacgattgatttagttattcaaaatggattttgttagtcaataacaaaactgctaacgatttaattccccctttcccttaaagacccgcacctacctatatggtttaaatttgtttcatagtttgtttagccgtaaaagacgggtatttcctatttttgtaaccaatgcaaagcctttttaatcaaaagcaaaaaaataaaaacaaaagagaagtaaacagaagctctatagaaaaaggaaacaaaaaatg

SEQ ID NO: 15140 - DNA, 3000 bp, Unknown
  misc_feature (1)..( 3000): cDNA_ID_3094505_gDNA_ID_2926058_Annot_ID_196160 3000 nt of promoter + ATG
caattttccactgtaatttaacatcaaaactcacacaaaacttccatcaatcgcaagccaatgaaaaccctaaaaatcacgaaccttaacaattgtatcatttcaaatcaatccagagcatcaattgcacagtagagtaaaagacccaaatcaaatcctaagattacgatcaaaatcgtaaagatgaaagaaatcgaaatcgagcgaaacctttattgagcttgattacaaacttcttagtaggttgcggaagtgtagctttcttccgagagagattagcggcggcgggagttggatcttcctccatatgaaagccaacaaccttgtcggcggtattagggtgttgaggggaatggtggaggtcgtttttggcctttttcatcggaggagaagagtaagaagagtcgtcggaggcagaagcggcggagaaagtagagcgtttggtaggaagagacatgaaaatgggtgaaaattgtgtgagagaatcacgaagaggaagaagaagacatcaatcctaaataataacaaccctttctctctaccaaaagcgcactgtgcactctctctctttttttttttgctcaaacctacgcgaaaactcgcgatttagacccgacccgagaaatgaagattttttgtttatttatatactctgaataaaatcagaattattttatttatacattcataaatcataattactatatgataaaaaaaatattattgataaaaatagacatataccgcaatgattagatgtgcgttgttttaatggttactaatcacaaaagtgaaaaacaaaaaaataaaaaataataatcaattgttgcctgttttgtatggttattttttataactacttttaaattttaactactttttatttttagtttttgacaactgataaatcatatctattgtatatttttagagtcgaatttttattaagtcattttacgatttaaagaataaagaatcgatcacacgagtcgatgcttgatatttagatcatttttgatatatatttttatttttattttaaagaaaattgagttgattttttttccatatatttcttttattttttaaaaaaaactattttaaaagaatatattagaataaaatgcctataaaatagactcacctataacgtggagaatggagataaaaatagagatgattaaatacttttagcagtcggtaatttcaggcagaaaattgtgtgatgttaaaagacatgaacgaagaatcatcacttgacaatatgaataaatataatatgatcgatgtcatggattagccaatgtggggcgtgttgacttgctgctccacagggtttttggacttccggtttagggtttggttctgattacaaaatatgggcttatcaaattatttacaggagttaatactttgggcctgattacaaaggtttaaccgaagcctatcaagcagataagagacgagatgagattgttagagcatctccatcggcaaaagtggtagagagtatctcaaaaagtaaataaattaatattttaatcaaattaatatattttaattagtttgaagtaaatgaactattaattgaatgacaactctcaataaatgctgagaatagtctctcttgccagtttctccacttttctcttcttctctcatactttttctctttttaattattatttaattgatgagtatctcaatcagatattccgatggagatggtcttacaagtgttaccgagacgtaccaattggcgaactcatataacttgtgctgttgtgcgaatgtgttttgattagtgagggttcttgggccaaaaaacatggctggtttttaagtcgcaattgcaaggatgaatattattacagccacagcctcaacgactgcatggtcttaaaactttttattacatgttgattagcctatggaattgtataattactaatacaaaatggtgttcattacattctcacctcgcttaaacttactaataatttttttttatttctttaatccctcattaacatgtcaacacatttattttttctttattcatgtttcaagactatagaatttctcaattaatcccaattgatactaataatagcaaattgtaagtctcttggatcgttggatcaatattttcacatgcaaacatgtgaaaatgaggagttattgaaaaattgtaagcttgacataaaacaaacaattgaacaattttagctttgaatggtttgtacatggaacactgattaataagattgcggattaaaaccgcttctgtttcaccatttatatattctaatcggtagtcatgctgagatataaaagtaaaaataaaattgttgtggactgttttttcttccaaaatttacatcgtaataaaaatagaaatcttatgcaaaaattataaagatttttttttagcttttactaaaaaataaaataagatttgtttttagtaacgctttaccttaaaaagctgctagagtttctaactttcagtttattatcatcagcacaaactcttatgaagatcttctatttcttcttcatcctcttcaacaccaatcactctcaccaaaaatgaataataaataaaccataaatctctcttttatccaatgggaaaattcatcacaaccacactatctccaccgctctatgcccgatcaaagcttctctgtttttcacttctctacttattcagtacaatctttctgttcctctacgtatctctctcaagaaaccaatgcatctttcgatattcgccatttgatccgattcaagcaaaacttttctcttatccttcttcttatggtgaacataaatatgctcttcccactcatcgatcttcttgttcttcccctattttcttttcaggtaattaactatttcttcatttaagaaaaataaaataaaactatttcttcatttttaatatttttactaaattttgatttttagataaaataaactttttgatcagtggcc

SEQ ID NO: 15141 - DNA, 3000 bp, Unknown
  misc_feature (1)..( 3000): cDNA_ID_3094509_gDNA_ID_2926058_Annot_ID_196159 3000 nt of promoter + ATG
taaaccagttaacatatttttattttttacttgaatgatgatgatctcaccggaattgctgaccggaaaatctctgaagaagccgcatggaacttcgacgtcaatgttcgaatgattgaaataagaaaatctcttctgagtactgaaatttccaccgaaactttcactttttccattgatatatctcaaattttcctttggtgatgaaccgctcaagatactctgtatctctttcaacactgtccaataatctgattcattaaaaaacaagataaacatattcaagattatttcaggaaaaatatatataataaagaatataacaaaaaaacataatgtgaaattccgtttagtcatagaaatttgagaaaatgtaggaatcacagtttgatatttttgctatttaaagcaattctagtggccagcaatattgaaactcacattgcgaatccatggccactgatcaaaaagtttattttatctaaaaatcaaaatttagtaaaaatattaaaaatgaagaaatagttttattttatttttcttaaatgaagaaatagttaattacctgaaaagaaaataggggaagaacaagaagatcgatgagtgggaagagcatatttatgttcaccataagaagaaggataagagaaaagttttgcttgaatcggatcaaatggcgaatatcgaaagatgcattggtttcttgagagagatacgtagaggaacagaaagattgtactgaataagtagagaagtgaaaaacagagaagctttgatcgggcatagagcggtggagatagtgtggttgtgatgaattttcccattggataaaagagagatttatggtttatttattattcatttttggtgagagtgattggtgttgaagaggatgaagaagaaatagaagatcttcataagagtttgtgctgatgataataaactgaaagttagaaactctagcagctttttaaggtaaagcgttactaaaaacaaatcttattttattttttagtaaaagctaaaaaaaaatctttataatttttgcataagatttctatttttattacgatgtaaattttggaagaaaaaacagtccacaacaattttatttttacttttatatctcagcatgactaccgattagaatatataaatggtgaaacagaagcggttttaatccgcaatcttattaatcagtgttccatgtacaaaccattcaaagctaaaattgttcaattgtttgttttatgtcaagcttacaatttttcaataactcctcattttcacatgtttgcatgtgaaaatattgatccaacgatccaagagacttacaatttgctattattagtatcaattgggattaattgagaaattctatagtcttgaaacatgaataaagaaaaaataaatgtgttgacatgttaatgagggattaaagaaataaaaaaaaattattagtaagtttaagcgaggtgagaatgtaatgaacaccattttgtattagtaattatacaattccataggctaatcaacatgtaataaaaagttttaagaccatgcagtcgttgaggctgtggctgtaataatattcatccttgcaattgcgacttaaaaaccagccatgttttttggcccaagaaccctcactaatcaaaacacattcgcacaacagcacaagttatatgagttcgccaattggtacgtctcggtaacacttgtaagaccatctccatcggaatatctgattgagatactcatcaattaaataataattaaaaagagaaaaagtatgagagaagaagagaaaagtggagaaactggcaagagagactattctcagcatttattgagagttgtcattcaattaatagttcatttacttcaaactaattaaaatatattaatttgattaaaatattaatttatttactttttgagatactctctaccacttttgccgatggagatgctctaacaatctcatctcgtctcttatctgcttgataggcttcggttaaacctttgtaatcaggcccaaagtattaactcctgtaaataatttgataagcccatattttgtaatcagaaccaaaccctaaaccggaagtccaaaaaccctgtggagcagcaagtcaacacgccccacattggctaatccatgacatcgatcatattatatttattcatattgtcaagtgatgattcttcgttcatgtcttttaacatcacacaattttctgcctgaaattaccgactgctaaaagtatttaatcatctctatttttatctccattctccacgttataggtgagtctattttataggcattttattctaatatattcttttaaaatagttttttttaaaaaataaaagaaatatatggaaaaaaaatcaactcaattttctttaaaataaaaataaaaatatatatcaaaaatgatctaaatatcaagcatcgactcgtgtgatcgattctttattctttaaatcgtaaaatgacttaataaaaattcgactctaaaaatatacaatagatatgatttatcagttgtcaaaaactaaaaataaaaagtagttaaaatttaaaagtagttataaaaaataaccatacaaaacaggcaacaattgattattattttttatttttttgtttttcacttttgtgattagtaaccattaaaacaacgcacatctaatcattgcggtatatgtctatttttatcaataatattttttttatcatatagtaattatgatttatgaatgtataaataaaataattctgattttattcagagtatataaataaacaaaaaatcttcatttctcgggtcgggtctaaatcgcgagttttcgcgtaggtttgagcaaaaaaaaaaagagagagagtgcacagtgcgcttttggtagagagaaagggttgttattatttaggattgatgtcttcttcttcctcttcgtgattctctcacacaattttcacccattttcatg

SEQ ID NO: 15142 - DNA, 3000 bp, Unknown
  misc_feature (1)..( 3000): cDNA_ID_1388571_gDNA_ID_2926059_Annot_ID_196165 3000 nt of promoter + ATG
aagaatagtaagatgcgaaccggtgatgaacttcaaggagatcaatctttttcaccattctatcaatttccatcttcagctcctacacaataatacaaccccaaaaatagtcgattaccatctgaattaatacatactgtacattttttttttaaataaatgaagaaactaacataaagaatatatatgaatatagagaatgaacctgcaagtatcgttctacttgaggcctctctgccacatagaaggcattactaaacttgccatatctatctataatcttctccatcctgaaaagttaattcacaagaagatatttgtcagtgatgaatgatgatgacggatcataagattgaaatattatggacgaatattcttaatatatatatatctacatgttatcttttataccgacttagcttctatgatagatttgtccaccaatattttgattaatgtagatgtctataatttagataacactcatacaatcgaatacttttaatttttgcaatcaccaaacctagtgaaggaaggtttttgctgcacaaagattgttaaacatgaaatgaaaaatgaaacaaagggaagttatacaaaataaattatactctgtaaagattgtatagtactaatctttaaaccaattctattaaccacaaaacaaaagggatttataaaatgaacaatgtaccgacctcatgattgtaaatctagtgaaaaagtttggatgcccgagatattttttaaatcttctcatcatgcattatatttacaatttctgtacttaatgtaactacattttcggatattcatttatgctggatattctaataaaaccagatgccaagtgggtgtgtgggtaacagtttaagttccaaggaatacgaggttcactgttcaagaaactttttttctgaaaaccctaatacaatccacttgctcgtgcttgaagaaactctcttaagtagtaaaaattcttaagtttgcttaaataaaatccagaagctaagtacttacaaaacttaaattctaaaattagaatgtgacaaggcattgttgggcaaagtcaggaactagctagcaccaaaagaaagggggccaaatctttagcgcctatattattgcaaaatctctagtacgatttaaccagagatatattatactattcactacagaagttctagatactcaacaaatctatgtgtagctagagaaagattttggaaatagacatgtgtaaatattttgaaataatttgatgaaagaatatcttactgggagctagagtattcgtgtaatcttccgctctgagaaaagacaatggcggctacttgagcatcgcatagaaccgaaagctcatgagccttcttaaatagaccgcttcttcgcttcgagaacgtgacttgtctgctcgtcacgttctcaatcttcttgatctcgatcttccctctcaccattgttcctgcgatattcattccaagattcatcagattgaaaccctaactaaatccggaaggaaattttcactcagacaaaatcaagaaatgatttcttgaaaatcgagaaggagatttcaaagccagaagtcaaagatgataacttgaataatgtaagaaactcagaagatccaaaaccagatttgtctagattcacttcaaaagctacatagaacatacttttttccagacgacaatcaaccgacaaagttaatagttttagagaggggtataatttgcacatcttaactatcaagaaaaaatatatttgcacaaagaaagaaaaggaacaaaagcttaataatggtgaaaaagaaaccctagaactaaaattccggaaagaggcatgagctagatcttatgatgataaactctgtgtttacctctgtgcctctttgtacaggagccacaaaccctaagtctaagctttgctttttgtgttctgattaattggacagagaaaagggaaaaaaaaagaagaaaagagatttttattttcttcttttggtgatggtagttggattaataattgaacaacaatagagagagaatcattcaaaaaaacacaaaagaaaacaagtgagtcccagattctgattaaagaaatgtccatgactttatctgtttttggtaaaattaagaatagagagcagaaggaaaaagagttgattagctaaaaaagaaacgttaattgaatataatcaaggactaatttctaagaaaccggtgattatttgttttttaatttggacagaacacaaagagtgggtgggataataataataataataatacatctaaaagaatagtgttcttcgattggcgtgtcgacatcatcgtacactgacgtgcattgttaaccaaatatatgaagacacgtatgttttccactttccccaaaatcacagtcagcttctgtgcaatgtgacctcgtcttcatcagacaacacacagattcctttttcctcttttacatggttctttgttatgtttagtaatattcctcttttctgttgagtgttgaaagaaatatgataaagagtatgtgtctaaacataacaaaaagggaattcaccattgtgtcctaaatatctaaatcgtgataagggaatatgaattcttctttctccattttgttttggtcgtgggacttgatcaacattgattttcttttatactagatcgtaagtcatgttctttttgttttttgctaagccaaaaccaacgctttatcttttgcagtcatgtaaagtcaaacatgatccataaaagaaacacccttgtagttgggtcatatataattttattgggcttgaatatacaaggttgggctttaacaaacaattaataattgggtcttgagaatgatttttctttttgtcaaaatatatatatttgtcattttgaatttaactaaaataaattattataaatgaatttaacaaatttaatttccctgaatctgatcttaaatcctcctcagaaacccagaaacgcgaag

SEQ ID NO: 15143 - DNA, 3000 bp, Unknown
  misc_feature (1)..( 3000): cDNA_ID_1580305_gDNA_ID_2926059_Annot_ID_196166 3000 nt of promoter + ATG
cccgtgaacttggtcacaaatccgacggagaaacgatacggtggttattggaacgagctgaaccggcgataattgaagcaaccggaaccggaactgtaccggctattgctgtatcggttaacggaactttaaaaatcccgacgagctctccagtgttgaatgacggcggccgtgacggtgacggtgacctaataaagaaacggaggaagagaaactgtacgagcgatttcgtagacgttaatgacagctgtcatagctccgttacttctgggttagctccgataacggcgtcaaactacggcgttaatatcctgaacgttaatacacaggggtttgtgccgttttggcctatgggtatgggtactgcgtttgttactggtgggccggatcaaatgggccaaatgtgggctattcctaccgttgctacagctccgtttctgaatgttggtgctagaccggtgtctagttatgtctcaaacgcttcagacgctgaggcggagatggaaacgagcggtggcggaacgacgcaaccgctgagggatttttcgttggagatttatgataagagagagcttcagtttttgggtggctcagggaactcatctccgtcttcatgtcatgagacttaaggaattttaactcttagttctagtttctttttagtttttagtaagtttgattcctgatttaggttaagtaagatttgtaaaagaattgggagcacaatttcaattttatgtttctgtcaaacattttggtaattaatggaactatcctatcatttttaaaaaataaatcaaaatgagattaaaaatgagtctgctaaaacgccagaggttgagtctgctaaagctctcgacacaatagtagaaggaataatgtataggcacgttaaacctagattctcgtggaagctacaaagctggatcggagttgggatggagaagaagatgatagaagctggtgccatttttgatcgagtgtgtgggaaatacatatcagccaggagagaagaggtaaaaagatcacaagtgaataataatgatcatttcattagagatagtcatgcaaatcttttgacatctcacataaagcttgatacaacccagtaccagctcttggatcctatcaatgataaattcttaagagacaatgtctttgctttacttctagctgggagagataccactgcctctgctctcacttggttcttttggtttttgtccgaaaaccctctagtggtgaccaagattcgccaagagattgacatgaatctaccaagaagttgtagtggccaagagagaccatcttgtgatccaatggagtacttaaacaaagatgtacttaaacaagattttggtctttatttatggggtggtgggtaggatgagagctgtatggggagaagatgcattagaattcaagccagagagatggatttccgagaccggagagttagcattcaatgccggtcgagaatatgccatggtaaacaaagagctatggttcaaatgaagattgtggcggtggagatattacaaaactatgacatcaaggttgccaacgggcagaagtttgagccagatactagtttaattcttaaaatgaagcatggctttaaggttaagattaacaagagatgttcatcttgatattagtgaaataatcaagttcttttttaagttctatttcgaaaccatagcctaattaagagtattaataaggagacaagtttaagtgtgatctaccttgaggtttagtttttattgtagacaaattatagtaatggttttttaatgatttcaatgacagtttagaagaatgtaactctcgatccaagaatgataattcatgagttagtaaactgatgaaatcaaaaaagaaatgttgtttcaattattatactgtaccatttttatttctacgaattacgaaaccatttcttctctaccgaaactaaagtaaactaaaccgtaacaaaaaattttgtttctttgttttcaaccgtatccaaattatgtatccagttttttttgttttttttttttttttttttctcattgttgacaaaataagtaattttctaatttaaaattttcttcaaaaaaatttattataatatccgtaactacaatgcaaatagtgccgtacacgtgagaagcaaaacaaaaaagatgcagaaaaaaaaatagtaccacaaaatccttcaccaaccgtactgcgaagccaaggcaattgaaaccaaacactgataggcataactcaacagtagttacccttttttgaccatcttctcgtttaattctcttctttattcattttcaatcttactctatccacacacacacgaacacatcaaaatgccaccattttacatctgatttttagtcttcattactcatatttaagcttaagttaataaccacaacaaccaccttttcatgtggtttatttggcaccatccgtattctaaaccgttcgtgttctttccttatttggcaccatcaagattctatttacaatattttttttcaagtggcaaaacaaaaacaaattacaatttttataaattaattgagttaaagaaaattacttccaggttccattaatgtatctaaaaatatttaagtaaaattttaattacaataacatccatttattttatataaaaattttaaaaaacgttttaatagattcttttaatagttaccaaaaacagattctgtccagctcttctgcaccaaagtacatgcttagactcaaagtacgattttagggagaaaagaatttgaatactggaatagatacatgtttgttccaaataatttgagtaactttaaagcatatgttatacacatacacattttctagaatattagcctctcatttctctccttatataagccaaatagtccccgcttcttctcattcatcaaatcctcaaacaacttcaagaacaaagagtgcttttcgaggcccaaaacacattaccataaaatg

SEQ ID NO: 15144 - DNA, 3000 bp, Unknown
  misc_feature (1)..( 3000): cDNA_ID_3094565_gDNA_ID_2926060_Annot_ID_196174 3000 nt of promoter + ATG
cacattatcaacctttgcatagttgaagaagcatgcaatgtgaaggaatagagatttatcattcgtcaacaatctgtcatatccgattcgtaatatgtcatcgatatccctatcaagactagattcgatcctagataatagacgttcccactcttgattgccctccccacgcaaagatgcacccacgacacaaaggcctaatggaaggttgctgcaaagcttagctactttattggcaagctcttcaaaaccatctggtatagagctttgtttgaatgcagagagacataagatctcaagagcgtctttcttcgatggaaaatccacacggtagatattgtgaatcccatgtgccttcaaaatcttcttatcttctgtggtaccgatgattcggcttccagaaccaaaccaagagatttctttagccaatacctctaattgctttagatcatctacatcgtcaagaatgatgagcactctttgatcgtgtagcctttctcgtattgcgcctaaatgatgtatcttcatattctcttccttaaaaatcttagacagaagttgcttttgcaacctcaacttggaatcatggtcagcaacacccttaatacttcccttgaggttccccataaaacatttatgttgaaaactgctagagagtctgtcgtcgaataaagctctagcaatggtagtcttaccaattcccgctggaccccaaattccaatcatcttgacttcatcactttccaggcataacaaagagttcaatcttttcaagtgagcttccatccctaccatcccctcaaaatccctcgacggtgtgagattcagtttgtctgaaacatctgtagcaatcttttggatcatctttgcttcattatccctaacaaaagcaaaaccaaatagatttggttggtctaaatttacaaaaacaaatagcttgagaaaaataaaaagcattaaaattcatcgagacataccaattaagagagtgttccccagcaatggtagcgacatgtgccaaagcatttctccatcggatcttcacctcctcatttttcccttgacaagtcttctcaaaagctttcccgaacactccactctgtttcttaacatctgacggatcaacttaaaaaaaaaccgtcatcacaatctgccccaaagcttctttgcacttcaagatttccacaagttcatctaaacaccagctggaagaagcgtaattcttcgagagcacaacgatcgagactctagcttctttaatcccttgtatgagctcaggtccgatcgtctggcctctctcgatattctgatcattgaaagtcgtgatacctttgcttgcaaagagactgtgtaaatgactgagaaaccctttacggacatctggaccgtggaagcgcgaaaagacatggtgtctccttatgtgagacgaagaagatgaagaagaagaagaagccatgagagatcacaaatgcttgcacgtgaagaaagtatttttagaatgatattgaagaaagcatgattggaaaagcaagctccgatccttcggtttatttattgaagcaaaaacgcgtaaaaggagaagagaaatttcgaagaaaagtttggacgactctgtgtttcgttatagtcgtcgaggaccaaaggctagtttcgtacagattgtcattttccagtgaaatgaggtcagagttgaaagtagcatactcaagttggaagaagacgacgaattatgtggggattctgttctcaaccacatttttgtactttactttcttttaaatccaataacaattatatcgaaatgaccatgtgaacatcaagaaccaaactttctttgcaaagtttgcaaacgttgaaatttgatatttgacttattcaacaagaaactaaactctgcttttggtaatgatgatgttggatgtttaatttaggtttatccctgccaatttctttttgttgttgtttgttaaagccatcttttgaattatggagtttaattagcgtgttgcttatttttcaagaccttaacagcttctgtttcatagtctttactgctactacactaaaagagaagttatcacagaaataacgaatttgacaactgaaattgagctcgtaactttataaacgggccgagcctgagaactcgttttccgtttactggttggttaggttattcaacttttttggacctttttgacaaaaagaaagttcgcaacaaattcgttcaaagcagtaatttatcttgacgcgtcactaaaattttgatcatcccaccttattacacatttaataattagtgctgaggaaatctccagatacgtggatattttgacaacgtgaaggccataacataaatactatatggttaaataaacaaatactattaaaaaatgtaatatacaacgaaagtcgcgggaacagtacacatcatatatgggactccaagtaactcggacatgttttcaacgatcaaaatacaccaaaaccaaaatcaacattttacaaaaagaaacaaacaaatattagagattttcttagcaaccaagaagaagacaaaaacaggggaaaatagacaactctgttttgttttgttttcttcttctgaattcctctgctgctttcaatttctcttttgaatctcttgtattgatcggtgagagacattctacataaccaatttttcaacggttgattttctttttattaagtttttcaatttgagatagtgtttaggagatttgctctgttttgcttcgggtatgatatgcttttgtatgctcgattcatcgatccttaaatcataaaggatcttcatttcaggtttgacctcaaaaccctaatgttgcttcttcttgatctatatacatcttaatgttctttggtctcattttgattgtttttgttttccagcattcataaatctcaagtcttgtggaacaattatttgcgttggttttattgaaagaaagagatttaaggattttttaaacactgatg

SEQ ID NO: 15145 - DNA, 3000 bp, Unknown
  misc_feature (1)..( 3000): cDNA_ID_3094555_gDNA_ID_2926060_Annot_ID_196176 3000 nt of promoter + ATG
tccctcttctatttctaatctacacaaactggagattctagatgttaaattctgctctatgctacaagttattcccaccaacatcaacttagcatctcttgagagactcgacgtgagtggttgctcacgattgagaacttttccagatatctccagtaacatcaagacactcattttcggaaatataaagatagaagatgtccctccatcagttggatgttggtctcgtcttgatcaacttcacattagcagccgaagcctcaagagattgatgcatgtaccaccatgtataactttgctatctctgagaggtagtggtatagagaggattacagattgcgtcataggtctcactcgtctacattggctgaatgtcgatagctgcagaaaactcaagtcaattctgggtctcccctcctccctcaaggtcctagatgcaaatgattgtgtatcactcaagagagtacgcttctctttccataacccaatgcacacactcgatttcaacaactgtttgaaactggatgaagaagcaaaaagaggaatcatacaacgatcagtgtccaggtacatatgcttaccatgtaaaaagatccctgaagagttcactcacaaagcaacaggcaaatccataaccatccctctggcacctggtactctctctgcttcctcaaggtttaaggcttccattctcattttgccagttgagagctacgaaactgaaggtataagttgtagtataagaaccaaaggaggtgttgaagttcattgctgcgagcttccatatcactttttgcgtgttcggtcagaacacctgtttatatttcatggtgacttgtttccccaaggaaacaaataccatgaagtggatgtgactatgagcgagattacatttgagttcagccacactaaaatcggtgacaagattattgagtgtggtgtacagatcatgacagagggagctgagggtgacagtagcagggaattggaagttttgaaactgagagtagcagcagcccagttgggagatttgttgggaaatttgaatttggaggcaacaacaatcaccacacagatggaaatggagatggaaactatgaagcagaaggttccaagttctctcaagatgaaaacatcaaaaccagcaaacgttggttttatgagttggcttcggaagcttggtcagtgaagaagatgaattctcatggagtctcatgaagaccaaaccagtttttggcactttcttagctccttaatcatcttcataaggtactctctcttaaataacagatggagatggagaatatgagcctgaagctgttaagctctgtaaatgtagatgaaaacatccttggttgttggatttagtttgggaagtttaagggtagacgaagaagtacaaaacatgcaacttaggtcgtaggtcttcccattaaccagcataagtatttggcatacactagagaccagtttccttaatttctgttgttgatgtgttgtgtggattgctgtagaagatatattgctctgttctttagtcgtcgcgaattctttgggaacaatcttaagagatggatttatctgagtttgcagagtgatgttagaattgattctggttagaatgtagattgccttagccatagaacgtaaacgttagaagcttatgtgaatcaagctatcaacgcttaacattatattctttctgtttcaggtaggagattgggaatttcgacgcagcacctgattctccagtgatcaaatctaagtccacacaaagagaccatattgtccaatcagttccagatacttggtgcattgccttctgttgtgagcataaaacggcaaaccctatgaaagaaggttgatagcattagagaaaacagagcattgcagctcacacagtccacccatgaactgatgatttttccggattgattgcatcttagaatcataatcctgtttccattggccttaattagctgtttaagtactaagaaaagtcttgttaccttgtgatctagttaattagctgtttaaatactaagaaaaatcttgttaccttgtgaattacttaagaatcataatcttacattagtgagttactttatacagtctacaattggccttgaacttacattcagggagtgatatggcggctgagactggtctataaaagctgctcctggttcaagcctcctaaaatggtcatttgaatgaatcttgtattattgattcgtgtttttactttctactttttagtaattactttttgccagattgattgatcttataatcataacaattgtaactctgtaataactttcttcaacatctcttttactatgaaaccaagaatagtagcagcaaccaaccaaaccaataataaacatcaaatctttaagaaataatattcggattacccaaataatcaaaccttaaggatggggtctcaacgacttttgggggaaacattttgtttttgtatttttctctacagtgacaaattcctttgaaatttcagttccgtatatagcttatccaaaacatcaaattaagcatcgtgatccataattagaagcttgtcattcccaaaagcagaatttagtttcttgtcgaataggtaaatatcaaatttcaacgtttgcaaagaaagtttggttcttcattcttgatgttcaaatggtcaattcgatattattgttaattaacttaatacaaatattctccttttcaaaccaaatattcaataataatatgtacgaaaatagtcattggtcctcgacgactataacaaaacacagagtcgtcgaaatttctcttctccttttcgtattttttcagttccagttacattccaatttcttcgaaacttctcttctcattttacgcgtttttgcttcaataaataatccaaaggatcggagcttgcttttcaaatcatactttcttcaataccagtctaagaatactttcttcaagttcaagcatttgtgatctctc

SEQ ID NO: 15146 - DNA, 3000 bp, Unknown
  misc_feature (1)..( 3000): cDNA_ID_3094560_gDNA_ID_2926060_Annot_ID_196175 3000 nt of promoter + ATG
gtttgatcagactaacgaggtattttggtgaagggaaagggaaaagaggtctctctcccattctaatattgatagtcattggttcaccttgaagatgactatcttcaaatggaactttacctgttataagctcaaaacacaccattgcaaagctatacacatcagctttatgcgtcaacttagatttcggagttttaccattcaggtcttgttccatctctgctagaacttcaggtgcataccatattacaggatcaggagtgcctggtttcgaggaagactgcgctttaacgactgaagataaaccgaatccacaaatcttcgcatggaagtaaccttcggtgtgactcctctctttcagatgaatgttcattgggtttaaatctccatggaagatatcatttccatgaagatactccatcccccttgcaatttgcaacatgatatcaatcaccacagggatcgagaacaaatatcttcttcttggtccacaattctccttcatgtagctctgcaaatctttgtgcatcaactccataaccaaaaaacattctttcctttcttcatcatagaatccacaaaggtactgaagtatattcgaatgacaaagcgctaaaagagacgagatttcagaacttagcggctcaagatcgctgaaaaagtgccttagtgcaaaactatcacctaaccattgaatctccttgtattgtccatctgcatctaaccgtttcttcacctggtaatcctttgaaccaagaagtatcgaactaggaaacagtttaccgttaaactgctccaaaccggttaacttcttcaacagcaaatcagctaaacgcttctcggttttaccaatatcatcgctatccgatttcctcttctcttgcaatgcctccactagattccatctatcttctctccaagaatgctcaaaccggctgcaaatatctctcgagagcaaatactgtttcccaaacctccattgaaacatcttaggatcattccactctctatcatactttcttgaaaacacaactctccttctctccatctcagaagggtcaagacccgaaatctcaccagcagcctcgatggcttcaacaaccgcagagaaataacagaacaagttgtgtatatgaaactcaacacaatctttgttctgatgaagattgattactttaccccaccaatcactattatccatacaatgcttaacatataactctccttctttaaaaactctataaagctcccttaaaggttgttcaagagctctccatttagtatgcttctcttcaagctttagattctgtctgatctcttctgcgaccgtgttgaaagctaagctgaagagttctaacaacaaacaacattgtctttggttgatcaagatatcatcttgtaataccattagtgcatttagacttccaagaacttctccgatttgtctgaattgctccatcagtgtttaaaaaatccttaaatctctttctttcaataaaaccaacgcaaataattgttccacaagacttgagatttatgaatgctggaaaacaaaaacaatcaaaatgagaccaaagaacattaagatgtatatagatcaagaagaagcaacattagggttttgaggtcaaacctgaaatgaagatcctttatgatttaaggatcgatgaatcgagcatacaaaagcatatcatacccgaagcaaaacagagcaaatctcctaaacactatctcaaattgaaaaacttaataaaaagaaaatcaaccgttgaaaaattggttatgtagaatgtctctcaccgatcaatacaagagattcaaaagagaaattgaaagcagcagaggaattcagaagaagaaaacaaaacaaaacagagttgtctattttcccctgtttttgtcttcttcttggttgctaagaaaatctctaatatttgtttgtttctttttgtaaaatgttgattttggttttggtgtattttgatcgttgaaaacatgtccgagttacttggagtcccatatatgatgtgtactgttcccgcgactttcgttgtatattacattttttaatagtatttgtttatttaaccatatagtatttatgttatggccttcacgttgtcaaaatatccacgtatctggagatttcctcagcactaattattaaatgtgtaataaggtgggatgatcaaaattttagtgacgcgtcaagataaattactgctttgaacgaatttgttgcgaactttctttttgtcaaaaaggtccaaaaaagttgaataacctaaccaaccagtaaacggaaaacgagttctcaggctcggcccgtttataaagttacgagctcaatttcagttgtcaaattcgttatttctgtgataacttctcttttagtgtagtagcagtaaagactatgaaacagaagctgttaaggtcttgaaaaataagcaacacgctaattaaactccataattcaaaagatggctttaacaaacaacaacaaaaagaaattggcagggataaacctaaattaaacatccaacatcatcattaccaaaagcagagtttagtttcttgttgaataagtcaaatatcaaatttcaacgtttgcaaactttgcaaagaaagtttggttcttgatgttcacatggtcatttcgatataattgttattggatttaaaagaaagtaaagtacaaaaatgtggttgagaacagaatccccacataattcgtcgtcttcttccaacttgagtatgctactttcaactctgacctcatttcactggaaaatgacaatctgtacgaaactagcctttggtcctcgacgactataacgaaacacagagtcgtccaaacttttcttcgaaatttctcttctccttttacgcgtttttgcttcaataaataaaccgaaggatcggagcttgcttttccaatcatgctttcttcaatatcattctaaaaatactttcttcacgtgcaagcatttgtgatctctc

SEQ ID NO: 15147 - DNA, 2518 bp, Unknown
  misc_feature (1)..( 2518): cDNA_ID_3094580_gDNA_ID_2926061_Annot_ID_196179 3000 nt of promoter + ATG
catttgaaatggatcccataaaatattagatgtagtaggatcaattcgtcacccatgtgatatgcacatacctatatagttaatggagatatattttagaacatgtatatactataaaactgagtggacattgtatttaaatgtagaagattgtaacttataaataggtatatgtatttatgaaaagcacagaggcgaacgattagatagttgtcaagacgtgaatgattcggtagttgttatagttgttagaatcaaagaaaggatatgtatgcattgtttgttcccaatgtggttaatcttcattgagagttgatcgaaaaaaaattatataataaattgtatatgtaattattctatcagtagttgaaatattttaataaaattaatatactatttgtgaaaaatataattatatactatctgaatttatcgttcaatgtttaatttgcattaccttaagcatcaatcatccattaaacgataataaccctgagaattgtcagttataataatgaaccatattgtttctagcatatcgcaaccatagagctatacagtcttcgtcacttttggggtccatgtccttagtcggataagatattttgactatattattatacgagcaaaatttaaattcatgagtcaaaaaatactttgttggcaaaatggttttgattggacaaacaaaagttacgcgaataaaagaagagtccatattggttggacaagaacggatcatattcaaatatgtaattaaatagtttatctaatcgttgatatatgatgggatttgacataaacaaagacgtaaaataaagggtcgaaattgtgatgtgggagacattttgccttagccttaaagaaagatttggtgattggaggatttctagggcttttctggcatgcaaatgggtttggccttgccatgcaccactgttctgactcctgtgcattgtcattccacgtattactataataccaaaataatattaaagacattcaaataaatataaatgaaaatattacttatcattataacaatattgtataatattttatcagaaatatagtgtaattgatgaattgtatttagtcaagtggttaactgttcacctttatagcttcctaatagtttgactctattaaatcacattattttgcaagtaaaaagaatttggttatggatcagattttgttaatctaatgatgctaaaaaaaaataggtagaatagtgctattacttttttctgaaaatgggcaatatattgattatgttcacatagactgaaaataacaatattaaatactattaaatatgccatattaagaaaaatattgaataatactttaaaaaattaatttgttaccaaaaaagaaaagaagaaaatttagctttttccccttggatttgtttttcattctcttcttagttttacattgatttatttctcacatttctgaaactctttgcttatatcttgaaattcccaaaaatatttataagaaagaaagtaaaaaaagaaaacttcattaacaaaatgaatgggagagttagaactaattttgagaggtttctcgaatgttcatctccacgtgtcccgattcaattttatactcaggtaacttatgtttaattgtttattttatcttatttttacataaaaattgttttaacgaacattctcgaatctaattttaaaaaatttctcgaacgttcatctccacgtgtctctgatcattattatattaatttaaagatatatttatttgtttttcccatcattttgtacaaaatgttgtttgaacaaacattctcaaatccaacaaaaataatctaattctttcacttacagaaatttgaagcaactaaaatttacaaaaataaaccatttttaagaagcaaagaacaattacattataaaaaaggtagaataaatcaaacccaccaacatatttcttcaactgcttttcttgggttaaattactctctggttaaaaccacgtttactgtattagatctcgtttcaattctctagatggattttcattttaagatcgatcttccttgtgctctggtaattttgattttccattctttgataataaacgaaaacgcattcgattggtcaaaagtctgaaagataatgccacagtggtaaaaagactaataaagtacgtttaattagtcgttgacattattaccaagatttgtatgctttctgcttttttattattacaagatcttagccaacattgactagtttgtatttaaaaccccatatctaatacttttcagcaacaatttttttttaaaatctgtcttttatattttaaatcataaaaagtaagtaaataaaagttagaaacatggggtaatttagattaaattatctttagcaagaaaaatttagattgagtaacaatatagagggtcagtttcaaatcattcagtaaggtggaatttgcaatgatgggttgattaagattaaattatcagttcaaagttaaacaaatg

SEQ ID NO: 15148 - DNA, 3000 bp, Unknown
  misc_feature (1)..( 3000): cDNA_ID_3094574_gDNA_ID_2926061_Annot_ID_196180 3000 nt of promoter + ATG
tacttcttttttgctgtttgttttatcgttacgaaaaattgaacttttctttctttgtggttcatttgaagaaagaaatatctagaaaatgtaaccaatgtttgcacaaaaaaaaaaaaaaaaaagaaaatgtaaccaatgacgattcataatagttgaaagattaacggaaaaactttgaggaatcacaaaattagttgacaataactaggatgatctttaactcatcataattaaatcttagaggaatattgtcttcgaagattttggtaccaatataaaattagagttttcaattcaaaactaattgacaataaataaaatatcttaattcataacagattggcaatcgaaaaccgtatcaaacaatggaactcgggacagcgagtggactttattctatgtgacaaacactgaagaatcaagagattattatgtatatagtttcaatgtaaatatgctgctgtaatttggaaggattcagcccaacgactacttaacgtcaactattccacatactggggccaattgattgcactgcttaacaacacaaccatcctgaagctcaaccttttcttgttcagatacgtcttccaagcgactctataccaaatatggcgcgagagaaacacaagaagacatggtgaaatttcaccaaagactcggctcattaaacttagcgaaaagaatgatcgaaaccacatcaacggtattaaaaacttgggagatcatcgctatgagcctatgatgatggcctaagtttgtggttttctacccgatcaactccatgaacaagactgcaacactctctttaaattctattctctacctttaatacctgatttctataactttcaaacaaactgatatattcattgtacacgagtcttttctggttgaatatatttttacattcattcaaataagaaaaatgtctcatcgtacagatgcgatcatctggtttctgaaaagaagagagagactagaatatggaaaaattcaaattcaagcccaataaaccctgaacaaaatttaaagcctggcccttgtctgaccatctgggccttcttttgatttcaattttgggaaattcagattgcgtcgacgcatttcttttgagggatggatctgctttctcgtcggcggctaatcaaattcttccagagggttttgaaagaaatttctcgagatgggtcaagctcaaagtgacgagaactcaattccgacgacgacgacaacgaacactcctcctccttctgcgaattcacctcgggattctgaagatacttcgtcgccatcgatggattctcttcttgcaggttcgttttttttttttttttgttggtgttttctgtatcccgattgagagagttacactattcgttgcatagaaaagttttgggaaattgggattgttttgttctattaatgatcattgataaaaaatgatgaaatggtgaaatggaatttgcgtttctctatatagtatctattcaaaatcttgttcttgcttaaaaagaagattcttaaatctttgtctatgtagtttctataggaagataatcttctaatctagttttgtaaagaaagctaagaaacacttatgtattatgggatatttgacattgttgtactctcttcaatatcacagaagctgcagcatatggtgaagatgataatgagaatgaggttattccttcaactttgttgttatttagtcatctgctagcttttctttttgaattaccgagttatctgacaaatactaaatccatcagtctcttgaagccaaagcacagagagctctcgattgtccttgtatagcagatttgcgtaatggctcttgcgggtctcagttctccgaggcattcctttgctttctcaaaagcactgctgaagaaaaggtaaaccgtaactaaacatattaggttgtttagaatgatgtaaactccactgaaatgctctaagattgacacattgatgacagttgtttctctttcgtttacgttttgtgtccctttagaagaaaaccttcacaaagatattggatgtgttgttgttgttgtaatgttgttacagggatcaaactgaacatattagattgtttaggatagtgtaacctcaactcaaaaaatcataaacattggcgatagttgttgttttcgttaaatggtttttgtgccatttagcgaagagaagtttcattcaaggatattggatgtgttgttgttgttgcagggatcagactgcgtgaatccatttgtagcattgcaaagctgtatcaatgccaatccggatgcattctctaaatcagttacaggggacgaaaaagaaaccgagaaaaaggaagagcagcctcctgtgcaagaccatagaatcatccctcctctctgggccaaagacccgcctcgcagtggcaattccaagctttagaatatcaacaacaatggagtcagcatcagaagctagtctctcctcttttgattcttttctctagacagcacttttaagaatgtaaaagaagagtagaagaccatgatcagtggtcgtgtagatcaacattgttctttcttttttaatactaaaaagctgagatttttggttatttgcttgcaccatttaaactaactttatgctgtgataatttggtaaaccaaacggttaatgttacagagttgggttttggttcggtttcataaaacaattgagcggtttaattcggttttgattcgagacattaattaataatggctattcgttaattaaaatcgaaacaattaattttctcactcaataatgaagaaaactgcgaaagcgtgcagataagagagatctctctgaacagatattatagttgatagtttgcgtactaggagtctgtgaaagcttgcacaggaagaaagcaaatcgggaaagaaaggaatctgaatcggagaagcaatcgaggtttacgattaccaaattctgatctaatctgattaattgtggtgatttccgatg

SEQ ID NO: 15149 - DNA, 3000 bp, Unknown
  misc_feature (1)..( 3000): cDNA_ID_3094600_gDNA_ID_2926062_Annot_ID_196184 3000 nt of promoter + ATG
acaaattgatgcaatatgtaacattatatatgagcattctttcagtccggtttatcccctctataaagtcctctattgatgctgtatctaattcgtagttttgaaatggtttggtgtttctaatgaattttttttttgttcatgatatctccagcatgtcaaagatcattgatcgttacgaaatacatcatgctgatgaacttgaagccttagtaagttagctacgaatatcattaaaattcttctggatgcagtttttgatgttatgaagggatagaagcactggtcgaacctgagataactcaatgttttgaatttttcgtactggacttaattctctctagttacagttattgcatttttcggaaaactcacaatctttctgaccattcccttcgttttctccatgtgcaggatcttgcagaaaaaactcggaattatctgccactcaaagagttactagaaatagtccaaaggttagcacaaagacacttttatctccctcttcttctgatgaaaaatacttttttttttcttttcttttggcgaattatgaatacagcaagcttgaagaatcaaatgtcgataatgcaagtgtggatactttaatttctctggaggaacagctcgagactgctctgtccgtaactagagctaggaaggtattttgtactgctactaagtgatcaaaccaattatcccaaatttgttttgttaattagttagatctgactacaagtatagtcttttgatattttcgtaatgtcttgttgtagacagaactaatgatgggggaagtgaagtcccttcaaaaaacggttagtacttttgttttttatttgctatcaaagctatattgtagggtaatgctgattttttaatactattaacctcggattctgcagatcctgtaaccaagtttaactctagatatatctctaggtcctgatttattcttggctttatttagatgaaaccctaattagaacccaaaaaaaaagcacttataaacttgtgatcaaattcgacttttctccctcgatgaatcaccgaattggatgaggatcatgctcagatagctttagaacttgttagaaattaatgaccttatgatcttgtccaaacaggagaacttgctgagagaagagaaccagactttggctagccaggtgacaaaaacatctcttgaagctaattcatcagttgatacacaataaaaatagaaattacacttgcgttaaacatatatatataaaagttgaaggactttgattgatgttaggcattttttttgtgaaacccccatatatcttaaaatctatgataaaagtcctttcaaaattcaaatttcttgttactatttagttgaatgatcagttttaattaatgaaattttccaaaaaaaaacagcctttttacaatatagattgatttcttgttaatgtttgttagctgtaggaaaataatataagaaagtttcttacaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtctttttgtctgcaagtacggattggatttaaagttttactttcttcagcgtgaagaaccctagacatagagcttcttaattcttttggttttacttatttagttgttagttatttgattacttgcacgtgacgtggcatagtgattttttccttttccaagtttatcagttctacttttgaggaactcaaaagactattcttccagaaagaaagaatatggcagaaaaatacttgtcttggctgtgcttccagcttcggcccattgaggcccatcagaagttgttttcattttttgtttcatttgcagctgttactgtcttactgataagtaaattagtaatataatatatttctgtttaacttggttcgaatttttgggttttggaaaacatattaatatcggattggtttggctttggattcatcttcgagttttgaatgtttgaattttaattttgcgggttatttgtttccaatcaaaacaagtttatcggtcagttttagggtcagaaccaaaattaaaataagcctaggatcctgagaatgacaagtcacgagcggaatatcgtcatatgatataagactaacaaaaacatattgaagctctctgatctttcctctagattcgtaagagatagacagattgaaagtttgaaacatacaaacacagaacgattgacgacagccaagaacaagtattagacttaccagtgatactaattgtatccaaaatggataaccttaacttattagttcttaatacatcaaaacatgtgaaacaaacaatataaaactgccgggaagaaggagtaaaactcgcttaaaaccaatttctgttcggtagggatgatcatcggaccggtctaaaccgactggattaaaagtttcattttaacaacactccccctaaggaatttcaacaagcgtaaaactaaaataaataactattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagcc

SEQ ID NO: 15150 - DNA, 3000 bp, Unknown
  misc_feature (1)..( 3000): cDNA_ID_3094611_gDNA_ID_2926063_Annot_ID_196192 3000 nt of promoter + ATG
aaacaacaaaataagaaaaatactatacttgatataatttgcttagctaagaattcaaaatataaattaaactatcgattgggtcaaatttagtacccttttcataaaatctcttttaacatactatatagtaaggatatatactgctggcataaaattactaatgtctatttgtaacagtgggtattaggtaacaacttttataattaataggttgaaaaatatctgtttaatattaacatataatataatttataggttgaaaaatatctgtttaatataacatataaagtatatatatctatataatttgcttttagaaattgatatattgaaatggtttaacagcctggcaaaaaacttcagtaaaattgtccactttagtttgccaaccgttgaggaaaaacagagttataaacacttagtcaaactagaaaaagactcttgtctttttggtatccatcatccaatcatagtttgactcaattaaatctaaattatttgttttgtttcaataaaatataaatcaatctcttttcgtcaacacatatatagtagcatacttttatttatttactgcctccttcacgcatataagaaatgagttgttgttttcctaataattcttattatggatgcaattataatactgatcagaaaatatacaataattgcctgtctaagaggtgacgcatgagaaatattcagtgatactaataatttctggtgcaaaaatgtttaaaagcaattatgagtatatatcgttcttaattgcgtctggaaaccatggaacaccaatgagtcaatactgttttccctcttatgctaattattccatactattttctacatatgcattgaacattacaactcaagggcagacgtaggagaaagggattgatgcaatcgtaaattgacaaaagaattaaaaagccaaagatcacctgcagttcaaattctttattattttcattaaccactcaataaattacgtgtttttaattaattttacctagaaaaaaatattgttgacattatttgcctcgacaaagcttcacccaaaatccagtccctagtacttcacatgataacacgatttactcgagtcaaaatccgacgtataagactacaaatatagaccatcaaccatttgactaaagacaccttttcttatatagaaaatataaaattaaaataaagatattaatatgcatatttttaactacaacatcacatatatatttagaatattgtttttgattatattttacattaaaagagtagaatattgaggatactaatttgacattcttcacggcatataacatctagaagttgtaaggcacatacatacatagcttaattacaatgtgtattattatttaccatgtttaatttcagatttgtatttaaaaattaatttttttttaataattacttatcaacctaatatcctatatgtttgggctgtagtgaatttgcagcccaatttggagattttaaacccttaatttatcttacaagactagacaacatttcaacaataacaactaagttaccagttttacaagaaaaagagagaggttatttccctataattatgactaaaagaatgtaactacacgtataagttccttttgtaacacatgtaaatgtaatatagcaaatgtaaggagtacaccacgaatcaggaaacttttgtttggccatttgtaccatattacttgcacatttgtggaaatgagtgtgtgactatatctgcatgcgtaaatcaaacacatgtaccttaaatgatgtaaaacagtagatctatcaattgtacacatatatatggatacatcgatgggtcattatagctctgaagttgattagtcgggccaaaaatacacctgatcatcatgatattcatatatgtatagatatatagagcacatatcacgaaactcatctatgtacatatatttatatgtttgtgtgaaaaaataattcaaaagatttattcatgcatgcaagtgtccatcaaagtagtacgaatgaataattatgaagggttcttttggcactttactaaatgtaataatgaaaaacaacattggtaagtcaactcgtgatgatacatttttggttaatagaatttcacaaaaattgagttttgtttttttgtcactttataatcagacagttccatatagttcactggtccgtccaatgcaatcttctcttccaacatgttttcttccttttatccgtgtaatatcaacaccacttgggactgttttttttttctttttcctttttacttttgaaattcatgatgaaaactaactagcaagttgatgtgcatatgtatgaaaatacatttggacgaatgatcaaatcaagaaacctgctgataattttagttaatgacttttttttttgtcaactcattacaaagttctggattttaaatatttgcatttctcttgatattaatgattcaattttgattgtttggagtttggaccatgcgtatgctgacaaccaagttactctggaattactctggattttggtagggatattccagactaaccccaagttatgaaataaaagacattgaaatcctcataaagaagggataaataaagtttatcttttgaacagttaatttgttttaacgtaattttatcaaacgaagcgcgagctaaaataaaatgaataattggaaatctaattttttcaaacacgaacaataaatatgcatgcatgtcaatcatgttgacttctccatacccatagctttagagacaaaatgaaataaataattggttctccagataataatatataataataattgatagggtgtgtccaaatccaagtctcttattaaaagggcacatattcaactactcctccataaacacaaaaagtccatcctaaaaaaagcaagtaagagataacaatttctctctttttcttttctcttcttcaaacttcaattcactaacgagagaa

SEQ ID NO: 15151 - DNA, 3000 bp, Unknown
  misc_feature (1)..( 3000): cDNA_ID_3094607_gDNA_ID_2926063_Annot_ID_196193 3000 nt of promoter + ATG
atgtggtcgatatattaagcttttggtccaaaaaagaattgggacttataagcccataggccctttaatttgtgtagaaattgttcatcttacttcatgacaaacaatcaactctctaaaaacttgattatgtatggattttgataataattcccttcaaattgcaagtggaagaatacgtaaaaacataatattaagaaactttaattcagcatgaagaaaaaagttggtaaacatagcagtgaactctatgaatctttaaccatggaatttcaagagattccaccaaaaacacttcaagttattctatgaggaaataaaaatactggaggaccgtataacaacctacatgcaagttaagagttttcaacaattacccatatccaatcgtcacaagatccgtatccaatccttctatttttagtttctataaattttattataagctataattttaaatgaagtactagattttaacccgcggtacaccgcggggacaattaattttttaatatatataaaagtttgcaaattgtatctatatataaaatatttttattttaaagtttacaattgttattaagtaatgtcctgtcaaactcgtcccgtaaaaaacctatttattttattaatgttgattttatttatgatatgtttataaatcattgtataaatattttgtaattttgtagtaattaactgctatcaaatatttatgcagtttgatgcttataatcgaattgttataatcatgaaaaaagcaatatcaaaaatgataattttgtagtgtttaaatgatattaaatattttggaagttttattttagtaactaattgtgtagttaatgtggagagatttcgggaagatagttaaatatcaaatatttaattcgaagatttactttctaattatcaaaaataattattaaatattagtggcaaccactgtaaataagtcccaacttgaagatttatttcacaaaatggctgcaaaaatgtatatatagatactaattttggatgaatttcattaaattcacttgtatatttttttattataacgtaaaataatttagttacaattttatataattaggatccaatccctctattttagtatctataagttttaatgttttattaatgtaaaataatttagatataatttaattattagtatctaattttttattataatataaaatagttttttttgttttttttggcaaaaaatgtaaaatagtttatttattactttaaattagtatccaatcccacagcactgtatggctgaagttatccacaactcacctacctatacaagcatacacgtgatgatatcatgctaatcacttctgaaggaacaatgccgaaaattaaaccttattatgcattcattaacatccgaatccatttttctactttgacaaaatgaacaatatccacatgccagcatctagctagatgcagacctggtaaggcaccaatgggtttgaaaccttcctccatattgttccaatttgtatatattgcatttcaaaaaaccagaaatatttactgtaccattcacgatcgacccaaaggatttgaacccaatctcatagcctaatgaatcgtattcaaaattgatatgcaccatgagaaactggtatcataaacaaaaactgatatgcaaattaattaattaaatcacacatatgctatattttctctatgggctggactggtgttttgttttaattattatgataagaagaattgcaccaaaaaaaaaaaagaaaaaaaaaaagaagaaaatcgtatctttttgttctacctatacagacacataatgcatcattttagtttttgggacaaagacataatgcatcaacgtgtcagcaatatatgaaacgtgaagaatgttttgtctgagtctgagtaaaattactagaaattaaaattagtaagactgactaattacaaatatcccaagtctgtgtttattctaagacaactactagaaaacttaactatattagactaccaactaggcaacaaatatcacaaagaatatcgtatgtcacctacctggaggtgcataccacgtgattttatccccattttagatatggtcatatcgattagttattgtatataaaaaaaaaattcttacaggctataaactattatgctacaaattttggtaaaaacctattacttgttattccgtttccaaaacatattatggctatattaaagtgtgtataaatgagttaaaacatttttaacaacaaataaatgtaaaaaaaatgagtttaacatcgttgtaagtaaacttaggatttgtttgttacctcaaacttaaatattattccctctgtttctaactaagtgtagtttaaaggttttttatttttttcagtataagtattgttttcacttttcgatgcaaacattaaatgtatttaatagtttttaaccaattatattttacatcatattttttattggttggattagttgtaattggtgatattttttttaaaaaaagataaatcaaatgagatttatatattttcttaatttgcgtgcaaaaactttaaattaaaaatattaagaaacagagagagtatcttttctatacataggtatatcacttatatatatatatatgtatacagctaaatatttatgtaaaaatgtaaacatacgaaactgtttatagaaagtataatattctaaaataagatatcaaacacagtataatatttaattttaaagaagatactattttgcgtttaatgttttcatcgaatataatttcttattccgctaactcaaatgtttattatttttaacatcaaaatgtttctaatactaaaaagtttaataaataaaaaaatctctctataaatagataaattatatcgtataatgttcaaaacaattcccacactatctttcctccacattaaagtaaagtatctctctcttttttctcctacgtactccatagtg

SEQ ID NO: 15152 - DNA, 3000 bp, Unknown
  misc_feature (1)..( 3000): cDNA_ID_3094642_gDNA_ID_2926064_Annot_ID_196196 3000 nt of promoter + ATG
atttttttaaaatttttaatttttacaataatgataaatatcatctgccgtcgtgtgtagggtgtttctgatatacatattttattttaaaatcatataatgatttttttttattatgttttaagatataaccgtgtattaaaccaaccatcatatagataggtaaaagattaagaacgtcaaagcattttaaagtgaaatattcaaaaaaattatgtaaaacgaaatgtagtagttatgttatatggttactgtaaacaatttaacatattaaacggttgagggagatgtaaaaaaatcgtgcgaatgaaagaaaatactaatagttataataaaataaaaagaagagaaatagatggagagaatcatttgttcgagctggaaaatgatgatgatggatgtctcttgtattccacgcagcaagacaaagccattctcaggttgacttttgtcaagctcacgcaaaggcaacattattactgctttattttattttaatatataacaaattatttcctctattatttctttgcttttttttttatcttaactataaattatttttacttcatcttaggatatgcttctgatgatttattcaatttattttcataaagttctgatgatttgatatcaccgaaattcgttgattataaatcatatttttaagttgacattctagatgaagacctcatattctctggttaaatgtataagttgtaagtttgtaactatttttattttctcaataacttgtaaatggtaactaagattaataagtatgaactacgagaaacatatgctacgcattacgtgacatttcacattaaattttgagtaagttatacgataatcttttctttggtcttctactagataagttgatatgattaattagtgactcagaagttcacgaaacaatttttccaaggctgatacacgtttgtttcttacacgtcgtcaaagtaactattttcgtcacattgttaatcagatacgttgaactaactggagggtggaggcgacgtgcatttatatgaaattatgttagcattgtgtttttgctatttcaatttgcatgccaatttattcttttttttggttaatttactttcaattgcattgcatgccaattaaattcacttacgatatgttacttaaaggattaatacattggtttctacacgatattcaccaaataacatggacccaagtacgcatcttctattttttaaaattcttttgtttttttcaaatgatttttgtcttcttctttttattatgtttaacgaattcaaagaatcgaaatccacgattctgatttagcagccgctcgtttccttttgtttaatccttcagaaaccaatgtacttacttaataaataaaaatgcgtagtggagaagaataaacgtaaagctggttatagtataatgaacaaatttattaccttaaagagttaggtgcaacgtctaatttaataatgttgaccaaattgattagtaacacattttacaagacctattttaataaaataaaataaccggtgtaaacactttctttgaaacttttcgtcgccaatcacggtctttagcttcgtcaccctcctatcatcatatccttattttttttttcttgtgtgtgtgttttttttttctcaacaactaaagtgtacattcatatgcaaattttctttgtaatgaaggaaacgtaaaagttatttactctacgatgaactcgatgtattagtaattagtgggcttactttttgaaaactagcaaaactatgtctgattaatagtgtctttttcaacaacaaaaagagagttaatagggaaacccactttaccaaaaaaaaaaaaaagagaagagagattaaatctctatagtaacaatttacaaataaagtttattaatatacctaagaaagaaaaatgaaatgaataatttaacgccgaaaaatgattaatggaaatctttttatttatttatcaaatgaatgaaatcttttaaaatatgatttttatttagaaaaagactagtaaaacaagaaaaagacgaaaatatagaaaaagcaaacacagagcccacaaagcataaaaaatattccagaagaagaaacaacaaagaaagcttcaaacttctttctctatttccctccctctttttcctctcagctcacctatggaaaccctacaaagatctctctctcaagatttctgaaaatggatatataatctcactgatttgtttctttttttgttcttgtttcgttttctatatgtttatggatgagttgtagtttccatctcccagccggatatagaaagaagaaacagaggaaatttgttcataaaggaggtattgtgttaattagaatcgaaatatctttatttttgaatctctgtagtttcaaaagttcaaggttcgatctttgtttgtgggtttgccttggaagcttataagtttcttacttttttttctgggtttcagactttttagcttcttacagttataatatagctcacgtgatctgattctgttgtcggaatagtttctgaggttttaaagtgtatgacttttgtatgattcagaagttgatatgtttatggaacttgtaaatttttacagcccaaaccttttgtttgtctcatctcattggtatcagatttagatgttcttgattttctcaggataagattgaatttcttatatgctctgcttttttcactttgctctgtttggttctgttgcttttagctccttttgtgatcaaagcttatgtttttggattatgattagactaaaccccttgttggacttcttcatttgattaatttttccaatatctttagagtaagatctgagaattgactatagcattcaccattagcttctgtttcttcctctttccactgatcttttaggttcttgataacattgataatccatttcaaattctgcaggtacatatatacacatacaagtctctgtgaaatatg

SEQ ID NO: 15153 - DNA, 3000 bp, Unknown
  misc_feature (1)..( 3000): cDNA_ID_3609838_gDNA_ID_2926064_Annot_ID_196199 3000 nt of promoter + ATG
atcctggatgggaacatggtattgctcaggacgagaggaaaaagaaagtgaaatgtaattactgtaacaagattgtgagtggcggtattaaccgttttaaacagcacctggcgagaatacctggagaggtagcgccgtgtaaaactgctcccgaggaggtttatgttaagattaaagagaatatgaaatggcatcgagctgggaagaggcagaacagacctgatgatgaaatgggagctttaactttcagaacggtctctcaggatcctgaccaagaagaagacagagaagatcatgacttctatccaaccagccaagataggttgatgctgggaaatggaaggtttagtaaagacaaaagaaaaagctttgattcaacgaacatgagatctgtctctgaagcaaaaacaaagagagcgaggatgataccgtttcagtcaccttcttcgagcaagcaaaggaaactatacagtagctgttcaaacagagttgtatcacgaaaagacgtcacatcctccatttccaaattcttacaccatgtaggagttcccacagaagcagcaaattctctgtactttcaaaagatgattgaattgattggtatgtacggagagggtttcgttgtgccctcgagtcagctgttttctggtaggctcttacaggaagagatgtcaactatcaaaagctacttgagggagtacagatcttcttgggtggttacaggttgttccataatggcagatacttggaccaacacagagggcaagaaaatgatcagtttcttggtctcgtgccctcgtggtgtctacttccactcctcgattgatgccactgatatagtagaagatgctttaagccttttcaagtgtctagacaaactagttgacgacattggcgaggaaaatgtggtgcaggttattacacagaacactgctatctttagaagtgctggaaaattacttgaagagaagagaaagaatttgtattggactccttgtgcaatacattgcacagaactggttcttgaagacttctcaaagctagaatttgtctccgagtgcttagagaaagcccaaagaatcacaagattcatttacaatcaaacatggctgcttaatcttatgaagaacgaattcacacagggactagatcttcttagaccagcagtcatgcgccacgcttccgggttcaccactcttcaaagtcttatggaccacaaggccagtctcagaggtctgtttcaatctgacggctggattttgtcacagaccgccgccaagtctgaagagggaagagaagtggagaagatggtgttgagtgctgtgttttggaagaaggttcagtatgttttgaaatcggttgatccggtgatgcaggtgattcacatgatcaatgatggtggcgatagactatctatgccatatgcttacggttacatgtgctgtgcgaaaatggcgatcaagtctattcatagcgatgatgcaaggaaatacggaccgttttggcgggtgatagaataccgttggaacccattgtttcatcatcctctctatgtggctgcatatttcttcaacccggcatacaaatatcgtcctgattttatggcggtaggtatgattatcattcatttgaatcaatgactaaaagctttctgccattttccttacatttgctgtaaatgtgaatgaatctgcagcagtctgaggttgtgcgtggagttaacgaatgcattgttaggcttgagcctgataacacgcgtagaatcacagcattgatgcaggtgagacaaaaaacaaatcaccaagtcacacacattgttctcagaacctgaggttaaaccaactttttgttgaaatgttttcagattccggattatacttgtgcgaaagctgattttggaacggatatagccattggcacaagaacagagcttgatccatcggcgtggtggcaacagcatgggataagctgtttggaactccagcgagtggcggttcggatactgagccacacttgctcgtctgttgggtgtgagcctaagtggagcgtgtacgaccaagttaacagtcaatgccagagccaatttgggaaaaaatcaacgaaagatctaacatacgttcattacaacttacggctcagagaaaaacagctgaagcaacggctacattatgaggatgaaccaccaccaactcttaaccacgctttgctggatcggttgctccctgactggctcgtaacatccgagaaggaggaggtacttaacttacttaaagtgagaaacgctaaacgccattccagtgattttataaaaggctaataaatgtagtttattggtgaaggaggaggctttgcacggggaagacagagcagagaaggaagaccatgaagacgatgaggaagaggaggagaagttttacatggaatctggtaacgttgacggtgaaggtgaagacaaccttgatccttacgatgatgatcttagtgacgatgattagttagtgctacaattctaacgaagtaacactgtattttgaattctagcattgtatccttaaaatattcgaaaaatatgaaaattttgttggctagaagaatataatcaaagtattattaggtgaaattagtgaaagtgaaataatttatctaacaacggatatggatgggaccaaaaagttggcgcctcgctgtcatttttttaactaccgaatatctgtctttttaatttatttattaatcaattttgtttttaaaaaatatatatgtttgaataaaaaagaaaaaaacaacacacacctgacagctctctttcccttttcccgttctttgtcgtcctttgtttcgtctttcattcattctcctttgtgttttctctttttggagattttaacttcagtttttgtctaattagggttttaatttaaattggagggaaattttagatgcagtgacgtagtttttgggtaaattttcgtcggattctgaattgtctccggcgacatg

SEQ ID NO: 15154 - DNA, 3000 bp, Unknown
  misc_feature (1)..( 3000): cDNA_ID_3094627_gDNA_ID_2926064_Annot_ID_196200 3000 nt of promoter + ATG
tgttattgatgtcttttgctgtgtaatttgcagggatgcatgaaaagacatggtttcagtggaatgccggcatcacatggtgcttcattgtcccatcgaagcgggggttccacagggcaaagagatgctcctggaaaggtatgtgtcaaattgctaagattcttgggaatttttctccaaagcaaatgacactactgacttgataaatacacttgagtaggtgttcaagggcagaaagatggctgggagaatgggtgcagatcagaggacagtaaagaacgtttgggtctacaagatcgatcctgcgaggaacctcatgtgggtgagaggacaagtaagtatctcaatcccagttccagtctttggctaggatctgtctgtcacaaaacatgagctccatttctcttctcttattagtaggtcatgattgtgatttggtgttgttgcaggttcctggtgcagaaggaaactttgtgttcataaaagatgcatggtgcaagaaaccagacatctcaaagcttccgtttccaacttacttagctccagaagatgaagatccatcagaattagaaccgttggttgcagatcttggagaagttgacccatttatgttggcagagtgatgaaaacagcatgatcttgatctttatttgggcttttacaatgattagagaccagaaagaagctgtggaagtgaaggaatcacagagctaaagctttttgcagatgaatttgtctttttcttattttagttgtttggatgtatgatttgaaaacgattaaatagaggaatttaggcttgctcgcatttgttatatcacaatgcttaagagtttgcaataagcaatgaggaaaacacaagattattatgtttcctttcatcttccaaatatatacacttcgtattaacaaaaaataaaagattctgtttttaattcaacaagaatcaagacccaatttttaatcttctatataagttttttcagctcccaatagaattatacgttgaagtctcttcaagcccaagatcttcaacattctgagaacaacacaaacgcttctttcatctttctctctctctctctcgcttagggttaccgttgagggagagagttctcaatctcgttgacttagccatgaatccggaacagaaacagcgcgaatgcatagtctgccgtgaaaaagagccgtcgttcatccacaccgtcatcaaaaccggcgctttccggcgactctgcaccgattgtttgctcaaagagtaccgagaacacttttgctctgtttgtttcaatctcttcgacaacgccgttcctccacaagctcgtatcatctgcgtcaattgcccatcaagcacccacctttcttgctcaactcagccgccgtcttcctccgccgcatcttcctcctcctccgctccaccaccagcttcttccttcacatgccagccatgttctaaccccaatttcaccttcttccccaaatctcgagtcaatgaagacgtccccgatgaaacgcctctcactccgaaatcggcaatggctcttgtcgcagctggaaatatctcggtggctaatatgaataaagcggtggctctgttaaaggaagaagctcttaagaagatcatagcagctaaaacggccaagttgagagctaaaggtgcattgacgaatcttcaggatattgttattcgacagagtaaggtcaccggcaagaggaaggaagatgaacgctgattttctaaatcttgatagcaattttactggtacgtagagcttttgtgtgatatatcgcttctagggttcaaggaaagactacttttttgcggttattggccatttatcttggtgaattttagttcatattcagacgtgtttgatcaaatgtctcccagagaaagctggagactttgaattaggatacattagggcttttattttgtacaatggtgtgtgtaagactcagtgacattcattcatattaatcggttccatcttcaatctttaaaagtatctgtatgatttcaagagttcatcttgttgtgtggctttactggtttggagattttcatggaaggtttgatatttttagagttctccagctagtgaattaggttttgattggcacttatccaagaaagtgataatacgttgatgttttggtttggaagttgtgataaagcacacattgaagaatgttttggatgattcagagttctcgagccaagaaatgataatgcgttgatgtttttggcttgaaaaatgtgataaagtcactacttttgcttgattggaaaattatataatttgaattggtaaaattaatataggtaaaactgtttttgcaacacgaaaattgaaagaccaagttcaggaacttccaaagttatgttttgctatattggtgaaagagcaaaacaccacaaatgaatatctgactggactgcaagagagggttagttacgtagatttccattatataaaggctcaatatgtaatttcgcaaatatacaagccctcattttggaaattcgttaaaaacaacgagtcagccgaagacagaaaccctagaaatcgcccgagtcgagttaattcgcctctcacccagctctatctcgtcccgtgactcgttccttcctccgcaaaaacgcttcttcgattcttagctcaaatacgtatctcgccgtctaaatatgtgttccaacttcgcttaagcttcacctccattttcttggtctgaaaaatcaacaaaaccagaaaaaaatctcgcctccgattacgaaagttctcagcttcgtaggtatgctatagaagaaaaacccagttcaattatttgttcttgctttataaaattgatgaaaaaatgttgtttttaaatccatctatgttgaatccatgcatgttgtttcaaagtcttgtttttgttgtaaagactcttgtagattgtggctgcactggtttgtggaactgttaaagtttgaagcttgtaaatggtttgacaatg

SEQ ID NO: 15155 - DNA, 3000 bp, Unknown
  misc_feature (1)..( 3000): cDNA_ID_3094636_gDNA_ID_2926064_Annot_ID_196198 3000 nt of promoter + ATG
atacatttaaccagagaatatgaggtcttcatctagaatgtcaacttaaaaatatgatttataatcaacgaatttcggtgatatcaaatcatcagaactttatgaaaataaattgaataaatcatcagaagcatatcctaagatgaagtaaaaataatttatagttaagataaaaaaaaaagcaaagaaataatagaggaaataatttgttatatattaaaataaaataaagcagtaataatgttgcctttgcgtgagcttgacaaaagtcaacctgagaatggctttgtcttgctgcgtggaatacaagagacatccatcatcatcattttccagctcgaacaaatgattctctccatctatttctcttctttttattttattataactattagtattttctttcattcgcacgatttttttacatctccctcaaccgtttaatatgttaaattgtttacagtaaccatataacataactactacatttcgttttacataatttttttgaatatttcactttaaaatgctttgacgttcttaatcttttacctatctatatgatggttggtttaatacacggttatatcttaaaacataataaaaaaaaatcattatatgattttaaaataaaatatgtatatcagaaacaccctacacacgacggcagatgatatttatcattattgtaaaaattaaaaattttaaaaaaattaaaataagctaattggttgtagaagtagaacaataatttagagcacgcgtaagaaacaattgcatgattagtgtccgcctccgaaagctaactaacaatggggtttagttggtgttgttcatattttatttcatttgtatattactttctttcttttctttcattttctcttaaacttttggttttatatgcagttttcttttttctctttgttgctgactcgctgtcttattattttgttattgtcttgcagttgttgggtttacatcatcatgtcctactagcatataagatagtctaaaattaatgtattagggtcttaacaacaatgatttataatattttaaacaataataacaaggattcagtgattgtttaagctctatttttgtctcttaagtataacatgcatgcatccaaatcataacaacaatattgtcggaagtttgttcaagaaaaatatcacaagttacataaaatggatagtgcggccattggggatagaatctgagcttcttaataaaattgtcactttttcataagtagcataaactacccaaatcacaaaaatccacattaaactatccattcctcattattttttttgggttttcttcaagtgaccattttccgaagaagctcatatagtttatgggctatgttggcttaatgcagttgcttaccttctatgctttagtttggttattttcgctttgaacatggttgtatcaaaacacctttgtcacattttctcaaagtctcttactccctgattattaccgttagaaactgaaagatatgtaagggtaaccaagtccttgtaaccataataagagaggagatttggattaaaaggtcttccttcgttaagcttggaatagaacacaaataggttcgaatacaacaatgcataaatcaaacaaccaaactaaagcatagaaatcaattatcaaaactctcattgaacataagtagttattcatgtctaatctcgaaggagagtattattagagtgtaatacacaatttctgaaaatcgataattaagttgatttatatgtagatttgtttaatcaaggaaaataagttgacaacaaatcaacaatatgtgactgccgacacaaattgattagtaataccaattaataagaaaaaaggtagaatacgaccttcaattataaaattggttagtatatcacattcacttagttattcttaattaattataataaacctctcaaatcctcacgtttagaaacaatattatattcacgatttagagcttaaccatatcgataattacacacactcatatcattatcgcatatcgcagatttttctctcttcaaaattagctttgattattcacatcataaacaggcctagaacaaagtctcttgacccagcataaggtgttatataggcccataaagcccaatctttctaactctcttcgcaggtcttctccgcatacaagagataaacccgtagccgttagattcaggttttgctgattagcttattcatctccaccgtcaatttaatttaattgttttggttcaggaactggacaaaatattaattaatttcaagttctaatctttcttcttctccaactaaactactgtagctagctatctccagttctacgttctttctattaataaaatcttcttcttcttctctttttggttgattcccaccattgaacctctcacgaattcgtcgtcgtatcatcagattctgctcgaatagctgaatttgtttaatcagatagtgttcctcttgatctatcgctactagatttgttgtgcgtttgttttctttgctgataatttgcaaattctctgcttatgatctcgaggtagtaatgtctgttcttctctcccttattgttcattttttaactcgttgcttatcggatctgatccatttcgctctctttctctgatcgtgatctctcgattttatcctgctcgtatctctcgattttatcctgctcttattggtggatttttggttttggaggtttagatttcatgtcgtaggttttggattttattttctggcatcattacttggtgttgtgaatccaattcctcagttaaatctgcattggctgacaaaagttttgcttcatttttttttttgttgggtttcaggtaatggccacagagcctttgcacctggtttttatactgccgtgttttggtattggtgcagtgtaagaaattgattgtcaaaggaaaatatttgctttttctctgaggagaggggacgagtaag

SEQ ID NO: 15156 - DNA, 3000 bp, Unknown
  misc_feature (1)..( 3000): cDNA_ID_3094661_gDNA_ID_2926067_Annot_ID_196213 3000 nt of promoter + ATG
ttgatttcatggtggctgcgcttcgatcgaggatagcttctccagtgacggaattgtatgggaaggagcatttaatctcgactcaattgctctacgagctctctccttgtttcaaactcggtttcgaggccgcgaatctcgccattctcgacgccgccgataacaacgacggtggaatgatgataccgcacgttatcgatttcgatatcggagaaggtggacaatacgttaaccttctccgtacattatccacgcgccggaatggtaaaagtcagagtcagaattctccggtggttaagatcaccgccgtggcgaacaacgtttacggatgtttagtcgatgacggtggagaagagaggttaaaagccgtcggagatttgttgagccaactcggtgatcgactcggtatctccgtaagtttcaacgtggtgacgagtttacgactcggtgatctgaatcgtgaatctctcgggtgtgatcccgacgagactttggctgtgaacttagctttcaagctttatcgtgttcccgacgaaagcgtatgcacggagaatccaagagacgaacttctccggcgcgtgaagggacttaaaccgcgcgtggttactctagtggagcaagaaatgaattcgaatacggcgccgtttttagggagagtgagtgagtcatgcgcgtgttacggtgcgttgcttgagtcggtcgagtctacggttcctagtacgaattccgaccgtgccaaagttgaggaaggaattggccggaagctagtaaacgcggtggcgtgcgaaggaatcgatcgtatagagcggtgcgaggtgttcgggaaatggcgaatgcggatgagcatggctgggtttgagttaatgccattgagtgagaagatagcggagtcgatgaagagtcgtggaaaccgagtccacccgggctttaccgttaaagaagataacggaggtgtgtgctttggttggatgggacgggcactcactgtcgcatccgcttggcgttaacttcacacactcttttttttcttcttattattaccatattattattaattttcgagattattctgatattattatcattgtgattttccatttcgaaaagtgtaggaatcttatgtaacaaagaaaaaaaaaagacttttatgtttttctaataataaaagaaagagtgattgggttctttaatattctatattttgtaatatatcttagaatcacgaagatatcatagaatttatgccttaaaaagatgtaatatctgaggaaattttgcaaaagaatctcgcaggtggagcaataacaacttgacaaataatgtgattcttagacctcatacctatgaattattttattagactattaacaagtgaattactacatggtattgtaacttgtcatgttggatatgaaattctttcttacagataatcatattgtatatatgcgtgtgataaaaatttatgattggactcagttttaacgtgagtgaatgtgttggtgagaatataagctaaacaatactagtatacttagaggaaacaatgtatggcgacttttgtggtcatggaccttatagttcaattattttaacactaataaaagttggcattcgatgggtccatatccgatggcattcgatgttcttattttatattatgcttataaagtatccatctttacgcgagacttgtaaaatccgtgtccttggaatattttaaggcatatatgaaatataacaaacctggtcattagaaaaagataatattattattgtttggtgcaagctgtttgcggctaaaattatgcaaaatctttttgaaagacctctcttcttaacctcttgtttgttaattaagatgatttctttctaatatacgcaactaataccgtgttgagtgtttgattggattgttagattgttttccaagaaaaatcacatagacaaaattttatccataatttcttcatagaacaaattgagataaactttttgatcaagccaagtatgtaatgttaccaaatatataaataaaaaacgaaattttcatttattcattcgaaatgctacgaggtcttaacacttcctggtcctatctgaatttgtgatgtaaccaactttcctgatgaccacattacattatacattcatatgaaataaatgttacattcatttagttagagaattttaatgctttgttttttgaataaactgaaaagttcatttatgactcacacatcttatgcagttgacgttggtatatctttcacttgatctgaagtacctagtagctgcaagaaaagaaagtaacaaaagacttacacacgcttgcaataaatgtaagatggttagaaaaatgtggccatgtaggcctagtgcattatattattggagcactaataagtcaatatattcttaagaaaatatgcgatgtatttcaatatggtttggtgtggttcatcttcaaatatattatacagacaatatagagattatttgaaaaataattcttcttagggatcaagcatgaagcaatataaaaaaaaaaatggctcttgttgaaaggtaaaccaagcatgagtttctcgagagtttataaatggttagttttaatagtttacacaataacttatttatatcaatgtggattcttgtattagaagagtaaattgttgcttaaaaagctagaaaaaataaatcaattttgtattttgttagtattatgataacaactaacaatgtaatggcttgagtattaatattaagttttatgtgtccagtccaacgggcaagaaatgtaaaagaacccagactctcactttattgggcttataggtccaattaataaaacttaatgggcttatccacacaacgagtttacgaggagactgtgagagtttgttttcacagtcatcatcatctctaagaaacaaacttgtatgacctttaagcagcaaaaaaagaaaaaaccacaaaacttctctgaaaggtggataa

SEQ ID NO: 15157 - DNA, 3000 bp, Unknown
  misc_feature (1)..( 3000): cDNA_ID_3094658_gDNA_ID_2926067_Annot_ID_196214 3000 nt of promoter + ATG
aagtattttttataatctttgtatctatcaaaatcacggtaacatatgtaattggtacttgataattaatttttatcatctttgtatctatcaaaatcatggtaacattagtattagacttttaaatatgatacattcttatttgactataaaatatgtttactccattaatatttagatatacatttgaaatcataattggtaagaaaaagttgtttacctttttaccagtaagtttattgcaacatgtcattaaaacatagtccattcaaattctaattcataattttaaggtttgaacatgaataacatttcaacctatgaaagtttagaaatcatttgataaacttttatattcattatagcaatttaattcttgaaaattggtaatcttagattcctttgactaatcaaaaacttggtaatgttgagatatatataagtgatcaatctagtgagggggtggccatacataggtgtattagtgcttatgagttggtaagaaatatagtctcaagaaatctcttcttctcttctttagtctccgcatgattattatctcgacataatcatgtaaaagatttatgatttaatataaaactattacatagatgatttgttttaatatatattttttctaaatattctagataccggaactttcgagaaagagataatatcacaaaaaaacagcaaatagtaaggtaaaattttcattattcttatttaaacattttttttaataacatatggattcacccaaatgttataatatccatggatatagatatccatattatataagatttatgaaagtatatctttgtatttaattttttttatataagtcacataatatgagaacaatattttctaaaactatacaaaatagattatataaatcttgaaaaagaccatgtattttgatttaaagattaagatctctggatgttcatcttcatatttatttttgtattatatatttatattgtaattagtttttgttatttataatatcaacaaattcagatccggataattgtttctcgaggtaattcgaatcggaacatctcgaaattttaaagtatctagttctgtgtcgactttattgtattatatcattatttacacacaggaaataagttctaagcatatgatattttcagtagcaaaactttttcttatataagctattaaatattttttttcataaaatatactttcagtttttagaaaatttataattggtaaaaatttatttacaaagagcgggagccaggaaaaaagaattgttattatttcaagtgtaattttcttaaacgttgacattttttttgattatatactatacattgatcaaaatacacacgtgcaaaattttaatctaatcattaataaatttgatcttttttattttaccgttacgtttgaaattataatataacgatgattattattttctatatatcaaaccaaaaatagctatttatacaatccaaatctttttctttttttaatcacacaaatcattaacatttgatgaagttgtttctttttcaatctccatcaagatcattaaaaatatcattttacaataaaaaaaaattaggggttaaaacataaataaaacagaaagtataggggacaaataacacaaaaacaccaccacgtccgccaccaaaagttttaactttcacacgaagctagccatgtcactctctgctcttcttgaccattgactttttttagagatacagagatatgtcttactatttaatttcctcattttgcaaaatggtaagaacgaaaaagaataccgtcattgagggtaaaaccgtaaatattaggatacaaacgagggcaatttaggtataaaagaggatgataaatacgtggtaataggtcaccaccaccaagctcttcttatgttcatcccaaaaaagctttaataaaaaaataatcgtttctctatgaagaagaagacgacgacggaagaggaagacctagcatcgccgacgatttatttttgaattttcttagtctaagatatctccggcgaggagacgtagattcatcgatctaatattcatcgatctcgttcttgtggctttttaaatcgcccagacttttaagagacgctggatttgatatccgagaagagccgtttgataaatacgtaatcgattcgagcggtggatagtgaaattacggcggaggagttgaatcggatctcggtggtggtgtgtttctgtatttgagtgaggaggaaggagaaatataaaaagtaggtggagactcaggtatatgaaaaccctaagttctttgattactactgctctttgtttattggttcaatcaaggagagatctgttttgcttatggacgtcaatggaagatcccttaggctgcgatacgcttcgaatattcttttcgccatggaagatcccttaggtttctgcaattttcttgggagatctcttaatcatgagaacgatttctttttaactcatcttcctcaggaacttagtggacatgagtctagcctttacccttctgatttggctcatctatatgatagaattaggacacgatgatactctgattttgggcaagtttaatggatcttggcttcacgcggccattcaagtttttccagaatcttcgatttggccaagggcagtgatctgaagtcagatttaatcggactagaaacatgaataaatacttgttttgtatgcttttaatgtcaaaactctggaggtttttttcagacttatagcgcaatctgtcttaaggtaaaggctcatagagtctttaacttgactgtctagctatgaagtttttttgcctgcagtgactctattattgtatactagaagtaggcaatagctcttgcttatgttttttttttaatatggtttactaatgaaaggttattgcttgcaggtgaggtaagcgttcataaaacaaaaatcaagttttgtgggagtgcattgaagc

SEQ ID NO: 15158 - DNA, 3000 bp, Unknown
  misc_feature (1)..( 3000): cDNA_ID_3094679_gDNA_ID_2926068_Annot_ID_196220 3000 nt of promoter + ATG
caagaaacttcatcatcaaacatgtgttccaaaacactatccattcggtgtggggtgaaaggaatgcaagaagacatggtgaacaaccatctccggtggggaagctggttaagatgatagacaaaaatatgcgcaacaaactgagtacaatccggtgtggaggaagactcacatatgaagatggacttcagttttggtttgcttcaagacagaacctaatctaatgtgtggattgattagcttatggaaaaaattatgcattaagttgtagaacaatgttgtaattttacccatcctttttttgaatataatttaacagctattcaaaaaaaaaaaaaaaaaaaaaaaagcttgcgagaccattggtttcttcaaagtggtcaaccacggtgttgacccggacgttatctcccggttggagcaagagtccataaacttctttgctaaacctgttcttgagaagaaatcggtcggatcggtggttaaccggcctttcggttatgggctgaagaatattgggctcaaaggtgatattggagaggtcgagtatttgctccttcacactaatcctctcttcctttctcagttatcatttggtaacgattctaccaagttcgggtacgttacataattacttggctactgtggagacctggttagtatgtagaacattaagattagggatatctcgcaataaaaacgagttctgtctatatatcaacgtatcttacagtctaatacgtacagaaatgtaaatgcagttttttcctttgtgtataaatgcgagaacctatccgtatatacgaaatttgcatgcatgcatgtgtatagttatatctgctagatagatttttcttttctactagagatagattactagtatatgagtttgattttgtttttcgcgtttgaatgtacatgttaaaagtgtgtctagaacataaaaacccacaagatgatttcagagtgttctattgactatagtggaaaagaaaagctaataattaacccataataaaaaatatatagttgactaattacaagtgaattggaattctgttttcagccaaacttataatatttttttaatcaaatgaaatttatgaattggtttctttcttacatattatgaaacattaaattcgagtcagcaacttgaatttcaaaagtacagcttctcgatcagtctgtctactcgacagggaatgggtaactttttttttaacttacgcaatgcatgttgtgtgtgcagtgtgtataacgctaacttatatcaacaataaaaaaaatccttttttccttttttttcccccccctgaaactgttatgctttcgaaatttcacttatctctctgacgtgtttagtttcatcctaaaagtgtatatatatatagcttaatgtttctatgttttctcttatcttataatatatgtatttcttataatgagcaactcgtgatgatgtatgatatgtctgtttgacagctctgcggtgacgtgttacgtagaagcaattaagcagttggcgtgtgagatcttagacctcacggctgaaggactacggctcccacctcataccttcagcaagttaatcagagccgttgatagcgactcagttctcaggcttaatcactacccatcatccaatcaattccttagtggagccaaggtttctgatatgtctgtgtcattaccgagagttggcttcggggaacacacagaccctcagatcttgacagtccttagatccaatagagtagggggcctccaggtggcattccctgacggaaggtgggtctctgtctcccctgacccttcaaccttttgcgtaaacgttggcgatcttttgcaggtcagtccctatattcattacccatttgattctgtatatgttactttaaaaaaaaaaaaaggttttcaggtgctacttgaaaaacttaaaatgcaggaatctaactatttaataatacatatcaacatgtaagaatctactaagattctataaatttccacaactattataactaaaatattaatcgatgcaaaatttctaggtgatgacgaatgggagattcttaagcgtacgacacagagcggtgactaccggacatgcaagcaggctatcgatggcgtactttgccggtccatccgtccatgcaaagataggccctattccgggaatcatcccggcggcagaacagccacggctttaccggacgttcacatgggctgactacaagaagtttgcttactcgctaagccttggagataaccgtcttgacattttccgctcatgtgtcgatgagcatgatgaattgggcttctagtaatataactgaattgggcttctaggaatatcactgaatttgggctaaaaggccgaaagaaacttcttgtagttggtaaggtaactatgaatcaaaaagtaggaccacattttgtatgggaaatttgcaattcaattctattattttggtgtctattatacaactcgaattaaacaattcgtacatgatattgaaaatcaccataaagatgagaaaccataacaccagtgatgttacaaaaaataaaatcaaccaaccaaccaatagacacaatttttttcccgtgtaacacgagacgacccaattattcgtcttcctcaaaaagactcgaaaacgacgtcgtattgaattcaccactcacgaagtttccgtcttcgttgttgagagtcggcttccgaaaactatctttcttaattgctttggttccttgccttgccttgctcctcagaaatttttgcttctgtttgattttgtttttgcccctttgcacacatatcatccaaattcgttatcatttttcacctttgaaagaatctatctccttgctctgttatctccagttctagggcatacgccgatcacatccctagctccttttggctctaataatacagtaatcttaggttttcggggagtgaatcgtgtattggtattctagttttagctcaagaac

SEQ ID NO: 15159 - DNA, 3000 bp, Unknown
  misc_feature (1)..( 3000): cDNA_ID_2113740_gDNA_ID_2926069_Annot_ID_196224 3000 nt of promoter + ATG
tagtgacacctaaagtaaagaagcttaattaatgccattagaaaaaagtagctgattcttttcatatgtttatgtcttttgcatgatataagtgggttataaccttcattaatcctagtcaatgtgtcacactcacacctatcgcaaaaaattgtatgaagacgtacaaagccaaaaattcccggactaatctattttctttctctgtttttcgaaacagagtttctaacaaaactaatttatcgtcttccatttgaacatgaaacttactcaggacttagctacggcctacgggtaaactcagtcgtggttttggaaaaacggtgacagctttgctgtgttcaaatccctctatgattttaattttttgtcaaatttcgttgtacttttgtgacttgttcatatcacatagtatggattgttgttaaaatagttcatttctgtgtttttgtttctaacaaacaacattttttataaaaaaagccaaaaaaataaacattttcagttccaaattccaagagccaaataagaaacatcttttacatattccctaattttcattaatatctctgtttctggtacaacttctcttagaactgtgagaagttaattaacagaaacttgttgtttatattttctaggaataaagaatagaatgtttgggcggcaactcgaacccggttgcatgaaccttgagaacaaaatcaggacatatctttaaacacaatatctagctaccagctttcttttttcccttatataattaaaattttggcagcaatatacaatagagaattttactctgtgggacaagaatactcttctaaagtggattactttttatgtaaaaaaaaagttgagaaaaaccaaaactttcttgcttcttttttggttcttcaagggaacagctacatgcctaagattcagttctcaggcaacatgcaccaataacaatagccaaacacaacttgcaacaattgcactttgaccttcttcttttttctctcttttcattttatccaattctttcatttttatctcccttttttaattcaacaacaaaaaaaaaaaatctaaaattttgtaatagttatagcatacattgtttaagagtaattaactgtgtagatcagtctttgtttgaggaaaaaatgaatgcttctttttagtgtaggataattaaaggtaggaatattttcagataacaaacaaagatcgaactaagatatcagtttcgctttagcttaacagaacacatgaaagcaagatttcccaagaacaactttttaagtttgaacaaaaagccactaagtaactcataattatatacataaaaaaggtatcagtactttgaaggcattcggacgcagagtttcagatattgatgatttactattcctggggaatgctgatgagattctattttttaagagcataattaaatccacaagtaggataagataagatcagctatggtagagtttaaaaatatcatatgacatgtaacactgacatcttatgatgtataatttgagatatttggaagatcttcttttttctcataaaatatttcattgtctagtccatgggacgagtttgaagttaagcagatcatggaaagagaatctaatattatgaagttgtacaatttcactgaaaacaagataaagggaagaaaaacatgtctccctttaatctttgaatgcatattcagtcatgtcatgactgacccatccatcatctttcttcgaatctcctatctcactgaacatgtttggaggcagccttccgtattttatatctacacttatgatctcctatctctccatcacccatatttgattatatttttcaacatattaatgtctcaatttcccattcttattagttaaaaaggaaaaacaaaccctaactcgtggtgattcagtggttgaaatttttttcatacggtttaaatggcaaaattcttcatagatcccggagattatacggaacttggtttataattcccggctcgaaagtttaagcattggcgaccagagtttagatatcaaatcttgtaaaatacgcatgcatggttgtcatgcaaacgtagtattatgatgtaaccagtgaatctaaattggactgaggaggtagggggtaaatagacacacaaatctaagttcatatacatttttgcttaaatatttattggtggattcaagtcatgggggctgttttgtacttggagtaatttataatgtaaacaatcgagaagaacatgtgttaagattctggagctaggcgtagggtttctctttacgtagttttcatagcgtgtgtatttgtgtacggccctttgaaataacgcgaaaacatttattctcggtttttaaaattctctttttttctgtttattgaaaaaatgacgagacacgaacattggcaactaaggacaattggtgtggcttaaattagatatctaattattcggctgtgctccattgtctaacgtatcacaattcgacagatgtatcttagtatctacaatatatcaattattaaattcgatgacttaagctgtttaaagtttcattttctcgtagttgaaaattttacaaaaagaaatgttcttaagggagataaaacaagcacaatggcaaatccgaaagaaggataggtggatgaatgtagaaagaaaagtgcaaaaattaaacgaaaatagaaacagttagaacataaaaggaaaaatgagctggtaataattaagatgtttaagttaagaaaatggctttgacagcatgaaaagagagtgtaaagaagttattaacagagcatagagtctcactaactgtaagtttggtgttttcggtcagcccaatttgtgttacggtcagcctgcccgaacccaacaacttgtaacatcctcacacaaaaactcctctctatgtttcctatatatatagacacttgcacacactctcatttcctcccaaacaaccccaaacttataacaaa

SEQ ID NO: 15160 - DNA, 3 bp, Unknown
  misc_feature (1)..( 3): cDNA_ID_3094746_gDNA_ID_2926071_Annot_ID_196233 3000 nt of promoter + ATG
ggg

SEQ ID NO: 15161 - DNA, 3000 bp, Unknown
  misc_feature (1)..( 3000): cDNA_ID_3094772_gDNA_ID_2926071_Annot_ID_196234 3000 nt of promoter + ATG
tgatgttttttttatgcaaagccaaaggtaatatgtatattgatttataatgttttcttgtgttgtttgtggatgcagaacgaatgtgttattagtcgtgtttttcatacacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactgaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattctgaatttggaaaatcgaaaatttggatgttaactagggggtatatagggtttttaaaaacagtgtatatatgcgttatgtgttagctttagattctaggatatacaaagatgacactaatagattcttataacattttgtaaaaaaaaatcattgtagtgaatactctcttgccatttgaaatccattgtgtttgcatatttaaggtgttcataaattgtcatgctgaattgtgtttgcatattctcattatttccctgtttgtaattaatgattgtaacatacctaagtagataatattagattaaaaatatgactagtttaccaaattttacttgttacattttgggttcttaatcaaaatcaaaaggctgcaaatggttgtctcaagtagaaaatattaagttgaaaaaaactgagatcttaataaaacttctgataaacagaataaaaactaaacaagtgaaacaataaggcttcatgatgaaaagtgaatttcaggagattactggcagcagagacacgaaaaaaaaaccgaaactgattcgggtcgggtcataagctgcaaagcggatccctaattttgatatatgcacataaaattattagacagattccccaattgtttttacagggatgtcccagtacttgtgcaatcataaacagcctttgatactcacaaaaaaaaaaaacgaaaataacgaagaagatagaaacggcggaagaacataagtgtgtattgtcttttagaaactatcggtgtgataaacaagcttatatataaactagtaaaaccctaatcatgtgtttgttgatattttgggcttttttgacctaaatattaatgggcttttattatatgtcaaaatgggctttgttttttcattcacaatcccgagaagaacttactcatttcataagcaaatcaatcattcacattttcgaatatataatttagtcatctttgtatatcctagtcatttttgatttgctatacaattataattccaagtctatctctttatgataattgccaaaagacatttctaagggaagacacggataaataccatttctcgaattgtaatctcaataactctcaataatagagggtcaaaacctctttttcttatgccaattgccttcaagctttcaatataaaaaattgtattcatatatatatatatatatatatatatatatatatatatatatatatatatatatttaataggagcaattaatctcaactccaaagtctcctactctacagaaattattactagtttgagtagtttatatgtaatggtatcaacccactcttatcaacaaagcatatttcccaagtcaattttgagatttaaataagtttttatttccggtgaaaattattattaatctgtggatttccaacttgaaatcaaattgagtggagagactcatatcttatatatactatttaagattctactcaattttcaatgtgggacaatatctctaatacgtctcttcgagataatggttcttctggccattcatctcgatatgttcagacattgatcagcgggtcaactactgattgagctgatgtggattgggttgagcatgtgcagatcgtggtatgatattttattagattgtaggcttccaactcaaaactaattggcaataaatagagaaatccatctcttatatatactttttaaaattgtactcaacttccagtgcaaatcgtactcaacttccatgcaaagccgtgccggccactaaccataaaccatttttttaggccacaattccaagaaaattgtgttactttggttggtttgagctgactcaaatattctttatgcttcaaattcaatctattttagtgacatttattccaatatataatttgaacatttggttttgtattgtttttgttatgctttatttttatattttaaaatttcttcttatatatgtatatataatttagttttctttaatttattatttaattatttaactagacaaattggaacatatttttttttgcccgaaatctcagcagggcactgttccaatgtgagacaatatcttcaatctacctattttgaggaaaaaagaattcttgttattacataatatactaagactaccttcatttcaggttgacaccgttcgtgtcgtgtgaccattttatcggccctctcttctcggcgcaaataccaagtctcaacgtccaacttctctcttctctctcacagacagactaatatagaatatgtgttatatatagtaatgaaatgatcaatcgaatttgtatactaatagttatcaaattattaaaaaagtatcagctccacttaagatccaaatccctcatcatcaactctcctatataaacattcgaactcctgacaattcatctcataaaaaggttataaaaaaaaaaggaaagaaaacccaaaca

SEQ ID NO: 15162 - DNA, 3000 bp, Unknown
  misc_feature (1)..( 3000): cDNA_ID_3094781_gDNA_ID_2926072_Annot_ID_196246 3000 nt of promoter + ATG
taatttttggttaactggtcggttcaattggaggtgtagttttaaaaacaaatctgaaagtacatgtagttttatcgagattaaaattgtttatggtggtttttcaagtggctaaaagtttagggtggaaagttgagactgtcacctaaagttcatgaaactgtcaaatccttacttgccggatttagtagaccgaaaatactctaagccaagttacttcatcgaagataaaagacccgtagtgtgctcttgcgatgaaactggtcgggcttggatctatgttttcagggaaaataagctgaccagtaaaacttagatagataatgtggttgatccttgaccttcgcattctacatttattcccaatttggtacatgttcctcaaggttaaagagaagaactagcagagttaaaactttaattttcttacatttgggcttcttgtttagttgttgagggagctaagtttgatttggattttgcattttggtgctttattcacaaactatcctctttgttggaactagagattgtttttggtaatttttgttttttttgcaacataaattatttattgtttctagaacaaactagagagaattgcattcactctcgtggtcttggctttgttccgataataaaaatatgttagacttcacttgttgttgggtcaaatatgactaagctttggtgatagttttaatttacctagcttgtgtacagaatttaaatacatgatggtatgaagatcaataagtagcaataaatggaaattttctctttttcctagtgaataaatgtaagagttccatattttatactagttaatacttactaaaatgtaaaatttacaaatttcacggatgttttatatgtatgtaaatttttgtgttgataaatgacgatatactatatataaatatatgcccaatggttgaccaagggtttattaatgcttctacaccaagaggtcggggttcgagtctcagctactgcgatttattagcagatttgcagattaatggaggcaagtgtgcaaaagatctacaacgatgtacaattatagccgttcacctaggattctacgcagagaagatattgaaggtgtccatcaagcgcatggagaaggagaatgatgtgtcgtctgccatagatctaataagggtcggaaggaattatccgtggtagaatcgtctatgtaacaattctcataatttgtaataaataataaatctagacggtaaaaaaaaccagaaaaaaaagacgggagaaagaaaacatttgtctgtgtgcaatatgaaatgtatttgaacatttccctcttttaacttggtatatacatattgaaaactcggtactcttgtagccttgccattttcaaatataatagttgcttctgactcagaagttctgagtaatctggacaagtagggaagaagaaacaagcagaagttaccatgccatggagaggaattgagcttcaaaaggttaaccaagagccatgaacgattaagtgttttattgtaaaaagatgaaaaattagttcttatctttaaaacatgcaaaatttagcttgtcattccattgtattcctccaaacacaattacatagcctttagacgatcaattagagccttgtgcatcatatggtcctcattaggaacaacataaaaaaactaaactaaataattaaatcgaaccaaaattcatcaatttaaaactgaattgagtaaactggtttaagaaaaacggcatttttgattgatcaagagagttgatttaggatttagactacatgatctcgatgtaaagggtgcaaactaaacaaaatgatgtcagaatctagcaaaattttacatggtgatttgtggcaaaaatctcgcgaattagttaaatatttaaatcgtaacagagaaatcttcctaacaaattgattaatatttttgtctagttgaataacctccaaaaggaaaaataccgtttgagatagtttaatttagtttcaacgaatacatattagatcttagacaaaacgatctaccggatcaggtaatttaagttggttaaaattgtccaaaaattctctaatgccagacttgatctagtcccaattagtaagaaaatgagtactgaatataaaaaaacaaaaacctcatctggtgatagaaatcgagtgtaacatcatattttttcttacccatttcatcaaaattccacataaaacaggtttgccatttacttattacaccaaaacaaaaaactggttgagagtagaaacaaacttgacttgggacgaaaatactcttaaaagtcaaaacacaaagattcgaaaccaaaacaaaccaaaccaaaccaaactgataaaatcctaactaaaaaaaagcatttactaaacattttaaaataaataaaatttcccggaactaaaaatggagggaaatacgacgttacaataccaacaacaataaaatgacgaatttacccctaaacacaattatatctccattattttctcgattcgcgcatgtttctctcaagtaaataaaataaaaatcccaacaacaaaacattaaaaaccctttctctcttcccactttcacatccatagctaaacccttgaagaagattgtttagtgtgttctcgtctcttcgtttatttcttctccaccgatccaacaatgctactctccggtcaatctccgactctgattcgttaatctccctccgtctctctcgtctgattccttccgtatctctctctgattttggccagagcacgcttgataatcaaaatttctccggtacggttatgtaatccgtttcctgattagggttttgaatttcgtcttcgtattgtttctcgatctgttatgatcgtacgtttttcgtttattgttcgtcagttattttttaattttgattttgattcgttgtgaaattttgactgtaggggtctttatatgactgagatttgagaacattgtgtagaaaagtaaagaa

SEQ ID NO: 15163 - DNA, 3000 bp, Unknown
  misc_feature (1)..( 3000): cDNA_ID_3094800_gDNA_ID_2926073_Annot_ID_196251 3000 nt of promoter + ATG
aaataagagctgaacttatacgtaaagttgccattgatttagtagactattctcttattcgtggctgaatacatgcactagacaacacatatggttatatagacaaacggtagaagaaaatattttatataattaggagatcaaaagatctaagggtgtaaaatatttttcaattaatagctaaaaaagcttttataatatattgaccgcaaaaatgcttaatctatatctgttacaatattttcaacttttatacattataatcatttcaacttttaaattattaaataatggtacaaccgtacaactaatctaactaaatctaaatgaaaaaaatatcatttaactcatcaattattatttttttgatgatttaaaacatgaactttggatctgataattgtacacatttgtataattgtcatttaaatcacacacttctttttctccaaaagctccttgtgtaattatacccacgaggccactatatgtatgtaaatttgatatcatagcttatttgattagataatgtccaagcctaaatgatttgtgtacctcgtgattctcgtgttatatttggtgacgttattatgtacaaaaaaattatactaatggccccttcaggtagaacagccattcgcacaaaaagtgaagtcaaacaaaatgtatcttctccaaattctaaatgttatgtgtatctcgtgatcgtcgtgttatgttggcaaacaaacatggcccttttaggtagagttagtcgtatggaaataaattctccattcgaagcttggagaaagtataaaataaagtatataatgttcacttggcttaacaatcgccactcgttcactgcacattatcttaatttatatcaaattactattgaaagataatagaagataacgtgcgtgtatctccaatatataagacgtcacaactcatcacttgctctgtcttattagaaggaagacaagaagagttctttgtgtcgtttgtttatgcatcaaattttgcagcagaaagaaaggatttgtggagtgatattaaatatcatcatgattcccctttgttctataacaaagcttggttaatatgtggagactttaatgagatattagaaggagaggaccattcactctatgaatcatctccattcgttctccaagggatgagagattttcaagacttaatcagacattgtgaattaacagatatgagctaccaaggccagagatacacatggtgtaacaagagaaaggaaggagtaatatgtaagaagctggatagggtactgattagcaagcaatggatgcaatagtatgaacagtcctacagcgtctttgaatcaggcggttgttcagatcacctaagatgtcgattctatattatggagcaggaacaacgagtcaagaggccttttaaatttataaatgctttaatttcgtattcggatttcagaagtgagacagaagagctttggaagacaactcagcctctctttcattctacctcagccatgcaccgcttatcaaaaaaattaaaaggtctgaagccacatttcagaaagatggggaagcagttacttggtgatatctcaaaaaaagcaaaagaagcctataaaactttatgtgaaaagcaagcagaaactatgacaaggccatcttcacaggcagtggtagctgaagcggacgcatatgagaagtggttaaggctgtcgggtattgaggaaagctaccttaggcaaaaagcaaaactgcattggatgaagataggagaccaaaataataaaactttctacaatgctgcaaagattcgggaggttcgtaacaatgttagagagattaagtgtgatgatggacatattgcatcaaatcagcagcaaataaaagcagaggcagttcgatacttcagagactttttaacgctcaaaccgccagactacgtggattggtcgcgggaggaactggaaactctactggattatagatgtgatgagaatgacaagacaagctcacactagaagtcactgcagaggaggtgcggaaagttctcttctcaatgccttcaaataaatccccaggccctgacggatatacttgtgagttctttaacgagacatggtcgatagtaggaaacgattttgtggtagccatccaatctttttttaagacaggcttcctacccaaaggagtaaactccactattttggccttgatacccaagagaaaagaagctgtgatgatgaaggactatagaccgatatcatgctgcaatgttctctataaggtgatatcgaagattcttgcaaacagactcaaaatcattcttcccaagttcatctcttcaaatcaatctgcctttgtgaaagatagactattaatgaaaaatctcctcctagcaacagagattataaaggattaccacaaggaaacagtttctcctcgatgtgccatgaaaattgacatatcaaaagcttttgactcagtccaatgggggtttctcaccacaactctacaagctctagattttccggagtctacattaattggataaaggtatgcatctctacagcgtctttctcggtacaagtgaacggtgaactcgcaggctattttggtagtgagagaggattcagacagggctgctctcttagtccctattgttcgtcatatgcatgaatgttttgtccaagaaaatagacaaggctgcaagtgataaaagaatagactaccacccgaattgtaagacgttaaacttaactcacctctgttttgctgatgatttaatggtgtttgttgagggaaacaaaaaatccattgagaatactttagaagtgtttgaagactttgctattcactcggggctaaagataagtcttcaaaagtccaccttatatatggctggtttacaagagcaccagagagatgagatcctacaacaattccctttcgagtatggctctcttccagttcgctacttagggctcccgctttggttacaatg

SEQ ID NO: 15164 - DNA, 1625 bp, Unknown
  misc_feature (1)..( 1625): cDNA_ID_3094800_gDNA_ID_2926073_Annot_ID_196255 3000 nt of promoter + ATG
aatgaagaggccttacaagagaaatattcaagtgaagctttcttctttcttttcttttctttttttgattgaaatttatgctttctagattcacccaatccccacacactcaccatgaccgaaaagaagtttccttttcacgatcatcctttagcatatgagaaattggacagattttcttgcattttgtgcaaaaagaaaggtggttttggctatttctgcgataagtgctatttttgggggcataaggaatgcatcaagcgctcacttctgcatccatctccatgcaaacattctctcaaaatctacacactcgaggcattgggctatgcaggtgaccattgtcatttttgtagagattatcttcttgatgatttttttcattgtttgatatgcaacatcaacatggatctcaaatgtcttaaagatccaccaccatcaagtatttatcacccaaaaaaccatatgcatatgcttactcttttgccgagagtggtcacatttacttgtaatgcatgtagcgtagaaggtaagcgtaatccttatgtatgtcttgaatgtaatttgatgttccacaaggattgtatatatctaccacgagttataagcatcaactgccatgatcatcgcatttctcgcatttttcatcttggtctcggagattggaaatgtggaatctgccgacaaaagattagttgctcccatggagcttttacatgcttgcgttgtcctagtcttgcatttcatttaaaatgtgcgatgaaagatgacgtgtgggatggaaaagaattcgaagctgaacccaaagaagagcttgaagatgaactcgaagatgattccgaaaaggaaattgaagatgatagttctgaagaagaaatcgaagaaccataaaactaatgaaaaataaatattggcgtgtatgttatgagaaattcattttaaagcttgatgcggattctgttagtgacaaactgacaatgtggtgcaacgattgtgtccaacaatgatccattctttttgtatacataatgtttgactcttgaccaaacgaagaaccctgaagtctaaaattttgtctatgactcgtcattagtaattctagagttaatggaacatgaccacattagcctaacacatgattaaaggggccaaactcatttttaaaagattttgaaataaattattacaattacaaaagaaaattaatttattgaaaaaattgtatataaatgtcttcctgatttctaccataccaaaaatatatatttcttcctgattttctatgtaggagtttcaagatttaaattttaaaatatggcatatcaaatttaacactagtaatatggagtcatatctcaaaattgttttttataccaatttcacaaaaccttttttatctatatatgtaaaaatgttttaatcatttgttaaagaaataataatgatcaacctctatgatctaattcaattttgttgccttaaataaaataatacacatatgccacgtttgccttatttacataaaatccctttaaaaagatgttacaagcaattctggtcgcgattctataccaaaatttcttgagccttaaccctaatttcgattacgacgatactctctgatg

SEQ ID NO: 15165 - DNA, 107 bp, Unknown
  misc_feature (1)..( 107): cDNA_ID_3094834_gDNA_ID_2926074_Annot_ID_196257 3000 nt of promoter + ATG
ttgagaggttttcatataatgtcagcaagtgtttgttttcacatcaagctccgtttctacagagtttgcatctcaatatgaactttgggtgtgaccctcgtataatg

SEQ ID NO: 15166 - DNA, 3000 bp, Unknown
  misc_feature (1)..( 3000): cDNA_ID_3094855_gDNA_ID_2926077_Annot_ID_196264 3000 nt of promoter + ATG
ttattcagattatgatttgtaggattctttaatcatattctaatgtaatctatttcatgaatcttttgtgtttgatagtgaatgagctagttacatagggttatatatattaataggatgcttggacaaccgtcacttattcgagaatcttcaatacgtagatttccatggacatgctcagtgtctcaatttaagatcaggatctcacggaacaagttttctcagtgaaactcttagtttaaaagaagaaaatgaggtgaacccatctcttgattttgattttgtcttctatttaatcatcaagatactaaaagtgtttttttttaatctctccaacatttgagatgctattaaggttcatattctcttcgtttgtcatctggtggatctgacctgatatgtgagggtttattctctcatcctaatgagatttgggaccttgcttcaagcccttttgatcaacgcattttctccaccgtcgtctccgctggtaaattctcttcgcttgatttgattagttgcaagaatttggagctctggtctatgtactgatttatagcgtgagtgtttcaaaaacacaaaatggttttatccgtgaatcatttggagcaacgatttgccaaattcctgagttatatggtcaatagaattctcaacaattggagaggagcgtgttgcttctcttgatgcacatgttggtaagattaattggtgactttatgatcaaacgtttacagcagtctattgctaacaatgatataagagtgttaagaacttattttcttcttgtcttcattctccttttacaagtgttaagagtgttaatacaattatattaaagacaaatatacgaacaaattactactgtagatgtggagaaaagagtgatagagattgcttgttaaataaataaaaagacacaaaaattggtaaccgagttcacggcctcaaccggtacgtctagggggagatctcttgctcccaaagcttcactatatcaaaggaattacaaacacaccactaacttgtgatgttgtcttttggtttttacatatttgcactcaagaagaacaaagatttaagaacaacaaatagaaagaagaaagcttgcttaggaagctcttttttatctctcttctctagaacactctttagattcttttctcacctacctccaccatacgtcgtacgttgtaatgcatatataggtgacgtaaatgggctacaaactttttgcccacacttttgttcttcttcaccttgccaattttgttgacccattaaagcccaatgcttgtgttatgtcaaacccaaataacagtaggaaaaatatgattggtgaacagtagtaattctaccaatttcacaactaatatcaaaataaaatattctgacatattttttcaaaacgctggacacattatacaaattgtggggaaaaatcaatattaattacgattttgatatatctacaccaaaaaaacaaaaattcacaattaattaaatatataagttctgtgaagtccagaattgtacgcataatgatatacaattacgtaaaatatattacaattatgcaagggagtaaaaagacacaaaaatattaataagtaacagcatatagacccaacggctataatgctacacattacacataaatccaacaaataataatgacaattaaaagctcttcaattatataatcaaataacagtaatgttaaaccttaacaatgtcactatataaataacaaaaacacacatgcagaaaaccataattacatcaacaaaaatatcaaaatggaatatatacaatacgcaatgcgctatgaagcaagtccaacatcaacccatccacccaacgagctccatctggatttatgaagaccccatcgacaagaaaacaacatcagctacagaatctcattctcccacgaccaaatacttcaaccaaataataacatttcagagaacttaccaacttctatcttaccttccatgacattgacgaagcaacatcatgtactttgatcaacaatttgacaaattttatagaagcagctcttctctcatttggaataggcaatccacaaccactcaaagtcatttttataatcgaagataacaatccaaatgcaacgacaagacttgatgtggaagtcactatacaacacctatcaattttacaaaggcaaaccacaaaagaagaaaaagctgaatgctcaatctgtcttgaagagctacatggtcttcaaaacattaacactatcttgcaatcacatatttcaccatgaatgtatttcaacttggttacgtcatagaactacatgtcctaattgtagaatccaaatagtataaccttcatattattttcttattattcatgattaataaaataataatgctcttttatcaatcatgcttttgttgattcgaacatttgtaaagggtttactaaaacacaatatttatatatataaacaaataccacataccaaaataataataaaaaataatatatttattaaaaatagaaaaaacaaaaaaaaaaccaccatttcacataaaacatcataaaaataaaaaaataacataattacattttaaagacaataaaacactatattaattaaagaagcaagaagaacacaaccatataccaaattaaacaataaaaatatacatgtgcaacaacaataaagttatataaaatatatatattttttccaaaagtttaaaaacaaaaacaaaccaaacccgcccaacgggcgggcctttacctagtatatgatgtattgttcctactattgagatatttgatttcattgggttattgttcttcattttatcactacaagaaaacaggcgatttgcgagggaaatttgcggtggaaaatctccctcgcaatttgctacggatttgcgagtgtattgcgagagaagaagacaacctcgctaatccctcgcaaaatttgcgacgaacaaatccctcgcaaatatg

SEQ ID NO: 15167 - DNA, 3000 bp, Unknown
  misc_feature (1)..( 3000): cDNA_ID_1396414_gDNA_ID_2926078_Annot_ID_196272 3000 nt of promoter + ATG
tgatcagtaccaaactactaataatttcagaaagataaaccattaataacttaatatatgagcaaccatttttggtaatcaattgagttttcttttaatatcccattgaactttatagttaaccaatgattgcaagtacgtactaggtttaattagggattagatgcacgttggaaacaaaagttgtggatatatatattttttattaacatatatacatggggcatgatggtactagtcctgctaaccgttccatttaaatttcttgaactggaaaattgatgtctccgtttgcagaaatcagcgaactatgatgccacgcacggccaagcgtagatagataggtagatgagaggttcgatccttatcctgataagttccggagacacacatctttttctttgagtgacttcccaaaattgggaacattcgcaaggtggctctatccaacgtcacaccaaacgacactgatgagtcatatcatcttgaaaaaatatgaaatgacataaattcacattgaaatgaatcatggaaaagaaagtggtgtgcgacaatgtcgattaaatttaaggttaggtctcagctcgaattgtatacgttgtcttacctgtcattatatttttgtagttgcagctttcgaactttgtaccttcgtattgtgggtcgtctaggcgcctatgtatctctatgttgatttgattagtactttttctctaattaattacgttgtaattattacaattccacctagtaaatattccttttatatactaatatggtatattttgtaagttcactatcaagagccaataggttgatatgtctagattgatgtgatttgtaagtttcttttgcaagtaaatgtgacttaattcgttctagtgtctatagttgatgtgaatattaatggtcaggaaatattagtataaggttgtgtctactgatatgtgtgacttgttttttggtgtgtgtgacttatgtactttatcaacattagtttggtcccaatatcttttgacaactcaacttcagtgaatgacccaaccaattttcacgtacgttaggtttgtatgttgggaatcacatgaacattttgttgaacatctataaagtaatgtctggtatgtaaattttattttgataccgtgtcggtggaaaagccggcctgagaatttaatggcttagcttcacgccaagaaacatacataactgacccactaaatatcgattaatccaaattctcttcaaaatatatatatataggatcgatcctgaacatccaaaattactccaattgatattatcagcagaactactggggttttctctctaaaattattatataaatcaaaaaccctatactcatgaatgtttgagaagctcttaagtcttaacaggggaaataactagaccttcggttcgagtcttataattaggaaggacataattaatttatcagctatgctaatatgctatatagcctaagaaaattatggaccgatgttatatatataattgtatttgtacatctaagtttataaaattctatatatattactaaatataggattatacaaaaataaaaataatataataataataatataggattatacatcgatggatagtcccaatgatttactagaatagaataaaacatgttcaacttaagaaaagaagagttaaaagccaaaagaaaaaaacgtttagataaaacggaaaagaagagtgaaaatattatgaagacatatctcttatgagttgtccaaaaaaaaaaaaaacatatctcttatgataaattgggtatgtgacgtttctccttttcattttcaactgctgtgtatctccttcctgcagaaaagactttcttgaatattctacaaaaatgcttctcattaaaaatttaaaatatttttaaagattaacttgctaaaagcctaaaacatgtacaaatgcatttagtaggtagaacttaaacagagaaggaagttatgtgaatggctgataataatctgatatgatgcctaattgcctaaacctttttccattccactcttttaatacaaactactaggattacttacctaaactacttgttagaatcttcataatgggcttgctaatatgattatccctaacacataatgtagaaatcgttgagagcatataagtaagatactataataaattttttcctttacaaaaaaaaaaaaaaaaaagatactataaaatactatatacgcatctttttgaacccccaaaccacatgcctcttcttattattaccaaccttgtaatgggcttctgggacatattgggcctttaggacatcttatttaatgaagcagctgatataatcaagccaacgtggtggcaacaaaggttgaacaagttagagagaagtccgggaactaaatactctacatcagctacattctatatttgatacacttgcgcttttccagtgtgttgacttctctcattactcaattctattggacaactacggtagtatacagtaatacgatacacctagccacaggtgattagtttgagcaaaacaaaaatgagagtttctgagctcagtatataaatcccttaaaccctactctttgtcttcatcctctcactgcctcttttctcactcactgttacttcgctaaaaccctaatttcgccattcccttctctaaggtttgcttcatctctttaatgtctttcatagctttagaaatggctttggtttcgatgatctattgcaaagaaatgattattatagcttgttgattagatatggagaaatggaattgattttagtcttctgggtttacatgttgtgtttgcagacatttagaaatggctttgattttagggtttgggattctttgtggtctaattgaaaagaaatgactttaatagcattgttgttaatcattttacagatatatagagtaatggaattgattgttgatttagttttgtgtgtagacatttagaaatg

SEQ ID NO: 15168 - DNA, 3000 bp, Unknown
  misc_feature (1)..( 3000): cDNA_ID_3094909_gDNA_ID_2926078_Annot_ID_196293 3000 nt of promoter + ATG
tgtcgctgcttagttggccattcacattcagtacgagaacattttggtaagctacgtttccattagcttagatctttcctatttttttacacaaaacttttgatccattcatcaatagagaacaacccaatatcattcatgcttgctcttctgttgtcttgtacataagtttattagtacttgagtcgttgcaagatatattgtcttgctttagttacatatgttgagacgtattttttgaaatatttggaatttgaccatttcagtgaaaatatgctgcaattgctcttctctcatatattaaaattttgaccaagaatggcgaagaagccgctcaagaacttgattattacaaatttgtaaaatgtgtaataaaatcatctattcagtgttatgatgtaatggaaattatagaatcaaattatttagtaataatatcgtcgttagtcgttaccattaagtaataagctacataattaattaaactatataagaaaaaaagattctatcttcagagttcgatgcgtactgtgaccattacatactacagttagctttcttctctagccgtcgaagtttcacgcgccgccgtgagaaaatgcagcacacaccggagcaaccgagagtcactctttacataatcctcaccaccgcgtttctctctctatgtttcctcctctctctctcttcctcttcccagtactcttcatcttcctacaccggacgacccgatgatctacgacccgacccgagactctttccttcttcctccaaaatcgccgccgatacagctcctccttcaatcgcttacctaatttccggatcttctggtgacacgcgacgaatccttcgacttctctacgctacttaccatcctcgaaatcgatatcttcttcatctcgatagcttagcgacacaatctgaacgagatcggctcgctgttgatgtacaagatgtaccgatttttagagctgcaaggaatgttgatgttattgggaagcctgatttcgcgtatcagagaggatcgtctccgatggcttctacgcttcatggtgcttcgattcttcttagattgtcaggaacttgggattggtttgttagtattagtgttgatgattatcctctcgttactcaagatggtttggattcttcttgcgaaattctctttgatttgtgatttttctgtgtttgtttttactgattctgagtttgattttgcgtagagcttcttcatattatgtcacatttgcctaaggacttgaattttgtgaaccacactagctacattggttggaaagagtaagattatgtttccctttagtttcacttagagagtctttgtgttgtaggctggatttgattccatagagctaagattcattgttttaggatcagtgtaacattttctcttggtttcttgtaggtccaggaagttgaagccagttattgttgatccagggctctatcttgtggagaaaaccgatatgtttttcgcttcgcagaaacgagagttgcctaaggctttcaagttattctcaggtatgcttagctacgttacattacgttttcattttcccttttctgttttctgcatttatctgtggatcattactaattgaccaccttgtttgctatttagcatattcagtgttgtgcaatcatttggattgatattattatggaagattactttttcctaattatgctgttttgtagaaacttaatccctttttcttttacatggttagcagtttcttggcaccatttcataatttggtaggtagatacgtgatagtgtagaagtggataagtttaggtgaaagctctatcagaatatagactacatgacgtcttgtttatcagtaatgctattagctgctttaagcagataagtgaggaaagggaagccagtgtctagaaattgcttacaatggttctcattactgttatattttgttggttgtttaacaacaaagttctcctattgaatagcataattatatttagttcctactgaatatagcatattgaggaaaaagaaatctttggaggggattgagaaaaatatagcataattaggaaaaagaattgacacatctgaaaagaagggtttgagataccgtttatgtctttgatgatttaaactaaatgccattatctctatttggcaggtccatctttctccatcttaagccggaatttcatggagcactgtgtcttaggcactgacaacttccctcggactctactcatgtacttgtccaacacacctgattctctttccaactacttcccaactatcctctgcaacacggataccttcaaaaagaccatcatgaacaacaacttactctacctagcttctaacgacacttctaaagaaagataccatcagcttgatcacaaagagttcacagaaatggttgactccggagcagcttttgcaagaggattcaggtacgacgacactgtccttgatcgcatcgatcatgaacttctgggacgcaaacctggtgaagttgtgcctggtggttggtgtttaggagattctagtaaaaaccgtagctcgtgttccgtctggggtgactcgggtatccttcggcccggttctggttccgataggctcgagagacgaattgttgagttactatcaaacgattggttcagattgcaccaatgcgtacctgaatgatcggatgatcctcaccgcactttcaatagagtaaatagttgtccaagacacgaagaagataacggtactttatgcttctgtatctttagagagagttccacttctacattgtaacctgtgactttgagagtgtttgttccattgttgttgtagaaaaaccatctcaaagctgagaaatgaaacgactcggttcattggttgaagtctaaaccggtataaaatcccggttttaatctaatctagaccaaaccgtgtttcttatatatatttgaatccgtgatttacgcacgactggttaaagcagaatg

SEQ ID NO: 15169 - DNA, 3000 bp, Unknown
  misc_feature (1)..( 3000): cDNA_ID_3094950_gDNA_ID_2926078_Annot_ID_196284 3000 nt of promoter + ATG
aaagccatacgcaacggtattaacggtaaatttgctatagttccacatacaaacattatgtgtgagtcatttggattgtacgtttggtattcgggtcgagctatttgcatgtggtgaggttgtatgaaactatctgctaaaaaacatttagtcttacgaggccagaactagtcggacatttaccctgccactaaagtaaattaaggtaaacctaatttcagaagctattaaacaatgttttcaccaaaagaacgactaaaattagggagacagagcactaagtaataattagggattcttgtaataaaaggaaaatatgagatatacttaacaaataattaaggacagatagaggagccggattaatagggaagttcacgtgaaggcacagcttaaaccagctgagccaaacacatatactaaattctcattctcacaaacaaaaatcgtgggtccaatcttgattatgtggctgtaaaacctaaaaacataaactattcacatgaataagattttgattagacaacagtcttacttttgtctcttcctctataagattaatctgacccttgagccactcaaaaacaggtatgtctatattcatttcctaatgtgacatctacacacatattatctcttttttttttaatcatgtgactgtagaaactgattagtaaatagtaataggaaaacaaaatacttagtatagagttatatagagtatagagagagggatgggtccaaatagttgatgatggaccatgtgaaaaaaacaatgaaagcccacaccattaattgtggtaaaggatgagaatctagtgttgtagttttccatgtccttaaacggttaaacctatcttctaacaaaattctccaccttcccttctgacatctcccatcacttctctcttaatttattccatccattccaccaaatttttagtttcactttttttactgtagtgtgtttacacttgtgagtgagtgaaaaagtaaagctagagaggttactgttttgagatgctctttttagaaagggccatatataaatggtagtgtagtagtactagtggagcttcttcatatacaattttgacttctcttcattgaatgtaggagagaggctctttacatcataaataaaacaagaacacagctttcagagagatagagtgagattctccttcattaacatattcttcttcatgttataagaagaagaagaagaagtgtccaaaaggattagagatgggtggatgcacaagcaagcaagagaggagaggtgtgagaagtgtgaaggagacatcaaaagaccaaagcagaggaagaagacacctgataaaagagagagatgagagagagaaagtgatgtttcttcagcttaaagaggcggagagagagtggagaaaagagaggaagaagctgagagaggaagtgagaagactaaggaagaagctagaggaaagagaagaagcaaagacaacaacaacagaggaaagagagtattggaagtgggtggttgaggagatgtgtgtagagagagcagtgagagatgaagccgttgagaaatggaaacaactctatttagctatcaagaatgagcttgatcatctcatctcccacactacttcttcctccggtaaaataaactcaacttatttcaacttaaaattagaaaaagtaaataggatctttaaagtgtgtgtttgtaggagaagcaatcatgcaaaggaaacttgaggaacaagaagaagaagaaacagaagcaaagagagttgaagtattgagagatgaagttagagttaaagaagagacagttgagacacttgaagagcaaatagttttgatggatagacaaaagtatgagaaagaaagagagattgacttattgagacagagtctaaggattcttggaagcaagaagaaaaagaagacaggatcattcgcatcaatgaatctgttgatattgaagaccaaatgtgtcgaatgtacataaacactttttactcaaatagtcttctgcaaacagtcatatctcgtcagagaatcttgatccacaatgtcatatttatttctcttttggttattttacaatttttattttggaaatatagtaaatcatagcactatgagttcaaaaagcacatgtcccatgaaagatttgcacaaatcgtttttttttttttttgttggagttagatacaattctttagcaataatgataatgaaccatttttccaaagaacagaaactgtggaaaaaaacttactagacactaaaagtctaaaacaccacttgcttttttatagcccaagaaacttctagttctaattaagaatgtccaacttccggttcggttactgaaaattatcaaatttttgttagatgagataaagaagtgaatcctacaagaaatatatcatgtggttcggtttggtacaattttgatttctgctagggttttatcctttttagcaaaatttactttaatttccgtagtaaaaaagaagaagttttagttggtttatttcttatttttgcttcgattacggcatttaattttagcaatatttcattaacaaaaaaaaacaattctaattggtttatttctacttctttttctgtcttggtttgatctctattactatattgattatgaaaaaaatatgaaaccaaaaccatttattatgtcttcaattccatttttaacccaattatttcactacaattgtaataaccggttattgcacccctaattataactatttaagcaatcgcatataccaaaccagcgagttaaaccaaattgtttcccaaattatgctaaacgacagcgttttcacaaattaccaaaaaaacctatttttctgtatctatctgaattcagagtcctgaccattttatctcactctcacaaagtcttcacttttgaagtgtctcctccacacgcactgcgccgccaaaaaacccttctttaaaccctttcctcctcgcgccgtc

SEQ ID NO: 15170 - DNA, 2388 bp, Unknown
  misc_feature (1)..( 2388): cDNA_ID_3094882_gDNA_ID_2926078_Annot_ID_196300 3000 nt of promoter + ATG
gtagcgaacaagcgatcctgagagagatcagagatttccgacgatggtgaaccaaatccagacaaggaagaagatttgatggaataaattcgattatttatatgattttttgtacatattgttttgggtccaaaatcgtaatttccataccatcgaaatttctaggcctagactttggttttcttttctttattatccgttgggttcggtttactgatttttttggttttccggttttcctattttgagggaaattaatgtacattttcggtttgttaaaaatccggtttgggggcaccaaattgagacctatgtatgatttcagtgctttttcttgatgtgattttgagtacaatgaacttagccattttttactttttgttttggttttaattgtatttgtgtttcaatgttgaatctatttatagccaataatatctaatactactaatattatactaccaaagtattggtcaataaaaaaaataattaaaatacatttgcatctaacatatattgactaaattaataatttaaaaagtattgactcatactacagtaaaatatttatataatgctatttattttgtaaagtactagcataagcttgtcattttttaaaatctgtcactactaattttactatgattattttcaagttttataaagacactacttctgttgatgtatgacatgttgttgatttttatgatatatatatttataagtgaattattaataaaaatcattagaatttgcacatgactaaaacagagcattgtatataccatgaaacaatataataaaaatgggattgccatgtgtatgacatgatatattttattaagtttaaaatataatatgtattaggatttccattttttttttttgtttgacagcagattttccattttctaaaaacgcctactcggatatggattaggaaatagaaacagctctatctgactatctcctatatatatagagataagtttacatttttactcaacaaaaaatacaaacacagaagagagattaacaagtttatgataatgcatacgacgaacaagtatccgataaaactccccaacgattgctcgcagaaagagtttaagcgagcgttggagttcgtgaagaaagtaaaagagattgatgaaaaaggaaaccacagaggaatcttccttcgatatactactgcaatgaagctttactattctggatctttgagcgaagtcgatctcaaaaacagaatcacgactattttcaagaactgcgacgttttgctcgatgcctttgatcgatttctggaagattcgaattccagttctcgtcaaaaggaagtttttgttgatccaaagaatgttaaacgaataaaggagttcttaaagtcgttgagaagagactgcgaggaattatgtggagtgcttatagaggctttcgtgaggttcaaggaacataacgatgtgcagattttaaaagatgatgttgacctaatgttacgagattatcctcgtctaaaagaggagtttaggatgatcctactcgaccacggtttaatacaagatgagaaacgagatgagatgacgcgtggggaagaggacgagctgttcaaagatgatatgtactttcatgccatagaatcggccattaagtttgcggtggcggaggataatgagaagccggaggtgggtgtttatggagccattagacggttttacaaacaacgacgcagaaagttgccacgaggaatcatgaaagatccgaaacttggagttagaagaattttaccaaatttgcagaggaagtacaacgagttgctcaagaacagaacaaagtcgcttgagaaagtgcgaaaagtgaatgaatcattggttgtttttgattgggtacggtagaatgttgtgttttttttttgttaagggaagtatttggtttgttagggttaattaggatattgtgtctactattctatttagattgatatttggcttttgaaacttgattaacataatgataacttataaaccacatgttcaaaacagagagattcctaattatgaattgatttttactgtatttaattatgaattgatctgaacttagggacagtggctagtggcctatatcagcacgtgacactagccacgcgtagcggttccgctccaacaaaaaagcaaactcgctatctgtccaatcaggaacaaccacgtcatagctcctgacagaagtgaaaaagacgaaactatccaaacttatggatcgtatttacaaagtcaaacccaaatctgagtcaaaaaataagaatctcaccgttccttacttcttcttcatcttccctcgaaaaactgagaaacattttctttcaaaagagagattacaacaaccatg

SEQ ID NO: 15171 - DNA, 3000 bp, Unknown
  misc_feature (1)..( 3000): cDNA_ID_3094887_gDNA_ID_2926078_Annot_ID_196298 3000 nt of promoter + ATG
ccagatataaaaaatcttatctaataattaataaatctaaaaagtagcacgagaaaggaaacaaatttcgaaaatcaatgggttatgtgaataaaaggaacacaatataatatttgttttggaaaataaatgaaatctaaaaattatataatagggatcacttcggattataatgagatacatgagagattggcgggcacatattgatgaaattttccttgtgtgattatattttatatatagccatcaaccatttgtgacttcttatgaatgaatatccataaggatttgtgagagatcaaaataaacaaatgactatatatgtccatggcgtagaaaaataagcacaagaaagataagaaaactaaacgacataggataaaagaggaagaaaagagagctcggaggtgaaaataatcatacttttatttttttgtgacttcttatgaatacataaggggttttataactacaattatatcataaagtttaagcatactctaagagtattatgatatatatataactcaacgatacaataacacaatgcaagttgttttgggaatcaccatttatattgcttttggtatttatgaatagaagcgacgtataggtagaaaccatcaggattgatttgccatagacaagaaccatcgggtttgcatcttgatttgtctctatcgagatcaaagaggacgaaaggagtcattttggccgatgatgagaagatgacgcaattccatctagttgattggtcggtgtcaaacataagcacgtaagtctcacctcgaaataacacctgagacgaagtatctaatttggacgaggtgcatcttatggtgaacggatgagagtcaagtgcaaggttgttggttacctttacggtgaagactggagccgtgaaagataacgaagaagtaaaggctaaggctaaggagacaaggaagaggctatatgctttggtggatatcatctttagttttgttttacacactatatatcaatattcgagtgaatcatatatatatataagaaacttctttgactcacaatgtaatgatcttaccatgtaatcttttaataataaaaatgagtcaagtcaagcaatgagtcaagtcaagtcaagaaatttatcaaaaggaaattaataatgaaatatgcataaaaggaccacgaatcagaaaagagttaacaaactagccatggtatgagtgtacaccatcgctcttcgattacaattactcgtatacccatttaagcattttatttgttgaatgctatttgtttctggcataaccgtggggattacaaaccgggatgacaaatagagaaagaatgcgaataagcagaaaatgttaggatacctattctataagaaaacaagaatttgttgacaaaagaaagaaagttcgctaaaagagttatttagtgtctcaaaataaagagatcattgtttccacaaatagctagcatataatcatcaaaaatacaagaatgagatatttacaaaaaaaaataaaaaaaattaatacattttatcacaacacactagtgaactaaaatccatagacatatacaccatcagtgatggtccatccccatgcgagtggattacaaatatataatttaacataagtgtgtaaacggagaaaaactaggtttacaagcgttttcttttttcctaagacggaggtgatgttgttgaagtgttacgttggaaactgtatgatgacgaaactctatcaaaaaagacgaaaggatgatgaaacgcaatggttaccacaattatttcagattttaagaatgagataatttcataattaaaaaaaaaaaaaaaaatttatgatgatgttaagtatcggttcttaaagtgataacatcgagttagccaactttcgtatatgtgatatgaagaagaaaaaaaattgaatcatacgtatgttttcgttacgacacctaaaccaagttcttttctgtgatttcttcttatgaactaaatcatatcataaatttaaaaataccttagaaatcttataattatattatattatacgactgaacgatacaataacacaatgcatattgtttggtgtatcaccaattgaattgcttttggtatttctgaatagaagcgacatataggtaaagaccatcaggattgatttgccatagacaaaaaccatcggatctgcatcttgatttgtctctattaagatcaaagatgacgaaactactctttcttgctcccgatgagatgtcacaagtccatttaactgatcggtttgtgtcaaacccaaactcggaactctgaccttgagatacaacagcagaccaaatatctttttgtggcgagatgcaacttatggagatcggattagagccaggtgcaaggttgttgcttatctttatggtgaagactggagccgccaaagataaccaagaggtcgttaaggctaaggagaccaggaagaggctatatgctttggtggatatcatcttttgtttgtatcaatatttgtgtgaattaatcatttatataagaaacttatttgactcccatatatagtaatgatctaattaccatacataattatcaaaaagatagaaaaagagtcaaaatcaataaattagtaactaaattaaaaactgattcttaaagagtactctaattaattagagagaaatttacaaactagtgtttggtagactattaaaaataaaataaaatgaatcaacaccatttttcattctcttcaagaatcccattaaaagtcaaaaccatgtttgggctaggaaaaatatgtttgggctttagtaggcccaactacccaaaataaccacataaagtaaacggttatcattaatgggcggttactaatacttaataaatataaatatagttaaattaatatcatttctagagcttatcctaatttctctccctttcgaaaatcgaaacaaatcggtgcgattactccgttttgaatttcaccggcgacg

SEQ ID NO: 15172 - DNA, 3000 bp, Unknown
  misc_feature (1)..( 3000): cDNA_ID_3094899_gDNA_ID_2926078_Annot_ID_196295 3000 nt of promoter + ATG
gggtcgggtcgtagatcatcgggtcgtccggtgtaggaagatgaagagtactgggaagaggaagagagagagaggaggaaacatagagagagaaacgcggtggtgaggattatgtaaagagtgactctcggttgctccggtgtgtgctgcattttctcacggcggcgcgtgaaacttcgacggctagagaagaaagctaactgtagtatgtaatggtcacagtacgcatcgaactctgaagatagaatctttttttcttatatagtttaattaattatgtagcttattacttaatggtaacgactaacgacgatattattactaaataatttgattctataatttccattacatcataacactgaatagatgattttattacacattttacaaatttgtaataatcaagttcttgagcggcttcttcgccattcttggtcaaaattttaatatatgagagaagagcaattgcagcatattttcactgaaatggtcaaattccaaatatttcaaaaaatacgtctcaacatatgtaactaaagcaagacaatatatcttgcaacgactcaagtactaataaacttatgtacaagacaacagaagagcaagcatgaatgatattgggttgttctctattgatgaatggatcaaaagttttgtgtaaaaaaataggaaagatctaagctaatggaaacgtagcttaccaaaatgttctcgtactgaatgtgaatggccaactaagcagcgacaaaaaatgtctacccatcaaaaataaagtatgtgagatcatacaagcacaagatggtgtggaagaaaagtaattaatcaaccatttgggtcagataaaagattttatgttgcttaacaagcgtaactacatttatacatatttataaaagtacaaaatacacaagcaaaaagaatacaaatcgacacttaataaccaatttccaagatatttgagatcaatgtcaatatcgtatcatcatatacatgaacatacatttcaattgtagatttatgtgtcacatcgttagccaaaatagtatactaactaatatgaagtcttgagcatatattgatcacttaaagaactgctttaagatatatcttccttaccatcatcaactcaccataattcaacataacatttgatagatgagcttaaaatcttaagaagaacaaaccaaacctacatcttataacaagctagttagtatttgaccgtcaatccacaagtaaacataaatcttaacgtatgagactatgagtaagcatcaacacaatatcagatttgaaacaaaatggttttgaatggtaatctcgcatcgaggatagaccctgaaattttggtggtctaaaaattttctaaaagttttacaaatttgggagcctatgtataaaagtaaaactaaattagaggcctttttgtaaatacatgttttatggaaattcacaaaccattgtttctcctatttgtttaaagacgacactgtcattgtgatatatcgttttgacaattaccgattttaaaaacgttattaaaatttttttagcttttagagatacaacattatggtcagcaatgaaagctaacattatggttaatgaacaagaggagaacataaatgtcaaaaaataaacattaagaaagtggtaacgtttgattctaatgaattgtgttactttcatgatataaattgaatttagatcgaatcttgtctttgtttaaccaaaacaaaaaaaatctaatcaatccaatttgagagagaagtcataacttttttaacacattgttgacttaagtatcttctaaagatatattcaaatcagatttattttctaactataaattacaaaaatgttaattaaagatttctaatgttgtactccctccgtcctactaagatgaattttttagaaatttcacattctttaagaaatattgtataaagacaattttaacctcttaatatactttaaaaataataataaatatttatctaattatttagtaagggtaaaacaggaaaaaaaagtttataacattaagaagatttgaataacattaaaaagatttgaataattagaatcttgaacttgacaatatttaaggtaaatcgcatcaaaaaaaaaaaaaggttatcccttaattttgaattcataatggcgtaattgtcacaaactcacaactgtgtaatattcacacctttatttttaattataggttttttattttaaaagtaatgaaattcacttttgctttcaaaataattcatagtgtagtgcgcgtagatcatacatatccccaatctaccccgcaagttgcggtggcaattttcataaagtcaaaaaagtattcaacacgtgtcgttccactattcgtccaacactcacgccctcgtaatcctattggttcatatgcatcaccctcttggtcactcaattatattatcacccttcaactttatccataatcacgtgaatgccattacactaaaaacagtaatcaaacttttttatgttaataaaataagaaaatctaatgagagtataagatcaaaaagcgtctatcataagtacggtcgatcttctccttctattttataaggtccactgaagtaaataacaaaacaacgactcacttttggaataattacactcacaccattcaatcacgccgttgattttggtgactaatattaaactcagtggaccgcgttacacttgattgtggcttcaatatacgttataggaaaaagtgaatttaaaaggcaaaggaaaaaaaccattttgtgtcatccccttccccacttccaaccaaaattaatttaaaatgtcaaatattttttcattttcctcttttcgaaattaaagaaaaccctaaacgccgttgtctgatattgagagagagagagagattaaaaacttcttctggttccttttatcaacattttttctctctcttaaaacttcgaagcgatttttgatttacagact

SEQ ID NO: 15173 - DNA, 3000 bp, Unknown
  misc_feature (1)..( 3000): cDNA_ID_3094904_gDNA_ID_2926078_Annot_ID_196294 3000 nt of promoter + ATG
gtattaaagagaccgaaggagtctgttggccgtaatccagttttccggcgagtaatattcctcggtggttgcgtatgttcgtcgtcgtcttcttcctcttccggtacagagaagttcaaaaggtcgtccatgaatgattccatttccatagtctgtaaatcaaaaatcgcttcgaagttttaagagagagaaaaaatgttgataaaaggaaccagaagaagtttttaatctctctctctctctcaatatcagacaacggcgtttagggttttctttaatttcgaaaagaggaaaatgaaaaaatatttgacattttaaattaattttggttggaagtggggaaggggatgacacaaaatggtttttttcctttgccttttaaattcactttttcctataacgtatattgaagccacaatcaagtgtaacgcggtccactgagtttaatattagtcaccaaaatcaacggcgtgattgaatggtgtgagtgtaattattccaaaagtgagtcgttgttttgttatttacttcagtggaccttataaaatagaaggagaagatcgaccgtacttatgatagacgctttttgatcttatactctcattagattttcttattttattaacataaaaaagtttgattactgtttttagtgtaatggcattcacgtgattatggataaagttgaagggtgataatataattgagtgaccaagagggtgatgcatatgaaccaataggattacgagggcgtgagtgttggacgaatagtggaacgacacgtgttgaatacttttttgactttatgaaaattgccaccgcaacttgcggggtagattggggatatgtatgatctacgcgcactacactatgaattattttgaaagcaaaagtgaatttcattacttttaaaataaaaaacctataattaaaaataaaggtgtgaatattacacagttgtgagtttgtgacaattacgccattatgaattcaaaattaagggataacctttttttttttttgatgcgatttaccttaaatattgtcaagttcaagattctaattattcaaatctttttaatgttattcaaatcttcttaatgttataaacttttttttcctgttttacccttactaaataattagataaatatttattattatttttaaagtatattaagaggttaaaattgtctttatacaatatttcttaaagaatgtgaaatttctaaaaaattcatcttagtaggacggagggagtacaacattagaaatctttaattaacatttttgtaatttatagttagaaaataaatctgatttgaatatatctttagaagatacttaagtcaacaatgtgttaaaaaagttatgacttctctctcaaattggattgattagattttttttgttttggttaaacaaagacaagattcgatctaaattcaatttatatcatgaaagtaacacaattcattagaatcaaacgttaccactttcttaatgtttattttttgacatttatgttctcctcttgttcattaaccataatgttagctttcattgctgaccataatgttgtatctctaaaagctaaaaaaattttaataacgtttttaaaatcggtaattgtcaaaacgatatatcacaatgacagtgtcgtctttaaacaaataggagaaacaatggtttgtgaatttccataaaacatgtatttacaaaaaggcctctaatttagttttacttttatacataggctcccaaatttgtaaaacttttagaaaatttttagaccaccaaaatttcagggtctatcctcgatgcgagattaccattcaaaaccattttgtttcaaatctgatattgtgttgatgcttactcatagtctcatacgttaagatttatgtttacttgtggattgacggtcaaatactaactagcttgttataagatgtaggtttggtttgttcttcttaagattttaagctcatctatcaaatgttatgttgaattatggtgagttgatgatggtaaggaagatatatcttaaagcagttctttaagtgatcaatatatgctcaagacttcatattagttagtatactattttggctaacgatgtgacacataaatctacaattgaaatgtatgttcatgtatatgatgatacgatattgacattgatctcaaatatcttggaaattggttattaagtgtcgatttgtattctttttgcttgtgtattttgtacttttataaatatgtataaatgtagttacgcttgttaagcaacataaaatcttttatctgacccaaatggttgattaattacttttcttccacaccatcttgtgcttgtatgatctcacatactttatttttgatgggtagacattttttgtcgctgcttagttggccattcacattcagtacgagaacattttggtaagctacgtttccattagcttagatctttcctatttttttacacaaaacttttgatccattcatcaatagagaacaacccaatatcattcatgcttgctcttctgttgtcttgtacataagtttattagtacttgagtcgttgcaagatatattgtcttgctttagttacatatgttgagacgtattttttgaaatatttggaatttgaccatttcagtgaaaatatgctgcaattgctcttctctcatatattaaaattttgaccaagaatggcgaagaagccgctcaagaacttgattattacaaatttgtaaaatgtgtaataaaatcatctattcagtgttatgatgtaatggaaattatagaatcaaattatttagtaataatatcgtcgttagtcgttaccattaagtaataagctacataattaattaaactatataagaaaaaaagattctatcttcagagttcgatgcgtactgtgaccattacatactacagttagctttcttctctagccgtcgaagtttcacgcgccgccgtgagaaaatg

SEQ ID NO: 15174 - DNA, 3000 bp, Unknown
  misc_feature (1)..( 3000): cDNA_ID_3094978_gDNA_ID_2926078_Annot_ID_196278 3000 nt of promoter + ATG
ttagcaacgatctctctagggttatagtttggtatgaacgtgctccacccagttccaatgccttcagcgccattgacaagtacagttggaatgatgggcatgtacctaaccaacattaacatgttaagttaactagtcttaggaaaaaaaacaactaattaaggagcgcaaagaattaccaagttggctctatcctttgcccgtcttcattcaagtaatcaagaaggagatcatcatccttgggaaacaagatccttgttactggagagagcttagtgaaaatgtatcttgcactagctgaatcttttccaccctacaattgtgtacactatgatgagtacaagcatagataaatgacaacagttggtctattagctatacttaccgaagttcgtgtaccaaattgaccatttggtagaagtaagttgatattgttgctgcccacgtaatcctgcgccatgcctatgatagcactggcaagactctgctcgccatgatgataagctgacagcaatgatacataaccaacgagctgggcaaccttcatttctttacgagcgattttcttgaatgcaacgaaaagtatctttctctgacccggtttgagcccatcaaccattgagggaattgaccgttgaagatccgccatggagaacaagatcagttctttgttcacgaagtcactgtacgtaactttcggttgtctctgatcaagatgattgccaggctgaatggaaaataggaaatcagaacaggcagatgtagtaagcaataaacacacgtttttaaagataactcaatcctccataccacatagctcgaaagccaatttttccgggcttcgatcttctttttactgaaagcaagttcaatggcttctccatcttgttcatcctcccaaacaaaatcctttttgtgaagaccaagattactaaagtactctttgccctcctcagccgtacttgtacccaacccctggagattataaggacaattagtaatgcaaacttgcagagaacatgagcactttcaataagttcttcctaaatagttatagcagagagcaaaccttgtagtatttgatatcccacccggttgcattacccttcagactttctttccattcttcgtattcaggcattgagtagaatgacagaactttttttgtacccttacgcgtagcctgtgtaaaatatattcagggcagttgttagcattcttatatctactatgtcaagcactataagatattataaaagaataatgtttttgtacttaccttcacaatgggtgttataaactcaaccaggaatgatggaacctggagtaacgacggccaaaaagagtggataaaattgattaagagaccctttatatgagaaccatcatgatcctgcacaaggtagagagggagatttcgtcaagaacatatccatatagaataatgcactgagtgtaaagttagggagtagacttttaacatacttgatcagtcatgatcatcatctggccatatcttaatgagttaacattctcgtacttcatattttgctttagtccaaggatcttcttgaggttctcaatttccttattgtttgtaatctgagtggtgctggcttccctgacattcaatagctttcctcgaagcggaaacacaccgcagtagttattacccaagacagacctccccgccaactgaccataatgagtattaggagttttgttatcaaaatagggaggtagcagaaactatagatcaaaaccacttacagcgagagattttgctgagtctccttcagtcaaaattaacgtacagagtcgagagttcttccctccagcttcggcggcatcgtctaacttctcaactagaaccctccctgttttggctccatcacttttctttagatctttgttctgcttgaaatctgcccatgaaagcaaattctccactacgccagattttccaactaaaacaaacattacataagaaaaaggggttaatcacacttctagaaaccagttacatcacttatccaaaaagacagatcgagcacaccatacctttcttcagaaaatcttctgaaagttcacatttcgacccaaaactgctctgtcgaagagtcagtgtttcttttgtttgagaatcaaaagcaggattgtcaatcaatgcattgacaaagacccacagatggtttttcacattatgggccttaacatttgcgtttttattctttttgttcacagcagccacaatatggtttgtaatctgactcgtcacatagtcaacatgtgtaccacccttgattgttgctatggagttgacaaagctgacctggtagcagcagaaaaggttgttaagacttaactcattcttcataacaacaaaaaataataacagccaaccaaatacatacctgctgaaattgtccttcacttaagctcacacaaacctcccatctatcattaactttctcagtcaacctaatcacacaaaactcaaaaagatcaacatccatttcaagaaacacaattataatcactgagcaaaaacaaatcatagaacaaaccttgggagaggatcctccgtcctcgatttattagctgcacttaggtataggtcaacataatcagtgaatgacttcactggtatttgtttcccattcagctcaactttgacagacttccccaaacatccagcaatatcaaacactcgcttactcattagagcaaccacatcgtcttctaattcagtcatgttaaacttcttcaaatctggtttgaatgtaaccttcgtccagttctcactcttattacacttggttataaccggttcagatttcttccccatgttgttctcaaagacctaaatcatcaccagtaaaagttcagttcctaaacgaatcaattacgcaacaattgaaacatcaacaacaacacagaatcataaaacaactgtatcaatcgaaatcagatcataaaactcaacgaaggccacaaatg

SEQ ID NO: 15175 - DNA, 3000 bp, Unknown
  misc_feature (1)..( 3000): cDNA_ID_3094966_gDNA_ID_2926078_Annot_ID_196280 3000 nt of promoter + ATG
attgagcaagagagaagaatcacgtacgtgacagagtcaccaacgttgccaccacactgatgaaacgacataacagcttgaaccttaagaccaagcttcttagccagctcaagcaattcattataacctccccaattataagttccaggagattccttctcaaccaaaccccaccacacatcaatcataatcccttcaacaccagcactcttcaacgcttgcaaactcgctttcatcgcctttcttcgattcaccgtgttccccatggtaacactatcaagcggcatcatcacaaacacaggaacacctcctcctccttctttctttccaccaatccctccttctctatacgttctctgttcttcaatggtcccgattccattctccaccgcgaaagctttacacgccaccgacagatccgcacgtgtcgcacctaaaattggactcatcggcggtgatggatctgttccgtgagccttgtagtttcgattcattgctttaggtgtcatcattctcgccgatggtggtgaaattgataacaacgatgaatctgtcatttcaccggatttgatcggagttccggcgagtactcctagctgatgcgataaattaagcgccatttttctctctatacgcgagaaaacgaatcaagaatcgatcgtcagaatattccttttgacaaatttcaaattgtttttttgaaatcggaagttttgtgtgacggaggagagatcggagaaggaggaagagaagataatttataggggaagcataaaaaggataagattaaaataatgttttttatagaataggtgatcgtgtgacacgtgtataaacgtatgatgtggataaagacacggttaagatctaaaagagtcagaatggacggtggggttagcagagcgcgtgaactttccagcagacgcgcttttagcctcagaatattttttgtggttaccaaaatagagttttattttatttattattgttaagagtataaatatgactcacgagtttataggtgagataagcctttttcttacaagcaaacggtgatagtgttctacaacgttctctttcatgaaacgtacgtttttcatattggtttgttatgtaaataaataaatatatgaaggaaacaaatatgtatgtaaaagtgaatatatacaagtagtgttttcctaacgagtctctaatacgttcgtctattatcgttagaacaaatggtttaggtgttggttcgagttatttcgagaacatttagaagctgacctatgaatcgctttacaaattattgctttttgtcaaccattaaaaaaattattgtttcgaaacttgaatgctttgcgcaatccttgatttgttttggctgtcttgtagaggcttttgggatcaattgaaggggtgaaatgtatttattaatctacgcatgtacaactttgagcagaaaacaaggtatcacagtggatacttagatactaagtgaagtagagaattagagatggtcacattatttttattccacgtgagatcacatgatgtacaagaatatgaacatataagcaaattaactagtttctgctatgtctatgagtatattttagagaatacgaaatcaaatcaatttaataactcattatagaattgtatcgttgaaataggtatgtcagtttattagggtatatttttagactgactttttttttttaattctgatgaatacaagtagttttcgatttttcttctctacaaacagtttttttttttttaaaaatccttcgattcaagtcaataatctaatatgcaatatttttttatatatgtacacaatactttaaacataaaaaggaatatccttgacgaaaaaagaagaaaaaaatgtctaacatagattaatagataatacacggacacaaaacaacatgcacgaacaaacaaaatgttgagtggtggagaaagtaaaccaatattgaagttttcctctgtaagcttaccacgtgccatggtgatgtggagtggcaagttcccacctttttgggatgacttttcctgagtatttaaatcaatccaacggctgggaatgaaccgattcgttgctcgtcaaatcttttaggacaaaaactgtttgccttttacaagattggattatggatttctgacaaagactagaaccttcttttcctttcatgaaagatcaatgattcgtttaaagagtaattaagatgtgaagtattattaatcttttacacaaaacgcaattagtagaaacagattatgtatttgtgtgacatgatattaagatcacattcacatgaaagagttgttgcaatccactttgataactgcatcaatcaatctcatccctctagctggcagtttcttcaccgttcttgatattattattgactccatttgatgtacaaagatatatccaagtatataaatattcgatacaatcggtacaataagaataactatatgtaaatatcaaaatctctaccctgaagtaaggaagattttttattggacattttaatgggggcagatttactgaaagataaaataaaataaagcagatgtggctactagagggtcgaatttgggagctgagggaacatactcactgatatataattatgattttgattaaatttaattaagttttttttttctttttttttaaaaggggaagtaaacgttacagattaaaattaaagagtcttctggttcaatacgttacgattggtcataataaattgaaccggaattgcaattaacttcaaccctctgggtcaaattgattcaaatagaattcaggggttaatgttgaagaaaagtataaacctcggggagagttatgtttctcttccgtttctctttcacctttcccatttgaaaattgaaatcgtcttctctgctttcaacttcacaactacactctcttcagttctctaacagtagcgccaaaatgaatccccaagactaaagctttcttcaatg

SEQ ID NO: 15176 - DNA, 3000 bp, Unknown
  misc_feature (1)..( 3000): cDNA_ID_3094961_gDNA_ID_2926078_Annot_ID_196281 3000 nt of promoter + ATG
actctatatgatctaaaactaaatcagtagaagaaaactaatgaagaaccttgggcatgagactgagaaagacgttcaatttcttcagaaactttggcactttcagcctccacagactgaagctcatttctcaagtactccaagtaagcatctgtcagatttccatcacttaatttcaccattatttgactttcatacttcatcttaatctcacaggaaacaacagagcaaacctgaatcttcaacatccaataaatcaacatcgccgtattcttcaacaatctctttcacctttggctacacgaaaacgaaattagcaatctaatcgaaaattagacaaatttgaaaaacggaaaagggttctcgaaatctcgcaattacttcaaactgaagaacaaaatcttgaaccaccagagtctcgtaatcggaactacacgattctacaggctcttctctgcaattccggggaaagaaatcgagctctttcacgcgcctgagaaaaatgagaacaaatagatgaacaaagcagcacaaaaatcaatgaaagaaagagacgaaagagaagtagaaaacctgcgaatctcttggagatcgagagatccgtcgtgggtttcttcttccattgaagaaagctttagtcttggggattcattttggcgctactgttagagaactgaagagagtgtagttgtgaagttgaaagcagagaagacgatttcaattttcaaatgggaaaggtgaaagagaaacggaagagaaacataactctccccgaggtttatacttttcttcaacattaacccctgaattctatttgaatcaatttgacccagagggttgaagttaattgcaattccggttcaatttattatgaccaatcgtaacgtattgaaccagaagactctttaattttaatctgtaacgtttacttccccttttaaaaaaaaagaaaaaaaaaacttaattaaatttaatcaaaatcataattatatatcagtgagtatgttccctcagctcccaaattcgaccctctagtagccacatctgctttattttattttatctttcagtaaatctgcccccattaaaatgtccaataaaaaatcttccttacttcagggtagagattttgatatttacatatagttattcttattgtaccgattgtatcgaatatttatatacttggatatatctttgtacatcaaatggagtcaataataatatcaagaacggtgaagaaactgccagctagagggatgagattgattgatgcagttatcaaagtggattgcaacaactctttcatgtgaatgtgatcttaatatcatgtcacacaaatacataatctgtttctactaattgcgttttgtgtaaaagattaataatacttcacatcttaattactctttaaacgaatcattgatctttcatgaaaggaaaagaaggttctagtctttgtcagaaatccataatccaatcttgtaaaaggcaaacagtttttgtcctaaaagatttgacgagcaacgaatcggttcattcccagccgttggattgatttaaatactcaggaaaagtcatcccaaaaaggtgggaacttgccactccacatcaccatggcacgtggtaagcttacagaggaaaacttcaatattggtttactttctccaccactcaacattttgtttgttcgtgcatgttgttttgtgtccgtgtattatctattaatctatgttagacatttttttcttcttttttcgtcaaggatattcctttttatgtttaaagtattgtgtacatatataaaaaaatattgcatattagattattgacttgaatcgaaggatttttaaaaaaaaaaaaactgtttgtagagaagaaaaatcgaaaactacttgtattcatcagaattaaaaaaaaaaagtcagtctaaaaatataccctaataaactgacatacctatttcaacgatacaattctataatgagttattaaattgatttgatttcgtattctctaaaatatactcatagacatagcagaaactagttaatttgcttatatgttcatattcttgtacatcatgtgatctcacgtggaataaaaataatgtgaccatctctaattctctacttcacttagtatctaagtatccactgtgataccttgttttctgctcaaagttgtacatgcgtagattaataaatacatttcaccccttcaattgatcccaaaagcctctacaagacagccaaaacaaatcaaggattgcgcaaagcattcaagtttcgaaacaataatttttttaatggttgacaaaaagcaataatttgtaaagcgattcataggtcagcttctaaatgttctcgaaataactcgaaccaacacctaaaccatttgttctaacgataatagacgaacgtattagagactcgttaggaaaacactacttgtatatattcacttttacatacatatttgtttccttcatatatttatttatttacataacaaaccaatatgaaaaacgtacgtttcatgaaagagaacgttgtagaacactatcaccgtttgcttgtaagaaaaaggcttatctcacctataaactcgtgagtcatatttatactcttaacaataataaataaaataaaactctattttggtaaccacaaaaaatattctgaggctaaaagcgcgtctgctggaaagttcacgcgctctgctaaccccaccgtccattctgactcttttagatcttaaccgtgtctttatccacatcatacgtttatacacgtgtcacacgatcacctattctataaaaaacattattttaatcttatcctttttatgcttcccctataaattatcttctcttcctccttctccgatctctcctccgtcacacaaaacttccgatttcaaaaaaacaatttgaaatttgtcaaaaggaatattctgacgatcgattcttgattcgttttctcgcgtatagagagaaaa

SEQ ID NO: 15177 - DNA, 3000 bp, Unknown
  misc_feature (1)..( 3000): cDNA_ID_3094955_gDNA_ID_2926078_Annot_ID_196283 3000 nt of promoter + ATG
tccggagttgtttcaggcggataactggggaaaattcgtagcgtttgtgaagaaaatgggtgaagggagagactcacatagatgtcgggaagaagttgagcgtgaggctgagcattttgtgcacgttactcagccgctggttcaagaagctgcagtggctctcactcactagagagatagattgtggcatggttctatggtttatgtttgtatgcgattataatgaaatggttatatgacaatgccaaaaaagatgtttaggcttgttggagcttgtgtatgtattgttagtaaaactgaaatgtatgccacagctctggtttttttccggtcaggttgtggcatgctactacttttaatatatgctaaaagatgtacatgttctttaatgaagccaaaataaatagcatttctttaatacatatcactctgaatcaataaaatgatagataaattatgtgtgtgattggtttgtctgtaactgtagattttttactgtaaaatttttgctgtatgtgtgatggtggtagctgtagattttattgctgtagaaattaggctgtaggttttattaatttaatattattatttgaagaaattggttgtagaaataagattatggttgtatgtatttttaaacaaaataatattattggtaaattgtacttatgtgttatataatagaattcacaaatatcaatttaatatatatatatatatatatacatttttgcagtcattttgtgaaataaatcatgaagttggaatttatttataatggttgccattggcttttaattattgttttttttttggcaataaattgattaacaaacgaaaaacattccaaatatatttcaatcccatatatcatgcagatttctccaaaatttgaactagattttgacaactatttaaaacaaaaaatgtttgacaaaccaaaatacaattgcaattccttaaaatgagcaaaacgcacctaaatacattttttacaattcactaaatcttatttctccaaaatttgaactagatttcggcaactattttaaaaaaaatttgtttgacaaactaaaatacaattgcaatcccgtaaaatatttatttaaattatatatttaaattagcggtgtaatgcaggtttttttacgggacgggtttggcaagacgaatttggaatgactttacttaataacaattgtaaactataaaataaaaatattttatagatagatataatttgtaaacttttatatatattaattttaaaaaataaattgtatccgcggtataccgcgggttaaaatctagtatattacaaaactatagtaatgtttttaaagaaatgagaaaataaagtgaaaagaaaaagagaaaaaaagggacagacattctaaagacgataaaattatgctttagaaaaacatgaacttacagacaaaataattaaaaaaatattatttgggctgtgagaaaaaatagaaaagctaaaacatgattgtttcaattttagggctttaacttttttaggtggtttaaaaatttcttacagcccaaccaatcatggcctatgtaatatcatttgtaaacagtaaacttataacagtagttcgcaatttgcaaatagacgccttctaagttatactttggtaggtgcttttgcagtgtgtatagtttgctaggtcgaaaccgtgtttcttattcattggatgggtgtaaaatgtaaaaacttagacagtaaaatagctaccaaaagccatacgcaacggtattaacggtaaatttgctatagttccacatacaaacattatgtgtgagtcatttggattgtacgtttggtattcgggtcgagctatttgcatgtggtgaggttgtatgaaactatctgctaaaaaacatttagtcttacgaggccagaactagtcggacatttaccctgccactaaagtaaattaaggtaaacctaatttcagaagctattaaacaatgttttcaccaaaagaacgactaaaattagggagacagagcactaagtaataattagggattcttgtaataaaaggaaaatatgagatatacttaacaaataattaaggacagatagaggagccggattaatagggaagttcacgtgaaggcacagcttaaaccagctgagccaaacacatatactaaattctcattctcacaaacaaaaatcgtgggtccaatcttgattatgtggctgtaaaacctaaaaacataaactattcacatgaataagattttgattagacaacagtcttacttttgtctcttcctctataagattaatctgacccttgagccactcaaaaacaggtatgtctatattcatttcctaatgtgacatctacacacatattatctcttttttttttaatcatgtgactgtagaaactgattagtaaatagtaataggaaaacaaaatacttagtatagagttatatagagtatagagagagggatgggtccaaatagttgatgatggaccatgtgaaaaaaacaatgaaagcccacaccattaattgtggtaaaggatgagaatctagtgttgtagttttccatgtccttaaacggttaaacctatcttctaacaaaattctccaccttcccttctgacatctcccatcacttctctcttaatttattccatccattccaccaaatttttagtttcactttttttactgtagtgtgtttacacttgtgagtgagtgaaaaagtaaagctagagaggttactgttttgagatgctctttttagaaagggccatatataaatggtagtgtagtagtactagtggagcttcttcatatacaattttgacttctcttcattgaatgtaggagagaggctctttacatcataaataaaacaagaacacagctttcagagagatagagtgagattctccttcattaacatattcttcttcatgttataagaagaagaagaagaagtgtccaaaaggattagag

SEQ ID NO: 15178 - DNA, 3000 bp, Unknown
  misc_feature (1)..( 3000): cDNA_ID_3094972_gDNA_ID_2926078_Annot_ID_196279 3000 nt of promoter + ATG
gaaacaaaccaatccatggcacgtccccacgacttgatagtaatctcttcctaaaagctcaccatcatgttctgagacgtagaccgttgacgcgttgtagagagaatggatgcagcatgacttgagatggtaccgagacgttgttatgactccgtaaggactcttcgtggaagtagttgccttcgatgtctccaagatcaaagcgtgtttcagagcaaacagagtctctgagatcaaagatctccaggagctgcaaacgcatttgaatcgcgtcaatgactttacgggtagtcttaagagaatctcttccatcatttcaagaggaagattatgaggtgagaacatctctctggtagtttcatccatgagccagagcagaggaaccaatagtgttgaaggataataaataagaaatattaaaaatcatttctttaggtatattatccgcattggggtataccggtatagcatgcacaagtggttgtggaaaaagaggagatgcatgtgtcaggataatgtaaattattaaatataatgtggatattatgtactttatgatataaatacagtatacagtatatatttagatatgggggataataaataatgccgtaaagatgttgacatttaaatgaaacttgaggatatgctaaagggtatgaccagaagacgttaaagtttgctacttatttacgtttcgtattaaaaattttggttcttgtcataagcaataagcaccaaagctccatcattaactacgatggaccgtggcagaaaatttccaaagtattataccaaaacaacaactttgtagggatatattgaaactgaagacaaatcataatggctttgaatggaggcagcggacaaaacggtccaatttggttgcggtttaatccatttcatttttgggatggacaataaacagctgcagactaaatttatttgtatgtataaatggtatgtagatggtccactgcgatttttttttttttttttttgtccggactactgcggattataattgatgaatgataaataaaaaacggtctgattcgttgacggttttgtccatcccaaccgttgtaaccattcaaacccaatatcttaaaaaaacgctatagttatggagttaagaaagtttttgttagacatgttttgggatgtttaaatggattgggttcctatatctacaaagtgagcaagctcaacacgagatccactaagcatagaacccgcaaatcatataatcaaatcaacgtacaaaaaacctcttatattaacaatggggtaagaatgggtcaacatttgctaattctttaacaaactacataaatgcaaaataaagaggatgttacaatgtctagtctacttagtagagtttttctagttcactctcggattgatcaggcctcctgggtactttagtatcaaattattacataccatataaaatgttatttttgcatgaattaatacgaacattttaccaaataatcaaatatataacaactttgatcaaagatactattaaattgatcaacttagacaaaattttgatattcaccattagttaacatatttatatgtaagtttgtaaaagaaatatagaaataatcaaacaacctaaaagaaatacgtaaattagaaaataacgttacaaaaatgacctatgtactagcaattttttattatttaatatttacaaaaaagacacttgctttaggttaatcacagccgtcaaatcttcccaatacgatcctcaaaattctgttcgtatagttaatcacagccgttagattccttataagaatgtaggctatcttctctcccgctcctaccccaaattcaaaattcgaattttgattcggtcaaacaccaaccgttgtaattctctctctctctctcttttcaataaatctcacttaaatccctattttcaaaaagctaaacgatacactcctttgtacgctcttcttcttcttcttcttcttcttcttcttcttcttcttcttcttcttctcctctctgtactttcgcgaaaaccctaattttctagatctgtttctctataatcgcctctctcactttgtagatccttcagatctactctccagtttctctctcagaaacacccaaccatggctaccaaacttccccttcaaaacagcaatgccgccaatgttgcgaaagctccggctaaatctcgagctgccgccggcgggaagacgatcgaggaaatgtatcagaagaaatcgcagcttgaacacattcttctccgtcctgatacatacatcggatctatcgagaaacacacccaaacactttgggtttatgagaaagatgagatggttcaacgtcctgttacctatgtacctggattgtataagatctttgatgagattctcgtaaacgccgctgataacaaacagagagatgcgaagatggattccgttcaagttgtgattgatgttgagcagaatctgattagtgtttgtaacagtggagctggagttcctgtagagattcatcaggaagaaggaatttatgtaccggagatgatatttggtcatttgttgacgagtagtaactacgatgataatgtgaagaagaccactggtggaagaaacggatatggtgctaagcttactaatatcttctctactgaattcatcatcgagactgcagatgggaagagactcaagaagtataagcaggtattgaatcgtttattgcttctgtgatgttgttgttgcatttgtggccttcgttgagttttatgatctgatttcgattgatacagttgttttatgattctgtgttgttgttgatgtttcaattgttgcgtaattgattcgtttaggaactgaacttttactggtgatgatttaggtctttgagaacaacatggggaagaaatctgaaccggttataaccaagtgtaataagagtgagaactggacgaaggttacattcaaaccagatttgaagaagtttaac

SEQ ID NO: 15179 - DNA, 3000 bp, Unknown
  misc_feature (1)..( 3000): cDNA_ID_3095127_gDNA_ID_2926079_Annot_ID_196312 3000 nt of promoter + ATG
agccgtccaagcttagcaggtaccgtgactctcactcaaaacatactaaagtcttagtttttttgtctgtgtgttcacagcattaataaacaaaagccctgattgattaggaccaagagcgctctcttacaattatctggacattgctttctctccttttgatgattactggaaagaattaaggaggatatgtgtgcaagaactcttcagtgttaaacgagttcaatcttttcaacctatcaaggaagatgaagtcaagaaacttatcgattcagtctcagaatcggcttctcagggaactccggttaacttgagcgagaagtttacttctttaactgtaagagtgacatgcaaggcaacatttggtgtgaacttccaaggaactgtgctcaacagtgacagattcgagaaactaatccatgatacatatttgtttttggggagcttttctgcctcagattattttccaaatggcggctggatcatcgactggctcacagggctacatgggcagagagagagaagcgtgagagctcttgatgcattctatgaacaaatgtttgatctacataaacagggaaacaaagaaggtgttgaagatttcgtggacttgctcttgaggttggagaaagaagaaactgttattggatatggcaagctaacaagaaaccatatcaaagcaatcttgatggtaactatacaacgtttctcattccatcattaagatatattgtagccctagatattctaactttttttttttttatgatcttacacagaacgtccttattgggggcataggcacttctgcaataacaatgacatgggcaatgacagaacttatgagaaacccgcgagttatgaagaaggtgcaatctgaaatcagaaaccaaattgggaaaaagtcaatgatcaccttggatgatatagatcagctccattacctgaaaatggtgatcaatgaaacatggaggctacatcctccatcaccctttctgattccaagacaagtaatgtctgaatttgagctcaatgactacgtgattccagttaagacacggctttatgtgaatgtctgggctatcgggcgtgatcccgatacatggaaagacccggaggagtttcttccagaaaggtttgttaatagtagcattgatgcgaaaggacaacactttgagctgttaccgtttggaagtggtcgaagaatgtgtcctgccatgtacatggggacaacaatggtggagtttggtcttgccaatatgttgtatcactttgactggaaaataccagtaggcatggtggccgaagatatcgacttggaagaatctcctggacttaatgctagcaagaaaaatgagcttgtacttgttcctctgaagtatttagatcactaatcacttaaactttgttttttcttgagattacaaaataaagtgtatacaaataaatcttgtcatttattactttttatttgttatcagttggtctaattgctagctcaaaagaaattattcaatattaaaggtgggcacgagaatattctggatttggtagtatttgtgatcagatttgctatgttcgaataattaattttatgattagtatttgcttcgaaagtaaccgaagatccggatgtacggatatccgttagaatcaaagatatttgctgatttgctgaatatctatcaaaaacaattataaaaattataatgaaaaacaaaatcagaaattgaatccaaattaagtaatatttcactgaaaaattatttctttttaatttttaaaactaatagttatataattaatttgatgaacaaaaacttagaaaatttacattaaaaagtgtaaaattataatatatatctgtaattatctacatacatatacatatgttcatgtacaacggatcggagcggatatccgcctgtttaaattttagtatttgttatttgctccgattttaaccaatatcatttttagtatttgatttgcctcgtaaaatcacggatatccgaatttttcgaatcaaactgaaccggatcgaacctaacgaatattttgcctatcccttatcaataaattgttttatataaaacaattgttttatataaaacaattgtttttgtagtatcggaaagaaaagttttatttgaatataaaagtaagttttactatagaaaaaaaaatttgacacaataagacaataatgtttttattattattactagaaatcaacccacacgttgtgtggatttattggtatcctatactattatagctatttttatacaataatcttgtcactcaattttatattttaataaattactcttatttattttaagtttttatatatagtttggatctaatactcttattttatgcttgttttacctattttaatattttataatgcataaagtttgtattacaaatttacaatcaaatacagtatttaattaataatattatactcataaatacttcatatctttttatatattattattaatatttatttattatacttaaactcttttcttatatattttttaaaaatttcatatattacaaatagatttgaattgaatgatatttttaatatattttaaatttattaaattaatattttgctgatgttgacaccttagatggagatagtattctctaattatatatatgatttaaattaaaaatattatactcataaatacttcatatttttgtatatattattattaatatttattaattatacttaactcttttgttatgtatttcaaattattctcatgtatagatttgaattgaatgatatttttaatattttttaattttattaatttattgttttgctgatgtggatattttagatagaaagagtactctaattatatatatgattatctataaacatggattacccgccagtcagaaaataattgaagacagcaacgtgcttatacattttttgaggtttcccttcagaaaacagaaatg

SEQ ID NO: 15180 - DNA, 3000 bp, Unknown
  misc_feature (1)..( 3000): cDNA_ID_3095096_gDNA_ID_2926079_Annot_ID_196320 3000 nt of promoter + ATG
gttcccggatctttcctcgacgataatcctagcaattctacgtaaagataacttgcatgagaatctaaccgaatcattacttctttgttaaacttcaacttgtcaccatgataaacctttatcacttgtgtttggtctcgttcttcagggtctgtatatagcacaactacgtacttcttaaagccctcgtaacgtttcagaagagttttgtcatcgcttgcgaatgctcctaccctcacgattaaatctgttgtttcgtcttcattaatttttcttttccctttgctaatcattagtcttcgtttcttcgccgctgcttgccccaagttcttcatcatctctagagaacaaagtgaattaagatttggagttttagggttttatatacaattatttcctcttttttctagggtttattctaaatatgtttttccttttttctttgcatggtgataatgatgaaattatatactccctctgtttctgaatatttgtattttaagggttttacacacaaattaataaaacatacaaatctcatttaatttatctcttacctagaaaaacatcattaattacaactaatctaaccaataaaaaaatatgatgtaaaatataattggttaaaaactattaaatatatttaatgtttgcatagaaaagtgaaaacaacacttatattgaaaaaaataaaaaacttttaaactacacttaattagaaacagagggagtatatgaaaattggtcaagtctctccacataaatgacatatcatcacacaacaaagtgacatatgtcattcgatgttttttaaattaataaaactaataaaattaaataagcaaattaaatatatcatcaattctactcttaattgatttctccaaaataaaaataaaaaataaaattatgtaaacaaattaagtactactttcattatactctttttattttattaattttttatcatcaataatcatgactaatttttttattgtgttgtaattgtttgctacctaacctcttattagtttagtaatttaattttgagtatttgataaccttgacattcaagttttttcaaataataaaccttcaaaatattagacctaccaaataatgtaatacacgatcatttctcttatattgatatatgcaatgacagacgatataaaagtattgactttaatgatactttaatttttgcattctttttattcttttcatatgaatactcttgaaatcttgttcagtttatatcaattctatatatttaatcatgagcctataacatagttgttggagtattatatctagaaaataaataaaaccataaatagtttatttataatcaagttgaacaattttcaaattatccaagacacgatcatttctctaatattgatatatgcaatgacaaaagatccaaaagtgttgacttcaatgacattcaatttttgctatctttttatctttttgtacgaatactcttcagatctttttcagttgatgtcaatcgaaactttaatcatgagtctgtcacaatgttgttgaagtacataaaacaaggaattgatttatttataatcaagttaggaaaattttaaaccacaaaaattacatagttacacagaattgtatcaaaatatcattattgttgttatatgtattcatgaagtgaaaaaatattaaaatcttacaaataatcagctttatacacacaaatatataaattgatatttcaagtcacaaatgaatctaaccataaaaattgtaactacatattatagatctaattttattaacaatacaagaataaacaaatagtaaatataaattagcataaagaacaatcaatgtaatttttttttaacaattttcataacaacgctagggtaatcatctagttagaattgatttagttatgaattatgatgtgtgatttggtgagtgtaagtcactcgcttctcatgtaaactataatatattgaatctcctctctcttctctttttcgcaactttcacagagaggtagtttttgatgtttgccggccggaatattttccggtgaatagccgtcccgagtggctcggacttctgcccggtatctttcagctttgatagtggagatagccggtttacgtctggcaaacccaatttctatgaatggttttggccgggtttttatcttttctcgccgtcgatcggtttataccgattgcttttcacttttatttcaataatttctacagatctgagttaggaattgatttttaggtactagatcctaaaaattaataattctggcttgtgattttggaaacctcgatttgcaggaaatctatcaagcggttatttcttggttgaaagattgaagaatattccgatgcatattaccattcccttatgttgtgttctttaggagttccgttcagtgttatttcggtggtaaacaaaaaaatttcgtgcgatgtttcgacgatattttcttcaccggattctgggcttctcgacggcaaggttgatgtcgttaaatttctgatgatgacttatcggcatgtgttacagttgaattctaaagtcaacacgtgttttcggataagagtccaacgttaagaatctttttgctgtacatgttactctaatgggctattgttgggctccaattttcttgctgcacaatcgttgtaggctttaagtcttgtatcttttgtttaataaaattcacttgggaaaaaaaaaaaaagtcactcgcttctacagcgcgtgatggcttgtttctccacccatctctccttcgttgagaagcatgcaccaaaaaaaaaaaaaggcttcaaagagaataaatcccaaaaaatttcaatctttacgcaaaaggaataaacatttctgtgacggtttcaaggtttcatcggaaccctagatctaatactttttcccgatttgaatttgcgatttcagatctgagagaattagtcaaattctgaaatttcaaaattg

SEQ ID NO: 15181 - DNA, 3000 bp, Unknown
  misc_feature (1)..( 3000): cDNA_ID_3095081_gDNA_ID_2926079_Annot_ID_196323 3000 nt of promoter + ATG
gcccatttattcaggcccacttgtacttaaatgacgaaattaccccgttagctgtcgaatacgagatatatcgcgtcgtttgctttcacttgtgtcttgtgtgttctgccaaagtttctctgcagcttctcctcttctcagaaattagggttccgtctcaaattacgagcagatctcgtactctctggtaatgatttctcgtttcttatactttgtttataccgaagtatcgattcgcttgcatgtctcgtcatctttgtaccgattctgatttgaagtttctagggtttaccatcgcgcaattacgatttgtagatatgttgtttgcgagtagagatcaattgaaattaccttcgtggatttgtctcgtaagcgcgaaccatgtttagagaaacgagttcagatttgcttcacgcttaattattgtgttgtagctgtgtatatcttctggatctgctgcgtgtgtttggtttttctgggagtcaagtcatattaacgttgttcaaaaacacttttggctgtttgttttagaagatgtctgaagatccggagtaccgttgcttcattggtgggcttgcttggacaacgtctgatcgtggtctcagagatgcctttgagaagtatggtcacctcgttgaggccaaggtaaattttttatctctctttcctcagtggctctctgttcttctggttactgaaacttagaagctttgttctgtttcgccttcagattcaaacactgaagctttgatatgttttgtaatttgtttgctttctgcaactctgtttatggtgaggcgtgtctgtttagtaactgacttcttttagtggctatcagctcttctgattgctgagacattgaagctttgagtgatttgttcattttcttgctctttgcaaatctgtttgtagtgttgtctgtttgataattttatttgaaatttatcttactaccttatttttattgccataactattatgagagataaaccttatctattgatacacaggtggttcttgacaagttttctggtcgctcccgtggttttggattcatcactttcgatgagaaaaaagctatggatgaagctattgcagcaatgaatggaatggatttggatgggcgaactatcactgttgataaagctcagcctcatcagggtggtgcaggcagagataatgatggtgaccgtggtcgagaccgtggatatgatcgtgatcgcagtcgtccctctggtgggcgaggtggtggagattgctttaaatgtggcaagcctggacattttgcaagagagtgtccttctgaaagtagtagagatggtggtggaaggttcagctcaaaggatgataggtacagttcgaaggacgataggtatggtgcaaaagatgataggtatggtgcaaaggaggataggtatggtgcaaaggatgataggtacagctccaaggatgataggtacagctccaaggatgataggtatggtagtagggatggtggaggtagtcgctatggacctgatcgcagtggtgaacgcgctggaggacgcagccgggatggtggcagccgtggagctccaggaggtgagaggcacagtcgtgctccatatgaccgccccagagctggtggtttccactagaattctactccaaagggtatgtatgcattctgttattttaactttttctattgtatcccttcaaagttaagttctggtaagacttttgttgaagtcgctttatatcttcttttgcagttaaagaagttgaaggtttctgctttcagctcgtgtcaagtcaaagttacgcttgatggtctattttcttcaatgtatttggatagctcgagaaagaagatgtgttctctattttggccctaaactcaagagtcgactatgttcctaaagtgctctctctccttttgatatgttgatccctatggaaaccttgtgcttggttggtttgagacaatttgagatgtgctactttatgcttatcgtaatgaatgcgtgggttatcccccaacaccaaatatgcaaaagcctcaggtacgtgattgatctccacggaatatccgaggtcgacatttggtaaaattcaaatgttgttatatatggggatatgccgtttattgattctggtaaacaatgatgcaggatggtctgatactcgggtttagccgtgaaaattaaagactgatctataaaacttgtgatgggattgggaaatatacattgctgattgatacttggctactggaactcaaacatcccttcatgagcaacaaattgtcattttcaggaaaaagattgactttgtgcaattttagatcttggcaagtcaaatccaatagttttcttcaactagggaaatttctacagccaaatggtctctggttggctcgtctagtatagctcactgggtttatcttcgatctattctttgtgggttcttcgtgcctcttcgtctactttgtttcttgctcgtgacctctacctctgcctttgattctcaagctctaaactccaggaattgggaaatggtgttaatgtatatatagttaatatacgcttgaataggtatccttactttgataatttgttgaaattgcatacataaataggtcacacgagttatgtcgggaaaacactgacttgattattttatacaagtgaatagtatatgtatggttagaacttagatgcatgactagttcgttcaccttctttcacaattttgtattgcatacatacatacattgcttaggtgaatatataatcaatttaccataaataaatgactttgtaagtctcataatttaagactttgtttctaacataaagaaagactttgtagaacatatgagttggtgtatagcttaaacgttgactcaattatttgatagaaatcgaatagcatagctattcgacgccactattcggttactcgtacctcgaccacaccaaattaagaacacttaccggaagaagataaaaggagaaa

SEQ ID NO: 15182 - DNA, 3000 bp, Unknown
  misc_feature (1)..( 3000): cDNA_ID_3095071_gDNA_ID_2926079_Annot_ID_196326 3000 nt of promoter + ATG
cactttcatttgtggaagatggtaaaaagtctcagccgcttctcgcgtatgtaaacaggagccatgaatatgttctatttgatccttatagcgatgaaaaactcgagactagcgccatagattatgaagtttttcttgcagcaataagcaaaaagaagaagagatctaggaagaaagcattgatgtcagagaaaccttgggaaacaatgttttgtggatcaacactcaatttcccgcctttccccgacttgtgcgcttcgttcttcagttcccggatgcagaaagaggtgtgtgagagagcagatagacaacctgaaagacatagctcttgagagaccccatattttggaacccaacttggataacatcattttgttggtagcctttttgttagagatacaatctgattccttcagctactaaaagggttgttttgatattaaaagggcttcattcatcatgtagaacctgctgatttgaggtgtataaaccaattctctctttaatacgtaaaaaagtaaggtcaattgtaacgtatggaaaaagaagaagctaaaacagagtagtggacgataaattatatttaaaattgtgactgaaacataatttaacaaattgaaaaacataaatcgaaagcaatttgtgttttaaagatcgtagtccgcaaggttgagtgggttgcaagtatcctaagtcgtatgtggtcaagcaggaggattcatggaggctgcaggaggagacatcatcggtaggagggtctcggggtcaaagccgttggctcgtagtaagacatcttgcgctcgcttcatcgcaagcatgttgttgatgacgttgttggagaaggtgcggaattcagcctccaaaatggtgacccgcatatccatgtctaggttaggctggatgtgctggtactgaattgagccaagtccgtcgtagtcacaccctttggttgatgtgacgtgctgcaaaagaaacgagtattatagagatggccttcaaacttggtgaacaagaaatcacaagggagagagaagaaaacaaagatagatagacctcatgggaacgttcatcagaattggcccggagaagatgaagatcggcaaggatgtgtgtcaaaatggaagccctaaagaaatcagagagggtcttctctagcttctccattttcttcatgagatataactgtcgaatcatattccaacgattgcatgttaagaatttgtccatgagtttcttgcccttctctagagactcaaagagtatacggatttgagcctggcggtgagcaggcagctcaactccactgtactggatctctttgatcgtcggttgaatgttctcgatcaaggtgctgaggttgtcggctgtgtttttgtaccggcctgctctcgcagatatcagaaagagctgcttcaaaagctccgtcgctatctcaccggcgaaataatcagtgacggccatttagtaaaggatatgttaaagagaaaaagtgtggagatagagagctgagagacaaggggatatgaactaattaatctgtatagaggaggaattcaccggtggaagtttcctagcaactcgaagtgacaagtgacatctccatataatatttgttcaagagttcaatgaagaagaaacaaggaaattaatgagaaggtagacgtatattttattttggcatattgtcttgtttacaaatttttaattaaggtttcttagagtcaaattactgacatatacactgacgtaatatgatcatattaaatcgtttgattggtgtatgtacatattactgctgagtttgtggttacaagcaaatcttatagattcctttttattttttactttttttctttaaaacttaagcaaaaacataaacatgaccatattgttatagattctaaaaagttcaaaaacttaagcaaaattaacgtcaatgaattacaataccagttgtatactattaaatataaacaaattataaaacgacgaaaacttatcatatatttttcaatcctgctctttaaggcaatatcagaatattggataataagcttaaaaagcaacgttaaaaaaaaatgagagagatatttacattttttgtagtgtgtgtgatggtacaaaatacaaaaaaagaattgtgcttttatagaataaaaggttaatattttattttaccttttgttttttttatttattacaaaattatggactgccgttggaccactcacattaacgtatgagaaagaactgtacgcagttaatctacttttattactaaaaaagcaataaaacaaaaattgtatgcagttagccgcctgatttttatttttttgcttattaaaaattaaaaacagtttatctgtcacacattttggactaccaaaaatctgacttaccattcaaaacttttaatatcgatccataaaatgcaaaaataaattaatcttttcgttctacctcaaatctctaaattaataaaaatatgtgattttaatttatacatattttcatgtataagtataacttccacacgcaagcacagtcacactatcaaatctatggattcaggttacttatgacacgacgattatatattaatatttatcaatcactatacaaatatgacacaacatcacaattcagtaccgactacaagtcgcagttgcgattaatgattggataaaatttagtaaacatatacgcgataattgtcctcacgattagtgtgtttcgcgtatgattgattatcttgtaaaggatgatggaccaactatacacattaataacgtggtcgcggattcgtttaccaaatcaagaaaatacatttctatgatccactaatgctcttatattttattttaatgattaaaagaaacggtagaaaccatatttgaaagcgtcagcttctgatctatataaaccaacaagtgttatttcagcaaccaaaacaaaaacacgagtggaaacttttaaacaagagagggagagagcgaaatg

SEQ ID NO: 15183 - DNA, 3000 bp, Unknown
  misc_feature (1)..( 3000): cDNA_ID_3095055_gDNA_ID_2926079_Annot_ID_196329 3000 nt of promoter + ATG
ccaaattccaactaaatcagttttgattataacaattattatcaattttgtttatctagaaattgtatagttaaatgattgtagtaacatagaataatttggttagtttttctttctgtcaacaatttgtggtttttttttttaatggaaacaagtagtgttactatctatctttgaaaatatagagacttgggacgtctgatgtacccatgcaactaaatacaacatacatttgaaaaatggcgttcattgtctccaaaattagggttttgagttacacttacgcaaaccgatgacaaaaaacgcgggacaaggaagacacaagatttgtttttggtcattgctaaatgaagataaattaccataatggtttttgtctaaggtttgtctacaagagaggaatcatcatcccaatgggaccataccatcgccaccacaaaacacactttgtctttgtttcaattaattttggacccaattttccaatttattttcatactatttcatttcattttctatctttttcctgcaacttgcatttagttgaatttttagttggatttctttgttcctttttattgatatagaaatcaaaatatctgcatatctaatcagcatatgacaaaaaaaaatccaataatataattaatgtcgtttaaaaaaaaattaatatctaaaatacaaaattgatataacatcttttatagagtaactattaagaaaaatatatatatagtatatatcttttgtaaaatgcaaaatttatttaatattatattttggttatcggcatcatacgcttgttctcaaggattttctcaactctgtagcagatatatatctttcattctctttagagtttatgtcacgctttatcttttggtttatgtcgatgataacgttatcaaggatatttttttcaacaagttcatgatttatggatcccatatgctcgtttctcctttataattaaggatctagataattgacaatattttcatggaatcgagttctctcgcacttcaacttcatggaaactctttatgagttctagatcctttaatccaaaaatatatgataactaccttgctatcaacaaaattatcctaaccaatccatcaataaaagaagagcattaatggttggcctccaaaataattttgtgctacttgtgtggaattagatctctctcacatccagtggccgttcatgcttcctcggatgcgaattatcaaataaacagattcgggatacaatggattttttatcttcccggtaaaattggcatcacataagaaaatctctgattatcaactgtgataacattggtgcaatctatccactttcgaatccaatttttcatctttgaatgaactatgttgtcattgattttttattttatcagaggtacttgtatgaggtggtttatgtctttacagaagatcagcttgattttgctttaaccaagtcgcgacgcactctagggacatttgttttttaggtctagctagggccaagttcatttcttcatagtaacaatattagaagaaccgtacctattgaaatcattagattatatgtttacttgttctaatacactaatcacatatcccatgtagatgtaacatcagtgtatttatgctttggattttttaatcatgaatataggagtcactcattttcttacatatagtgaatatcctttggtacaaattattaataaattaatttctaaacatatcagttcagaatttgaacatatttggataatgtttccagtttaaaaatctgtgattcttagttcccagtatttaaaatgtgttggcaacaaaatcaaacaacagagtacacaacttttgtctgtctcggatcggtcgttttccaaagctttcaatgggtatctcgagtgccccatataagggtccataattataaaactttttactattagctcctcataatttgtttttgttttgttaagcagctcatacattaatatgttacattttgagtctttttattttctgaatataatattaaattaaattcaagaaaaaataaagggtaggtcatcaaaatgcaaaagttgcttctttttttcctgaatttgaagatgcatgaatttgttaagggcgtaaaccatgtttaagagtaatagtaataccgtatgtcgctttcctttcgaatgaccgagagtttattttaaatttgcttttccatccaattgacgagtttagttgcaggaatcagctgctcatcatgcttccttccattacgctcccgccatatcgaatgtatattgttatttgaaaactgtagggagctaagaacgtttgaatcctgcctaattgagattcttttttcttcttcttcggactgttgtaagttgttacaaacacatcagtgataaggtatatattgtgcaaaatccgtaattaaagaaaacattaagaagaaataaactggatgagttggttattagagagaatgcatcttgtgttgagacaacagctcggattggtgaagagaagaaccagatcagagctgtgatcggacacgaagcagaggaagctgtaaaggtaaactcttcagatgacattatcaagaaggttctgagattgggccaaattgagaatgcagcaaacctcaagcccaataaacaacaggcccaagcgcagaccctaaacaactctcagctccaacggtcatctactgcaaaagaagacaaaaccaaaagcacatcaagattggatcaaaggacaaaaacaaggagctgtgctggaaaagaaggagtggttttacaaaaccgttttgactgtctaggatcaatagagacctgacatgtgtcagtgaaaaccctagtgtcactaagattgtaatgcctataaaaggaaacatgatgtaaccttaaaccctaaggagaataatcaagagaaatgaaacttatcttcttcatatttagcctttgagcatctttactttcatggtatcagagccatg

SEQ ID NO: 15184 - DNA, 3000 bp, Unknown
  misc_feature (1)..( 3000): cDNA_ID_3095060_gDNA_ID_2926079_Annot_ID_196328 3000 nt of promoter + ATG
aggcattgattacctggaaacttatagcctagtggtgagaactccgacagttagatcagttcttcacctagcaaccatcatgcagtgggacataaagcagatggatgtgaagaatgccttcctccatggtgatctcacagagacagtgtacatgatgcagcctgcaggttttgtagagaaatcaaagccagatcatgtctgtcttttgcataagtctatctacggattaaaacaattcccacgtgcttggtttgataaatttagcacttatctgattgagtttggctttgaatgtagcaagccggatccatccttgtttgtatacatcaagaacaagagtatcatcctgctgctgctttacgttgatgacatgataataacaggaaacagttcagatgcgatgtcaaagctattagacagcttgaatactgaattcagaatgaaagatatgggaagactacattactttttggggattcaagtgcagtttcattcagaaggaatgtttctctcccaacagaagtatgcagaagatcttcttgctgtggctgtgatgagtgattgtgctccaatgcctactcatctgccacttcagttgactgctatacctgcacaagatgaaatctttgacaatccaacatatttcagaagtcttgcaggtaaacttcaatatcttaccttaacaagacctgatatacagtttgctgttaactttgtttgccagaagatgcatgctccaacagtgtctgacttcaatctgctcaaacgaattctgaggtacatcaagggaactataacaatggggatctcctttaataagaacacatattgcagattgagagcttactgtgatagtgattatggaaattgcatagactcacgaagatccattggaggttactgtaccttccttggtacaaatatcatctcatggtcctcacaaaagcaagattcagtctccaaaagctcaaccgaagctgaatatcgaactctgtctgacactgcctcggaggtaacctggttaggatctgttctcaaggaattgggcattcctctacttgacactccagaaatctattgcgacaatctctcctccgtgtatctctctgcgaatccagctttccacaaaagaagtaaacactttcagctacactatcattatgttcgagagagagtagcacttggagctctgattgtgaagcacatacctggtcatcaacagatcgcggacatcttcaccaaatctctccccatcaagccgttctgcgatcttcgttacaaactaggcgtcgatgttccacctacgccgagtttgcggggggctattagagagaatgcatcttgtgttgagacaacaactcggattggtgaagagaagaaccagatcagagctgtgatcggacacgaagcagaggaatctgtaaaggtaaattcttcagatgacattatcaagaaggttctgagattgggccaaattgagaatgcagcaaacctcaagcccaataaacaacaggcccaagcgcagaccctaaacaactctcagctccaacggtcatctcctgcaaaagaagacaaaaccaaaagtacatcaagattggatcaaaggacaaaaacaaggagctgtgctggaaaagaaggagtggttttacaaaactgttttgactgtctaggatcaatagagacctgacatgtgtcagtgaaaaccctagtgtcactaagattataatgcctatgaaaggaaacatgatgtaatcttaaaccctaaagagaataatcaagagaaatgaaatttatcttctttatatttagcctttgagcatctttactttcattggttaagagaacactgaaagcaacaattcatatgtataaaaatctgaaaaaataattcaacattctaattcattaaacgtaggatttacaaaagtcccactttgtctcccatttttagtcatcgttcatgatggttgtatgcgaatagtttgatgaacaactataattattacatttagtttgtttccaacgagccatatgtcaatgtttgttacgctacaatttttatttttcttatttcttaaactttttactttggaataagttgatatgtatatgaatcatctaccatttctcgttttttcacaataaatcctaaattttttgaacattttgtctatatataacttttccatgacataaattaaccttagataatattgtatctaaaggtataaactaccgttccaagtctgattaaactattgaccctaaacatttttaaaactgttagatccacaagacgcacaactagttgattgcatagtcttttgaaacaagacaaacaaacactatatcaaaacaatatcatctttctaattttattttagttatgtcgctatctatatgaacgattttccgataagctagtcatatgcaaaagatttataaaaaaagtaatatgttgacgaggaaagtgatagattgataaattaagaacataaatgtttttgaaaagaaattatagctaaactgtcataaaataaaattataaaatagattaacttatatataatagaagcaacttcagttttttaaaacattcatggaattaacgatggatatcgaagtttattggtcaacctaaaatcatacccatacattttagtatttattggacgacctcaaaaatcaaagtcattgtcgaccattgtaatacagttaatgtcgcatactatgcctctgaatcatccatccatattttgttaaaacgaagtgagtttgttaactacaaaatttccaattattggactatacattatattttgtttatccacagggtttttcacataaattaagaaaatacaaaatacttaagatcttgaaaaattatgtaagttattttcttgccgtctcattttattaaagataaaacagaaaaaataaacaaacaggccgaggcccaacaaggtcaaggcctagtccaagaagcgaaacccaaacatg

SEQ ID NO: 15185 - DNA, 3000 bp, Unknown
  misc_feature (1)..( 3000): cDNA_ID_3095036_gDNA_ID_2926079_Annot_ID_196325 3000 nt of promoter + ATG
ctggatctctttgatcgtcggttgaatgttctcgatcaaggtgctgaggttgtcggctgtgtttttgtaccggcctgctctcgcagatatcagaaagagctgcttcaaaagctccgtcgctatctcaccggcgaaataatcagtgacggccatttagtaaaggatatgttaaagagaaaaagtgtggagatagagagctgagagacaaggggatatgaactaattaatctgtatagaggaggaattcaccggtggaagtttcctagcaactcgaagtgacaagtgacatctccatataatatttgttcaagagttcaatgaagaagaaacaaggaaattaatgagaaggtagacgtatattttattttggcatattgtcttgtttacaaatttttaattaaggtttcttagagtcaaattactgacatatacactgacgtaatatgatcatattaaatcgtttgattggtgtatgtacatattactgctgagtttgtggttacaagcaaatcttatagattcctttttattttttactttttttctttaaaacttaagcaaaaacataaacatgaccatattgttatagattctaaaaagttcaaaaacttaagcaaaattaacgtcaatgaattacaataccagttgtatactattaaatataaacaaattataaaacgacgaaaacttatcatatatttttcaatcctgctctttaaggcaatatcagaatattggataataagcttaaaaagcaacgttaaaaaaaaatgagagagatatttacattttttgtagtgtgtgtgatggtacaaaatacaaaaaaagaattgtgcttttatagaataaaaggttaatattttattttaccttttgttttttttatttattacaaaattatggactgccgttggaccactcacattaacgtatgagaaagaactgtacgcagttaatctacttttattactaaaaaagcaataaaacaaaaattgtatgcagttagccgcctgatttttatttttttgcttattaaaaattaaaaacagtttatctgtcacacattttggactaccaaaaatctgacttaccattcaaaacttttaatatcgatccataaaatgcaaaaataaattaatcttttcgttctacctcaaatctctaaattaataaaaatatgtgattttaatttatacatattttcatgtataagtataacttccacacgcaagcacagtcacactatcaaatctatggattcaggttacttatgacacgacgattatatattaatatttatcaatcactatacaaatatgacacaacatcacaattcagtaccgactacaagtcgcagttgcgattaatgattggataaaatttagtaaacatatacgcgataattgtcctcacgattagtgtgtttcgcgtatgattgattatcttgtaaaggatgatggaccaactatacacattaataacgtggtcgcggattcgtttaccaaatcaagaaaatacatttctatgatccactaatgctcttatattttattttaatgattaaaagaaacggtagaaaccatatttgaaagcgtcagcttctgatctatataaaccaacaagtgttatttcagcaaccaaaacaaaaacacgagtggaaacttttaaacaagagagggagagagcgaaatggcgacgtcgggaacatacgtgacggaggtaccgttaaaaggaacagcagagaaacacttccagaggtggaggaacgagaaccatctcttccctgacgctgttggccaccacatccaaggtgtttctgttcacgacggcgaatgggacactcacggaagcatcaagatttggaactacacattgggaggtatatacctttattatacgttggaaattatttgcatcattacatatgaatatgacccaaatataatttgactgatacgtacacatgaatgtaaagatggaaagcaagaggaattcaaggagaggagagagatggacgatgagaataacacaatgaaggttgtaggactggaaggtcacgtgatggagcagctcaaggtgtatgagatcgatttccaatttattcccaagtctgaagaagattgcatctgcaaaatcactatgatatgggagaagcgcaacgatgatttccccgaaccaagcagctacatgcaactcctcaagagcatggttattgatatggaggaccacgtccttaaagcttaatcaacatcaccatcatccctatatgtttattaagttgttttcaattatatctaataaagtgtgtttcctttcggaatgctatattttcaattatatataataaagtgtgtttcctttcggaatactatatacgtaccatgtggtttcttaaatcaatatataagaaaatgggtcttgtggagttactttctgtagcatatacctttagatgttgacatcttttccattcaagatacacttggagactaaattttacggtttcaagatgatctaaagcttaccaattgaagggaactgaaatatttgtaatatataacaaaacttctcaaattcttttattttcatgtcgtatttattgtaaaactgttttttggggtaaaatataattttacattcataccaaaaaaaaaaaaaaacttaatttttctgaactagaaggatgatggaccaactgtacacattaataacgtggtccggaattattttatcaaataaagaaaataaatttctatgacccaataatgtaatgctctaatattttattttataatttgtaaaattaatgctcactaaatactttaggttgaaaaatgaagaagagaagtttctagcatgattaaaagaaacagtattcttaagcgtcatcttctctatataaaccaaggcaacaagtgttatttcatcaaccaaaacaaaacaaaagaagaaacacgagtggaagcttttaaacaaaattaaaaaagagagagagaaatg

SEQ ID NO: 15186 - DNA, 3000 bp, Unknown
  misc_feature (1)..( 3000): cDNA_ID_3095086_gDNA_ID_2926079_Annot_ID_196322 3000 nt of promoter + ATG
tgcagttggtacaatagatgcatttaggctcatcatatctttaagtttaaccaaatttggtgaatcgatgttatactaatttctaaatctcgggttttcgacaggtcttcctctagggaaggatggtaagaagaaaacgaagaacaaccaaatgtgggatatctttaactactactacacagttcccagattttgaagaagacttagagcagcgttaatttcattaataaaatattcataaaaaaccctaatctttgttctttttttgttggtccatcttcggaatcggagctttgttgtttcgttttggtcttctctactcagcgaaggcgtgtctcaagagaatgtgtctcttcttgttattatattgttagacattttcgaatgttgattgttatattttttgtagctattcctggagtctctcatctccttttgatgtattttgttaacacaattatttgccagtaaccctatttgtattggaacaacaagaaagacaaaaacgaaattgtttagcatacaacaagaagaaaaaaacacaaaactaattgcttacacatacttccctctatacttaggttttggatctttgaaggctttggaatcagtgtcaatctgagaagaatcaatgggtttgaatatagaggagtgaatattaccatcctctaaccacttaagatgattctctctaaactctaaatgcattaaacgagcagcttcttcaacctcttcactataaggctctactttcaccatcgttagcagaacccgactgtaccgcgagctcaggatctgttcagatacagctactaacttgaaacacgggtgctccgggaacttaacctcgctgccagtctcatctctcaaaaccgggaagaaaaagacgagcctgcctttcatcaccaacattcttgcagcaagatgaagtagatcatgaacacactccactagactatatgcaccagtggatggaatgtgatctgttcttttgtcatcagggacagtgtaaggatccactgttcctctaaggattttcctaccaccggatttacgtccaccagcacgaaccccgtaaggtggatcgcagataattgcatcaaagatctggaccaatagatacataagacataaactcagtgatctctctactcaatataccaaagataataatgaaagaactgagatatagagcattacctcctttagccccgatcgccaaggaggaacgttattatccattctaagtaaagctaccggcattggtaatccatactgcataagtattaacagatgtaagaaccagtgatatcgaaagaaacataacaatagaagtcacacactcatactaacctgtttgaaattgctccaaacattacaatctggaccacgtccatcacgcactactctgatatcgatatctgcaccctaatacaacaactcttttatcagttcgagattcagaaaccacaaaaggaaatcaataaactaagggaaaggttgcaaaccattgtcattgcgccaaagcgtgcagcagaaacaagaatgctcccagtaccaacaaaaggatcatacacaagttttcccgaagtagctttcgcttgattagccattaagaaagccatttcagcatccatagcagttggaccaaggtaagtacgagatttcaactgaaatgtaggtaaaagcttcctatcagcaaaaccaacctccctcccaaaaaatatccttctctgtagaataggttgaagtccattgttctcttcagattcaatcatttccattagaaaaaagttatgatctgggttcttcaagttaacacgaccctgcaacaaccaaatcaccaaagaatcaaaacaatgaagataaacaccaaaagagattgaaacaagaaagtggaatcagacctcaaatggtatataagtaaacgactggattcgatctttctgctcgtcaaaagttaaagcctttccaaaagtttcaacagagattctaaaagttgaatcagaagtgagaaatggaagctttcgagaatcagggtagctttgaatcgagtctttaagctcttcataacaagttccttcaccccaaagctcatacattcctttcaccaatatgcttcgtttagcaatgttacgagcgatttcttcagatgaaagttgaacgaaatggaatggagtatcgttatggtgattttcaggtagacgccattggagagactcattctctgcaatctcttctccgaagagttcagctaaagcttccacttctggctttctgaagtctaatagcctgtgatagaagacacacagaaaccacatctctctctctctctctttcccctgaaacgaaaaccctaatttgacaacagaactgagaaagaagacgaagacggagaaggaagaaacgaagaacgacggcgactaaaaccttttcttcaaaacccttatacatgggcccaataaagcccatttattcaggcccacttgtacttaaatgacgaaattaccccgttagctgtcgaatacgagatatatcgcgtcgtttgctttcacttgtgtcttgtgtgttctgccaaagtttctctgcagcttctcctcttctcagaaattagggttccgtctcaaattacgagcagatctcgtactctctggtaatgatttctcgtttcttatactttgtttataccgaagtatcgattcgcttgcatgtctcgtcatctttgtaccgattctgatttgaagtttctagggtttaccatcgcgcaattacgatttgtagatatgttgtttgcgagtagagatcaattgaaattaccttcgtggatttgtctcgtaagcgcgaaccatgtttagagaaacgagttcagatttgcttcacgcttaattattgtgttgtagctgtgtatatcttctggatctgctgcgtgtgtttggtttttctgggagtcaagtcatattaacgttgttcaaaaacacttttggctgtttgttttagaag

SEQ ID NO: 15187 - DNA, 3000 bp, Unknown
  misc_feature (1)..( 3000): cDNA_ID_3095105_gDNA_ID_2926079_Annot_ID_196318 3000 nt of
tgaacattcgcaaacattgacgttttcttaggaaccttgaaaggttcaatgtattgagttgctatgagtgtgttgtaatagtaaagctcgaatgtcacatagctaaactccacactacttttcttgcttgggtttgtgacgtttgctaaaatggttagatcaccgtttagaagaaaacccatgtcgagataagcagcgtttaggttagcagctgagatgtcgacgtaaggtgagcgaggacggtagacgaggtaaacgattaggatgataagaccgccgagaataagaatgacccagaatattgcacagcaaaatgcagctgaccatgtcattgcgtttgtctctcttgagggtggtggtaaccgtgggccacggcggtgatgcggggatggtgttggagcggttctccatggacttggtttgggtattggaggtaatgttgatccataaccccctccgttgcgttgtggtgcttgtggtggtggaggtcgttgttgttgattatcttcagggcttaatagcaatggtcttttcgatgagttttgagtttttcgtggtggaagtctctcctctgggcttaatggtacaggtattacagaatgtttcggttcttggattggattttcacggtggcgaccacgagtcttgattaggattcctggtggagctactgggtgaggttgcgtggttttgtggtgcgatttttttgggtgcggaatgggcgggatgtgtggttggttcgaagatgtttgtgaggtagaagcaccaccgcttttgagatgtggattctgcgatggaattcgcgcaaaatgagggttagtttcatggtgatgatgatgagacatttagatgaagaagctaaaaagcatcaaaggaaactaagttaagtaagacttgagatgaaagaatgagaacagagagattttgaactgttttaagtttctaaatgagatagagagagggagagaataacttggtgacaagttcaagtaaggattctttgttgtagaaaacaaaataaagaaggaaagtgatagcacgaagcaagtaatctttgttgtagattccttgcactaaaattaaaatcagtttctaatctcatgaaaaagtataaaaacattctctgtatctttttctcattcaaaagtttttttaagaaaattgtaattactcggtccaatttatctaaaacccaaataaaaagatctcgattttaggagagacagggttaaggacttacagtaacagtcatgaatatgtcaatctttctacttcagctcactccaggggaaagatgttgattctcagagcaacttacgaaaacttgtcgaatatgtcagtaaactatgaacatgttaagatatgtctcccatagatcaagaaggccgcagattagttagcgcaaatctgatgcgaaacacgttgcttctgcaggtagatactctgttctctgctcaatttctgcagcatcaaacatgaaaccaactctgcaatgccggttactgcaaacgttgacaaagacaactaccaatcgagcctgaccaaacagatactagtaaaaaagctggaagcaaactgaaaactaaacccatacaaaaggtattttccacgatcttcggtgcaattgttcttcctatatctcttatccccattctttggcatggcatggtatatagtaacatgaatatacataaaatgaaagtgtaaacgcctggaaagagctaacctacgctttacacgcgaagaaagcagaacaatctcagagtaatcatggccggaacaagaaacacaattcaagcacagagacccacagaacacagtcatacagagtgcaggagaagcaacgcacttgccctgaaacaactttcaatacatgtactcctaagatctgatgttctttctcaagatcattgaaaacttacgaaagagaagccatagagtaaacaactaatcaaatccaaaattccaattccacattgattcaactcatcaaaagttcaaaatgtaaaactgtgttatatcacacacagatactagtactgatcaacatagcagcactcttgcttcacctcagctctcataaacctctgcaaagaataacaataagaaatacgcaagatcttactaaactaaacaacaccattaaaaccctaaaaaatgtgaagcttttgagaaaaatcagaaaacattacctgactttcttgatgaggattgattggagttttcgagcaaagtcaatggatttgattctgcgttcaagattcttcctagcgagaaccttcttctccgaattcttaatgtgatgagtctgagtccctttgatcagcctctccattccactcgattgcatcttcttctgcaaaatcgtcagtgccttgtctaaatcattggagaacaccttcactcttatccctcgctcttgctgcaactgctggtttagactcggacgagtcaccaaccccgtaactcgcttcgctatcgtgttcatctcttttacttgttttctgaaaaagtatgtttctgaaaacgtaaatgagattgacgagagacagtgataggatctgaattcgacttaccggtcggaatctcgccggagagaatcaaagagccaatttgagtgatgatggagaatgtctaggttaaaaaagaggcgatggaggaaatgagataaaaaccagagaatttactaatataggggtggttatgtaagttttatgagatatagggatgtttttgtaaatatccttaaatctaatcttctgtttgattcagagagtattgactttaaagaagaacattcaagcctttcaaaaaaaaaaagcttctttaatttctctctctctctgtggagtgttcgaatctccaagctctctctcaaatggcagcgtccacatagtagagctgaagaagcactgtatctatctacagagaaagtgaagaggaagaaaaggaagagaggatatagaaattaagctggcgacttttagtccgaggcgagca

SEQ ID NO: 15188 - DNA, 3000 bp, Unknown
  misc_feature (1)..( 3000): cDNA_ID_3095182_gDNA_ID_2926080_Annot_ID_196345 3000 nt of promoter + ATG
catcaccggttctcttgttgatttgtatgtcaagtgtggatatctctttagtgctcggaaagcttttgatcaaattaaggaaaagacaatgatctcatggagttcattgattcttggatatgcacaagagggtgaattcgtggaggcgatgggtttgtttaagcgactacaggagctaaactctcagattgacagttttgctctttctagcatcattggagtctttgctgattttgccctcttgcggcaagggaagcaaatgcaagcacttgctgttaaacttccgtctgggttagaaacatctgttttgaattcagtggtggacatgtatctcaagtgtggattagttgatgaggctgagaaatgctttgccgaaatgcagttgaaagatgtgatctcctggactgtagtgatcactggttatgggaagcacgggcttggcaaaaaatctgttagaattttttacgaaatgttgagacataacattgagcctgatgaggtatgctatttagctgtactctcagcttgtagccattctggtatgatcaaagaaggtgaagaacttttttcgaagttactagagacacatggaatcaaacctagggtagaacactatgcatgtgtagttgatctattaggaagagctggtcgtttgaaggaagctaaacatctgattgatacaatgccgataaaaccaaatgtcggaatatggcaaacacttcttagcctctgtcgagtacatggggacatcgaattagggaaagaagtgggtaagattcttttaaggatcgatgcaaagaatcctgcaaattacgtgatgatgtccaacctttatgggcaagccggttattggaacgaacaagggaacgcacgagagcttgggaatataaaagggttgaagaaagaagctggtatgagctgggtcgagattgagagagaggtacattttttccgtagtggagaggattcacatcctctgacacctgtgatccaagaaactttgaaagaagctgaaagaagactgagagaagaattgggatatgtttacggcctgaaacatgagctgcatgatatagacgatgagtcaaaggaggagaaccttagagctcacagcgaaaagctagcgattggtctggcattggcaacaggcgggttaaaccagaaaggaaagacaataagagtgttcaagaacttgagagtatgcgtagattgtcatgagttcatcaaggggttgtctaaaatcacgaagatagcgtacgttgtgagagatgctgttcggtttcacagttttgaagatggttgttgttcctgtggagattactggtgatcatcaagcttgattacttcgtccccgtaccggtgcttcctagactgtgaccctcccatgtgttagggaagaacagctcgtggtgctatatcagcagggtgaggattcaattgatatattggagatttaggtttcgaccaagattgagcccaatgctgtgtcctggagcaagtttttgaaagtggatatgagaccactactcactggttttgttgctgttcgatttgaccacaactctatcctctgggagcttcttctttgatgagcaagagaaagttgctgtggttttagatgtagacgaacatctacacaccgagaccgctcggtaccgcacaacttttatcattggagatgacggctactttaaatctgtgagcctcggagaagctctgaatgtctatgtgggggaaactgggaatttcggatatactctgcgaatatattgtcccccacttgtgtgctcttcctgttatctcctgcaaatcaaccaaccacgcaaaaggaaagaaagagatgatttcgatttgcttcttgctaatctaactgcttgtcagtagtcactcatgatcttcgttacggttctatctataatagctaataacttaggatgtcgtctatttcatgtttcttggtcaattgtgtttcttgcgttgtctgactgctagcgattgttcaatttgctgttgatttcggcttttttcaagtttctaagcccgttcttaacttatcttaagatttctcatgatgatgcaagttttataagcacagctagaaggagcaaagtccaatctaaaaaacgtgagtttcagttcagaacaagataaaaccatatatatatatatactcaaattaagcttagaatacacagagattttgagtattagaagattagtctagggaagaagacaatgtgatgtggtgatgagaaggatttgcagatctactggcctgtgttctaagttgattagactagaggtctagaggtcacccattttcttccgtctcttgtgagattatttataaatgaaattggttggcggcaactttttgtaggaaaatatgagaaatagcaaaacaaaaaaaaacaggcccaggactaagcccaatttcagccttaagatatgcatgtgttgacattcattattaagtcaaacataattcgaatcttattggttcactcactcacacacacactcgcttcaaagaaaaatcattaaacaaaattaattcttaaatattcaatttttcattgggcattagatttttttttccctcattttctagtatttattggacttgcgcaaccgtggagccctaagactccgaggtaaattgcggaggagtaatcatcggagagacgaactctcggagtaaaaagcttccgattgtatcactaccatcccaattttgaaattcgcaagttaattagtggaaagtaggatctagggtttgggttcattcgaaataatttctgcaaatttgggctgatcatggaacgaaggttagtcgctccaatgcttattcttaagcatatccgtcgcgagactgcttcattagcttaatttggaaggcgttaggttcgttgagcggttaattttatttatgttcatttggatcagtctcgagaagaatagttgtatgcgtagtatctctatacctgttgattcgtcatg

SEQ ID NO: 15189 - DNA, 3000 bp, Unknown
  misc_feature (1)..( 3000): cDNA_ID_2991281_gDNA_ID_2926080_Annot_ID_196351 3000 nt of promoter + ATG
ccgtaattttcccttctgaaaccaacgatcctacacatcttcgtaaccttgctgcaaggtgttcatcactggtaatgcatcgcatgataaaacttttgtaccatgatgttccatttcttgttttcgctttataattttccaactgtttttcaggcacgagtccgggttttgtcgttgatagtgaagcttttttcgatttctcgacttgtagcttcagaagttaagaaatcggggcttcttgatttactggaggcagaaatgaagggtacaaaagacactcttgtgatcttaaatgttctggaactctactatgaggttggcctctgatgtctgatattattattcaatctgtttcctttgttgccctcttttgaaaggaaaagatagaattatattgaataattgtgtatgaacgctgaagttaatggaagtggagcacagttcagagttcgtgccacaaacatcacttattcagctgttgtgttctatcatcaggtacaaactgttgaaccttacccttaactattaagcttgcatcagctcatccttcagttttttttctctgggtcttatgttttgtatagtggtacatcgacgggaccctatgaaaagttaagagcaatgatgataagtggcagactactctcaaaggaaaatatctacaaagtcgtggaagaagctagtaagattttcattgtttttagcctttattggttaggaaatgagattgttttgttttctttctatgtgctttcacaacagggagtttttagggactatgttatgttaggaccagttgttccctgtctcaaagcctctgtttgttgtgcccataaaacgagtgacgaagttgaaaagttaactacgaattgctttgtttctgaatgtaatctaaggaagagaaaatagctttaataataatagacttaaatttgtaggctgtactgtagctggcaataaacaactttcaacttgtcctgaatacaggtgtgaaggcgttaatttcagctattgatgggagtctggagtcagttgagatgaatgatactgatgcacaggaagctgccattgatgcacttggtcagatgggatcaagtaagtgggtcacttttctttgaaactttgtttgttgcagtcgtcttctaaaagagatagctagagaggccatacatttagaattatgaattataagagcatccgacaagatattcgtttcccatgcaatgatcttgtaacttatatggatatttttacaataatcttagcaacgaagggagcggatcttgtcctttcaacttcacctccagctgcaagacatgttgtagcttctgcctttgatcgtaatgcacatggaaaacagttggttagtgtgtttttgcttctcatcaattgaaattctgccgattatatgctcttactacatttttgaagatccaatttttccagttttaggatttctaattctaactattgagggttgaaattttgcttcattagtagagacattcatgaaattatatgattgtttcgtaaatggcatgtgcaggctgcactgcatgcactggcaaacatcgcaggtgaaacacgacctaagagcaacagaatagttgatggaaaagctgaagaaagccttagatgtttgatatacgacgctgcagcacagagcacaaaactaaccccatccgtaagttcgtttcctcttttacttattcttctctcagaagtgtgcagattacatatttttgtttgatccgtagcatgagctaatttaagcatgtcgcacaaattgcagggtttattcctctcagttcttcaacaaagctcagagattcgtcttgcggtaaacctttaactcagcatctgatctatcatatcttctccccctttgtttctctagttggaaatttcaaaatgacacactacatttcattcaaaattaagaaatctcttttgtccttctacacaaaactcggatacatgtcactcatttgatctcacataagaccttcacgcattgcctagaggtaactatgttttttgcttatagtatattgtttacaatgttgtttgcagggttatcgaacgttaacagcattagtggctcggccatggtgcctggtggaaatcttggccaaagaagagataataaacatagttacggatgcaaccactgaaactgcaaaaataggtaaaccaagtaacattcctcgcatcacccacactccagccattgtattggcttcttcctccctcaacctctttgatctacgagtctaaatctcattttttttttactcagcaatggaagcaaggtataactgctgcaaagcaattcacgaagcgttcttgtgtagtaactttgttgatgaccctcgtcgtctaaaaaccggtgacaaggttccatacttttcctctgcgctctttaagatggaagtttcgaaaaggcttttctttgatgttgtacttttacttgctgatgacatgtttgacatttgttgcagttgcaagaagctgttcgaagtggaccatatatgtcgaagaagcacagaggcgcacgaccagaagtaatgacaggcgaaggattttaaagacaactaaagaaaaaaagttaaaacttctttgttaaccaaagttttttatatcttctctggctgttcgataagtaaactttagttctttctataaacaacgaaggctaggagtaaacgttttggcggttgaaatttgtgttctttaatttttagtgttgaacttaatcaaagaaaaaaaggaataacgagtttggtccgtttctcatcgtttgccattagcccacgcgggagatccaaaacactgggctaaactggagttaagacgataaaccaagggtaatatagtaattgcgtttccagacatcatctcttcctttatggataacactggttcgaaatggagccattactctttactaacagagggagaaagagcagagaagagagaagaggaagcttgtagaaatcg

SEQ ID NO: 15190 - DNA, 3000 bp, Unknown
  misc_feature (1)..( 3000): cDNA_ID_3095172_gDNA_ID_2926080_Annot_ID_196347 3000 nt of promoter + ATG
ctctgtaagataacgtccaatatggcagtgatacaggtctatacactaaaacgtcaaaatagcattggcatttctgaagaaatattaatggacgctacactcatatctagaggagagaaatcaataaacattgtcaattagcctgttctaatgattttctaaggaaagtcttcagaaaaacaatacagaagatgcgtgtacctcatgagaaaaaatcttatccggaaacattgtagagtttcttgtcatgagtagagggattaaagcacagatcagagctgcaaaagataaagttgtcaacggcctaactaagttggaaattgacttatattcctttagcaactaaaacaaactaggaaggctgtaaattatcttacagtcatttgcatctcgcaatgtaacactaaagtagacatcaagaagtcggggagcaatcttaagagtctgcttcatcctctctgaccgaggaccacttgcagcagcctgcagcgctgcattcaatgtaggagaagcgcggtgtctttcctgcagcacaaatttgacaaaatactttcagtttgtctaatatatcagacagtttaaaaaactaccaactttcacataggccctaaatttttactaatagacaattattatataaaactgtttctgttgagtttttggaataaagcaaagccagaggaaggatgcataccgctagaccatcattttcgtccttcagaagctccagaaacagaggatcagctacatctattgtattgttatcttcagattcagagtcatcccctccatccccgatggttgaaccagtatatgcttcatccataagggcaagaagcatctgcattcacaggtatccttgtcattcattgactatctaagaactgtcatatggtttatgtttttatgagatataagacctccggagctgcactcttctgaattgaagcaatgctacctccaacccttgaccccgaccccgagctcctttccaccttttctaatgccacgaccaatactagcaaaaatattaacaagaagatacataattagtacacagtacactcgtaaactcaatcaggctgagagaataaagtccaagcatcaatggagaaataccaaacaagctcaaaacaatggaaaccagtcagcttacaaatacatcttagtacagttggagtcatccaagtggtctccaaattagagtacaaacaaatatatgaagtcgagtagcattttttagacaagcggactcacttggcaagtctacaatggatggaaacagaggaagaaatgacccaggtgatatcagtcctggaaatatcttcaggaaggacttctccaacctgaaattagaacaaagaaaatttatttccttgagataattgttcaaatcacttgtgcatattttcagcttacttctcccaattccaggcaatgagcttaagcaacaacgggaaaaactgcaaatacaatttcttgaattagatagagatataatatatctgttatggcttaattgttcaagcggtggaaatgtaaatggacacaaattaagaaagatgaaagcagaaggaacagctagattgcataaagctataaggacagaaagatacagttctattacatatgttgatgcacacagtaataacacaataaatagaggcactttactaattaagagagtaatcttcttgagactgaaagctaaaagaaagtttaaggatttatatggctagtcattccagttaatacctgagggagtaagtttgggaaagatgctaagagctttctttggttcacaacaaggaattcacaagttgcctctgccacagcggcatctgagaactcactacaaagaaaatcatgatcatatcagcaaaatttatctacataaacgcatagtagcacacatctcagagcacagagccacaacaagacccagtcaagacataaaaggtagtccataccggctaagacatgagcggaagaatgtcctcaaacttgggtcagaatcgtgcagaaccatatccccaaaatcaagaaaaaactgaagaatggcctaaacacacaaacacagaatccttaatacacactagaacccaaaacgtaaaaaaacaaactttcatctgaaattcttcagggagaataatgtactagcaagagaaggcctttggacgcccctgactcggactgagatagtgaagcaaccgaacgatggaagactttattgaattgtggataaattctagccacaagatcatctgatttctccattttacagaacccatgcagcttcttcacctaatccatatacattcaaacaaaacgaaagcaatgtatcacttaataccagtctcaagccaattctcaataaatggacaaaagatgcgtactgattgtagtatagatggatcagaagcaggatccgtagaatcccgcgcgctgttgcttaggattctgaggtaaaaatcccagtctccttcttgatcactcatgttctcaatcaaaaagaagatcactagaaaaaattcatatgatatgatgatggatgaagaagtttcagcttcggcgactccagagtcccggagaaagaggattggaaagaagacgacgtcgtttattcaaagatctatatccttaaactacatgccatctcttcttgtccacatgtcgtttatagtagcataagacggcacacagtttatcaagcaaaccccctagacgggctatggattggctgcggcctttttatagcttgttgcagcgatacgacatcgtttggccagtacgacttcgttcggccggtacgacttgtcttcttcacgttttctaataggattaattaactacgtgtcgcttatagtagcataagacggcacgcattttattcagcaaacctccgtatatcgcaggctctctcactctttccgtcttctgatttctccctccaaaacaaacctcggaagagaaaattggagcgaaggagcgatagatatg

SEQ ID NO: 15191 - DNA, 3000 bp, Unknown
  misc_feature (1)..( 3000): cDNA_ID_3095177_gDNA_ID_2926080_Annot_ID_196346 3000 nt of promoter + ATG
aattctcaataaatggacaaaagatgcgtactgattgtagtatagatggatcagaagcaggatccgtagaatcccgcgcgctgttgcttaggattctgaggtaaaaatcccagtctccttcttgatcactcatgttctcaatcaaaaagaagatcactagaaaaaattcatatgatatgatgatggatgaagaagtttcagcttcggcgactccagagtcccggagaaagaggattggaaagaagacgacgtcgtttattcaaagatctatatccttaaactacatgccatctcttcttgtccacatgtcgtttatagtagcataagacggcacacagtttatcaagcaaaccccctagacgggctatggattggctgcggcctttttatagcttgttgcagcgatacgacatcgtttggccagtacgacttcgttcggccggtacgacttgtcttcttcacgttttctaataggattaattaactacgtgtcgcttatagtagcataagacggcacgcattttattcagcaaacctccgtatatcgcaggctctctcactctttccgtcttctgatttctccctccaaaacaaacctcggaagagaaaattggagcgaaggagcgatagatatggcgtcggcgtcctcgtctgacggagttgccggaaggattcagaacgcttctttggttcttgtctccgataacagttccacgcttgctgtgagtattttcgttcaaaccaaattcactcttttttttttttgatgtaaatataggtttctgagaagttcctgaaatctttcctccgagatgttaacagataggagcttcggcttataatgggtttgactagttagaagtgaacaagggatttctaatttgggcaaaatttatagcctagaatctgctttatctcgtatctgtttttacttttatttgcaggatatccgcaaagctgtggcaatgatgaagaacattgcagttcaattggagaaagaaaatcaaacggacaaggttggttattattttgtctgatatgagaggaagcgttttcagggataaacgcacttgtagccgttttacattttttttttttgctacaatgtagagtagtttcattcatctccttgagtttttgtattggctaatcataagtgaccttatcttaaacttgtgggaactgcctagactttcttctaatgtgattgattcttggttaattgcattgctgtaaaacttgttatcacgtatctctttcattctgacattgtattattgtctgctcttgccaacactctttccttgatgtctgtctttgtttttcttaaatgctctttatatatgctcttcatttttatattttgggttccacaggttaaggaccttgaaaattctgtggctgagttattggatttgcatagtgattgtaatcaccgttcgacagcaattcaatccgttgcaaatcggtaccaacccgtggaacaagtactcactttccctctttcatgtgttatctaatttcttattcggttgcatacttttagatgtagcaaattgatttttactctaatgactgcagttaacggactttaaaaagttgcttgatgatgaattcacaaagctcaaggctacaccttcctcagtgccacaaaatgatcatttgatgcgccagttcagggaagcagtttgggtatgtttttaacttaaagttcttggcttgtatctaataggtctatagtccgatttcctttttaagttattgtcaatgttttgctgcagaatgttcatcatgcaggtgaaccaatgcctggtgacgatgatgaggacattgttatgaccagtactcagtgccctcttctaaacatgacatgtcccttgagcgggaagcctgtcactgaattagcagatccagttcgcaggtacaatggatgtttcttgtcttttttcccttaacttggatgtcttgttttgttcggacgatttgcttgtcctctcccatgcctgatgtctatgtaggatgatcctcaaaagccatattcagtcgatactgacttctttctatacatgaccataaagcttgaatatgatttcatctttcgtgtagcagtagaactaatcaaataataatatacaattgtgcggtgaactgataccatgtctctctgatcctttttatggttgcagtatggattgcaggcacgtctatgaaaaatctgtaatcctgcattacatagtcaacaatccaaatgcgaattgtcctgtagcaggtaaaatagttcttgctcaaaaacatctttagacaccattactttgttctttcatgctgatttgtcatttgtatgacctcttgaaatcctcagggtgccgaggtaaactgcagaatagcaaagtgatttgtgatgcaatgttgaagtttgaaatagaggagatgcgctcgttgaacaaacaatctaatagggctgaagtgattgaagacttcacagaagatgtggatgaagattagagatcagacatttcttggaccgggttttaagcgctgcaatgaaacaagttgaagccatatgtttcacaactttttgctattcttagtccgttcggtatattttatcaaacgtgaaatttgataccaattgtttccactttatggaggatgtaaatagtcgatctcttccgattctgaattcaactgctgttttttttgccaagtttacgttcatttcctgaggctagtcaaagcttaatttcatttcttgtagtcagaattttcgatttagtaccattattaggtctactcggtttattagtttttcatggtatggtttggcattggttaagagtttgtgtggatataaatccagtttggttttcaaattcaatttttggttcgatttgaattggttactaaaacaaactaaaggcttttagcttcccagttcccagtccctgtactcgaaaggaagatcttcatcttcaatcttcatgctaatcgacgaaaatg

SEQ ID NO: 15192 - DNA, 3000 bp, Unknown
  misc_feature (1)..( 3000): cDNA_ID_3095277_gDNA_ID_2926081_Annot_ID_196364 3000 nt of promoter + ATG
agcaaagtctaacccaaaaaatacattaagggaaatttttcagcttaatatcaaccaatttagagatttctaaaaaagaaaattaaaactttttttagagatttatatttttaaaagagatataaaattgcctacagaaaatcttcaaataagccaaaccagctcagtttatgaatcattaaaatgaaacttccttaccaatataatttcaaacgaaaaaaaaattccgtatcgaatttttttgtaaagaaactcattttagtgggtttttataagctagactgatgaatttggtcgaagtacagcttattggcatctaactcattaaatgcaaatatcatacaaaattcgtaattacatgtaaatttcttccaaaattcgtaattacatgtatgtaataatctaattttgtgtgtgttagtgatattagaaatattattgaaaaaataatataggcatcgtgtgcaattttcaattaccttcacaaatgaagaaacattccgagcatatctccttggcataatgagtgggattttagagttaagccaacgaaatttgggcctaatttttcatcaaatacttgggcctagtcatcggttatgtcattgctacttatataagacccataggtataccgataaagtcttcatattgagatccaaaggccgggatcgaacaagttttgttcttattgaatcagcgttagacgcagccttgtctttattatgttcttcttcatccgttagaaaaagtatccgtatgatgtccattcgtttcatttgtaataatttgatgaagtcttcttaaagacatttggattggagttagaatgttccttcttttatttttcttcaggacacttggagtctcggattagtcaagagacttcgatcatattttctttatcacctcttcttcaatttatatggatcatctttaggaaaactataacgtgttaattgtgaaattatgatacaaactttataattcataaataaatatgtctgtgcatagtttttttttttaaattatccggataatgattatgagagaaaagcaggtaggtcgatcatgaatgtttaattttggcacatgttgaatgtgaggtcccagccaccaataaactgatcaagtcctacattatccaattcctttaattaccttaaagtatttacaaaatttgaattagtcaaatctttgagttaagacaccaaatgattttacaaaactcgaataatataagaagagtatacttgttgtaaccttggagtactacgaattcaacaatttgatgaagtgaaaacatagttaagaaatgattgggagattattcatctaaagctaccagtctaccaactttccagttttgacaatatttaccacgtggccctgaggaacatcattgtcagtttatcaaacactccatatttcgtggcagcttcgggtcaagaatccaaattggtattgtcacttggtcaggtcaaagttgaggagcttttatatatagtataatcaatgagtcggctaaaatgtaaaatacatgttctaaattaaacgtaataaattactataatcgtatcaaatttatccctcttatcaaattagtactttcgagtttcgatattgtttttctttctctgggaaactatatatatttacatttctagaaagaaagaaaaaaactatatattacattttatacgtgctaagcctagaaaagattaattacaaagaaattatacattttattgatcaagtggtgcttaaagcagtaaaaacaatttgaactcataaatcgtaaatacgtcgacatatttcgtgatctccattaatttttctttttttaaagattgacgcaaaataatattctgaaaatgaaaaagtaaaataagaggggacaaatattcgagatgtgacgtggcagatcgagtggtttaaatattctattagcaagtggtttgtgtaataagcaaatgggtggtcgaacctgaccgtattcttggatctattcaactgtagcatcagtccaccttccttacctcatctttcctaactttttaatacctttttaatttgctaaaaacatcactactatttatatttgatctctaattactgtttcaactctgaatattccgtaatccttatattaatatgtccaaaaatatataatttctggactttcccttgagatgggaatatgaaagaattgcatcatttacctaatcatatgaacacaaatagatattggaaaaaatgtggttttatttttcatgttttgttcgattatctttatctttatcccaaaaaaaaaaaaatcattcgattatatctaaaattcaaaatagattacagaaatataatttattagcaaaacggcatgtttaaagcgtttgaagttattaaatcattagtaagaatatataagaatgtaattagtggaaatacatagtaagtatcattggtttttgccacatatggtgagcaattttttattttaagaagggaaaatcaatttgtacatagatttatgtcacttattcaattgaataatacagaaggatttaaagtctaaagtaaaaacaggcaaaataataatatgtttttttctttgatcgctcagattatcgtattaaaatttggattatgacataacaacgataataatacaaactagttggttatgaactctgaataaattattttaaagaaagaatactactatttaattataaaatgactctgcatcatatcaataaggtaacctcgttattataaacgtcacactacacactattagtattttaattacacagtgaaaaaatttaattaattactaatctctgtccaggtacataatattattccaagatacggtccttcgttactataaactctataaaaaccaattttcacttccaattgaattgggaacaaaccaaatctctatctctctccattagagcttgaagcagccatagcctaacaaaaccttcaaca

SEQ ID NO: 15193 - DNA, 3000 bp, Unknown
  misc_feature (1)..( 3000): cDNA_ID_3095271_gDNA_ID_2926081_Annot_ID_196366 3000 nt of promoter + ATG
aacataagtaatgttgccaacaccataatcatcatactttgatgtttcgatcatcaaaatctggcattgactaatgttgaccaaacaacatattcattttttttttaataaattgtgttctcaactttgttcggagttagttttctaagaaaatggaattagatttgattcagtttcttctacttttggtaggctaggataggaggctccttcgttagcatatatatgggtattattccgttatcgtttcggatcaatcttttgttcttttttatgactgaatagtataaatctgagcggaatatttgagaattgaagagctgttaaggggaatgatttgatttagggttatattaattgtttgttgtggattaatggagttgataaataaaatagctttggttagtttgatttttttagcagttggtgttcctttagttagtagtgttttcaattttgatgtagttccttttttataagcttaacaaaattttgatcgcagatcatacaaattacaaaggattgatttacatctaaggatacttacgcaaacctgtgtacgctaatgagctgggaagaaggacctttgaaatgatcaaattagctttgctaatgtaatgtagagaacactattcttgttgacagtttttactttctatgatgctaaattttatccgtgtgaatggaaaagcatgcttctattgcaagaacaaaacatcagcgtcagagactcagagaacaaaagtggaccgactatacataagcccaatacaaataaaatgactttggtcaacggacgttaagaattaagaattgacttatatataatttgtagtcaataacaaatgaccacagattcttccacattggataagttatagtaatatgcttcttcttttttataattgttattgcagtagcgtactatcgaagaaaagttatatgaacgacggaagtctcaattataaacaaaaaaaaagaacagaattttttgggccccataaaatgtttatgatatgtatttttagggacttcttttttatcaagaagttttcgatttcgatttcacaaatgtccaagacaagttttcgatttcacaaatgtccaacagcctaaaactaaacctgaatggtagattttacatgttaaatttcactatccatcattcttgaatcttcataatatgtttatttgtattgggcttatggcctataggttttaaagtgcagcaaatatagtttgataaaaaaaagttaagcgaaaaccagatgattaaaaaacaaaacaaaaaatatcatctacaaagtgcaaaagcaaaatacatgtgttcagctataagtaatccacaaattagttaaaaaattgggtcaattctcaattgtaaactaaccataaccctatttcgccataatataccaatttattcccaaatctttccactttcttatgactctttgttgcttacgtcttcttccttatgtcatatctagccattttttttgtttctcttgacgggaaatatataacgtagacgaaaatgtgatgagtggttccaacgaggaatccattaatagtggttgagacttgctacattaagtccccatagaaattttggttctcattttcctaagttattattgcttattaactaaaataagcaatacctttaaattctttccacaacatatgaaatttctctacgcctgacgatcagattcggataattcgaggtggaaagccctgacttcgtcaaaaagttactgtccacttttacaacttttttttttttttggtaacaactttacaacaattccaagtaatttgttagtaggtaataatatatagccaaaaagtaacgtttggataaacaagattgataacgtagggtctaggtaatatgattgatatctagtattacgaggacaagttttatagatttttcaaataacttgtgtattcgaaaccacaaactagaacacatgaacaagccacaatatttccacttgatgtaggagttaattaggtttttaatagtaaacgtgtcaccttattattaaatagatttcatgttaggatcagccattactacagtctgagattaattcgaatttcacacgtatcaaactctttaaatgtttaataaagtattttgaagaagttaatagaaataaattaaaattatcaaattcaataacttaatcgttaatcaaagaatatactatacttacatgtataaaagtaggcatgtcgatcgatataccactacttggccaactttctcttatttccttcatattgataataacgaatgttagatattacacctaataaaaacacggtctatacacacttcatacatatcctatatactatagtaaaaaaatacaggtcatctctgtttaaaaaaaaaaaaaaatttatccaggtcaaaagacttttgagttttgagtttatcttataaagctcaagctgacacgtgtttccctgaaaaaactcgaaactgtttcgaactgttgcttctcagaaatttcactgttcaattgggatttggatcattgagaaaatcaagcaaatatctacttaatttatttttggttgacttattctttcgtggattaatatttgatactcattcatttattcattcatttggattatttttgcttaattgaataatatttttaatactcctcgatttataatgttaaatttatttgttgattcattcattttgtaatattaattgagctttaaaagcgttagatttttttggtgaatgtggctttcgttgtgattgctaggaaacttcgtggatgctacaaaaatgaccgactaatgaactaactataaaaaaccaacgcagattgtattgacatcacaacatcaactcttgttttgcattcttacccatcgctttcacaaaacaacaaatttacaacttttggttttcgttctattttcggtttatcaattccggttcagcaaataccagaaacaatg

SEQ ID NO: 15194 - DNA, 3000 bp, Unknown
  misc_feature (1)..( 3000): cDNA_ID_3095251_gDNA_ID_2926081_Annot_ID_196371 3000 nt of promoter + ATG
tagaagagatactctcaagacttccattgaagtctacgagagcagtgagatcgacttgcaaaaagtgggactctttattcaaaaatcggagctttattagtaaagcagcagcagcaagagaaggagagtctcagatggtcgtgttgatggatcacaatcttcatttagtgagcttcttcttcggcagtgatacttctgtagagattaaaggtaaacgtatttgtctaaacgacgattcagattcagaacaagtcaagatatctcaagtttttcactgtgagggtttgttgttatgtatcttgaaagatgataactttagtcttgttgtttggaacccgtattggggacaaacaaggtggatcaaacccagatgttctttcgaaataccccagggatgtgacatgtacaggtacgctattggatacgacaacaagagacgcaaccacaagatcttgaggtttatagattatgaattccattaccctcgagacaacgttgttttgtggtatgaaatctatgattttgagtctgatttatggacgactcttgatgttactactccacattggttgataaattgtggtaaccgtggtgttactctcaagggaaacacttactggtgtgctaaaaaaaggaactctgacctttttctcaatgctgatcatataatctgttttgatttcacaagtgagaggtttggtccgcttctgcttttgccgtttagtgatttggatggtgttgttactctagcttgtgttagagaggagaagcttgcggctttagtttgtcacgaggatgttgttgaggtttggattacgattaagattgaggccaatgaggtattgtggagcaagttcttgacagtgaatgttgatttgggtgatgagattccgagttcactgacatatggtagttttttcatcgacgaggagaagaaagttgctatgatttttgataaaactttggatcgcggcgacacagttcacatcatgggagaggctggatatggtggacaagttgatctcggagaaccggttaataaaagacgttgcccacttgtgtgctcttatgttccgagtttagtgcaaatcaagaaacctgcaggattccaaaggaaacagcaaagcaagttagaaaagcgtcaatatgttcgaaacatatcgaaacttcgcgcacttaaaacccaaagttcttggacattaagtatgtcacttgaatgtcatcaacagtaagatttatgtttcttggctcgtacttcgatttattactgctatgttttagactgatactttactaaatattacatggcttcatcaggagcttggtagagtgagaaagcattgccagccgatttttgcccgtatagctccgtctcagtttgtttcgggccattgttgaaaggacttcctgtgcgcttttttgtcgatcaatagtttagaccgctcttttttgttgccactttcttgcttaggggagtctttagatcgagttttcttcatcttcttactaagagcctcatcgcttaaggtttagttgatgcgatgaatctcgaaaggattatgcttccatgtttttttcctttttttggcatgggaccatgtttgtaggttttgcttcttgtaactcctaaactttcattttatatgatatttacattcttatcaaaaaaaaaaatatatatattacatggcttcatgctaaaggacatgatattaatcagatttttaaaatttaaagatggtggaacctcaggttttcgataatataatttagagatagcttctgttatctggcctagtctctacaaagtttttaaaaccgaaccagcgactcgactagatggcattgtcgatatatctatctagcagaatttcagtagcagagtctttttagtgagagggtcaggtgcattatcagtccttggaaacatcaaagacaagagcaagttgttcatgctcaaactaaaagattaccatccaccattttgggatatatattcaacttcttactctttgacatcttggaagtcttccacatcctcttcttcttaggtcgttatcttcataaacatcttcttcagtcaaatctgcctcaccttctgagtagcaaatattttaaaccagaccatttgtacttctgactattcttctgtccgatatgtatctctttagaagatcttggtgcataatggcctaatggggatcatcattaattaggaaataaaaatcaattcttatatgtgctgagaaaaaaaaaaaaaagctttgaagttaaaactagaaataataaaacatattggattaaagataattaatgtggatccatggaatgatcgatcatgacgagaaataaaatattatggggaatatataaagaaagaaaaatgtgcaagatgattagtatgaaaataacattcccttagtttcacaatataagtgttttggagaaatttttgtttcgaatgttttcaaaattttatgcaaattatagatttttttatttttataattatatatatatattatatggtctattttatgattggttaactttttaaaaaaataaacatgagttattgaggtttcaagaagaaagttttatgtttatggccatcaagactgaaataatgttttgtttttcttatttccgtcgactttcgtctttttcaaaatcgcaacttttatatatatttttttctctcgcctttcgatcatcggaaaagctctttttcaagtctccccaactcataactttgaattttctatttgccccctcataaaatttgcttctattctctttgtttgttggagttctcaagatctgtttgattctgaatccttgtaatttttgtatccaaccagtaacaaatggggttttgtgaaggtttatgagtttcccatattcaaatggcgatcttttagtctgagtaaaattgtggttcttatctgtttttgttaaagtttcgatttttattttgagggttgaattcgagaaattttg

SEQ ID NO: 15195 - DNA, 3000 bp, Unknown
  misc_feature (1)..( 3000): cDNA_ID_3095242_gDNA_ID_2926081_Annot_ID_196373 3000 nt of promoter + ATG
tcgtggctttaccggtaactttttgggcaatccaaccgagcccatcatacaatccttctccagtaaccgcacaacttgcttgaatatgccaatcatggttcttgatactgtgaaggttaagtgcatccgtgatctcagcaggagtcattgcgtctttcagatcctgtttgtttgcaaaaactagtatgaccgagttttgaagatcctcatgaccaagtaacctggctagctcatctttcatgaaagagattctggctctgtctgtgctatctataaccacaatcacagcatgtgttccacgatagtatgttgcccatgaagttcttagcctatcttgcccaccaagatcccatacctaaagacaacatatcataaaagtaaacatcgcctcaaatattcgattgccagtgtccaacagttagtttttgacaggaaacaattcaaactttagtaagtttagttacgtttatattcatcattgagttttgacatataagaacacatgcagattgtcataaaacagagatgaattcatctcaggccatgactttgaccactgtataaagatgttccaaacagtcctctggcaaaaaaactaagctaatgggaaatagcaaacagttcctccggtataacaaacaagctagataaacaacatctacaaaaatttactatacaaaaccataaatcgcacatacgaaaacgttcattatgagtttctgacaccttctcaaccaatcatgacaagaacttagacaaaaacatcatccatttttcaacgagaaaaatgcacacacccaagcaagaaacatagctagggacaataacacaatcaaaagatggcaatggcaaatttaagaaacatccataaagtttcaaacttctaaaacacgtccctagataagaagctaagaaacaacttcacccaaatgaataaagaaagagtccagtacctcaaagcgaatattcttgtagacaagctcttcaacattgctaccaacagtaggatgagtagtaacaacttcacccaaatgaagtttataaagcgtcgtcgttttaccagcattatccaaaccaacaacaacaatcttatactcttttgcaggaaacatcatgaaccaaaacctcgacatgaatgctcccatctcctccaatttctatcacaaacaagatcctaatcaaataaaacacatcattacttttacgatcaaattgttctacaaacagagtgaaatcgagaaaccctaaagatacatcctttaaattgacccatcaattttacaaacccaagtaattgaatcagagaagcccagatcagatttggatacaacgatcccagattcgataaagttaaccaaatctaaattatatatatacaaatcgggaaatttgtgatcaaaccttgaatcagctagaatctgaagattgcagaggtaagaatcggagatcaaaaaaagttcttcttctactattttgtaagcttttgaggttccttccttaaagcagatgggtggagagaagaagaagaagaaaagtatgcgggaaacaatgtcaaaactgtaaatatgatgatctaaattattaataacttttaatataacaaatattaaaatgaaaactatatagtaatgttttcttttacttacccaaacggctgcagcctctaccgtaatggcaccgaacacgtcaccgccattagccacgacgccaaagacgaacattgttgaagacttgaaatccacaaagatgtttttaaacgagaaaaaaaaaaactcaaacgggcttagggcctttccatatattttagattataacaattacattttctcggcccacagaagtatataaaattaaatagaagtaaattatattgaggatttaaaataacaaatttaattataatttgaaatcatggttataatacgatcgtgtgaaatgttaattaaatgcttatattgattattttattattaaatttgtgctaattttggtaacgaatcttatttttgttattgtatacgatgatttaaaatatatatatatatatatatatatatatatatatatatatatatataatagttctagaaaagtctaattggattttttagatcctatcatagttgatagttctctttttgtatatggctagcaatgcggaatcgactctctacattagattcaatgaaggcttggaatgtgaacttgaatcgaacatgtgtgttatgtaacactcttatcgagacacgagagcacttgtttttcagctgtaagtactcgtcggcagtctggtcctccctagcgaaaccactactctagtgacgattctctacaatatggcaagctctagtcattattattacttctgatcactgtaacagaatccatatattcttcctctaatacagttttcaaataatggttcattcgatttggcgagaacgcaataaaaaaaacacacaataaaactctgattcttatcacacatcttcctaagtgaatagataagctggaaaaaaaaaaaactctcaatcatttgaaaggagaaatatagtagatacgaaccaaatctccaaacatggtttgcatctaaaagtccttaaaacctctcttgtataatctaatttcaaaacaattttggaaaagttacatttgatgtatcctaactttattttttcttggtcgaatttaatattttattaaaaataataatagtaataatcacaaaatctaatttgatcattcttaggtgggtaggtacacttattttacatacagcctcgacggcaccaaaacatagaatatatatataaatacaaatacaaatattccaaatataacctctctcccaaagtcctatcatatcagaaaaaaaaaaaaaaatccaaattcaacactctcacacttcgatatctccgccttcattctcctcagagccaactgtcctgagatttcgatttcgatttctccgatctctcttcctccgtcgccggcgaaacc

SEQ ID NO: 15196 - DNA, 3000 bp, Unknown
  misc_feature (1)..( 3000): cDNA_ID_3095235_gDNA_ID_2926081_Annot_ID_196375 3000 nt of promoter + ATG
gaaaacgttaatgcatataatgacttgcaacaagccaacaatgcgtaagagcttcttaagatttgaacataataatttgcaacactgtcaataacccgtacttcaaaatcaaactttattagaatatatagcgaatgaagtaatgaaccatggtacttcaaatgtactactatcttttagagttagggttgaattgtataaaggatattcttaagcaatgtttggttagtttagtgtttgctttagctaggttagtttagtgtttgctttagctaagtaagacttaggcgtgggcattcgggttcagttcttttttttcgggtatcgagtctattcgggtaagaggttgagaaccattcggatattctaaaaatttggtttggatcaggttcgggtcgattcggttattttagtaaaaatttaaaaataaccaaaaatacccaaaatattttcgggttcagatcggattcggtttttttactcatatatacctaaatctacccgaaataccagattaccgataaatatattggttactttttatccaaatataaccaaatgtaagcaaaatacttaagttacctaaaaaaaatctataacattggttacttttatcccaaatatatccaaatgtatatgaattactaaaaaaatctagtatatttggatttataattttaattttgggtgtttgagatattacaaatataaatataactaatattttaaggtttacatttgtattcgggtacccacaagtattagattcggttcgagtttggttcgggtttttttgggtagtgagttctaggactcattcgggtaattttaaaaatcgggttcggtttggttcggttatttttcggattttcggttcggatattcggttctggatattataaaactaatacttaataaaattagatttattttgttacatgtatatacatggttatatatatgcacacagggggaaaaagtcgaaataaagtgataagaaaaagggttttgataacttgattgctgtagagggaaagtatcatcagcttttcgttttggggagacgaatctttgtttcttttttcgtgtttttcaatgttacttataactccattttctatattgctataacaatctagcattactcttttataacacacacacacacacacgaataatcgagtatctaatttgttttatacaacagaacaattactgtattaaacagagttccacaacacttaactatggtcaaataaagtttatgtacttgttttcttttaacttttgtagttgaatgttcaaatgactaaatgagtaaaacatgtacactatcaataactttaatacgttgacaaaaaacaatggtctagtacaaacaatataagatattgatttagatgcatggcacaattttggacatgaaaatcgaggcaagtattagaatacaatagtacatgattgataggtataaaaatacgtacgagtagtcactattgaaactcataatgtatttgtatcattgtcctctaatttaccagcagctaggataattgcatacatgcgtacaaaggaagagtcatcttcttttttattcgttttttaaaaccgtacatttctttaaattctcgattccacctttttctttttttactctatttaaacttttatttttgttgtttacttttacttttctttatatgaatagaccaaacggtcaaatatttggggccccttcttttgcatgatttttagtaaatttctttttgattaatggttgtgattttaatgtgggttaataaagtaaagcttaaagtctcataattacagcatgggtttaaagttataaaaattgtttaaatagcttattattctatattgttctcatttcaacattcagattattactgccataacttttactttttcttttacaactatttaaaaaaaaaatctcagcctttttcttcttttgtcctttagtggtcagtctaatattgttttccccaatttttactgacattatattattattactcaaaataacccgatcatacaattaaatcaaaatttaccaggacgagtagtgttaatagatttacttaagacacgtgttacataattattggattaaaatcagtttccaaaaaacgaataatccattttcggatatgcccgatattccacggtagtggaggacaaaaacgtaatttcggtattaccacaattactgacacgtctccagtaaaaaggattcaccaccacgctaagatgaaaacgacaaaaaaataaaaaaaccatctcctcccattaaaacggtaaaacaattaatatccgacgtggcatttacagtgcctagtcagcttttttacctttgaagtctcttcagcttcggacctctctctcttactcctttataagattaagccaacctctctttacccacacaatccacacacacacacataagaaaagaaattaacaaattatcacaaaaatacgttttcttgtataataatttttctctagatttgtcgcttaccttttgaaattctccggcgatgaatctcgccgggaaaaggaatattccggttattatttctgtttccgttactagtgactcttaccatcgccgtcatgtcttccgtgaacatcgtcggacctgaaaaatccttctcctagactttttttttttctttcttctctttgtattattattctttgcttcgtttttgtgaagaagatgatccgctgatttcagaagttttcttcttctggattttagctgagaggtttttggtagattctgtttcttcttcttcctctgtggttttcgaatccagttttggaatttttgaagattttgtttagtttctgttgaagagatctgagatatttgaacgaagcagagtgtatatgaaatcaaatctgtgaaaatttctttgaatttgaattgactttggacttgtgagagaagttagatcttcttcttcgtgagct

SEQ ID NO: 15197 - DNA, 3000 bp, Unknown
  misc_feature (1)..( 3000): cDNA_ID_3095263_gDNA_ID_2926081_Annot_ID_196368 3000 nt of promoter + ATG
tatagatgttgctcttttttatagtcttcattgtaaaaaaagaaaagtacatgttttgacttcaaactaatcataaccaaaagttttgacaaaattgattaatgaggaaataatcagtgaataggtccatgagtccatggccattaaaatagagagtaaaccaactatatactgtatgatgaaccggtctaaataatatagatttaaatggcaaaaaaatcccatttttcagtctctttgatcagattgggattaggttagacctcatattttaaccctaattcagatgacaagtactctaactaaatctaactattatttcacatcattatgtaaatgtgtactcaaaaacacactagtacgatttatagtgtaccttcttaatatatacggcattaaattgttttcaaccccttaaaagatgccattcaacatctacaataatctttgcgggacaaaaaaggtcaaatacaaaagacaaaactaaaagcaataacattaattgggtcatatacaactttacatttagcacttttgactttacaaaatcaaaacgcatccaaacactatacgtaagcttgtgtaatagttagtgtaatgataatggtaccataaagctagcattactaaattatatcaagaccatgtaaacaagaatacggttgattatttaaattgttgtgtacaaaagttattaaatcactaagttctatcaagaccatatcaatcaaaaaaagaacttgctcatttaaatgattgtatattcgtatcgttatcgtatgcatcatttcctccctttaatattttcgaatatctacattctagtcaagtcaacatgttgcgatggaggaaaagttcaatagtattgaatttaggtcttgggaatcaccagatccctgtacagttggaattttagtcataaattttgtatagaaataaaaccataatatatgaggttcaaattctaatagtttaggattcaatgcgatcatttaacacttcgaaatcctatccgagttgaagttaacttcttctttttttggacaaatttaaagataaacttaatttcctcttttgtataggtaataggttaaaggggttaagaaattgtttcaggtttacgtatttcatatgtagaaatattactgaatcatatcaaaatgtctttttttttttgtgtgtctgattttggtccagatagattctgaattgttttaatcactcttacgcattagattctgtcttttttccacaatggctaatttgattaagaacctaaatgattgtttgcgacacggccaattcagcttagtcaacaagtttaagcatgcatttagatgtcggtatcattatgcaaagtctacacaaaatggtgtgtgattcgttgaagctgagtcagcttttaatttaattagaaaagtctttatctacacaaagtcgcaaactattaatagtaatatgaaaatattcttagatgaactttgcaaattgcaacaccttcatacaatttcaaatgtaacttacataatcaattaatcaagtacattttaaaaaaaaatattttgtaaaaattataattgtgaaacttaggattttttttctttctgtcgaactatatttatagattataatgcaataactgaaaataagattacaagaaacagattaaccacaagatgtacatttttcttggcaacatatatatatatgtgtagaagattcaaaaagtacgatttgcttctaaataaatgatggttgttttatcaaattacacatttattcaaaataaatcaagaaaatgactaaattgaggaataaaagagatcgacacgttttcccgtaacgcaagtgctcggtctacctatttcaatgctctttgtctcctcgtcatctatcttacagctgttgaaacccacacccatttattttacatatacacatacttcatgtttttataattttttttttttttttttactataacaaattactacatactcttcgtctattccttgggtttcacaaaacaaatagtatcgtttttgaaactctactttcatttcacaaaaagtaattttgtatttttaaatcaaatttcaaattttttctctatttttaatttatttagagaagaaaaattagtttgaatattgtaacaaagaaaattgtaagtttttttcttattttaaaaatttacgtaaaaatagtaaaataacactatttaaacagagaagacaattcacaacccatctgcataatgtctttgcttggtattatatgtattttgtgcgacaaaaattgttttttttttttttttaccacactatagtaactttcaagaatattgacgtgattctgatcttcaaggctttcaagttagccgtgtataataagaaaacaaatatataatattacgagtacaaaaagaatttttaaagagtttcaatcaaattactagttagcctaaaaatatccctttcaaaaaaaaaaaaagctctaagttcgtataaaactttgttaaaggaaataatattttgaatcatgtgactggaattaaaattccaaataaataattgggaaatttactagggagacccatattttaggtttaattactagaatgatatatcaaaaatgtgagttatatgagtaatattttggtctaaaatatcctttatttgctttgttaggaaaaataatattacaggaatgccattattatttaatttcagcatggcaaaaagaataattttatttacgaaaatgccactccagtattttatttccaataatttgtgcaatataacttttaatgaaaagaagtggaaaaaggtgaatgagtccaaagcaagaaagtcgcaaagacttctacaaataagaaaacagaatgagagttgaagcacttcaaagcttttcagctctctctcttctcttctcttctcttctcttctcttctcttttctctctgaagaagactactaagcaagttttaattggatg

SEQ ID NO: 15198 - DNA, 3000 bp, Unknown
  misc_feature (1)..( 3000): cDNA_ID_3095325_gDNA_ID_2926082_Annot_ID_196394 3000 nt of promoter + ATG
agggagtacgcagatgaagttaatggagttatgtgaagccgacggagtaaacataagattagtttgatatgttgcatttgtttctgcttagtttttttagttttaatcagtggttttctttgttgtttccacatttgtttcagttccttaaatgataattggtttcccttttgagttttaatattcttagtttctcaaaatcatataatactaaactcctatcagctttcattatctaaacaaataaagattccaaattcttttcgtaattgatgaatctctctcagataaggaatcagttgtctctgttggtttattgtggagaacagcatgaccctagcatttgtgacgttattttctataatttaattgtcaaagtttatataaaatgcgaaatgaatctaaatttgcctaagttatatagttgttcttaatacctctagattctctacagcatcaaatcaagattttatgaagatgaagaactaacctttaaaatcgttccacattcgtcagattgacatcttgattatatgatagcctacaaattaacctgaaattaaaaaaaaaaaaaaaattattagatgcagagaatataatagatacttaacaatgatattctgatttagcaatctatataacaataatatatgattgcaatcatatcaattcgatatcttaacaaaagattatatagttactactcatccttaactcttaatttagactccattatttagaaaaattacagttctatcgtctaacaaacaatagcttgatgaagaaaagaagtgcattggttgataaaggtgaaaaccacatcactccatctgctaagaggaagtgttcatcgagcaaaaacagttaccatagtcaacacaaagctaaatcatctagaaatgggtttgtcgttccactgaaatctatatttgctcggttaattacagacataactaaatccaagcacgtggttttagaagagtctctttgtcctacagggaaaattgtagcacaatcttatacaggtatatcattatattctacaatatgctaattgatatgaacctgtagttaagacttcactactttgttatgtgtacaaaatggcttatatgttttttccaaattttcagttgatgagaacacctatctaacacctgtttgtcttagacaatcattgtcttcgcaagaacaatactctttatgcccgccgcccacatcaaacctatcaaaaacgacttcagtggttttggaagagtttctttctcctttagttaaaaatctatcagtgactgatacaagtaaatcattctctcgaataagagtataacaaatagttctatacagtattgacttttgatattttcatcaattttgtttgtgtctttttttttttttcaggctcaattgatgagaactcatatctaacacttgtttctgttagacaatcattgtcttatcaagaaccatattctttatgctctgtgcctgtgactccatctaatgtctctcaatggagtcaatatataaattcttctggtatgtttatctcatttatattttttgtttttattggttaacccatgaattatgttcaaacgatccttatcaatgtatgcagagcctcttgaatgtttaaccactgatggatcaatattatctgatataccaattaaacagtcaacttcagaacttggcagcaacgactttctaacttcaatcagatcagaaacaatcaaatgtgagcataatttgtctacactagcatttatgaagtcaattcaaagcaactgaaatatatgagtttttgtatatgagttttgtgtagatactattgtttttcattctaacataaataattcaatcatgttttcagcatacattgcaacagaaaatcatccaaatataaagactatcagaataagccaatcttattctcaacttgagtcagacaccttcttatccgacataagaagagacgctactaaacgtgagtttctgttttatatagtttctgactttaagcttttattcatcttaattctaatatgaaattacactttaaaactttgttctttttttttgttagattcgattaaccaggtttctaaacttgatacactgaaagtgaattcaaatacgaatagaactaagaaagggttttaggggacatatcaaaccaactcgatagaagaggacgagttgagccacttagagcatacaacatgctattcagcatgacttcccttggtggtaaagtttatattttattttcttacatattattcttccttgtgtattgaagtttattgtattttcactaatatgatttgttaacaattctgtgtttagcaagggaaagaatccgaagaaagcaacagccaaaaatcaagtgagaaaggatcttattgaaaagctcatcagaatgttggatgcttccaatccatacgttgaaaaattcaggctagcaaaagataagttggatagtaataatggggaaccattctatatgcagattgttagtgatagggtaggaaaggatggcaaaacctattgtaaccctacaacgtctgaagttacagctttgattcctggagactttcgtcctgaaatgcctacacgtgatattatcgttcaagataagaaaacaggacatctatcaagaataagcgaagttcatccttcttatgtcccaatgcaatatcctctcatatttaattatggtgaagatggttttagaccaggaatacagaagggatatacaggcagaacaggaaaacaagcaaacaagtgtataagtatgaggcaatggtatgcttttagaatacaagagagatcagatgaagctcagaccctactgcgttcgaagcgtttgttccaacaattcttggtagatggatacacaacaggttggcctatattaagtttaaccaatctaatctcagatgtgagaattatgatactgttaaggctgcgagagaaggtggaaacacaaacatg

SEQ ID NO: 15199 - DNA, 3000 bp, Unknown
  misc_feature (1)..( 3000): cDNA_ID_3095319_gDNA_ID_2926082_Annot_ID_196396 3000 nt of promoter + ATG
tgtgatgctaacaatcaagatgtgatcagaagtcactaagtcaagccaagcaataacaggttttggtgcgttctagcagtcctaagtgaacatgcagaaaacagaacatcaagcagaaacaaagaaacactcgactaacacagctcgttgcagagcactgggtgggtcgagtgacaggttgagtaacagacagataatgtaacaggtatactcgactgcacagtctgtcgccagacaactgggtggtcgagtatcaggtcgagtaacagtaaagaattgcagaaactaagcaacaaatgacaggatgcagtaaacagcaatagagtaaacaataaaatcaatcagataaagaattcccgaggatggggtaattgagtagtttcgtttcctcagtttacaggtgattaacatgctcaataaattaaccctagacaacaagttcattaaccaaatctaagtgccaccgcaatagagactctcaagttaacctagtcccagactcaatcaccattgacgagagctaacctaacaggcattacgaatcaacaagttaaagccaaaacgctccttgcaaccaataccttggtacagggtcacgaatctctggaattagtggttcagacatttcatcgaacaccttttgggcgcggaaatgtctgggctcaaattccagttgatcagaaagcaataggcatttagaacaactaatccataagggatttatcaatcaatactcaatcacctagcatactgagaattctacactactctaacccatcctcagaaacctattcactacttagacatcataacagaaagcataaacgttgaacaagttgaaaacatgataacaacagtgtaacagcaggatgatgacagaatgaacaacagtaaacgaaatcaagaacaaaagctgaatactgaatactgaatagataaagagaaatccagattacaaaaggtctagaacacaaggtctgcggaaataaaactagataaaaacttgtctgcgaaaatgtgaagtacatactacttatagccaaatatcccgaaaccctaatactcaaaacgacgcagtattgggacggattaagaactgtactcgacccatgtggtggagtgggaggtcgagtgaatagctggagtcttcttttcttccttgtgctcgagtgtctggttcagtgcggaatgaagaaggctctgaagcttgtcatcgagtatgcattcgagtggtggcgatggtgatactcgacttccaggtagaatgatgaggtcgagtactggtctggcaataggatgaagacactcgacctctgggtcgagtgatgtgatcgagtggtggtcaagagatggagatgaaaagtgatgatatgatgctaaagtgatgacaaatggatgctcaaaacatgcaaaatacacacttatcaatcaggttcacgttcttttgctaaagtgcaagatgccttggtaatgtttctatattttctttaaaattattgataacaattttttgttttttaaagattaacactatttcttacattgtctaatgttttccttataggtggcaaacaatgaagactcttccttcattgttgtgatgaaaaaaaaaacaccaaaaatctgatggtacgtatgttgatgaaagagcccggctagttgcggaaaaaattgatgaacttgtgcaagagcgattgtctgaaatggagtctcccaatggagaagttttgacagtagataatctcagccaagaggagaaaaacgaaatctatcttaaggcaaatttatagattatattttatgaggagttaaaatacatctcattatatatgtacttgtgtttttttttatagattgttggaatatcaaaacaaggtcgtgtatttgaatggttcatcggtttccccacaacctactgaagaagaagtaggaacgttagcccaccgagttgatgaacttgaaaatgaattgaagaagagtcgtgatgagaatttactcctcgatcgagaaacgtcttcaagcaattgaaattgctatgctttagactatggttttattttgtttcttcgtaacactttggctttggcttttatttctatttcacaacattctatttgatttggattttacttctttttctatttgtttactttaattatttattaataaaatatattttatatattttcctcattaaataaagtatcattgtaacaataacttaataaaacaataatatcaaatcctcttattattaaaagagaagtacaaattgaatttttgtctaatttgtccccaattttgatttcaattttggattttgttcttcatgctaaagggtaaaatcgtccaagacaaaaacttaagtaaacaggatccgcgttttattcagatgggtgggttacgtttaatgggctttcgatcacagcaaaatctacattttcggtggaccatgaagattgcaatcttaccaaaatcttaggcagaacacgtttagttctatatctcaacgaaatctacattgttacacgcatattcctttataatcttctgtatattcgattacgattgttagaatctttaatcatataatcattctcctcaataatcagtataaaatccacataaacggcatattcgtttcttctacctacacattgacgataatacattccatcaattacaaaaatcatgtaaacttatatgattaaatctagaaataaccataatcaactaaacaatattaaccacttatctatatatggccaatcattatgaactaaacaattttcgaatcattagtcattatcccatattttcgaatcattagtcattatcccatctttgatttgcaacttatactccaagatactgacgaatatctttgaaatattagatccagcaaccctagcatcctttctcactataaatatcaaagccattctcatcacaatccatcactcaaataccgcatttactagcaactaaataaaaacaatg

SEQ ID NO: 15200 - DNA, 3000 bp, Unknown
  misc_feature (1)..( 3000): cDNA_ID_3095394_gDNA_ID_2926083_Annot_ID_196404 3000 nt of promoter + ATG
attagaggtggtgttgctctttttttggggaaaaagctccatctttctaatttcaaatgactttttatttgctaattgcttcaatttcaattttaagataatatttaaacaatgagagtaaaatttaaaattcagaaaatcgggatctaattttacaataaaacataatttgtagggaacaaattttgagggccctagtcccaagtttcgatatgctacacatcgcgccggctttagggtattgtaataaaatagcgagttaatcattttccgattatttttatgtttttattagacttgcttattgaataattcctcttatgtagttgttttctttcaaaatattaaaacaaaaacgaagtcgtttttcaatatacaaatataatcaaagtcgttttgatttaatgaaaagaaaaaccctagttttctctctatatatatcaatgcatccgcctcatctttcttccactatattccaagttctgaaaaagtctccacataatctccttcgttggtaagtgtgattaatcatatatttttgtttcatatttttgtatagaaaacataaatctaaatatatagtgtttattagataattttaggaggctatatgagttgtgtttatctgaaaggatttctatcaaaatatatgagatatactagatctaaaatatttcgatatacaaagcactaaaattccaaaaaaataatttctacttcttatttgtgtataattatattatttaagaaattaaaattgtattgtaattgcaaactttgatgtcttatgtaatttgtatatcatttttctgttttgcagttatttcgagaaaaaataggcaaaacaaaatgaatgcaaacccatgcgaagtttgcaggttccaaaataaacaatgcgtcaacaactgcatgtttgctctgctatttccttcaagtgatctagagaaatttgatgtcgtcaatcgcatctttggactcgaaactttgacattctacctcaaagacctttcacctatggaacgcatagatactacccgcacactctattacgaggcaaaaccatgctttctgaacccacccaagaacccctcaaaattcctcgaagctcttctaaattatccttaccaaaaagctgaagaggtgtccaaaacaaagaagttgctcgcatcttactcgagaccatgtgtagtattggctcttcctgcaccaaaatatactcagtcgaaatctaaaccatctgttttgcgcaaaagaaaaagaaagactaaatcatcggatgaatcggccattcgtgtggttgaagattcctagatggtcattgttgaagatttttttttctttctaaaagtgaatctttggaaccaaatatgcttttaatttaatttcaaataaaataaaatatgcttttatttctatgtattttgatttctttttcttgatgacttatctttcttttgaattatttatggattttatcaaagtatatattatccattacatatacttaattagcgtaattgtagactttttttttagaaaatatttttaacacatccagatgtttgcacatatcctttcatgtttgattaccaaattttccttttttatggtcaacataagaaaaaaacttactattcatgtgttaaatatacttacattattgtaaatataaataaataaaatgtaaaaattcatgaaattctatcttaaactttattagcattggctagcgtgtcaaagactttttcatattagactaggtatttaattattagatttcataccttttctgtttaattattaattttccccttttaatggtcaacagaaaagaaaagaaaaaaacttactattcgtgtgttaaatctacatacattatggtaattgtaaatcaataaataaaatgtgagaattcatgaaattctatattaaaactttataatattgactcttttaacaaaaaaaactttattacattgaccagagttgttcaggactttgtttttatattaggctaggtatccaattattagattgcatacccttttctgtttaattactatttgttttccttttttatggtcaacagaaaaaaacttactattcatgtgttaaataaacaatacattattgtaattatatataaataaataaaatgtgaaaatatatgaaattctatcttaaaccttattacattgatttttttaagagtttaaatgggtgcttgaacttgctttgagatatagatattgtgttggaaatgaaaaggtacttggaaatgcttagaacatgaacttaagtggagatttggtgattgcctaaaaaaaatatgggagatttggtgatatgagtttagtctagggaagcatttgtcttgagttttttttataaggaaaaatatatagcggagtttatgtaggtttctaatttatgttgttttagtatacatgaatttaaaagaaatctaacttctttcaaatttaactgcttttagttcaattcttttgaatttgtttaacaacggttgcacaaattgtaaaaacattatttttttttccaatttaatttaacattacattattttatatatatatatatatatatatatatatatatatatttagaaacgttgtaagtattttcacgtttggtctcgtacccaatttaacattttaccgtcactttaagcatatgtgtttagcttcgacaaaacgttgacattgagctagttagccatttgatctacaaaatcataaaatttgactgcaaatagtcaagcaaagtgtcccacgtgattacatcaacaacttgctatacaaactttgatagatctatttattttataatctctacttgttgatcatataatttcctataccctcttaccttaatataatccattaggaaagcttaacatgccatatacatcgtgaaccaacgacttcaataaataccagactagtttcttattgtcaagctcatcgcatccacttacttgac

SEQ ID NO: 15201 - DNA, 3000 bp, Unknown
  misc_feature (1)..( 3000): cDNA_ID_3095390_gDNA_ID_2926083_Annot_ID_196405 3000 nt of promoter + ATG
ttgaatcatgagaaccggttcctacaagcaggcaccacgagcttggttcaacaccttcggtaattatctcctagattttgggtttacttgcagcaaatttgatccttctctcttcacatatcacaaaaatgggaaaaaacttgtgcttctactctatgtagatgactttgttggtgatgaaatcaaaactgattcacacggtctttttcttcaccaaacagcttatgcatctgacattctacaataggctgctatgtctgaatgtaatctgatgccgactcttttaccacataaaatcgacaacctcaactttgaattatcctcggatgcaacttattttcgaagcctagctggaaaattgcaataactcaccatcactcggccgtatatccagtatgtagtcaattttgtttgtcaacgaatgcatgctccaatagttgcagattttggtattctgaaacgaatcctgcggtatatgcttaaatcatgcatttgattaggtttactttgcttgtttcgcaagtattcttgtttcatcacgattcacgaacgaatgtattttacgctaagtagaaaatttttatttgttagacagttattgtacaattcaatgactgatgttgtggcaaatttgtcaaaatttatcaaacttttgtcagagatagtatttgacaaatttgtcaaaattatatacgttctgacctaaaattttcgaagaaaacaaaaacgtgttggtaatataaaacgcgtaggaatttagaaaaccaaataatttgtgaacagataagatttgatatgggattcgagcggcgaaagagttaaagaaaacagcaccgcccaacagtcgtcaatgattacaatttgttttcagttcataaattaatccaatgaattgcttatgaactgacgataaaaaagaattgcttataactttgtgaataggaaataataaagtatttgtggttacagagttgtctttatgcaatatacaaaaataaaaatccgaaggaagagacgttgttaggtcttagaattatgaacaaacgtgtgggttgtctctgtctcttgtaagaaaccaagtcatacataatttgcatatataatatgaccgaccaaccaaataatataatgttatgggctcttaacaaaaacatatataaatagtcatttcgttgtgacaagaaaaaaaaaataaataaaaataatagtcatttcgatattttgttggttggctagtgaaaaaattgccttaagcgcattatcgttttttcacaataaaattgactcatgaaatatgggaacgagagttctataaaaattacattttgggtaggccctacactgatgactataagggcccataaagccgtaatgggcttaaaggtggaccacatctggaccataaaaccaggctgtctaactggtatgcagctgtagtccacgtgtcatatcatttcgtcattaagaaaaattcttactaaattagtgattcaatcctttaaatccagtggtccaatttttctttccataaagagttaaagactatactaaaaaaaaaacactgcatcattatatcaatcaaaaggctaaatttttaactgttcacgtttttaatattacgtatatagattagagatcatgggatgatcattagagataattgatgattaagtatgacacgtggcggaatctcaacggtacttattatacagctgtgaatttgtagggtttgacgtagacttgtgaattgtgatctttccccagcatttaattagctggctaattaacctgcaaaactcaatttttttttgttctaatttaactcattaaatccctaaaaaattgcatttcaaggaaacaatatttcttttaggataaataagaaaaataattaattcttaacgggcaaaactcaaactttaactttaaaaaaacaaattcatgaaaaaattgcatgtgaaggaaacaatattttttaaaagttttaattaaaaaaaaggtaatcttgaaatggatgaaacattcatttcatagtgtttagtttccagaaagaatctcgtttttttctgctgtaatttttggggaattattttttatctgtcggttttacttttccttctttgaaaatttgtaattttctttggtttcacagcaaatttttaatcaaattttagatgataaaaaaaatggatgagacattcattattatttttcaaagagataaatttatttataaaattgaggaaaaaagataaattatttaaagagagagtgcaagtagggaagaagtcatcttctttttattgcttcaagagtcaatcatcttcaaacctaatgatcttcaaaaaaatttctggttatgcatctctttcttgaaaaaataatcatataatcacatcaaaaagagtcaattatcatcttcattatcttaatataatcaatcaataattcaatttaaaaggtaaattaaagtaagcaatgtagacccaaaaaaaaaagtctgcttttgtttcaaaacatataaggacagtgaaagggtttgtgcataaatgttgttgcttcatctttctcataacattagctatgagattatgaaagtgaagatataaaacaaacacctaaaagtgaaaagtacaagacaccaaatccttcattttcatctcttacacaaccacactaagttaccaaaaaacagaatctgttctttttttgccttcttgcagatttcttcagagtcaaagacacataaaggttcgatttttatctcttaaaatcttcaaagttttcgtttttcttttcaatttcgttgaatttgattctgggttttgttctctgttagtaactgaatctatgtcagctttagataattctagttagggacttatggttctcaatttcgagtcttttgatgttatcttgttgttttaacggatttgaatctaaaatcttggtctccattgattcagatttataattgagttgtgagttttggaggccatg

SEQ ID NO: 15202 - DNA, 3000 bp, Unknown
  misc_feature (1)..( 3000): cDNA_ID_3095377_gDNA_ID_2926083_Annot_ID_196408 3000 nt of promoter + ATG
agcctatctcgggtaataatattattttttggtattataatatattgaatcaaataaactaatttggaaattgtgtatatatgcatgcactcgtatgttgatacaatatatgtgtataaatgattactttttgatgatgagggtattgatgcttgtatgggtttaaagttataaggaagagtttcaaaacgtgaaaagattcactgtttaataatacattaatctctatatatatctacacacatatacatatatggattgtatatgactagcaccaaaatcgttaagacatttttattttacatgagatgcttattatattcaagattatatgttaataaatgatgtgtttatataggtatgatgttcattttgggatacaagacccttatgaagattgtgtagcgacgatgaggctttacacgagaatgagatatcagaaacacaagattgaagcttaccctttagccgccgatgcgcagaaccgtagcaaccaggtggcttggaggcagagtgaggccgagaggatgtctcctgatgaaatgctctcaatctctcgttccgactattactgctggtgcttagactcactagcttaatttctaaacttatggggttatttaagtggtctcttaaaattagtaattcttcaaacttttccagagatttttaatttagtagtgtaatgtcgaataacattggttatgattttgtagtagtatctaaattttcgagtgtgtgttgtgtgagatgcctagattgttattgaactttgtaataatgcattaatctcaattattgattaattgactgctttttttccaatcacacattacttaaaatatgattccattacttgatatttaaattttagaagaatatacatttctgttaaatatattaaacacttttattttttaaaaggtatgagttaaaaaaatcaactttaatactagataaaaaaaacgaaaattgaaagaaagcaaaatattagaaaaactagcacaaaacatactgatatcttattgtataaattttattttcaaagttagtccagtcattaataagatcaccacacatgactcataacttaaacaatatgtaacaaacttttcatcttgtgtggcttttccttcatatcatataaaagatttggacagtcaatcatatacataataaaaaataaccttattttttgtagtaattacataggtatgccattagaaataaaaatttaaagagtaaattaattcatctttttaaaggttaataatgtttaagacaataaattttgtgatatggcatataatattttgaataactttaacactaactaattgaatattttcaataaataatcatactcgcactcattagtcataacatcatcaatttaattctttttttatgggattattatatgtacttgatgactaaaactttgagaatattttcatgaataatatgaatttcttcaattgattacaatatttatcaaaaacagcagttaccaaaaataatagtttcatattaaattttacacgttggtcatatagggaatccttgcgtactgcattctgcatggcatgtcagcacagtgaatcagcatgtgatataattttactataagtagagcattcatcagtcgtgaattttcggaatatatattgatgataacgtcggttgttaaatgacacaaaaataatgacgtcgttttgagaaccgttgtaacatcgtcgtaacaacaatatagaaaagacacaagcataaaaaagaagcctacgcaacaattactacaacatcaatctccatattgaattgtcttctgatatacaataccattccatgccaagcagactgagactttataagtatgtgaagcatctcacgagagttctcagtcaaatgcaactcaacaaagaaatcataagaaagcattgagaagcaaattagttcatgaaccacatcacatcagcatcctggagaccaaaaaaggaagacagtgaatcactcaatagaagaactgataagttcttgctttcagtgccaagagtgtaagaaacataccgcaaaaacagactactaaacccttttcaagaacaatccgaaggaaattgattcttctccacatcatttagcatccaaagcaatgaccaccatctttagttacagctctacgcagcacatctaaagctttcttgttcttttaccaattctaaaaatctcaaagaagagatcgattccagatacaagagctgcataagattcattcaaagttgtcaaaattacagtaccatttttttacggaggaatgacaagttatgagagtgtatcttttcgggtaaacattgtaacgtagtgaaagttgagagtgaattgcgtaacaaccgatagaatgaaccaaaaagaaaaaaagaacatcttttctatcgcccaaaaataaatctaagggttttctatttattaggtgtatattgtcttttctagtactaaaacaataatggctaagtctcatcctcacaagagattaaggttgagaatatattgtattgttgttagcataaacaaaaatagatgaaaccaatttctaccaaattcatttttttttaagccatttagagtacattgggtaacaagtatttcaactaaattactctaagacaattctttctatcttttatgagctgaaatatggaccacttttcttttctgttctttgtggataataaaaccaaacttcactgaattatatcttcaattcacattgcactaaatttttagattgatctcaaaataaagtttttttcctaaatattgtcgtttatcgaatacaattaattaaaggataaattgattaagttgctttgctttgtatataagaccaccatcgctccctcctctttcatcagttaagataatataaattcagtaattaagagagaagaaataaatacaaaaatgttggttaaagttttctcttttttcatccttatgataata

SEQ ID NO: 15203 - DNA, 3000 bp, Unknown
  misc_feature (1)..( 3000): cDNA_ID_3095382_gDNA_ID_2926083_Annot_ID_196407 3000 nt of promoter + ATG
caccttgataatggtgcaactgtaatgtctggaagctcagatatcgtcttcgaggagttacacgaaggatcctgatgacaaataaaacataagtttcttttttattataaaaaaaacaaaagggaaaaacaaaaaatcaagaaatattgagttctttaagtaagtttttctttttgtgagtctaatacaaaagtatagaaacgaatacttacattctgtgggtttacacactagacgtaaaatgaaatttcattaattaactataataacaacgtcaataacataagtaaacaacttgtagttgaacttttatttttcttactaaactttctaattgaagggtatatttttgttaattttgttaacgtatctttaatcgaaggtattttaggtattaaatgtagataaatttttttgttttaatttagaaatccaaaacaaattcaatgtatattagagcttaatagtacaataggatttttatatgtaattggatttcttttgtgagtctatatatgaatagatgcagtcatgaaacatgacaaaagagcatccgaactttggggaatatgctaactttttcttactaaaaatatgaatatggatgtgcatggacacatcttaactgtagaatgtgctgtaattgagaagaaaaatattgtggtgattaattcatttcaaagcctacatttctattatgcatattagaaactatttatcaaaaattcattaaaaaagaggtttcgaatcaaattatagatgaacgtgttgaaggaatattttcaacaaggaaaaagctttgaaagtttaaatgaataaattggattttgttagtcaagaaaagagataggtgtatatgcatggtctgataccaaaggaccatctttgcttttgttctttaacacaattatatgcatgaataatacccttttttttattatcaaatttggaatcttttaggatcaaacactataaactagaatcttagacttggcccatatttcctcggtcaaaagatagtaagcttctaaaaaaacttcaaacctttcaagcaaaatatttttttaagtcaaaattaagaatctaaaacatatgtaccattttgcagtctgatttatactgcaaaatttggtcactcaaaattcgagacaatattttgtttgcgtttaaattgaatactgatatttattgttaagaagatatcatggttccttttcgaattaattcacacacattcatacacaaaatagagaacatgaagctctgaatccatgtgaagttaaattagcatatccaaagaagattgaaatgcgtgacgtcgtaagtttaagctacatttttgtaaactaagagtaaacttgcagaaaaatattacttatattttcttagaaagccctacatattatttatcaaccgctaatgtgaactatggacacaaacgcaacataccgacatgcatacgcaagagcatgatattgcaacagttaaaagaaaagcctttatgaaaaaagtaaaccttatcttcagcgcgtaaataagataagataaagatgatctttgagtcaattaataaatttattttttctttttgaatttctgtcacagaatttttttgttctttattattttgataaaacaaataattttttacagtagtgtgctataagacaatcgttaattgaagtagagagatactgactagtaagaatttgatggaacatgaattcttaaataatatatatatatatctttaagtttataagacaattttcgaaactactttatctttctaattttctttatatgtaatataaatatttgaataaatgatacaaaataattattttattttaacatcaaacgaactttgattaatttgaagagtgatccttgtggaagatttgtacaaaaaaactaggaagaaataaatggtgtataaaattcacattgtttggtattaagttctttgtcaatcaatcagccgcttcgttgttgttccttgaaacccatgtgaaggtagaatttgtgaacttttctgccaggttatagactttaaaattcttcatttctctattgataatatgtggtatttgcttgttatctccttcaaaagtgacattccaaatcctcgtatccaagtgtgttgcagttccgcctcaatgacgatattacaggctttgcctctactttgtgttgcttcaacaaataatcctctatcatctcgtataatctagccagctttttcatttttcccagtccgtaggagactacaatcataattacattttaaaaaactacttgatgtggtttacgccattgttggtattcttgtgtatataaaatgatttttttttcttagtacatgtacatacaaacttcattttttcaacaaaaaaacaaattttagtgtattgaaggctttttaaaaattcgaaaatgaagtgaatgatgtaagaacattttctaatattttagagattattcataaaccttttattggtatttttgaaagttatataaacaatcgtaattgcttgatggtttgtatttttgatcctttgtatttttatgtgagcctttgtatatttgtttttcttccctacacctacttagtgttggctagctagttatctgtgtgagattttcttgtttataaacttgatcgacatcacattttcacacacacacgtgcatacaataatagcatcttcgttatcgtccaaaacaaatgacaactaaaaattatgattccttttaccatgaaaagcgaccccatcgcattaaggcatctacttcaatttctgttcgtctctaacggtcatatatgagaatggtcagctttgcttttcttcatcctgcttttatgaatattcatctataaataccttctcacaccttctccattcttcacatactcacacactcagctatcaagaagagaacaaactctctcaactctttcgttctcaagtatttgcttgcaagtgtctgatacgtaca

SEQ ID NO: 15204 - DNA, 3000 bp, Unknown
  misc_feature (1)..( 3000): cDNA_ID_3095438_gDNA_ID_2926084_Annot_ID_196420 3000 nt of promoter + ATG
atcacctgttcatgtggatgtcgatgatggcagacgcaaggtatgaattaaatactctgataatggatattaagggagcatggagagttttcttatcaagtttccaaaactgttaggtgacaaatgaaggattggagcaaggctattgtgttgttccgagcaaacaaagacttatccttctaatttcctttttgaaaaagaacctaaataaaaagattatggtatttttctcgacttgcaagtcggtacaattccatacggaaatcatgaaaataagcgacgtggatgtctctgatattcatggaggcatggatcagaacagaagaactaaaacctttttcgacttcatgaaagcaaagaaaggtatcttgttatgtactgatgttgctgctcgtggtctcgatattccttccgtggtacgtctccacatctatgttcttgcattggttttgtacgcatttacttaccaatggttttatggaaatcatatttctggcgatttttattatctgtaggactggattatacagtatgatccaccagacaagccaacggtaagacaaacacttcctcatatttggttttgcatatccctttgcctctgtatgtgtatcttagattgttctttggtgctgttatttcaggaatatatccatagggttggtcgaacagcccgtggagaaggagcaaagggaaaggcattacttgtcttgattcctgaagaacttcagtttattcgctacctgaaggtaagaatggttattgaaattttattgtgggttaaccaacttgagttttaatttgtaatttaaccctcaggctgcgaaagtacctgttaaagagcttgagttcaatgagaagaggcttagtaatgttcaatctgcgctggtaagacttctgattcagtaatgttgtgggtttaataactttccatttgtaataacaacgtttcttgttctgtctcacaggagaaatgtgttgccaaggactacaatctgaacaagttagccaaagatgcgtacagggcttatctctcagcatacaattcacactctttgaaagacatctttaatgttcaccgacttgacctcctggtaaaagaaacttaaaaaacaaatattcttccaaagatttttgttttcataatagctaatatctcgtgttttgacgttgagtatcacaggctgttgctgaatcgttctgcttctcttcgccgcctaaagtgaatctgaacatagaaagtggagctgggaaggtgaggaaggcgagaaagcagcaaggtcgcaatggcttcagtccttacagtccctatggcaagtccacacctacaaaggaggcataaagtgtcatttgtttacaaaattactattttgctccgtagttttgactaattaccaccaccaagttttgtttaaagagtaaacagtgcatttgatttaaatgaaatgttccttggctactattaatatttcagttctatgggttataactttttaagaattgttgatatcgtttgcttataataaaaactgatacatggaaatggaataagaaaacataaagaaaccataaagagctttattaagtgattatcggaactacatgaaaagtgaaaacatattcattgaatctaaaccggtctaaccggaaaccaaattcagtaatcgaaacaaagaaaaagaaaacgctaaaccggcctaagatcttcagcagctaaaaccgctggaactaaaccaaaccaaaaactgaaacaatcagaacagcagagacaacaaaaccggaactactgaactggactgcggttttgaaggcattgctcttcttggccttgggagttgacgccggaagagatgatgatgacgaagaagaagaagaagaggatggaggaggagactctgtagaagactccgtctccataacttttacgatcatcttctgacccttttcgcagtggccagagacaccgctgatgaagtaaaacaaaccgggtcggtctagtttgaaaacagtgtcttcgttgtttgagtagagttgtggtttggtcgctttgcatttcttgtactcttcttctgacaccactaacactgagtctttcgtgtacttgaaaccttcaccaaaaaccgcacaaaagagttaatatatcttattatcttacaagatgaaacgtttaaacttcatacaaaagtgttcaatatacttaattacttacggagagtgtcaccaactttaaaccggttatctgacgcccattggttaaacgcatctccaagagtcttagattttggtacgatccaaccattttctcctccaacttcaaattcagtgcttgaaacacatgaaaacatgtaaaatgttacaagaaacataacgataatgatcttctttgatgaatccatttgttgtttttttggattgatatgaaggaagctctaaccaaagttacagagattgttttttttttagtgttcgtaatgacttgtgacttgtgaggttttgagtttaaaaagagtgagacttggagatttgttagagttgaccacttcttgagggatattaatggatatctctttgacttggtattttaatttcttgaatcaaaaagatattttgtcgaaaacaacatgacttgaagttgtaaaggaatatcagaattgtgggatatttttgcttgttattttgaattacaaaatttatgtagacgatgtgtattccaaaagaattgttaaatgcttattaacggatacataggactatgagttgtatttttggtgacgacaaaagcaaatttcttcttcttattgaccatttcagcatgtgggttgaaattgtcatttaagagagttttggtaaaaagtattagatttgaaataattgaggcactttattccaaaatattctaatcactttctccgctctttagccctttagggtttatgacgttaaacccagaatccaacatttgacgattcgattcgaaaatctcagtgaagatcgaaaatg

SEQ ID NO: 15205 - DNA, 3000 bp, Unknown
  misc_feature (1)..( 3000): cDNA_ID_3095426_gDNA_ID_2926084_Annot_ID_196423 3000 nt of promoter + ATG
gtactgtatgatgaatgtttctgaattgaccacaacaagctccaagtgtaggaggaaacagaaaaaaacatacttggctcacattcttctcttcttcttcttctcatgtcttatgtctcttcctcaagttccttatggttggcaagtgcctttcaattgaatgtggacacccgaaaaaagtcaaaagattccggcagcttttttcaccatcttcttctgttccttgagaactcaaatggctcaagtaagtcttgccttcatagatatagctaagctgttgccacagcaaaacacttagcccaatcgccacagaaacactcgccacaaagagatagactagaacaaggcttcgaacagagatgaagacagcgttggctatgtaagtaagacatatattcttcaccactctcagaatcgatatactattaccatgcgccacatgggccacatcggatgcatatgcagctcctttttcaataggtggcaagatatgaatcaaggtatacacacacataacagcagcatagcttgtgctaatgacggctgagataaggaatgctatgaagtatttgtgattacccgcaccaacacagttcccaatctgcaaatacaacacaaggagagtcattagcattaagtccttaaccggtaattaagaacactaatatttacggtattgacaaacaagtctagtatccgaggactctatgattggggaagatcagagggtcgtatgagataaaatgatgaacaaggtacaagtctagcattcctatcaccacacaacgtaaactcaaaaagccactctacattcagccctttaagtaaaaatgatatatgtaataactaaagagaaacctgaaaacgctatgagacttacaaaggggcaatggtgatccatgtccaatacacacatgccacacgtgcggcagtgatgggttctaggtgacttgggtttggagcagtagttacaaaaggtatagttgttaagtgcaccattccctactccagggtgggttccataaagaatatttgttggcttcccggcacatttaaaagcaacgagaataaatgttgagagcgttgatatcgccagagtcgctgttgtaacagaatggaaaattccgcaagccaagctgatcgaaaacaagacgggatatgcagcccaaatcccaccacctgaagttttttttatccaaaagagtatttagcagggaacgaaatataattttcaaaattatggtttacttattcagagggacttacatatcacaaagagcataaaaactgcaagaataacgacaaaacaccggtcacggaaacgtctcaacccaaagcttttggtttcaggtctgactggattctgattcgtgattgcaccacaccatccacacttaaaaacaggtgcatatgatggaagaacaaggtttagcccacagccccaacaaattgcttcataatcctcatttatggttgcaacaaaactcccctagagaaaaaaaaagcaaacagttataaagctatttcacagttatctctgttaaacctatgctgcaagaaaacagtcccactatgcaagggtcactctactattagatgaccacaatgtgtaaacactaacacaatccagcttcatgattgcctacactgtattatgttctcttgaacagttctctactagctaccaatgattgagaggttaaaacgttccctttctttaccattcactaagcaagtattatgaaaagagaaagctcaagtaaaaaggttttgcatcacatatataatgccagatttgatatcaacttgatctcctaagtcctaaatcactaaatcaagcaagcatgctgaaactggccaataatttcaagatacactaaggcataacaagatgaaatcgttaagactatgtagtgaagatgggtgagactagagagagaaggatctactaacctgggaagaatcttccatagctggttacaagaaaggtttcttcagaagatttgatgagagttaacaatcaccaactcaaagaaaaccaaaaagctctttttttttgtaatgaaatcaaaagaatcaaccaaaaacttgttttcctctagctttgaatatcctaaaacaatggactacgtgtcaatttcagaagaaaccccatccattcatctgctaatcgatgaaacaggtctcgctgaatcatccgtgagaatatactaaatctctaatcatgggcaacgaacagaactatcagctccctcaaagctactctctttacacaaagatctgacagattgttttcggatcaatctgaaattgcttgaccacgacgacacaaagcatcagattcttcacaagtgattttgcgttgaccgtctttaacattcacgaaataaaatgagagcctcctctatttctccctctaattttagaaatcaatctaccgataccccaccgttggcgagtggcgacggctattgcaacagtaaacaccggcaaattttgatcggaagtaatgaagaagagaagaagcttttgaacacattggcgagaaatgattaattcttaatattttgcatatcactcccattattttattctttttttaattccttctataatgtatcttttaatcttattttaaccagccgtgtaaatgtaaattttgacacatgtaaaatttacaaaacttgggagtcaagtgtctagagaatcacattaaatggtaagttatcttttgtccaaaaaaaaaacaaatggtaagttaacatatcgcttgaaacgtggacggttcagattaagtttcacatataaggaaaaaggaatatcaaaataaaaagaccgacacttcaatttcccaaaaattcagaagccaatctctctctacctataaataacaaatctcccgtggaaaaaagcaaaaaccctacacgcgaaaacttttaagcttctcgtaaacctagctggtagctgctacaccagtttcgcttgtgatcaggatctatg

SEQ ID NO: 15206 - DNA, 343 bp, Unknown
  misc_feature (1)..( 343): cDNA_ID_3095417_gDNA_ID_2926084_Annot_ID_196426 3000 nt of promoter + ATG
aagatcaatcttttcaattgctcttggattctgagtttaatggataacaagatttgctatgaatggtttcacactactgttggaagatctatagaatgagcaatattgctcgttgagcagagaatatataaaatatataacaaagaaacttgatagattaaaatcaaatccaatttgttgttattttcgttttcgtgtgcagatgtttccagttaggaggtttaagtctagttattattacagtttcttttttacttgtttgctaattttactctatttcataaacttgttatctacagatattcttttgatgtttggtgcttactagttggggatggaaatg

SEQ ID NO: 15207 - DNA, 3000 bp, Unknown
  misc_feature (1)..( 3000): cDNA_ID_3095432_gDNA_ID_2926084_Annot_ID_196422 3000 nt of promoter + ATG
atgacttgtgattagttttatattctatacactaaatatttcatattattttcctactttcaggaaagtgatgatgaaaaacctcctacgaagaaggctaaagtttcatcaaaaacttctaaacaagaaagctctagtgatgaatctagtgatgaatctgataaggaggagagtaaagatgagaaagtgacaccaaagaaaaaggtaccaataatgttacttctcagatttctctatagagtgtttataaataatatatgttctaaccttttaatgaaaccaggattctgatgttgaaatggtggatgcagagcagaaatctaatgcaaagcaggtaaaaactccatacagtaaaattttgtcaagaattttattcctttagttatgattattatttggttaacacgttttatgtaataacgtttttatgtggttataacgtttaaatgttatgtgtttatatattacagccgaagacacctactaatcagactcagggaggatcaaagacgctatttgctggaaatctttcctatcaaattgcgagatctgacatgtaagtataatgacattttttcataacatttttctggttcttcctataaaatgttggtggtatgatatttataacccaaaatacagagagaatttcttcaaagaagctggtgaagttgtcgatgttagactttcttcatttgatgatgggagttttaagggatatgggcatattgaatttgcttctccagaagaagctcagaaggtaagttcatattgggtttttttggtatcatggaagtggtattgaaattacgatgatgattggattcatttttggatgttttgaatgtaggcattggaaatgaacggtaaattgttactaggccgcgatgttcgtcttgatcttgctaacgagaggggtactccacgaaacaggtacgtttcttactttgccatatgagcatgatgggattatgtatgtttttgtttataggctaatatctggtttgttggactatatgcagcaatcctggtcgcaaaggagaaggaagccaaagtcgaacgatttacgttagaggattcagttcttctcttggcgaagatgaagtaaaattcttgtcctagacttttcttaaaccaatattaacatgttacaaaagctatttgtgtaaaactctgatgcaaaccacttttgtgatcatgatcagatcaagaaagagttgagaagtcattttagcaagtgtggagaggtgacaagggttcatgttccaacagatcgtgagactggtgcttccaggggctttgcttacatagatttgacgagtggattcgatgaggcgttgcaactgagcggaagtgaaattggaggagggaacatacatgtggaagagtctagaccaagagatagtgatgagggccgttcctcaaacagagcacctgctagaggagcacctcgtggccgtcactcagatagagcacctcgtggaggacgtttctcggatagagcaccacgtggacgtcactcagatagaggagcacctcgtggccgtttcagtacgcgtggaagaggacccagcaaaccaagtgtaatggaatcatccaaaggtttgtttcttcttcttctcctctcctcttccccttttttgttgttgtgcattgtagaattagtgttgttttaaaacttgtgtgtttgtatggtcttgcagggacgaagacggtctttaatgatgaagagtagaagaaagctgtttttggttctatcttatagtagtagagcgtttttggcctagtttcttttgttttctgttgagaaaagcattaagctttatactcttcttaagattctttttgttggtttttcttaaaacttattaagagcactttactttgctgctcaaaattttggaataaatccttttgacttcattagtggttcattggcattgctatcagcccttctcagaataaagcttagacaatttaaaatctctaattatcattctctgttgcccatgccaaaagtttttgagtaacattttctagacagatcacgtgttatgaatctggctaagacaattctcagtttctaaaaaaaaatattttttagagttttcacacgttaagaattttattaatgtttaattataaatatactattttgcattaaacaatttccataattctaacccaatagtaattcaataaatataaaattttcaatcaatatttcttgaaaataacaatatcttgttattatttattgaaaaaaatacattgaaaacctaaaaattatatctttataaaacaattttttttctttctagaaaatacactaagaaaaagctgaggcttcacaaccgaattgttaaccatcttgattttgggagtagtttgtgaattgtaagccaaaagaagaattgactaatgtatttttaaaataaaaataatagacggataaaactgaaattatgtgcattttagttaatcacatactcattttttttttaacacaagtacatacttatttatataaaaaaaattgccgatattatacgaattactgaaattaggtgtataatgaaataaatgttaaaaaataaaaaaataaataaaaggttacgaattacacaacttcaaaggctcgttaaaccctaaaccttgtctccgcgccgcgttatcactcttacgtttctctctctctctcaacttcttccacagcaaatttcttcgattctctgagctctctcccatccttttcaagtggcttcgtttctaaaagtaagtttttttaatctatgggttctcttcaagtggttgttccttttcgaatctctgtaccctagatgaaatcgagtacagctttaattactctgtttttctttgggattgctctgtttcccttctcttagaggtgtataattactctcaaatttgttgtttttttcattcataaattcattaatattgctgcagaattgattggttgaagaaagtggaaacatg

SEQ ID NO: 15208 - DNA, 3000 bp, Unknown
  misc_feature (1)..( 3000): cDNA_ID_3055551_gDNA_ID_2926084_Annot_ID_196421 3000 nt of promoter + ATG
taataaggaattttcattattagaaaaagaacacaaaaaggatgtaacatgctcttccatatcgtctgaaataagcaatgaagatagaaaaaaatggtagttatttactctcattgtttcttcgaattcaaacacaacggaagacatttgattataatataagtatctctccaaaaatgtatagaaaaaaaacttaaaaacaaaatgaaatattacatttcaagcgacggacacaaagcttacattacacataactagatagatattcttcttcatcttataaagtataaacggaaacaaaataagaaaatgtaatattaccatgaaccgtgttcctcctccataaatcgaaccgtgatcggttaatactaccctgaaccagactataccaaccggttcaggtcaagcaccaggggccgcatctttagccctgccatggaagtaaccaccgtattctctagcgtaatctttgacgtgagatgccgtgtcatagatcctactacgtgcataatccatctgattcgatccaaccgggtgcattccccggaaatagcggtacgtccacgacactaaagccaccgttccgacaagaaatccggagaccgttaagaacccgccaacgacgacaaaaacgggaatccatatcggactcgagatgatgatcaatggaagaaagacaatgaagccgagcacggcagcggtgacgcttacaccaaggaggaagaggaggatgccagtggagataaagagagcgaggaaaccaaagagctgcgaggatgttggtgaatgggatcggagctgatggaaaaacgacgagatggggctgttgctaacggtggtggtggcggtgctaccataattgggccaatattgggcctcgccgctagagaacctttccgccattgtagagagcgattgttgttttgtgtgtgtgtgtgacagagaacagaatgaggaagggtaaaacaaatggaggacagattcagctttgaggtggcattcatgcaatgtttgtaaacacgtggagattggtcttggttttcactttgtctaaaatcgagattttggtttagattcggtttagtctaaatcgtattgattgggtttggtttgggtttatttgccgaaaaccatggaaaagggccaatgccaattgaagaacactaaaccaaaccttcaagttacaagaagagacaacagaagcgaaactagaaatactacaatagcaaattgtgtacctttatgacaacaattttttgtatgttaaaaatcagtagtagccaacgcctctaagctcagcagaactcggttgctgcatatcaccggcttttcccaaaaacacaactcggcctgtaaggagagaaaacagagatcaatatttaattgtttcccaatgaaatatgtaagaaatggagttttaggggttgagccattagtaccgtttctacgaattgctacttctcttatacgtcgaaccaaaccagtgacaggatcagtgaatatcttcgtctccagattaccctctaagtagataacagtactgttgaatgaacacgaaacaagttgttatgacacatacacaaaagcaagctaccattttgaatctagcaagcaagattcacctaaagtttcatcctttttcaccgattcttgatcgatatcagacatgatacatacatttgttccttattctatcatcacataaccttacaagctaaatatgatctcagaagagaactaacccgggttcaacattcttcaacacaagatctgccaagcgttcagggtaaacagagacacggtgccactgcaccgcagaccggctcgcatactctctcggatcttcgttaataagcggtctccggttgttcctgatcccaccagttcctacagagaagagagtgacagttctaccactcttaagcttcttctgcagaggaagctgacccacttgccccaccaatattgcctgtattaaaccagaaattagtctagaacacactaattattaacctatccagaacgagaatctaatgatgttcacaaaatgactcaacaaagatcatacaaaaggcaaaattgcaacgatcgatttaagaaaaacaacaaaaacagagtatgtatcaattggaattagaatctaagtttgataccttgaaaatgccagagtcaaggccattttcgagtggacgctcttccataacgcgttcttctccggaaaatcgagaaactggatctgaggcctttggttcaatgggcgattctaactcgtcaaagtcggagtcttctggggaagtgatgttgttggtacagaaagacatggaagcttgagaaattctagggttcgatagaagagatcgatagagtcttctagaaagtgtagccattgaattcgccattttcgatcttcactgagattttcgaatcgaatcgtcaaatgttggattctgggtttaacgtcataaaccctaaagggctaaagagcggagaaagtgattagaatattttggaataaagtgcctcaattatttcaaatctaatactttttaccaaaactctcttaaatgacaatttcaacccacatgctgaaatggtcaataagaagaagaaatttgcttttgtcgtcaccaaaaatacaactcatagtcctatgtatccgttaataagcatttaacaattcttttggaatacacatcgtctacataaattttgtaattcaaaataacaagcaaaaatatcccacaattctgatattcctttacaacttcaagtcatgttgttttcgacaaaatatctttttgattcaagaaattaaaataccaagtcaaagagatatccattaatatccctcaagaagtggtcaactctaacaaatctccaagtctcactctttttaaactcaaaacctcacaagtcacaagtcattacgaacactaaaaaaaaaacaatctctgtaactttggttagagcttccttcatatcaatccaaaaaaacaacaa

SEQ ID NO: 15209 - DNA, 3000 bp, Unknown
  misc_feature (1)..( 3000): cDNA_ID_3095511_gDNA_ID_2926085_Annot_ID_196436 3000 nt of promoter + ATG
tttcgtttctatattttggtttttttatgttttaagatcagagtcagtccaaccttcagcttcctccttgccttgcgtttcgtctaggtcctcgccttgagtttcatctaggtcgacctcttcagtctggtcgggacctcctgctgaatctgaggagttgtttgccgcatctgtgatgtttacaggttgctgattctccatcaaaccagaaagtgctagctttggtgaccactcaaggacatcatcaatgatgttggacatccttctttggtacctgtatgaacaaaactcatcacaattcaacctctactgcactaaattcaaatgagtagagtacaattagtttaagcgatatttaaaggtggacgagaaggcagtgtatacctggcccgagcagcttcatcaggggcatgacgcctaagcagcatgacaacaacaatagccactactgtgtagaaaagtcgagatgtccacttgggcggttcttcctcgtctttctttggccagaaacggaacagttccttcaatgtggcttcctcagctagaatgttggggaagaaccagacacgctttcccaaaagaatccacatagcaccgaaagcaactgctctcactgcaagaggtaatcaagaaggactaatctcagtataagccaagttaaaactacatgagtatatgacccccttcagtttagtagctatcgctagtaaataatactcccaagaaaatgactctcgaaggtgcaattacaaaaatattaaacagagtatttgtgtaatagagcttaccgaaaagtaaggagagaatcatcagaagaatgcccgcacatgagtagagtacaattagtttgcaacggtgtggatacacaggaaacaaacaaattgcaagagtcaatacaggccagaagaaggacaaaagcgtttgccatagcggatgccgtttttcgaacgtccatgcaaaaaaggcatcattttcagagaaagattgatcgtcctgcatcaaaaaagaaaaatgaaatcaaaagcgctgatatacttgcactgatgaatgcatatcttactcaaaataaaaacaaaacaagaaccaaagagaatgatggtgaaagggttgaatagcaattttctctaagaaacaaacttcaacatacaagacaacaagttcaatagcatatgaagcaacaccaaaatcaacttacacggaaaatctccaaatgagcaggccaagtagagagctttttcttcccgggacgaagagttttagtaacacgatcacagcggaccaaaaggttctttcccaacaaaacattggcaatatcgtctgtgtcaaggtctttatcttcttccagaatatctttaaagtcagggttattcttcataaagctcacaaaatctttccctctaaagtattcaactcgtgcttgctccataacagcccatctggattctaatcccttgtggtctctaactttctcagcaaacaactgaaaactatccttcttcacagcttgcttctagtaaagtaaagacaacaataagcatttgagcatatcaatcactaaatgcaaaggatcatcatttaacagtaccaaggccaaaacaaaaaaattcaaattctcgccacacaagtgattcaattaacattccagagattataattcacaagtcacacaaccaaaacagtaaaatttacgagcattaacatacaatttagcaaaacttaactatgaaaaaggcctatataatcatgcaatcgcaggtcaaatgctccatcagagaccaaaacagatcaaacaaaaggaaacgtaacctaagaacaaatttttataaaagagattagagagaaatgagagaggagagcaaaccctaggttgagaatcagaaccagaatctctaacggaagtagatgcagatcccgatgatcgtttaaccctcttcttctcggctccgaccggcttcttcatctctctccctcttcttccgagtcggagagtttttttttttcgatttttcttttacagatccaatgttttttgttttgttataacagaacaaaaaaaaaaattctggttttttgggtaaacccgtagagttaagattgcaataccggtttatagtagaccggttaactaacctagatttattaccaagtgctattaaaataacgtagactaactttgaaaattttggaatctaaaaagtatttcatttttctcacatttcaagattgatgtttgactaacatttatacatttaccttataaaaagatttccacaacttcaaattatattggatctttcttcataactaaaaaaatcaacaaattagacgtttagacctttttatctaagtaaaattagacctaagattatcatttaaaaatattttcagtacaaatgataatgtgatttttatgattagaaactttaacttacacatctttttatgttgaacgattttatgattgacggtttatcgataccacactcacgattaaaaaattttactttttagtttttactgattgaactatagcgatcaactctgtatgtatgctagagattttcggtaagcttgtctttgttaatacgagaaatttgtattctatgaatcgaacctcatattcatttatgatatacaatcactttaattttaaacttaagtgttacaatagaaaaaagcataatttttagtagaatatgatctagtgatgatataatagacggtttgcaatagaaaatgtgtttactcatgattaaaagagagaaaacgaaactataaattgctcagctttcacttgattagaattttactttttaacgggccaattcatgtccaaattataggccttttaacggcctatactttttgatatgcttagcttttttacttatccactccaaattcccaaaaagcccctgagtttttcggattttacattttctaccagagtggagaaaaaaaacagagaagaggaaacaaagcaagcaaaaaagagttgcc

SEQ ID NO: 15210 - DNA, 3000 bp, Unknown
  misc_feature (1)..( 3000): cDNA_ID_3095493_gDNA_ID_2926085_Annot_ID_196440 3000 nt of promoter + ATG
attataaaagattactctgtttcatttgcctctgcactttcatcaacaatggcagcaatgatcacctttgactttcaaaacagcttcatcttcatcctcttttttctcttctctctcctttgttactctctcttcttcaggaaaccaaagggctcacgagctggccgtgatcttcctccgagccctccttcttttcctgtaattggtcatcttcaccttcttctctctgctcttgttcacaagtcttttcaaaacatctcctctaagtatggacctcttctccatctccgcgtcttccacattcccatagtcctcgcctcctcggcctcagtggcctacgagatcttcaaggcccaagatgtgaatgtctcctctcgcggtcacgctccagtcggggagtctctctggtttggatcgtctagcttcttcttcgctccctatggagattactttaaatttatgaggaagctcatagccacaaagcttcttggaccacaggcactcgagcgttcacgaaaaatccgtgcagatgagctagatcggttttacaaaaccttgcttgacaaggcgatgaagaaggagagtgttgagatcggtgaggaagcagcgaagctcaataacaatatcatctgcaagatgatcatggggaggagttgttcagaggagaatggtgaggcggagaaattcagacacttggtgatcgagtcgatggctttgacaaagcaaatcttctttggtatgatctttcacaaaccgcttaaaaagctcgggatctcactgttccaaaaggatatactaagtctttcccgcaagttcgacgagttgctggagaagattctttttgaacacgaagagaaaaaggcggagcacaatcaagctaatgacatgatggattttttgttggaagcttatggagacgaaaatgcagagtataaaatcacaagaaaccatatcaagtccttgttcgtggtaaatgttcttcccttctaggtagatgcgtaagcgaacaccattggtcgaaacatattgtggcatgcataaaactttaaacataaatctttgtattaagcttgtaagtaataaggaacaacaaagctaagacacttttatataggcccaaaaacacatgatacccttagatataggaaatatggaaatactctaataattgtttgttactacaggatcttgtcattgcagggactgacacctcggtgcaagcaacacagtggacaatgggggagctcattaacaaccctaagattcttcagagattgagagaagaaatcgaatcggttgtagggaacacaagattaattcaagaaaatgatttaccaaacctcccttacttgcaagcggtagtcaaagaagggctaagattgcatccgccggggtctatctcggtaaggatgtttcaagaaaggtgtgaactcaaagggttctacataccggagaagacattacttgttgttaatacttatgctataatgagagatcctaatttctgggaagatcctgaggagtttaaacctgagaggtttatagcatcttcaagatcagagcaagaggacgaggtaagagaggaagtcttgaaatacattcctttctccgcgggaaggagaggctgtcctggatcaaatctagcttatatctctctaggaatcgtgattggggtaatggtgcagtgctttgattggagaattgaaggagagaaagtaaacatgaatgaggctgctgaaacaactgcgttgtccatggctcagcctcttaagtgcactcctgtttctcgaaccaaaaaccctttgccatcaagtctacatattcccagttcttgatttggagattttagctttgccttttgttgtttttgtctcatgattgcgcgtgattcctgtttactggttacctttggtttaaattgcttcttcaataaactgtgttgttcttgtgtgtaattatgtgttggcaataactttgaaatattattatttttgtttaggccttgtgtgttacatacaacaagattatgtctttcacaacatattggcattttacactctacaaaaccagaaaacttacactttaacttccccatcatccttgtttcctcggcctcagtggccggcgagatcttcagggcccacgacatgaacgtatcctctcgcggtgctgctgcgatagatgagtccctcgtgtttggatcttctggtgtcgtctacgctccctatggagataacttgaagttcgtgaagaagaaataaaatataagatcaagtcaaattaaaaaaagaaatcagatatttatgtttaaattaaatagattaattttagaaaattaacaactcataaaatgtagctaaacaaagataagatttatttctaaaatgtatttaaaaaaagataagattaagagatacttaaggatataaatcatttaatttaatatattttgtcagatttattttataaataagaaatttttaaggttttgactaaaaagtttacaaaaatgtatatatagattaatttggtcaatgcctttacaaaggaacttacgaattatttgaaagaaaaattttattctatagacttggatacaacttttttctttaatccgaatggggcccaaattttgttggtcccgcccttgatgtatttaaactaatctacgcataatatggatttaaatcatttcaatcagagttttttttatgagatacccactaatgaaataatagtaaaaacatatagaaaaagtaggaaaaaaagagaaaaaaagagagagacgtttcttgcaagagagactgaacttgtattgacagttgtcattcaactaatggtatatttacttaaaactattaaaataaaaatatttttttcttttcttttgagatagtctccatcgtttttgccgatggagatgataaacaaagtatggattcattataaaagactactttgtttcatttacctctgcatttttgagcaacaatggcagca

SEQ ID NO: 15211 - DNA, 3000 bp, Unknown
  misc_feature (1)..( 3000): cDNA_ID_3095497_gDNA_ID_2926085_Annot_ID_196439 3000 nt of promoter + ATG
tcagaatcttctcccgtagagacgaagaagctgtttataactggtatactaacacttgagattgtatgcatgaattgggtcacatagccatataacatgttatagtgacaaaatctccatagcatttaaaggaacaaacacataccatataactggtacagtgacatgatggatgtgctgttggaagcttatagagatgaaaatacagagtataaaatcacaagaaaccatatcaagtccgtgatcgtggtaaatgctcctctcttaggtggattcgtgagtgaacactattgctttgacctgactaagaaacgtttcggttgtgaattcgggtgaaacctttgaataaatgtttggaatccctaaatgtttctgtttgctactacaggatcttattgttgtaggcactgacaccttaacgcaaacaatacagtggacaatggaggagctcactaacaaccctaacattctggagagattgcgaatcgattgtagggcttaacaacgttaataaaaaaaactgatctaccaaacctctcttactagcaagcggtagtcaaagaagggctaagattgcatccaaagccggccataaggccaagcaagcaaaacacatgcttgcggccgcctagaatatcatttagtttcgggcattttctagttaagttcttgtcgtctaatagtttaaactcaatgagttcgacccttgaaagtgaagtttaaacataaaaatattttacaaccaaatcatgaaattaaatatattatgtggcctattttttttccttagcttgtagcctcgcgaaactcggagacgtgaactcaatgggttttgcataccagagaagacaatatttgttgtcaatgcttatgccatgatgagagatcctgattttttgggaagattttgaggagtttaatcctgaggatttaaaaaacatgaagctaattatttataaatacaatataatcgattattaataaacatacaaaaaaagggtgaattattatgattttaaaacacttgaaaattgaaatattgtattcgattatgtacagccaaaataaagaagccacgagacttagtaagcattatattaatatcaagtgatcatgatgatcacaaatatagacagcgaaactgaaaatgtcagagatacgagagatgtgtgttaaatgaaatcgtatatcgttatttaagaaaattttaaaaagttttaaagaactaaaatcctaaattttactcctacaatcaaatagattttttttgacgtattatctgatcggttcaactaatccaccgaatcactggttaatagcaaattttctaagttttctgattttaaaattgccagctgacgttaaaactaaacccaaacaaacaaaaaaaatatactaaagtcaattatgtaaagccaaaacaaagaaaccacgagagttagaaaacattatattaataataaaatatcaagtgattagtgatcatgacaatcagaaacaaagacaaaaaaaagaccgaccggtttgttgcgctaaagttagacgagagatgtcacaaaatatgagagaggtgtgttaagtagtatatcactatttgagaaagattcaaaaattttaaaagtaattaaaatatattaaagtcataattttgaccggtttgttgcgctagacagaagtatattattttgggcgattatcacgagttattaaagtattgaaacacaagtaatgaacaccggttatttaagtattaatttgatcaatggttgtacaaagaaacttatgaattaataaaaggagaccgtgtatcaggtgaatcggactgtttttccagttatgcaaataccaaatcttttaggttaccttcaaggcttcaaatactatttttaaacttgataactggtatgcttaacatttgagattgcatgcatgcttttgcttttgaacttacatagtagaatctgttattacagtgacaaattctccatagagtttaaaggaaaactaagcgtttattgaataatgatgattacttttgcttcctctcaatttgttgcctacaccttaactcactcagaagataacatttacgaatacatcatgtttcttggttttgtgaactagtctacacatctgagaaaacattacgtgcagcatttgaagggttttgtgaactagttgaaggtactcatgatttgctatccaattcaaaagtaagaaaaataatatcattgggaaaagatagataatcacagccctataactctcctctgcagtcaaaattattatggacaagatatcagaaggctatgcctttcgagctagagtacacgaaaaaggaagccgcaagagctgcattaaaagagctaaatggaaaggtaaagctagattaccaaaccgatcaggcaaaactgaagtcaaccaagtttggggttctagtatcgagtattaggtgatgcaaccatggggatttgagatgcttcaggccaagaaagaaaaggcaagcaatgtcatttttcacactagatcaagctttatgaggctggagtgttccaacttccaactctgcaaatagcaaaagacatttggttacgtttaacgaggacattaccctaatatctaaatatttcacatgcacatatctaaatacccactatgcatgtgacatctctgcaaatatttcacatgcacatatctataaaattggattttacaagattccggccgaattaaagggcctactgatagtgaagtaatgtatagttaatcaccttgggcgatgaacacgcttaacgcaagttattaaactactactattcatttttatcagaaaagaacttctgatctacttatatataaaaacacttcagatgtacttatatcacgttcttttagagagaaacgtattactttatgtttaggtaataaacaaagtatggattcattataaaagattactctgtttcatttgcctctgcactttcatcaacaatggcagca

SEQ ID NO: 15212 - DNA, 3000 bp, Unknown
  misc_feature (1)..( 3000): cDNA_ID_4359676_gDNA_ID_2926086_Annot_ID_196451 3000 nt of promoter + ATG
catatttatgcatgcacacatttcatttacagatgataaaatcatgtgacataactaatacaataatttaagattgatcttacaaggaagtgacaataggcggcgtggagttatctagattattgcagtttaaaccctcccacaaaaactgtttaggaacgcatggatctccttgccagctgattttacttaatccataagtgctttggatactcttgatagcagcaactagaataaagttattgttgcatcaaaaaacaacccatgaaattatatttatagaggaaattgattgaaacatatagacttaccatcatctggatttgtttccatctgtggaaaatcgatcacggtgaaaacctcaagagcgttcatgagaggaggaagagtagacttaggtgttttcgtcaactccaagaggcatgtcccatcttcacattgttgtggtgtcgaatagaaaatggtttcggtggctaacgttttagggctgtagcgttcataagcaagttttccattcaacgtcactttgaattctcgggtatcgagggaccgtagagtttgaatctcggcaaaatgcatgtacacataaaattgggttgtggaagatggcaataaccatgagaagttccatgttccaaaagtacttataggcgttgaggctgacgccatcacaacttctggtggtgcataaccattagaactgtttatattcagattggttgttaactctgtccactcttttgcatcaaagaatggataccatttacgatcattgacatcatcagggtacctatcaaaaatatttttgtcatgtattaaagactaacattttacttaaaaacaaacttactgaaacaaatcaaaatccatattaataaaccaagatgctagaaaaatgtctataccaaatgaacccaatccgagttttgtgcaaccaaaaacctaataagtaattataatctttaaacttcaatatatacactaaatttattaaaggtttaaaacaaataatcttcgttaaaaagtttatcctaaacggatcaaacagaaccagaaaccaaattttgttcatgattaagtgaaagggcgtgattcataccgtatgttttggcctgaaccgctgaaataatatcggaagaaatacttcagagagccactctgagtattgtaagtattgtttttaagtggtcgtagctctaacgtattaatcataggtgagcttgttcctgtcttaacaagacagacctggagagacttagatatggtcttgtggataatctcctggatagtaccattggtccgtccattcatatcaaccgttacccatagattcggaccaaggtaaagatcgaaactcgggggattgttaagaccatcgtagttaccatacacaaatacagctttgatcagatagtttgtgtcttgcgtgacattcaaggtatagcagtttcggaatccgtccgggaagtatctaagcttcaaagacggtttactgaagatcgactcgaacgctttctggattcttccagttttgccactctgcacgaaaccatcgtccgtcgagtatgttaatccggttgaaggatcgttgtaaggaggctcatttggcaatgacccgcaatccaaactaatgaatcctagtaacacaagcgaacaaaatgtatcagaaaactaagtaagaacataatttcgacgaaacattatcaaaaacaacaaagaaatgtgtatatgtatatacctttttggtcttgtgcttcaacgaggtgtaaaagagcatagaaagagatgaagatcaacgcacataacctaattgcttgaggatggtactccattattcttctatgaaacaaaagagagagacatttacaaaaagaaaaagcagaggtttgagatatctaggcaataatggaaattattgaaaactaataagcacgacgttatttttgtaggtcaacttatgaaaaaaaatatgtatacaagagtcggttgtctcgaacctaaataaaactaaactaatatgtttgatttgattaacattctataaagatttaaaaattaacgatccaataatcttccaatgccgtttagttgatgtcaatgtcctgttttttaacgttgtattcgtacgtatgcataatgcactaatatatcttattttcgactaaataaatcaaattgaagtaaataatataacttggtttttgctttttgtattcaattcagttttggttaggcgcgtttgttaggtttttgatttttttttcttttcttttagtttatatacatagaatccatattgaacaatatcttggtttggtttggttcgacacactttagttttaatttgaattccaatttccagaaactgccatccatattccatggtaagaaacaaaaaaaaaaaaaatccaattcaatggcaaatgaatagccaaataggtaagctacaacgtggaagactaattttacattgtttaaaaagaagcaaagattgtgaggatcaaaatggttccaaaggcccaacaatcacaacaaactttgataaaaaaaagaagtaaacgtagcaattggcttcgctagctggaagctggtccagggaggatacgtgcatggaacacacaacaaaaccttcttatgatttaaatggtcgttgacttttgacccttgtggttttttggacaaaaccctgtgtttttatttcatttctataaaaaagatttatctgcctttgttatgttttcttcttattaattaagttatcatcggacaaagttcaattactagttattaaaaaaaaaggttctatagttattataagtttgtaacaaaaaaaaaaatgttgtcagaatcagttgataacacatttgtctaattccttcaattttgggccaatgaaattcgaaagcccaaattacataatgggccgaaccatattattctctctctcgctctctttctttctctgtgctcttctccttcacggcgaagtgactcacttcc

SEQ ID NO: 15213 - DNA, 3000 bp, Unknown
  misc_feature (1)..( 3000): cDNA_ID_3095561_gDNA_ID_2926086_Annot_ID_196459 3000 nt of promoter + ATG
ttttcttgcttttattacatttaaaagataaaataatatgtaagagtgtcataggatcagtgttttaggaaaatccagcaaaaagagattcgttaagttacactttattgacggtcggtatacgaaacgagacaatgcttacaaattaaaagtcaagtttcttgaaaattcagttttcctaaagtttgccttttttttttttttttttttctctctttcccaaaagcaaacggagaccaattatagttgaaattcacctaacgtgccaattagttagattaatcggagaaaaaaatccatattgttaaggtttattgacatctaactcgaatccatagtctctaatttctatcttactcttgatgtagcattgctaacacacaaattcaagataatggttcttattcttgacaaaattccaatcgaatcaatcgaacctattttttgttagattgatttcagttcgagttagtcggtaaaggccaatgtatgtttaacttctatcaccatattaacttttatgaattttcaactcaaatcactatcagttcattgccctttttatttgttacttgggattcatatcacccatagttgtatagatctcattgtttgtgtccacaagaccacaacaaatagtgttactgaaactgaattaatttttgagtcaaacttaattattggttcattatccgattatcctttattggaccaaattcaaattctagagcttctctagaaacatcataaaatatcatcacctctttaagtgttttaagaatcctattctttgattatcttgatatacatgtcgaaaaatctagatatatttgcagagaaaaatctagatattatggttgaatgttttctagattaggataaatattgttagatattttgtagttttggattctatacatagttcatctttcctccatttttaaccaagttgaacaagtagaaccaaatgaataatagagtttttttttttttaaactattcataagttctctaaagtgtctcctaaatttttcaaagagggttcattcttttgatttctttcaacggtcttagggtagtgttaatcactatcgatgtttccttacaattaccaacacacaactttggctgtattcaaagtgtccatttttcatgttcgattaaggccaatatatctaaaaattaacacatcaattgaaattatttttgtaatcaatgtatatattttgatgagaacagactgatcaagtatatacgtgtattgaaagagaagggttacaaaaagtatatgatgaagtagtggtgactgaatttcaacttgcaaaccaatgtcttaatttggaagtctttactcatacttgaaacttgtacgtctctctctctctctcaacctctcgaccacgaagattgaagatctaagtagacttgcaatccaatggggaacaaaagtacaaaataaattagaataatttatttatttatttgtaaaagaacaagaaaaagaaaaagagcacactaaatgtggagagggtgagcttgaggatattagaaattgtggggttgaaaagaagaaagtgggtacgttaaggtaggggccatgctttgtgtttatgagtttaagagagaaagtgatgtgccgaccaaatctagtgatcttctcgtcgcacttccttcccacattgtgccttcttctctttttctttcttttcactatttttcttgttacttttcttcatagtaattttcatacgtatttaacataaaagtcatgagttttattcataacattcgactcaccaaccacaaacttagattaaaaatgttttcgcatttcttcattttaaattaacaatctattgtgcatttaggtcaacacaggagattgtactagtctaaagacaatctagaagtgtagtgaaattttttttagaggaatcttttcagctttttgacgaattgtttagaggaatctttttaattacaacttgacgataaaggttacaatctgtgggaggagaaaaaaacaaaaataaaatagaaaataatagttattccgaagaaagaggaatgtgtttggtttggtatcatgattatgtctaatgaagaaaacacaaaagactattactactgactcgagcaaaaaaaaagtattttggaaatgctactttaattaaactaagcagaacctctcaatcttatttatcatttttacacttttcctcaccaccagaacctaactacttttttggcttgcgatcagtggaaatgaactacaagtagtaatatctcttcttcaacgatattcgcatcatctccttaaattggaagctaactcattcaagttttagttgtttcaatcatggccttagtgttgggcttcttccttttggtgtatcttattgactagtttcatttgggctttttggggcatcttattgtgggcaacacaaaataactatgttaaatgaaagattaaaataaaatttatttgaacgctaggaaatttgaccggagcttttatgggaatatatatatattacaaaatctaattcattttgctttaattggtatatatatattacaaaatctaattcattttgctttaattggtatatatatatatatatttaagttttcttaactagacaagttggaatgctggtccacgcaatcttttgctataactatataataatatagtttttaaaaagttttgatttaagaatatcttaacaaatcatatttatagttcaccaaatgctaatattagtttatatggaataaaatctcatagggaacaataggaaattgactggaacttttgagggaaaatatatatttcagattttttctttattttacttactttaattgctttatccatctattttagttttgtaaaattagataattaagttgacaaatgttgatccacgccacaccatctttatttccaaatatttgaatcagattctcttttaaaacaatctttataagatg

SEQ ID NO: 15214 - DNA, 3000 bp, Unknown
  misc_feature (1)..( 3000): cDNA_ID_3095555_gDNA_ID_2926086_Annot_ID_196461 3000 nt of promoter + ATG
cgcactagtgtcaccttcgcttcaccacaaaattctaattgtcaagtgaaaatgactgggaaggttgttagatttgattttgaccttacagattttatctgactaatatctatgttgtttccgacattgattgcactgaaacaaacataatttaatgatcatttatattcataatgttgtcttttttcttttttttggtctggaaacaccaacagattctcctcgatgttgacgcataacaaaatgttggttatttacattgctgcaccaattgcgatcatagcgattctaatcgctcttttctggatttccatattactgtgtggcaaaaactccctcaagagttcaaccggtaagtctaatcttgacattataaccacacttagtgtttttaatacatttgatgtaataaaaagacaaagaaaagttttttacaagtcttttaaatgtgtcttttctatatacaaatattaagttttattgggtttattatttaatttaaacatattagttaatgtgctgatcatgaaagtaattacatcttttgatgctcttgtaattcacgtctacaagtgacgccacaacgcctgatcgagtactcgatggaggaattaaggcaagcaacgaacaattttgacatggataatactattgggcatggaagtcacggaacagtttacactgggctgatcaaggacatgcccgttgtgatcaaaagggagtggtgtagtccccaacctagattcttggatgaggtacacacaaacaaaaaattggtgatttcattgaaaataatttatgtatttgtgacatattgttgtatgtgtctcaggtttcttacatccaacataaaaatttggttaatctgctcggttattgttgcgacgacgagaaccaatcgctcgtctttgagtatatggtcaacggtagcgtccgagattatctaggtggtaagtaatgcattatagtaaactcttgaaatttgatccatacatcatttttatgtgatcatctctctttttggttattgagtagagtctagcgacttaacgttcaagaaaagaatatctatagctcttgatgcagccaaaggtaaatcaaaatggatgatccaaaactcacattgattgttctaaaaactaatattaaagtctctctgtttttcaattcagggttactacacttgcacaacttagatcctccagtacaacacaagagatttacggcgagtaaagttttgctcgatgccaacctcaatgccaaggtatcagatggggcaatgttgggactgcttcaagcaagtgatattcatctcgctaatccaaggtattaattaattcacttatgatcatataagttacatcattccttcaaagtcctaacaaatatgttcttatgaatattttctatagaggtggttcagaggagacaattgatgtgtatagcttcgggttgttccttctagagcttatcacctgtcaaaaccctggactgttacaatcagactatgaagttttacaatgggtacgtaatagaaaaaaaaaccctctctttctccatttacaacttttttttgtttgttaattgtatgtacttaaaaatatattgtttggaaatttatttgtgatttgtagataagtccgagactttttacaaacacattttgggataagaatatacctgcagaaacattcacgagaccatcgttccaagcttatctgataattacgtcggaatgcttggaatatcccccgataaatcgcccaaagatggatgtggtcgtgaccgagcttgagacgatttaccttaatgtcatcagtgagaaccatgaggtttctctaggaagtgagctttttaacataaccattgagtaagcgaaagacatggtgttgttgcttcagtctatttcgaaaacccctataaaggactataataaaattcaacttgactattacaaaccagaattaaaccgcattggattcgaactgtgtggtttaaatttggtttaaccaatccaaatccaatttataaaggcgaaccgaaccgaattggatttaatttgtaggtttgttttaaaaaaatgattgaatcttcgcaaattatttatatagagagactctctgcaacaaaagttgtataacgaaaaattacattttatcggattcttctaatatttatttttctttttattttaaagttttcgcggttatatccccaaaaattgtttcaatctcttgtttttgctgcttcttcatcttcctcaatctctctttcgatcgctcaaaaaacccgaagaagctctgatctgttcatattccgatctcttaccggatttctctaatttctctctgtaatttcttcttcaagtcccggcgatggcttccgagtgattttggatttgtgtaggtaagctctttcaatcttctctttttttttttttttttaattctgatttgttctcatcgaattttcaaataatttgagcttttttaatcgttcgtcctgcaattttcgttttttattcggtaggaaagttttttggattaggtgcgaagtttgtgagtttaaaatttggttctggggaatctgcgcactgattattgagctttggattttgaaattcgaagctcaaaatcgatgggtgtcaggtcttgtgatttgaattcgcataaatttcactagctggagttgcttaaggagattgattttctaatttggacaagttgtttcttaaacttctctgggtttcatattctattgagcgaaagtagggttgatactgataatgagcacacttttttggtatgaggtgggttttgcatgtagactttagtttcattagtactggtagtcagtttctttggagatgattaactgataaatagatgtatctatcaaggattgagcttatgatttattgtgtttgttgtatcttggtaaaatctaaacttgggttcaattttgggaatgtttcaggtaacagaagagctttaacttatg

SEQ ID NO: 15215 - DNA, 3000 bp, Unknown
  misc_feature (1)..( 3000): cDNA_ID_3095542_gDNA_ID_2926086_Annot_ID_196464 3000 nt of promoter + ATG
gtcttggaactctatatatacacatatactcgcatgtaatctttatgaatagaggtatcttggtataatgatggagcaacgctaaagggagaatcttattttgtggggagatagattgtggataagagaagctgatgatatgatgctcgagagttgacaaattgtgagtaagaggatagagattgatatgcatatagtagtaacttgtgatcatgatgatgtatgaagagaaaaaattccaatatttggggatcaatattacgtgttaagggaatgtcaactttgttgattctcgtcgatcatcacttttcttgccgcaaggggatttacgttgccatttatgacaagtactgaactagacagaaactcaaattccaaagtagattaaatggattgcttctttttattaagttaaaccatagtagagttctcacactccatgcacgctctcagttttgtaattgcatttttttttctttgttttggttaaagttttgtaattgcatgttgggtttactatgtaaaacagttcatattcttagtatttaagatgatgggacatagaattcgtagtgactcttgagatatcaaagaagccataatccaaaaacaaagaaccgtacggcaatgcaagtggcgagatgaccattgtacttaaggcataattaaccacgtcatcagcaaaattcctcaactagctagctactattggtttagtgtgtcatcgtcattgtcggtaagatttggactcatcatcattagtgattttaatctcctgttgatattgttcgaaagaatgtttgatgtaatcaccaaatataatataactgcaacaattgatgattaattggctaaaatattatctatttggccatatgatgatcgacaaaaacgttaggaaccaattaagcaccttagctacgacggattcttctgaatacgaaagtggtttgcgctattagtttcggacccgtagttagaaatcttcctttcaagttgaagttcattcactttcttttttttcaaatctttggttttttaattacattcattataaaacagttttttttggtgaatacaattttatatttatacaaaaaaattggctaaaaaatggcttgaaggacagagatctctgtcacaacgagcaatctaagtatgctttgatgattaagtaaacacatgattagtttttattttatgtacttaattagttttaccttttgtactaccatagttatttttggaatttgaagtactacactgttctgactttgattctcgaaacgtgtaatctgaatttgataccaacctagatgcaacgatatgtctgttggtgattaattggctcaaaacactatatacttaattctctttaccatcctaactttgaatcgaaactaaagctgatgtaatcacaaaatcggatgtaaccgaaaccgttgatgattagcaatattctaataagatcagtcagataaatcacgctataatactagtggacgatctttggaattggacctcctgaagcatatatcgtcatatatatgagcattggcgcatctagctagatatatagatatattcttgatatactatgttcacctactagaaaattctatatccatttctcatattttttttgaaaacaaattataattttggagttgacattttgcaatttgaaattcacttgtttgggaccaatattttaaatataaaatctcctgaaatttattgtttctccaacaccatagatgtaagattcttcattataacataggaaacaatgttgttaacattgtcttaacatctttaacattcttacacaaatccatatcattgtcctgaatagcgccaaaatgatgtattaatatggaaaaaagttgatgcataatatgtattatgtatgtatcgagctttattcatttaactaaaaataaaaattataaaagatgtaatatatgcatggaataggatcaagggaatatgatgacagattgagagtaacgtgatcattcatgaatgggcctgttggataaagctatcgattctcccaaagataaacatatatcaccacttgttacaatctcattaccgacttgccgtccctaaaaccaaaccaattaatacgtgtcaatatcctacttacaccattctcattcaacaatttttctgtttttcatggtctgaaaaaaaaccttaatactaaatttgaagacaccttaacaaatgaggataagagcatattcatcatgaaaaattcaaaaattctaccgagcgtcgttagctcaattggtaaaattcctagacgaatcttagaggttgccggttcgagtgacgcttgggacgaaactaatattatatgcggtggttttgggcctggagggattacaagattcggcccaaaacctcctgatattcaaaaaaaaaaaaaaaaaaaaaattcaaaagttctttcaaacaaaaaaattattagatgtttttgaattttatataactaaattatagttattaaaataaaatcaaaccaatgtacaagagaaaaaaaaagtgtggtgtggtgtatatggtggagagaaaaaaaaagtgtggtgtatatgtccagcgagaactaacggggtcatttattgatgaataacaagtttctggggtgttttatgaaaatactattttttatggggcaaaatccgtaaaccctaaaaatacagagttcttgcgtcaaagagactgatttgttcttgtgacactgaaccattggagttgactgatcccgatatcatgcaatatctatcgcactctcgtagaatcgctcgggctttgaaaccactagctctcgtcgagaccgatgtgagatttgtatccaatgctccttctcatgttgttcatcgatctctttcccactctgtatttccaggtactatcttcttcatttttcacactttgtttgtttcgtcgttgaagctttgaaaaatgggaactttttggtttataggaaaa

SEQ ID NO: 15216 - DNA, 3000 bp, Unknown
  misc_feature (1)..( 3000): cDNA_ID_3095551_gDNA_ID_2926086_Annot_ID_196462 3000 nt of promoter + ATG
cgtacggttctttgtttttggattatggcttctttgatatctcaagagtcactacgaattctatgtcccatcatcttaaatactaagaatatgaactgttttacatagtaaacccaacatgcaattacaaaactttaaccaaaacaaagaaaaaaaaatgcaattacaaaactgagagcgtgcatggagtgtgagaactctactatggtttaacttaataaaaagaagcaatccatttaatctactttggaatttgagtttctgtctagttcagtacttgtcataaatggcaacgtaaatccccttgcggcaagaaaagtgatgatcgacgagaatcaacaaagttgacattcccttaacacgtaatattgatccccaaatattggaattttttctcttcatacatcatcatgatcacaagttactactatatgcatatcaatctctatcctcttactcacaatttgtcaactctcgagcatcatatcatcagcttctcttatccacaatctatctccccacaaaataagattctccctttagcgttgctccatcattataccaagatacctctattcataaagattacatgcgagtatatgtgtatatatagagttccaagactcacctctccaaaacaaactcatcaaaacaacattaaatctccaatcacttcaaagaaaataatatacataccaaaagagtattactatacaaatggatgtggtagcaagattagcgtcgcaaagagcggtggtgatattcagcaagagtacgtgttgcatgtctcatgcaattaaacggttgttttacgagcaaggtgtgagcccggcaattgtagagatcgaccaagacatgtatgggaaagatatcgagtgggccttggcccgattaggctgtagccctacggttcctgcggtttttgttggagggaaattcgtaggaacggccaatactgtcatgactcttcatctcaatggatcattgaaaatattgctcaaggaggctggtgctttgtggctttagcactcgtttgatctttactttgacctttgaaagtctcttcactttatgtacgtttaattaaagcatatgtgaagaggaactactttgtattgagagtaattaaatatgtctatgtggaggttgatttaatgattaactataacccattatgggcgaggtcgcataaacctctgttttatttcctactccttacaaattaattcacaagtcaaaaatacatgcaactttctctaagtgaccaaatacctctttgcaaacgattgaatcaaactcatgatcataacaagtttatgccattttaatccacaagcgaaggttcttggcgacaactttccagctaatcttccgtctcttataacttgtttgtctttcatttgtcgatttcttctcttggctttaactgatctacaattttaaggctatttgtagatttaaggtacttagacggtaataactgatggaagcccatactgttttcctctaacacatgttgcacacctaggttatgaatgaaaacgtgcaattcaactacggataaaattcgaagcggttctaagagcatcctcattggtgactttttagagatgtctttactatagtttattgtaaaagttaacattattttaattttaagtcatttattagtcaagtgtgatgtctttaaaagtaagaaaatgtctttgcagagacatggaagacacgggtcttcctcctaaaagcattaaataacattttattttagtttttcatttttaaaaaaaatttaaagacactatgttttttgtgcaataaagatggtctaatagtaccaaaatatattcatacacacacacatatatatatatttttttgttactgttggaaccacaccacactgtgaggttcgaaatccattcggagtcttagtttttgttaaggttcaatacaaatgtatatgatctagatagtttctttccatctctttcttagtgacatcctatgttataaattcttgggctgtttttcttttggtaagcccaattagttaaggctttgtaagcttgtattctccatattaatcattttagatggcaaaatagaagtttgtactttgtatatatatatgtctggatagataattgagatattacaaatagttaaatttagtatttgaaaaaattttgcaagctcttgaggtttgaataatggtagagcatatatggtagacaaattaatccataaagaggtgttcatgtaccaaccttcctttataacaatgtgtttgtaatgagctggattgaagcagtttaaacacactattaccagttctaatttgtagtgaagattatttccaataccaatttaatattggagattttttcgatatttggtatagtccagttggtcagatatttttcctaacaataacttttcaatgtcgtcaaacatttcttagttagtttgattttaccatttaaacaacttttccaaataagattacatgtatagaatataaattgaacgacaaacgattatcgaatctatgttctctatatattatcttatccgaagagatatactacaacgggatcaccaacgcttttgatttcaaatctattgaaaaaggtatgtgattttttttttctcacgagtagatgataatatatgactgtgattttctcactagtatagctgtcgtttcaccaacgaattttagtttcaaatgaatgcaaatgcgattttcagtttcgcactagtgtcaccttcgcttcaccacaaaattctaattgtcaagtgaaaatgactgggaaggttgttagatttgattttgaccttacagattttatctgactaatatctatgttgtttccgacattgattgcactgaaacaaacataatttaatgatcatttatattcataatgttgtcttttttcttttttttggtctggaaacaccaacagattctcctcgatgttgacgcataacaaaatg

SEQ ID NO: 15217 - DNA, 3000 bp, Unknown
  misc_feature (1)..( 3000): cDNA_ID_3436855_gDNA_ID_2926086_Annot_ID_196460 3000 nt of promoter + ATG
actaaggccatgattgaaacaactaaaacttgaatgagttagcttccaatttaaggagatgatgcgaatatcgttgaagaagagatattactacttgtagttcatttccactgatcgcaagccaaaaaagtagttaggttctggtggtgaggaaaagtgtaaaaatgataaataagattgagaggttctgcttagtttaattaaagtagcatttccaaaatactttttttttgctcgagtcagtagtaatagtcttttgtgttttcttcattagacataatcatgataccaaaccaaacacattcctctttcttcggaataactattattttctattttatttttgtttttttctcctcccacagattgtaacctttatcgtcaagttgtaattaaaaagattcctctaaacaattcgtcaaaaagctgaaaagattcctctaaaaaaaatttcactacacttctagattgtctttagactagtacaatctcctgtgttgacctaaatgcacaatagattgttaatttaaaatgaagaaatgcgaaaacatttttaatctaagtttgtggttggtgagtcgaatgttatgaataaaactcatgacttttatgttaaatacgtatgaaaattactatgaagaaaagtaacaagaaaaatagtgaaaagaaagaaaaagagaagaaggcacaatgtgggaaggaagtgcgacgagaagatcactagatttggtcggcacatcactttctctcttaaactcataaacacaaagcatggcccctaccttaacgtacccactttcttcttttcaaccccacaatttctaatatcctcaagctcaccctctccacatttagtgtgctctttttctttttcttgttcttttacaaataaataaataaattattctaatttattttgtacttttgttccccattggattgcaagtctacttagatcttcaatcttcgtggtcgagaggttgagagagagagagagacgtacaagtttcaagtatgagtaaagacttccaaattaagacattggtttgcaagttgaaattcagtcaccactacttcatcatatactttttgtaacccttctctttcaatacacgtatatacttgatcagtctgttctcatcaaaatatatacattgattacaaaaataatttcaattgatgtgttaatttttagatatattggccttaatcgaacatgaaaaatggacactttgaatacagccaaagttgtgtgttggtaattgtaaggaaacatcgatagtgattaacactaccctaagaccgttgaaagaaatcaaaagaatgaaccctctttgaaaaatttaggagacactttagagaacttatgaatagtttaaaaaaaaaaaaactctattattcatttggttctacttgttcaacttggttaaaaatggaggaaagatgaactatgtatagaatccaaaactacaaaatatctaacaatatttatcctaatctagaaaacattcaaccataatatctagatttttctctgcaaatatatctagatttttcgacatgtatatcaagataatcaaagaataggattcttaaaacacttaaagaggtgatgatattttatgatgtttctagagaagctctagaatttgaatttggtccaataaaggataatcggataatgaaccaataattaagtttgactcaaaaattaattcagtttcagtaacactatttgttgtggtcttgtggacacaaacaatgagatctatacaactatgggtgatatgaatcccaagtaacaaataaaaagggcaatgaactgatagtgatttgagttgaaaattcataaaagttaatatggtgatagaagttaaacatacattggcctttaccgactaactcgaactgaaatcaatctaacaaaaaataggttcgattgattcgattggaattttgtcaagaataagaaccattatcttgaatttgtgtgttagcaatgctacatcaagagtaagatagaaattagagactatggattcgagttagatgtcaataaaccttaacaatatggatttttttctccgattaatctaactaattggcacgttaggtgaatttcaactataattggtctccgtttgcttttgggaaagagagaaaaaaaaaaaaaaaaaaaaggcaaactttaggaaaactgaattttcaagaaacttgacttttaatttgtaagcattgtctcgtttcgtataccgaccgtcaataaagtgtaacttaacgaatctctttttgctggattttcctaaaacactgatcctatgacactcttacatattattttatcttttaaatgtaataaaagcaagaaaacatacataatattaatatatgttcatactatggttcatacaggaaaattcgtatcataacattttttcatcatttatttgttccatagagaggctaaagtagggataaaacgtcacctcttattcacttttcttttatttcgtttaccaataaaaataaataatatatgaaagtaacatggtagtataattggagtgaatatgtaagaacattaattggaatacaaatttactacaccaaaaactatttttaaccaaatatgtcaccaaattcaatagaatttacactaatttttattgggaacacatgttcccatcatggcctctttcctcctccactggttattactgataaaataataacattagacacttaacaacggttgattctctggtattaatgaaaaaagaatttcgaaagtgcacaaaatggaccccaaactccacaaaacctgcaacacactcaattatacgcacaacatgcaaacaataataaacatcactgaccatccaagtatttcttctatatatgtagactctcactcttttacgactcaaagagcaaagagctaaagtccaaaaccaaacacaaaaacaaaaatctaaatttctttcttggtctgctttcaat

SEQ ID NO: 15218 - DNA, 3000 bp, Unknown
  misc_feature (1)..( 3000): cDNA_ID_3095580_gDNA_ID_2926086_Annot_ID_196455 3000 nt of promoter + ATG
ttttggtcaatagtaactagatttaatctcttaaatattttattgctaagtcctcttcttgaccaaacgtcccggctatataatcatcctctcaccatggttccaagtttcaacagcaaattggtttagttcaataagattttcacattcacacatcttaaagctgcaatgaaaaccgggtcagcaaaatccaacatcctcctatatgtttttgttctctcacttgtcttgtctccaatacttccatgtcaagccgctagtgtgcttctaggaggtaagctagttatctatgaatatcctccactatactgtatgtatgactctctctctctttcagttttttagagggattaatgattttatttttcactgaaaaggtggagggcgtaagctgatggcgccgtcaccaccaattcgcatgtgtccacagtgtgtatgttgtgcaccggctccacctgattcttgctgcccatgtcgttgtccaggcggcgcctgaagactgacgtttgctctcaatcaaatgggttattttgatgtgttaaatatgtgtaatctttataatatgtatatataagtaaataaaaagtgtaatctttgtattgtgaataaaataaccttgggttatgttgaatagttttactataagctagttttgatagtaacacacttttatacattgttttcttagttggtgataatgggatcacaaaagatttgatattatttggaaagaatgtttgacaaaaaatattaagaataaatgattcttgtttttagaaaatcgtgtgaaaaaccctcttcattatcccataaccgatacgtatcatttcaatcttcatcttcgtcacttacttacgaaatctcaaatgaccttttcccattattttatgttttaattgatttgcatatttgttgtgttgtgcatgtatatatagacttgactataagcatttgaatgtaataaccaatactcacttgtacatgaatttttttttatagttcttcaagatgacgagtaaacatgtttatttttgtaaaagtccactttgtacagtaacacgcagccaaacagcgcatgagaaaaaagaagtaaaaatgtattttccatcgttcatagttcaaagtagagtgtagagatgtgcctcttccggtcctatcactggttttgaagctacaagtaagagataacaaactttcatgagtgttactacagcgccgtcattcatccgaaactgagatgtgagtgacaaataagattgatgaaaccaccaaagtggtgtcgtggaggaaggtcttagctctaccactaagccaagcaagatagtcgaaacttcacataaacgagttaatccggttgcgatgacacttttttctaagagaatttgctaaaactcaaagtattactgcaattaattgtcttctacactacaagactatatgaagtgtaaagtctcttgattgagtgaaaaagttaaaacttgaaaaattaaatttttcttcggaccaatcctgaaaacgtgtttgcgaaatgttaatacatacgtgagatcacacctagttttgtagaaaatatatcaactatattttttctgtgacaaaaagttttatattatattaatttggatttccaagtagatatgcaactttgactaaaaaaaaatataatttgattaagaatataatttgcaactcgaatatgcattattataaagagttcctattatcaacaattggaaaaattcgctatgagtcacatgacaagatcacaagatagcatacttcgagccttcaattactacagacaaaagtatttaatagtatcgtacctttgactttaaacatcctttgtatgttaacaatattactgacgtcttaagataattcaagagtggcaaaaaatccatgcacaaaagctttaactacattatctcaaattaaaaacaggattcaaacaacaacaaaagttgaacaaaaagagtaaaagaccatgggaaaatgtattattttcgtcaattcttatctccttattttatctactaacattctataaatacacacttagacatataagcttatagaaaccaaaaaccatactcaagactcattatgactagctctatgaagaaaatgattcttatcattttcatcacaaccatggttttatctccgacaagttttatctcttgtctcgcaggtaagtaaactgcttagttaactgatttaatttgagaatttacctatcaatttagagttttttttatgtatctctattcgcatatgaagatgttcatgctactgaaagtcccaccgaaccagcaggcaagaacattgacaaacctcatcactaaataatcagaacattaatgagagcattttcaatattaatttatcttatttgtaaacattttttaatgattattttgtagcctctcacgttactggaggtgataaagtagcatgtcctgcttgccgctgctgtgaaggcccaaaacctccaccgggaacttgttgccgttgttgttaaatgttaattaagctcaaaaatcaacttcctcgtaaactttagttaagcctcttaattactattagggttcaatatctacttatgttgttgtagtgttgtgtattcgtacttgtcttgaccaaataaaagtgtagctagccgcttaaatccatccgttgttaggatggtgctttggccaaagtgattcgaatataccttttatacacaaatacatgtttagaatgatgtgttattgtgttacacttttaattggtctttaattttcacacaaacatgcatgaataaatattctaacatatcatagagagtgttccacatcaaaaccaatttatagtggttcatggtaaaaaaaaatcatgagtctggtataaaaaaaacttaccataacatcatgagtatgttgtgtgatagtgacatcaaagagattgtgaaaatactaagattagaaaataatttgagaaaacatcagaaaaaaa

SEQ ID NO: 15219 - DNA, 3000 bp, Unknown
  misc_feature (1)..( 3000): cDNA_ID_3095585_gDNA_ID_2926086_Annot_ID_196454 3000 nt of promoter + ATG
atatgttttatttctcgcactggtcttgtctccaacacttccatgtcaagcagctagtgtccctctaggaggtaagctaattaatctctgaaatttctcccatctactatcactctctctgttttggtttttcatagggagaaattgatttattaatggaaaagtgaagggcgtaagatgatggcgccaccaccacctattctcatgtgtacacagtgtgcatgttgtgcaccggctccacccggttcttgctgccgttgtggctgttctggtggtccctgaagactctgacttatgctatccaatgtgctatccaaggtccttaattccttataatatgtatgaacacgtaaacaaaaagtgtattctgtgttttgaataataaaacctttgggttctgctcagtacttatatgtttataagttagttttgatgtcctccttggagagttgatgaactactgtaaaaaattaaaaatgtcgaaatcctagagttcacaacaatgtcgaagttaatctttcgggttatgaatgtaaaaccatgtttacaatacatgcatctttgtttgaagtttataaaagtcagctaaaaatggtacaaggttatttcttcatctatgcttgtacagaatttttaggtgctagcaaaggctcttctatcatcgtttaatatgaactcgttacacaaagtcatctcatgcaaactacctcaaggtcaactaatcgcaatagttgcaacatgtatttattgcaatatctatcaggtagatggtgatatcagaagatagtgtatatcaattaccgtgtgaaatcaaaatatagctgcatcatcaaaactaatggcttattttggtcaatagtaactagatttaatctcttaaatattttattgctaagtcctcttcttgaccaaacgtcccggctatataatcatcctctcaccatggttccaagtttcaacagcaaattggtttagttcaataagattttcacattcacacatcttaaagctgcaatgaaaaccgggtcagcaaaatccaacatcctcctatatgtttttgttctctcacttgtcttgtctccaatacttccatgtcaagccgctagtgtgcttctaggaggtaagctagttatctatgaatatcctccactatactgtatgtatgactctctctctctttcagttttttagagggattaatgattttatttttcactgaaaaggtggagggcgtaagctgatggcgccgtcaccaccaattcgcatgtgtccacagtgtgtatgttgtgcaccggctccacctgattcttgctgcccatgtcgttgtccaggcggcgcctgaagactgacgtttgctctcaatcaaatgggttattttgatgtgttaaatatgtgtaatctttataatatgtatatataagtaaataaaaagtgtaatctttgtattgtgaataaaataaccttgggttatgttgaatagttttactataagctagttttgatagtaacacacttttatacattgttttcttagttggtgataatgggatcacaaaagatttgatattatttggaaagaatgtttgacaaaaaatattaagaataaatgattcttgtttttagaaaatcgtgtgaaaaaccctcttcattatcccataaccgatacgtatcatttcaatcttcatcttcgtcacttacttacgaaatctcaaatgaccttttcccattattttatgttttaattgatttgcatatttgttgtgttgtgcatgtatatatagacttgactataagcatttgaatgtaataaccaatactcacttgtacatgaatttttttttatagttcttcaagatgacgagtaaacatgtttatttttgtaaaagtccactttgtacagtaacacgcagccaaacagcgcatgagaaaaaagaagtaaaaatgtattttccatcgttcatagttcaaagtagagtgtagagatgtgcctcttccggtcctatcactggttttgaagctacaagtaagagataacaaactttcatgagtgttactacagcgccgtcattcatccgaaactgagatgtgagtgacaaataagattgatgaaaccaccaaagtggtgtcgtggaggaaggtcttagctctaccactaagccaagcaagatagtcgaaacttcacataaacgagttaatccggttgcgatgacacttttttctaagagaatttgctaaaactcaaagtattactgcaattaattgtcttctacactacaagactatatgaagtgtaaagtctcttgattgagtgaaaaagttaaaacttgaaaaattaaatttttcttcggaccaatcctgaaaacgtgtttgcgaaatgttaatacatacgtgagatcacacctagttttgtagaaaatatatcaactatattttttctgtgacaaaaagttttatattatattaatttggatttccaagtagatatgcaactttgactaaaaaaaaatataatttgattaagaatataatttgcaactcgaatatgcattattataaagagttcctattatcaacaattggaaaaattcgctatgagtcacatgacaagatcacaagatagcatacttcgagccttcaattactacagacaaaagtatttaatagtatcgtacctttgactttaaacatcctttgtatgttaacaatattactgacgtcttaagataattcaagagtggcaaaaaatccatgcacaaaagctttaactacattatctcaaattaaaaacaggattcaaacaacaacaaaagttgaacaaaaagagtaaaagaccatgggaaaatgtattattttcgtcaattcttatctccttattttatctactaacattctataaatacacacttagacatataagcttatagaaaccaaaaaccatactcaagactcattatgactagctctatgaagaaaatgattcttatcattttcatcacaacc

SEQ ID NO: 15220 - DNA, 3000 bp, Unknown
  misc_feature (1)..( 3000): cDNA_ID_3095655_gDNA_ID_2926087_Annot_ID_196476 3000 nt of promoter + ATG
ctggcactcatcagagagacaaaagtcacatagtttttacgaccgacacaattgttaagccactgtagcaatgattagaactatgtcatcaactaaacccatgaaaatccagtcaaacatttgaaacatcagaaagcttaccttgcaatggtgatcaaaacaatcaacacatttatcacaacttcgacaatgcttgctgaacttgcgtacctgtgaaacatacataattgagtacacatctaaaatctgaaccaaattgctttccctaaagacttcttaaagcagattctagaagataaagaccaagaaattttagttattattaactgctcatacatcatttacttttcatattaaagaccatacacatgacaaatataaccatggagacttgatgtagaattctgaagcttagtacctcacaattgcacaatgtgcaaaacagagcctcttcgctgtttccttgttcttccgccggcccttcctttttccggcagtcttccacaacaaacacataacagaaaactgccagaggattatagcaagatcttctacttacagattccactctttgagcatcttctacagaacctttcacactagagtttccagccacggtagaactcctactgacaaccgaaggagaagcctgcaactgactaccagtttcatcataattccttgataagccacgaaccatgccatctccattcacgcctgtatcaaatatcgacatgattctcggatccgcaggattgattgcagtacaccgaacatacaaaacaaacacaagaatagcctgcaaaaacacacacgatacataaaggaacctatcagataagatcaatgccataaactacacagctgtggaatccaaaactcgttatgaatttgcaaaattgattctgatcataaacactactagcttgagaagcattaaacataccacgggagagtaaacaccgatcaaaacgtattcccaaatacgacctccaacaaaaggagcgaagaaagcatagaaagcgaccaccaacaagcaaaacaccgtaattgcaatcacctgagaagaaaaatacacagaacccaattgaaatcacagccattggtgactttagattgagcagattcatgaaaaattgaagctttggctatagagaaaggttacattcgattttacctgaagagtgtgagcgggaagttgccaaccgtgtttcctcaccataccttcttctccaacaacaataagcaaagataaacaaactctaattttccgacaacgtcaccgtcacgttgccgttcgccaccgccggagcgattaagtgaagagtgttgttgctcgttgaaaagggaaagggactgagaaaatatcgtctctctctgttactgtggcaggtttagtcttaattaagtccaaatggttgacccaacttttacattagtggataattaattataaataattttggtattataaataattttggcataattataattaaatttcaggatattggctggctttttgtcaaaaaatatatgctgtattaaattaaatcatgtcggaaatagtaaattaccaactggctattggctattgattatgatattttatgaaatttattttgaattcataaaatatttccaaaaatggtatttattttattgtagctaatatgtaaaaaaaagttaggaaataattttttttttaccaaactttttaacattagtgggactaattataactatggtttttaagactgagctaatctatatgtacaaaattaaaaagaacagtgactcatgctaatgagtggctattgatttatttatttttttggacggctattgatctttttattttggatcaaatataataaattaatccaattctgaaatagtcataccaattggctcttggctattgaaagttggtaaaagcatttactaatatatatatatatatatagtccaaattcaaaactgatagtttgtaaataacaaaaaaatattttgaatagtttactatgatttttttttgtaattcaccgtaatgtttcagttttcaccatagtaaatacttagaaatacaaaataaaataattcaaacaagtcttagtcttagagtggaccaaacaaattttaaaagcctaaacaagtctactcttatagatgtaagtaaatctcatcattcccattattcacgcttccctccaatttttgttttggcatgcgcgttgcacaaaatttcaaacaaaaacagtttttttttttctttctaattttattttattaataacataaataaatggatagagatattattattatcaaaaaacatggtgatgcgtttagacagagagaagaagaagaagaaaccctagacaccaaaagaacgaatcgtggatcttccgcccactcgcttcctcagatcgcgtgaacaccactcaccaatttttcttctctttctctcttcttcttctctatctccttttcgcagatcgataccccaactcgcacccgattggcgcgtgttgtcttcttcttcttcctcctctcgacgacgaagagattaaaaagagacggccttttctcagtttctgctccgattcgtatatcttctgtttcgtacgaggtaaagttttcatttttattttttgtttttgttttatagtgataaccaacacaaatgattgggttatacagtagttttgatcagcttcgttttaggaattggatttgaggatttcgtttatgtgatgaaatacccactaagaatttagctgcaagttgcttttttctgcaattgtaagggcaaaatgtgtatactttctcgatttatcatcatagaaagattgaattttgatgggtttctctggtttgttacatcttttgtgtgtgactttagtatacattttgacctagatatatgtactgagacctagattttgtcttgcagtgttgtaagacgtttgttttgcctgagactataggtttgtcatg

SEQ ID NO: 15221 - DNA, 3000 bp, Unknown
  misc_feature (1)..( 3000): cDNA_ID_3434408_gDNA_ID_2926087_Annot_ID_196481 3000 nt of promoter + ATG
aaagctgatgaattcttcttctaagtttgatctcgtaaatgtttaattgaaggatctagggttttgtaggatggattcagatttggaacctgtagctctaacaccacagaaacaagacagtgcgtggaaacactgtgaagtttacaaatatggagatcgagttcagatgagatgtctttactgtcgaaagatgtttaaaggaggtggtattacaagggttaaggaacatcttgctggcaagaaaggacaaggcactatctgtgatcaagttcctgatgaggttcgtcttttcttgcagcagtgtattgatggtacggtgagacgtcagaggaagagacgtaaatcaagtcctgaaccattgcctatagcttatttccctccttgtgaagttgagactcaggttgctgcttcttctgatgtgaataacgggtttaaatcgccgagttcggatgtcgtagtgggtcaaagtactgggaggacgaagcagaggacttataggagtagaaagaataatgcttttgagaggaatgatttggctaatgttgaggttgatcgagatatggacaatttgattcctgtggctattagtagcgtgaagaacattgtgcatcctacttcgaaagagcgggagaaaacagttcatatggctatgggacggtttctgtttgatattggagctgatttcgatgcggcgaattctgtcaatgttcaaccgtttatcgatgcgattgtttctggaggatttggtgtttctattcctacacatgaagacctcagaggttggattttgaagagttgtgtagaggaagtgaagaaagagattgatgagtgcaaaactctatggaagagaacaggatgttctgttttagttcaggaactgaactccaacgaaggacctttgatccttaagtttttggtttactgtcctgagaaagtagtgtttctgaaatcagttgatgcatcagagatattagattctgaggataagttgtatgagttacttaaggaggtagttgaagagataggtgatactaatgttgttcaagttattaccaaatgtgaagatcattacgcagctgctgggaaaaagttgatggatgtgtatccttctctatactgggttccttgtgctgcacattgcatagacaagatgcttgaagagtttgggaagatggattggataagagagattatcgaacaagctcgaactgttacaagaattatttacaatcacagtggtgttttgaatctgatgaggaaattcacttttggcaatgatattgtgcaaccagtctgtaccagttccgctacaaattttacaacaatgggaagaattgctgatctaaaaccttatttgcaagcaatggttacatcatccgagtggaatgattgttcgtattcgaaggaagcaggtggattagcaatgactgagactatcaatgatgaggacttctggaaggcattaacattggcgaaccatataactgctccgattttgcgtgttttgaggatagtttgttctgaaaggaagcctgcaatggggtatgtctatgcagcaatgtatcgagcaaaagaagcaattaagacaaatctggctcacagggaggagtacatagtgtactggaaaattatagataggtggtggttgcagcaacctttgtatgctgctggtttctatttgaacccaaagttcttctatagcatcgacgaagaaatgcgtagtgagatccatttagcggttgttgattgcatagagaaattagtccctgatgtcaacattcaagatattgtcattaaggacataaactcatacaagaatgctgttgggattttcggaaggaacttagctatcagagctcgtgacacaatgcttccaggtacgccatttattaattgaatctcaaaaagatttcatatgttcaagtgttttgtaagtagttaaaacatgtttgattcctgtagctgaatggtggtctacatatggagaaagctgcttgaacctgtcacgttttgcgatacgtattctgagtcagacatgcagctcatctattggctcagtgagaaacctgacatcaatctcgcaaatatatgaatcaaagaactctattgagcgacaacggctcaacgatcttgtatttgttcagtacaacatgcgcctcagacgaatgtaagttggaatcttttgatcttcttgattactatactgtcttttgttcaaaacagaacttaaaaggattctctgtctgtttcctctagtggcagcgaaagcagcggagatgacacggtagacccgttatcacacagcaacatggaagttcttgaagactgggtttcgagaaaccaagtttgtatagaaggaaatggaagctcagactggaagtcactcgagttcattaagaggtcagaagaagtagctgttgttatcgacgaaacagaagacttggggtcaggtaaaagctttgcagaacctagtttttgtgaatatcttgacaaacatgagagaagttgtttaaaaggtgttttgaatgaaatgcgtaacaggtttcgatgatgctgagatattcaaaggggaaaaggaagcgagttacgaaggcggttattcggagaatctgttcacttgaacttgcaccttttcctgtaatcatcatagggtttgattttgtgattctttcttagggtttgatttgtattattaatagaagtctttaccagctttaagttgtatcccagaaactaatagttactcttcttcttcttcttcctcttcttcttctttactcagtaatgagaacaaaaaccattttagagatgttgattgatatttactaaagctttctctcttgtccatataatattgtttggacataagctaatcttgattctttaaaaggataagtgaaaaaaaagagttgaattcagatgctatctatataaagagatattattatcctcaagagccttatcctgaaagtttggttctgagaagaagagaagaaaatg

SEQ ID NO: 15222 - DNA, 3000 bp, Unknown
  misc_feature (1)..( 3000): cDNA_ID_3095628_gDNA_ID_2926087_Annot_ID_196483 3000 nt of promoter + ATG
tgtataaaatgatttggtgtataagtgttagtgtataaaactatgttttattgctggtgtacgagaatgataattaaaaacatataaatcatcttgtctttggaagaagaaattatttaaaaaaaaatatttttttttaataaaattcaaaaagatgaatatgaaaaaaaaataactataatataataaaaatagttctaaatagttaaataatataaaaatttagactcatattttctcatatgaagtaaagggtaaagtggtatttgacatatttttgtcttttagcttattacacataacctctatttcataaaaagtaaaaaaaatgtctatttcaccaatttctaaaaaaactacctacttctcaaattattttttaaaaagtgtctattattctaataagccctttttttttttgaaaaggtattcaaattttataaataaggtctattgggatatttccgaatttagattcatacaatttttacttagtatctaactaaacaaaaccaatttaaacaaaatcgaaccggtcctatgagaaccttaatctcaaatcgtaaaacacgattgaaccgccgtttatgaactgcagaagggattcacatatcctctagatagtacttgttcaatttgtctctttcaacttggatgccatgagatggtccttggaacattttagtataagcagaagggattcacatatcctctagacgtaaaacaaacatggttttgaacccaaatacattacccacagtcgaggtatacatggtagtaaccaaacattcatcaaaaagatctaaggggtaagttattatattcgcaataaattgaggttttttctcccaaaacgggtttgatgtggtagcatcatctttgaaacgatccaggctggtatgccccatcgctttagtttcccatgttccagtagaagattcagcagctaccgcatatatcgtttcttcatcgacactagctttgtatccaacatttgctttagtctttgttttggtgagataagtccctcccaacaagccatatatttaaaattcttgcaacaaaacgaaacaacaaggtctactagacataaattaagatatatcatttagttaaccttttcacatgaattttcacaaaattaacaactattcaaaatgattcaatcagaatgattcaatcggaatgattctgtattagaccatgatgcttgattcgccaaatacatcatttagtatatatttttcatatgtatagcgcaatctaatacttccttttcacgttacgttatctttgactttttatatatccaaatatttaatattaaaatcttaataaaatcactcttgacactaaatatgtttaagaaacctattgcctattctcgatgagaactaaagcaaaagtttttgtaaattgttttttatacatatacatttcagttttaaattatttttcagctagttgagttccaaatgactattccatcattggataagaaaaaaataactccacatttgccagggtgataccaacaaaattaaattctaaatcccattttgttttgaagtttgggttttgtgaaaaaaacttcaaaatcgtctttttgcaattttgacctctctcttaaaaattacataataatcctattaaatataatatgcaatatagccgttatacatatattgtaaacgttttcacgatcacgtatatttgttttttaaaattctaaaaagaaaattaaactcctcgtctccaaggtttcgttttgatatattatttatcaagatgttaacaacttgacaataccaaaaagggttttaacatcaactttgaatccaataattgccttagtctctgtttttggtgactataagtccctccttacaagttatgaatttagaattctttcaattaaaagaaaaaacaatgtctactcgatataaattaagaacatatcatttaataaattatcctttgcacaagaacttttcacaaaattaacaactaatcagaatgattctttattagaccatgacagcatatggtgataaaaaaaaaatcaaaaaggctagtgagatcgaaataatatatcataactatagttctgtttcgaattaattagataaaacaaagtatttcctattgcatattctactataaatatgatcatagattcatagtaaaagactttttgcaattttattttattcaaatatattttattttattactatgtctcagttaattgagcttgaaaatgaatagtactttactgaataagtaaaatatttttgaattaaccgatgaaatcaaagttttttctatatctgaaaatattcgcaacaaaagttaacatttttctgtttggaattgtaatatttttttttaatatgagaataaaaattccattggacccaaaaatgatacattggctaaaatctctttttcttttactcctactttgatgagtcctactactttggatccagaggtttcaatacgcttttaaaaaacacttgtggaatatttatgattcttcatcatcaaaacttgtgtttaactccataattaattcatggttcgagctagagatatgttgaaatcagctaattttcataaatgtcagatttgcaatttgaattttgttttgattctgattaagaaagacaggacatcggagtttttttgaaaaaaggcttttaacaaataatagaggttgaaaaaggccgttttcgtcgctttcctcttcccttttgcatttcacaaaatagcatttactttttcaccgcaattctttgttactcgacaatcacttgtgacttagttacattaaaaaaaaagtggtggtatacgacttggctaagatgagtctgttctgtatatgtttgtaagaaaaattaaaaaatggtggtacgtcttccttaaattaagtccacaacactcgctccacttcatatttctcccttccatcattcctcagctcctcaaatcagaatg

SEQ ID NO: 15223 - DNA, 3000 bp, Unknown
  misc_feature (1)..( 3000): cDNA_ID_3594430_gDNA_ID_2926087_Annot_ID_196482 3000 nt of promoter + ATG
aactctcttttaatgatctgtctgcctacactattggcagttgtatccagggttgcggcgaatgtgtcatgtgctgcgcgtcaggattttcaggatgatgagactcaagactttgcccaaaccagaaaaacaacatatacgtaatagaggattcatcagtatgttatttgcttcactggttgaaagagatccatgattcccatttgcttcgtctattttgtttctatataaatcaaagtaaaaaacaaaaatagctagtcataattcgtagcaacaaaatatgacgtaatgattttttattcctaagtttaatacaatatataataatataaacaacacctaagtttataaagttgttttcctttgcagtttaacagatcacaccaacataaggaacaaagccaaaactattaatcatggttcaaaggcagttggttaatcactttttcattttcatgaaatgttaaattaattaatcatcaaaagaggttatttaatttacatagagtttagagcaatacccaaaaaaaaaaaaaagaggttctaaaagacagttccaggaacaaaataattcaaatttgttaaattcctcatgttttacgacgtcatgtacgtgtacgtcatgtacgtgacgaaagccatttctgcaacaaaccatttctcactttcatctcaaccataggtatcgctttcctctgcccttgtgcatttcaaacaatatcatttgctttatctctgcaattatatatgtgttggatataaccaaaaaacctagacctaccacttcgctaaggtaggtctgtccgtgagttgtctgtgattagatgtttttattgttcaatattgactcttctttcttttatataatgaataatgtaaaaaatttcctaatatttgtctaccttataaattagaagcacaacactctctcctcttcacaaatctcacatcctcactcctcagctcctcaaatcagaatgaatcaatccgcgcaaaattacttttccggtaattatcttcaattgttttctaaaatcatgatcaatgtctaacgtataatcatgatgaacaataattctttactcaccaactagataactttttttttttttggcacagtgcaaaaaccttcagagacttcatcagggccgtacacaagtccgccaccaattggttatccgactagagatgcggtggtgggtgatcctccggcagcagcagtggagacaaactccaagggcgtcaaccccgaagccataatgagttgttttaggtacgtgtatatatatatatatatatatgtttataacttggctctaattatccaagatgttatttttttatatatccggcgttctactttttttttttactgatatgtctgttgacactattggcagtacttgtatggagtgtatcttctgctgcggcgtatgctccagcctctgtacatcagagtaaatcagcatgatgagacagaagtcgttgcccaaacctgaaaaacaacacgtgatagaaaatctatatatatatatatatatatatatgttatagtagtcgtttctatggatttccacgcattttaaagtttatttgtttcactgtttaaaatgaatcatttgcttcgtgtattttgtttctatataaataaaagaaattaaaaaccaaatagctagtcataactctttactactcaaaggaaactgtgttttagtgttcttaattacatcttgtttctgaccaacagtgaatgatccttgcatgggactcattaacttcaaaattaacgatttcatacaaattattgttgtaagaaatagataaaaaaaatgtttgacgatagtgaggaattaaggatggttgtgtttcgctttaaagttttaagtgaaccaaacggatgtgcgcacagttcgatttacagttttaagtggttgtgactttatccaaatataattattacgtgaaaaatgttttttttttcaatcaccaatcaatagaaaacacatgaaaatattatccagcgggataataatagacgagctagatttggtatttttatgaatgcgatcttttatgcattaatcaaccagaatttgcaaaatatctgagtctgatgctaattggattagaaaatatctgaatcccggcaaaacaattgaccttcctatacacgtgaacaatgcggactatccagtcctttgcgagaaagccatagccagtgacggatctagacccaaattctatatggggcactttatttataaaatactagttaaaatttaattagctaaattatattatgattttaaaaaacattatacctaaattacagttttgggaatcgaaattgggtttatatgaaacacactttactgtaaaaccatcaatgctatctaaattttcttgtacatacatagctaatacactatttataagatttaaaatggggcacatgcccacccagcttcaacatgggtccgcccctggccatagcacaattgtacaaggaaagactttgggtgagaatcattaatccttgtcttgagaaacccaactacaaatatcgaatcaatctccagctccactcttatgatttgcttctcccaagcgatataaagcccatagtagactctccgtaattctggtagaggtgcagaacaacgtccaatgttaaccgtaaaaccgtcacagcaattacgttctccatcccgcagagctcccccagcttacgaatctcgactttagttttgtaaaacaaaacatataaaacgatgtccaaacaaaacatataaaatggtgttcaaaaaaatattttcgaatttggtggtttcagggcctaaaacgatataagaaacttacatgggccttttaggatcatctcattttaatgggccgaattcgatattgaaataaaacaaattagggttttactcagcacactatataaagacaatcatctcttcaattagggtttcttctttgcggtggtgagaaacaatg

SEQ ID NO: 15224 - DNA, 3000 bp, Unknown
  misc_feature (1)..( 3000): cDNA_ID_3095643_gDNA_ID_2926087_Annot_ID_196479 3000 nt of promoter + ATG
aaaacatcacattgctcaaattctctttgatatctcataaagtatactgctctgagtcttaacaggacacagagagtagcaggaaattgtaggaaaacattataaaaatgacaccaaaagggaaagtctggagtaccagagaaggtttagtagtacggttccaaaaggagtgataaaacggcaaggtgttcaactgttcaacagcggcagaaacaagccttggctcatttcctcctgcaaggttttgggttaacaatgagggtcagaatcaaggaataccaaactgcagaaaaagaaacatcaattcatgtttagtagtattagaaggaagaatacctaaggcagtacaccataaaccagcgagagagtcaagatattttttcccagtatcatcatacacataacttccctgtaagaaaaacgtcacacttacacaactgtttgactcaacatttacactatgaaaatgagattttgacatgtacctcagactttgcaatgaccaagggatctaaatcagcactctgccatccagcagtaaaaggtgcaagcatatcatgccctttagacctgctcagaataaaaacatcaccactattcatgtctcgttgacgacgctataaagccttcagaatacaacgcttagaagcattaaaaaataactcacccaacagtgtttttcttctcaggtgctgcctcagtagtgaaaatcctcctggaagtggagttcccagacatgcaagtggcatacttactgtgcaaatgaacctgccattagagtaaaaatattagcactataaatcacatcactgtttttgggttaggatataatgatctccacagaattttcttcaaatttatctctttgttataagaagattatcattcacaacaagagatttgttccactttatgagaaaaagtttgttccttgattactggagaatctcagaaaagtatatactctcgaaaagacatgacctttttcatcctgatccacgtcaatttggcgttttgaaaaaagattagatttttatttacaattgttggcatattcaatgttattctgactcctgatctattaagcaaaacattcggggaaaattatgatgatgcaatcgaggatcatgtatgtgagaataatgagatcatcaagcgagtaagaagaagtggaagaacctgagtggtacgcgccaagcgtcggagactgttgataacgaccattttctcctacaacggatcgaagaaaacagagagagagagattgttaaagagaggatcaaaggagaggaatctgaagaatcctggattgtttgagagggagagctgagattggttacaaaacagaggatgatgaattgatgatgatgatgccttatatctttttatttatttaatcttttcgagttccatttgattttttccagtgacgtgtcattgagtcattttcttaatattatttttgatttattttattttaaagggaaacaaatcattttgctgctctctcacagagataataataataggttgtaactggtgcagtagtagcaagggaaagaaaaaacaaataagaggctagttgtatatagcagccataccataaaaatatcaattaaaattttattatattttctgctgaaataaataaaatggagaaatatagtaaaaaaaatcactccaatttgaagaaaaaaaaattatgtctcgatgtggaacacattttaatacacttcttccctcgcgtttagaaatggacatctgaaacgttaaggttatgggactggacatctatatatggttcacaatcgagacacattaaaactttaggtttatagcatattagtatgagcctaactcatacttaaaaattacttcaagtggaaattttaccatatatttatatattattctatacataaataaaattttatgtaggacatattctaataacttttctttgtgtgtttgtttttatctttttatttttcatttactaaataaaaacaccaactaggccaacccaactaacagaaaaagtagccaaatttgatggcatatttcaatttctaaggagggatagtaggaaaaactggagtaaaaattattttaatatacgagtttccataagattattacataaccatgtgatagttgttacgtctaacaaaagtaaacgaaaaaataataattatctttaatttagattaaaaaagatactaataatgatccaacattacaaaaactagtgacatcatataattaggtgacacgtcaacttattttgtcttctccattcaaaatatcagactgcaaacaagacttacacacataaatgcatgcattaattaaaaaagagaatcaaacatatttcaaactaaaactgcgtgccgtttcgaggtcaaaaaacgccgccaaattgaagaatagagcacgcgtacggcgtgcaatctaatctatcattcaatcaatcgtatctgagagaggagagggaaaacgaaacgatcaatcaagtcaattcctatctatctgtatatgttcgttcacacacatatcccctagagagagaataaagtatggacctttttctttttgtagagtagagagagagaggaaaaagtaaagtagccgagaaagacgctcactgactgaagaagaaaagatcacgaagtcgccactcactctctttaaagatctcatcggcgatctttccttcgccgccggtgtaaagtttttgaattttgcttctcctcgatgtgtctcaattttgcaaagtttggattttttgttagtgttcattactaaatttcttggttttaatattaaggatccaacattgtcaggagaatttagtgaactcaattaaagtttccatttttgtctattttgttatcaaaaaggagaaagctttactgttttgaataatttagttgctaaattggcaattttgcaggttttgtgttgttttatgttgctgatcgttggaattgagatagaatg

SEQ ID NO: 15225 - DNA, 3000 bp, Unknown
  misc_feature (1)..( 3000): cDNA_ID_3095648_gDNA_ID_2926087_Annot_ID_196478 3000 nt of promoter + ATG
cttcatctttccctgatttatagatgcacttctcaaacttaggcataaaattatcatgttgcttaacaacttgaccaagattctcagaaaccttcatcaatacatgccaaagaaaaaggcaatgccgtgtattggggaagatttcgggaacaatggagttcattacaacgtctagctcagtgatcaaaacctttggagcttgtccaccgattgctctcagccaggtctccattaaccaagaatatgttgctgcactctcatcggatattaaggcgcacccaaggaccatatactggtagtgctggttcactccaacaaaaatagcaagtggcatcttgtacttgtttcttacgtaggtggtgtctagagaaacaacatcacaaaaactgccatagttatgcctgctctttgcatctacccaaaatacattcttcactcgctgatcatcgcccagatctactgcataaaagaagttggaattcaaggattgcatccgtgacaagaagtcaagcaggattttgaaatcccctgtttccactgataaagtccgacctttttcaaaagaacttttcgaatcgctttttagacttataacagttttgtactcagcaaactgcttagccattgcagcatatatctttctggtctgttcactcacagcttgtgcaggtaaaagctcatgattatgctccctcacaaagctgtgaattacccatttcccatccggccttctcttaacatgcatactagctttgcaatcggttttcgcacatgttctcctaccagccatattctctggatcttgcttactttgtctagctcgtggccgattaaaagatttgtcatattctcttttagtaccatacctagagcaagcaaacttcgcatcaataaactctcttgtagttttcgatctacgactgttctgtatcgcagtgttaaaccccatagctcgagaatactcctggtaaaacgaatacgcttcaccgtgtgactcaaactccataccattaagaggttcaagattcataccctcagtgtactcaaccaactccccagttggaacacccatgcctacactgtcatcagtattaacctcaacagaaacatcctcaattttgccaatatccatatcttcttcattgtgtaacacattatcaagtcctctatcctcatcatctcctttgcaaaggtcacctgaatgtagtcgaagatctatatccatgacaaacctatagtctcaggcaaaacaaacgtcttacaacactgcaagacaaaatctaggtctcagtacatatatctaggtcaaaatgtatactaaagtcacacacaaaagatgtaacaaaccagagaaacccatcaaaattcaatctttctatgatgataaatcgagaaagtatacacattttgcccttacaattgcagaaaaaagcaacttgcagctaaattcttagtgggtatttcatcacataaacgaaatcctcaaatccaattcctaaaacgaagctgatcaaaactactgtataacccaatcatttgtgttggttatcactataaaacaaaaacaaaaaataaaaatgaaaactttacctcgtacgaaacagaagatatacgaatcggagcagaaactgagaaaaggccgtctctttttaatctcttcgtcgtcgagaggaggaagaagaagaagacaacacgcgccaatcgggtgcgagttggggtatcgatctgcgaaaaggagatagagaagaagaagagagaaagagaagaaaaattggtgagtggtgttcacgcgatctgaggaagcgagtgggcggaagatccacgattcgttcttttggtgtctagggtttcttcttcttcttctctctgtctaaacgcatcaccatgttttttgataataataatatctctatccatttatttatgttattaataaaataaaattagaaagaaaaaaaaaaactgtttttgtttgaaattttgtgcaacgcgcatgccaaaacaaaaattggagggaagcgtgaataatgggaatgatgagatttacttacatctataagagtagacttgtttaggcttttaaaatttgtttggtccactctaagactaagacttgtttgaattattttattttgtatttctaagtatttactatggtgaaaactgaaacattacggtgaattacaaaaaaaaatcatagtaaactattcaaaatatttttttgttatttacaaactatcagttttgaatttggactatatatatatatatatattagtaaatgcttttaccaactttcaatagccaagagccaattggtatgactatttcagaattggattaatttattatatttgatccaaaataaaaagatcaatagccgtccaaaaaaataaataaatcaatagccactcattagcatgagtcactgttctttttaattttgtacatatagattagctcagtcttaaaaaccatagttataattagtcccactaatgttaaaaagtttggtaaaaaaaaaattatttcctaacttttttttacatattagctacaataaaataaataccatttttggaaatattttatgaattcaaaataaatttcataaaatatcataatcaatagccaatagccagttggtaatttactatttccgacatgatttaatttaatacagcatatattttttgacaaaaagccagccaatatcctgaaatttaattataattatgccaaaattatttataataccaaaattatttataattaattatccactaatgtaaaagttgggtcaaccatttggacttaattaagactaaacctgccacagtaacagagagagacgatattttctcagtccctttcccttttcaacgagcaacaacactcttcacttaatcgctccggcggtggcgaacggcaacgtgacggtgacgttgtcggaaaattagagtttgtttatctttgcttattgttgttggagaagaaggt

SEQ ID NO: 15226 - DNA, 3000 bp, Unknown
  misc_feature (1)..( 3000): cDNA_ID_3095770_gDNA_ID_2926088_Annot_ID_196498 3000 nt of promoter + ATG
ttgtgtaagaaaaaaaacatattgatctcccaattcaccacttgcatccttccacgttgataagagtcaaccaaactccattaaacaaagaaagcttacgactaattgacgagagttgatggcctagtgatctttaaaacttcgataactgagactacgatggagtagattgtaatctatagtgtgctacacttcaaccacaatactaatgagtaacgtagatataacctagcgtacgtagtttcatttgcatacctttaaaatttctaatcttgaaatgaaatgaaaccgctatcaagaaagaaagaaaaactaacttgatcgaactatagaaattctcaatatatagcatcctataaaatccttggaataatactttcgaaaaagtactggtatccactatcaaactatgcagagtacgaactaataatatacatcgattggtctttatcacacgtttataaaaaaaaagaatccaacaaatcccaatattgtgtgttttaactgatcacaactcacaatatccaatggatcaatcatattttatggagaaatctcaaaagaaaacgtgccttatttcatctctatttatacacacacaaaacactcgtttatttatagcacaaaccttcatctagagacacaaaaaccacaacatgactaacctcatccttatcttcgccgcacaaatcctccttttctatgccgttgcttccgtcggagatgaattgggaagaaccatgaacgggaaacaccttggcccttacaaaaaggagaaactcactcatctccgagtctattggcacaactctgtaaacggtagaaaccctagctccgtgatgatccaacagccggtcttgaactcttccttatccggatcgatcaccatgatggacgatccactaacattcgatgtgccaaggaatgcgactgtggtgggccaagcccaagggatgtacgtagcagcggcccaaggagagataggcttcttgatggtgatgaactttgctttcactacggggaagtacaatgggagtacgataacgattcttgggcggaacgtggtgatgtcgaaggttagggaaatgccggtggtcggaggtagtggaatctttcgatttgctagaggttatgtcgaggctcgcaccaagtcgtttgatctcaaggccggtgttgccaatctacatatacatttttgcagccattttaacaaataaatcttagagttgaacttatttacaacccaatgccattagcattaaatttttttttcaaaataattaattttacattaaattcttaatttaaattgtcaatcacattatcaatcaaatttaatccaaacaaactgcacatcaatcctttaaaattagcataaaagtattttgttaacaatattttaaaacaaagttttttgtttaaataaatattgttcttactaaacgttttttgtttaaataaacaaatcatgtatttgaacttatttacaatgtcatgctactgacattaattattcaggcatgaaaatatttaattaaagatttaaatcttctaaattcttgcttttagaattattatatcattacctaaaaggcaaaaaatattaattttttaattattattatttatatatttaaaattcataaaacactattaatatttaaatttataaaaagtttaatatatcaaaaaaattaacatcattatataatatatagagtttaaaaaatctcaaaaaaaaaatcgtcatattttgtgattcaaaattttaagaatgaacatatattaactaattggcgaaaaatgtatggattcaacgtcccgcaacgaataaaatattttgacaatgattcataaatatattataaataagatcaacattaataaaataaataaattttttttgtggacgggtttggcgggacgagtttgacaggatgttacttagtaacaattgtaaactataaaataatttacaaatttttacatatattaattttaaaaaatgaattgtctccgcggtgaatctagtgttgaatataattgttatattctgcattactgaaataattaagtttggaatattgttcatttgatttcattacttatttgtttttatgtctcgttttgttatgagagtgttattgtcttttcccaagttaaataatgtattttatcttgtaatggtttgattttattcatctaaaaaataaataaataagtagttgtttatatatacattaaacatacattttttggtcaaattaagtggcacaaaggctctactccgcgttaatttggaaaatcatcaactgattagcgaataaattatttgaaattttgatagaaaataaatgttcaaataaatataatgattagttagcccaatcacgagctaatcaaaccttaaaaaaaaaacaccaaatcaaacctatttattgtctaaaaccaattttgatattacacggagaaattaaataatacatttagctacttttttgtttgaaatagaaaagacattcaaaatagtaaacatataaaaccattgtaagaaaagaaatcaaattttttatttcttaacaaaaacgtgaaacgtttgtttccaaattagtcgcaagtcacggaccgtgtgacgcaaaaaaagtccattcacatcattattacataatttttgtcataaggaaaattaatttgatttttccaaatttttttggttcttcctcttcagaatatctgacgtggcataaatatcgcctttttcacatcgcctgtcttcttttctctctccattttgggaactttcatccataaacttctatttttctcatcgcaaacttgaaccgtcgtaaccctaaatcgccatcttcatcatcggcaaatcgaatctccgattatatatcaaatagcttaccaaatccgacatgacccaggccctcgttttcggaggactataatgatcggactcttcgtgtcccgtctcgattgcatggggtttgagct

SEQ ID NO: 15227 - DNA, 3000 bp, Unknown
  misc_feature (1)..( 3000): cDNA_ID_1388484_gDNA_ID_2926088_Annot_ID_196500 3000 nt of promoter + ATG
tgggctctaaagataaaaatggaagcttcgggattaagtagagtgtctctcaagtctcaaggaactttaggttttttgttaatagagcttcttcatccacataatagaacagccttttttaagaacgtccacacctaaattgctgaagcttgaaagaatgacgaccatgggcgatcttccaggcgatttggtagaggagatactctctagggttccgctgacatctctgagggctatacgatctacttgccaaaagtggaactctttatcgaaaagtcagatttgtggtagaaaagcaacagcagcagagaataagtttctggggtttatgatgaaggattcaagggtttgttcaatgaaatttgatctccaaggaatcagaaacgacgacggggagttggttgagccatctataaagcaagtaagtaaactcgatcaaatcgaggtctctcaagtttttcactgtgacggtttagtcctatgcatcattaaggacaacacagggctcttggtatggaacccttatttggggcaaactaggtggatccatccgagaaacaattaccagatagaagataggtatgctcttggatatgataacaaccgtaaccacaaaatattgaggattttcgatttgtatccaagcagcaaccgcgtttttgggtacgaagtctacgattttagctctaattcatggaaggttcttgatgtcattcctgagtgggatatacagtctcattttcgtggcgcgtctttgaaagggaatgcttattttcctgcgcaaaagaaagaaacagtgggaggaataaagacaataaatattgaagatgttctactttgtttcgattttacaagggagagatttggaccgcctctgccactgccgtttcactcttacaatgcagacttttttgtgtctctagcttgtgttagggaagagcagctcgctgtgttatatcaacgctggggggcatttgagacaatcgagatttgtgttacaaataagattgatcccaatacggtttcgtggagcaagtttttgataacgtccactggttttccggttgacactttttctgggagctttttcattgatgaggagaagaaagttgctgtggtttttgatttagatagatataaaccgactgagacctgtcgctaccaaatagtttatattattggacaagatgaatacttcaaatctgtcaacatgggagttgccccaaatatcgcgaagaactcgtaccaagcttactgtgttccacttgtgtgctcttcttcctatgttccaagcttagttcaactacaaatcaacaaaccgggcaaaaggaaagaaagtaactagttccatttacactactttttatatttttcttgcatcatcttcttttgtttcattccattgactttgatgttcttttgaacgatcattaacttgtgttttgctatttatctgcttataaagaagtggggggttttgtgatacaatcagctcggcctttaactaaaatcatactagttgtttagatgtaggagtccatatggaaatagatagataagttaagagaatcatttactgcctctgtttataaaaaaacactcgaggtattggaaatgtttcatttgtttgatggtttggtggtctgatgcatcgtgttctgtgttttggtttcttaaactcttgaatgaaattaggcataaattttgagtcttccctcagctttatccttgaacaacctttttaacatcttgaatttacccatttggagtacacaaatgcaaccattcacaaaccttctcccacattcgcgccaaggacaattccacccatgccacgcttatagcttagcttggattgctcccatctctcgcacttcaaaacatagcttctttgaatgcaagaccaatatacaactccattcctaacgattaatgggcgtctcacttcttctctgaatgtgccatttacttccaatttgagcgacttgtgggttttcatcatccgagtgtcactatcgggaaatatgttacggcctaaaggaaactcatcccacaaactgtggtatattattctcaacttcaaactcaaaccgtttcattgcatcctcatccaattgatcaatacaaagggaaaactaaaacatacaattaaaaccaataaacaccaacttcttaagaaactagcttgttgccatgtcattaatcaacaagcaatctcgagtaaaaagttatattacattagttccttatacatcaaaatctggattttacaaggagagctgtgtgaatagcaattccaactccttctcttgagacaatgttctctgtccaacaaagaaacataagttagttagtttcaaaggtgtttcatatagagtagtaatgtgaagaagaagaggattgacttacttggacagataaaaggtcgttgattttgttgagaaccttgagacgatgaactgcataaacactgtttgatggaagtttacaaacccttttgatctcttcctgaatcacactcgatttctcatcacaatccatctcattccatctttctcccacacgattacctctgcttcccatttcgtaactgattcctcagctgaaacttcaataaacagacatatacaatgaaaacggaatcagttattacaaagataaagggctcgaaaaataacaactttgtgttcgatcgaaaatagaacaaaacagaacagtgggaagaaagattgagtttttacatcaagggttacgaattcagagctcgcagtttccgattttgtcacactcaagagaatttgcgaaaagaagtgatcgagaattgtcttccagccctaaattcgacaccggtcttcttatcaaataattttggctttttcagttatttacttacccgacccgtaaactaacctgtaacccgacccgggacctagctcactaagaaccctttaagccctaaaatctccgatcacatctgaattttgcttcttcctggcaatg

SEQ ID NO: 15228 - DNA, 3000 bp, Unknown
  misc_feature (1)..( 3000): cDNA_ID_3095757_gDNA_ID_2926088_Annot_ID_196502 3000 nt of promoter + ATG
atggaagttaattacaattagaataatgtgtaagacacaaaataaagaggaaatggtccaaaatgtgtaagtatagaacagagcacaatcacaggtgagtagttcaggttcggtgtcatctagtaaacctccgtggggtccgattccatcccctaatcattatctctctaatttcactctcttttcttttctttttttactttctctcattattactacaaaaattttaaaaactaaaatccttagatcatgtggtcctcctctatgcaaatttccacgacgcatgatcccacgatctctcttaaatcaagtttcattatttgtctattttagaatttggaacaagttatatattcttttatctgtgaatatagttcaatacttcaatatgttggtttgtgtttgaatctgattagtgttaaaagagttgagataattaatctaagttagggcttaattattgtaggtcccgaacgtcctttgacgttagctctgtcaccgtcacgggacacatcttcaacggcggccaatgctgtcacagctgctatcagtctcctcctgtcacacacattaactatacactttttttttttttccttctcaacaatagacgttattgtaacactatttgggtataaatatacaattaagttgatcattcatgaattaataattcttcaaaactaattaaaaaccaaaagtctataataacgacaacgttgaatggcgttttttgctggggtaggtgccggcatgagctagcatgtataatgttttatagtagtaaccacaccgacgtaaaaaaaaacaatacatatatttctaatcagtttgtggtgaatatttaatttaaggaatagtctatatacattatacatattttatagttttcgtttgaatcaaagcttcatgcacttcatatatattcaaaaaacgatttgaattttatcacggaacaaaaatatgtgaattagttcattaagtttcaaagctgtccattgtcttctgttgtcgagacagctaaaactgccacgatgaatggttacaacaaaaactcaacgtttgttgagataaatttgatacaaaaattcccaatttcacaatgaattcgcaaataggataccgtaacgctgccaaaattattctaattggttgtatgtagaaataacgaagttttatagaattcttcatacgtcggtttctctaacgacatacattgcaataatttgaaacatgaattaatataaaatacaattgcatcgtgcgggccatttttcattaagaaaatcacatgcacgtttttaaggactctgtttcctcatattcgttattagattatgtgcatactttagctaatcggtcatacatcaattgtttagaaacaatgaccctaaatttaatcacttatctcgtaacctacgttttagtaggctagcgagtagcgacccactagtcgtatactttgcatttggacactgaactagtaaccataatttttcaaagttatagtggagtaaaccacaactatacgcatttatttttgcaagcgccactaaaaacactcgagcagtctgaattctactccaatggttatttgtgtcttcataatgataatgatacagtgaactgtcccttgcctcttaaatactttttttttttttttcgacgttgcgtattaatttagttataatgcggttatcaatttcgaggtagaaattgcattaaatcagtccagaacggtaacatacatttattatcattttgagtaaaactaaacaaataaatgtaagtgtaattaattattgtaccaggtacttccacaattaattttccggtcgctataaaatggagtaatgcaaaacaatagtaacaatcttgtaaataaaatattaatcaaaaaaattcgaacacaacaattgtttgcataaaacaagaaaatttgaacacacgtaacgtggccatatgtatagacaataatcatgcaaaaccactgccgaaacaatgaataatatggtccactacatgccattttcgagcttctccttattgcaatatcgtttttattattacccatgcaggtccaaagtgtaccactattagcatgaaaaaagatacttgtatttttattcaaccatcattacaaatatactttcaacttccgcacatcaataattgcacctttatacaggtacctgcacatattgtctaatcatcatgtatgatctatgtgtgtatgctcatgaaacacacatgcacacacacacgttactagaaatattgtgttaatcaaaccaagctaatttaccttttgtatggtatataaccataagatattaagatggataaggtttaattaagatcttttatgttttgagtgatcccagaatttggatcacaaaaagaagtacatgacatgtgaatcaatggaagagatgtggaaaggccatgtgtgagatattatatgcattgggggcgaaatgtcaatttttattcatcataatgtgatgaagagaagagacaatgaccctacactattaaattgcatgttctctttatctttaacattaccatacatcatttcatgtatgggccgctttggttatgtcaacaatgacatgtaactatcttctccactcttatcatccacaattgtgtaatagactaaattaatatcaccttacaggcccaatgggctttaatatattttattcatttaggcccataaacctttattttttctgcaaaccacgcagacgcagattcgaaaatcgtaaccgtagatcgggaaaagtaacctcacgaatccggaagatttctccgatcaatttggcgacgacgattttttggttattaatcttcgaaggtgttgaagtaacttgaggtagattggacacgattgtgaaactcaggtgtgaaacgaaacgacgaagagattagggtcgattagtttctaagtaaaacgaagcggaggtgatttggtgacttaattgaccagaaatg

SEQ ID NO: 15229 - DNA, 3000 bp, Unknown
  misc_feature (1)..( 3000): cDNA_ID_3095744_gDNA_ID_2926088_Annot_ID_196506 3000 nt of promoter + ATG
ccatgggactgcctcacggtgtctccgatgcgttcacaagaatcaagaccaatcttgcttacttccgtatgaactacgcaatcgttgtcttgatcgttatcttcttcagcttgatctggcatccgacatcgctcatcgtcttcaccgtcttggtcgttgtttggatctttctgtattttctccgtgatgagcctatcaagctgttccggtttcagatcgatgatcggacggtcttgattgttttatcggtgttaaccgtcgttttactcctgttgaccaacgcgacgtttaatattgttggagcgcttgtgaccggagctgtgttggttttgatccattcggtggttaggaagacggaggatcttttcttggatgaagaagcggcgacgactgagacttctgggctgacgtcatacccgtcgacttaaatcgtttcatctcgaaatttgtgtatcttttctatttttgtatattatcttgtttttttaattatgcgtaatcaatttttattggtgtgagtttggtttgagactttctctctctcttttgttttctgagttttgagctctgtctgaagtttgaacaattctaatttgttataatttttattactccctctgtccataaaagataaattttttaggaaaaatatttgtcttacaaagatagaaattttatatttgcaatgcaaattttaaaattgttttcccgttttacccttactaaataattagataaatatttattattatttttaaaatatattaagaggttaaaattatgtttatacaatatttcttaaaaaatgtgcaatttctaaaaaattcatcttagtgggacggagggagtattttatattcgcaaaactcaggaataatttcttggaatgatttattaatctgaaatatttaaaatgatttaatctgaaatacataataaataatcaaattaataagtcaaacattataaattcaaaatgggttgtaatgaatattccctttttgcattccgtaacaaaaaaataatcaatttttgttgtaaagtttattcaggttggttcaccttcaaagtaggaaaaaaagtttggtcttgatttaagttcttttttcatttgggtcacacaaatgagcaatttgaagcaaaaatccttgatatatatgcaggccttattcaaatttccaatgtaaagatttgaagcaaaaatccttatatataattaggtctttcaaaaggcacaaatattctagcccatgtaattctaaacggacgccattagatatgtaagagcatcttcatcagtagtctttcaatgagatacccaataaaaaaaatataataaaaaaggaaaaagtaagagagaaggaagaaaaagtaggagagaaggagaattaagtttcttggaggagaaactttgagaaactattctcattcaatttggacagctgttatcctattattagtttaactattaaataacaattaatatatctgtcttaattaaaatattaatattttaattttttgaaaaactttccttactgatggagatggtctaacagtattgagcatacacatctttgtacgcgtcagctcccttcgccggcgcttaataccaccgccacacttgccgccaattagaagcaaaccggtttaaagtggcgtatcaccaacattacgatcttaactacgtctatcgacatcatcctcatccccataatcttatccactcaagactcaagtacactggacgtggcagaccaagtttttctatttaattcttccaacttcatattccaggaactcgatcgactttcagacattgaccaaattgaatcagatcataacgctacatccttttatatatatataacatcacgctacattattgtaataatatcacaaaatttctacggaaaaaaactcggtctaatgttttaacacaccatctaatttatttggttttattccatatgcaaattcaagagaccttcttcatatattatacacagagagataaaacaataaatcagaacagttttacattatttcaatcaagtcatcttattcactaatggcgaacaacgacgagattaccacgtcgtctcatgcatctccggcagtgaatcacgagtctatctcacgcgctaagcaacgtatcaaagacggactagccacgcgccgctcctggagggtgatgttcgatttacactccacgggactacctcacggcgtctccgatgttttctcaagaatcaagacaaatcttgcttacttccgtagtaattacgcaatcgtaatcttgaacgtcatattcttcagcttgatttggcatccgacctcgctcatcgtctttaccggtttggttttcctatggatcttcctttattttctccgtgatgtgcctctcaaggtgttcaggtttcaaatcgacgatcgtgcggtcttgattggtctatcggtgattaccatcgttctacttctattgaccaacgcgacgtttaatattgttgcggcgttgatggccggagctgtgttggttctgatccatgcggtgattaggaagacggatgatctttttttggatgaagaagcggcgacgactgagacttcaggactgacgtcacacccttcgtcttaaaacgattgatctccatttttatgtatattctattgtttttgatcatcttatgtgtaattatagtttatggtgtaaccgtgtaagtttggtttgattctctctctgtttttaagttttgaagtatgaacaaacttaataatgtcaaagtcttcgcttcttgtttttggcgggctgcttacttttatcactttttggcgccttattgggccattcattaaggcccaatagtatcagcccataaaattcaaaaaggaacatatttttacatttaaacagtgtgtctcacacttccatttacacgtcagctctcttcgccggcgcttaatacaaccgtcaacctcgccgccggctagaggaaaatg

SEQ ID NO: 15230 - DNA, 3000 bp, Unknown
  misc_feature (1)..( 3000): cDNA_ID_2990585_gDNA_ID_2926088_Annot_ID_196511 3000 nt of promoter + ATG
cgtaccatatatagtttttcacattttcttgggtaattttttttttgtaacggcttaggtaaaaaaattacatcatcttgctgttgtagcggtaattaaggataaatatatatttttattggactggatataggtaataggtccatgaattttctctaatgaggctagatatcatgattaattttaaaaccagcatttagctttctaatttttttgttcggatcctatcagtcgatgaaaatataacgtgatgtgttgaaattaggatgagctagcattgtgaaatataatccctaactacgaatatttgtattagtatagctctctttaactatgaatattagagcagttttgtggttgactgcagtaataaagatttattgacagagaagctcggatctaaatctacatgaccttcgtcgttatcttctctttctttgtggagctatattattttcttgttgttcttcatagttaatctgaacataagggaatacattaattaggatatatgataataaaattaaaacaaccacccgtacaagattttccttgacggccgtaagatccggaactagaaagtcaaactctgttgcagttcaaattccgtgtactttactcgccgcgcgcgcgtgacaaaaaaataactatgtgagtgggaaaggaataaactaatgaagaagaagagaaagcaaaagaaactcgaacgcggagaaattgttgttgtcgtcgcagttaacgggttttattttctctattgtcttaaattttcttgctcgttccattttcactttaattgctccacgcatctcaaatcaatgacaaaaaaaaaaaatgtaccagtgtgaatgtgtcataagatctctttaccaaacaaaaaaaatgtgtcataagatctaaaacattatacggatctaaataacatacaaaattcagatcgatgcatgcgcagatgccttgtaagcgtgttggttatattttgaggagtataactttggatatgaaaaatgttaactaaacttaaaaccgaaaaaaaatatgttaaactctcttcttcttttttttttttgacaaaatgttaaactctcttattcacaagttttctacaccagttcaatttgttttttttattcaataaaaaactacttcatcggggtatgtgttatcaagtatttcattgtagttgttaattggtctatgtgaaaatatataaatttgaaatctaattaacataatcacgacaaaataaatatgcttttaaaataaagaaaaataaatatgattgttagttatttacattttttaataccggccagtagtatatgctgcggctagctctttgccatatatgatacgtgccggtgcatctttgttttgcttgactactaattttatagttctgtgtttattcataactcgaatatttgtctctatataacagatgatagaaagcatggttttattcaaatgtaatcgattgcgttttactttaatgatgctttacatacacgatatctccctttttcgacacattatctcttcgattagaacaattattgtgtatgtttgcgtgttttgatgagtatcttatagtactacttatttgaaattaataacttatacaaacctttaaccaaacacattttttgttttatcaatattaataaagatttatagttccccaattccataaatatgaatacgacacatcaacgaaaattatgaaaaacagccatatatagtttgcaatgtcgaatctcgatatctccgatggtggtcacagctattgataaacaataattgaacaaatcatgatcatacttaataatataaatggccatttaataagctgttagaagttctatcaattaaatagctagatatttaaattaagcaatttagtaaattttccacaataaaacaagacgaagtttatgtaaagtcttaaacatgtatagttttaggtagagaatcgaagacaattttttttttttttcaaaagtttgcatgtgttcagtggttgagaacttgagataacgattggtttatctaacgaacacgctctttcatatcttacaattaacgtttcaatcagacaaaggaaaagttaaatagatgtgtagtaaaaaaaaaacatattttgtttgtagtctttgtcttgtaaaagtcttagaatttgtggtggctaaacttaacccgtgacactttgcaagtattgttgggccatttactacaacgtgcagcaaaacgcgtgaaaaatcacgtagcattaaaacaaagagccagacaatctggagattattatgaagattttttttttatctcgtaccgatttcagccaaaccaaaaaatcggattccataaaaccaatcagaaaaaggagatgtggcatttgaatttgttgcaaatgttttcactcaatatttattgaaaaagcaaaactccatattaaatcatactctaacatttttttttcctactatgaatgctactacaaatatggtggaaaactagttatttgttttctctagaaacttacactttattcgtctaaatttgcttgcaatagaactatactaatgaacattcaaatcacaaatgaccttttttactacaatcctaaaaaaatcttaaggtattcaattatttaaatgaacaataagaaaaagacacaaacacggtgggacccaaaaaggtctctcaaggtaggtcccacgagaataccctccattgctgagtgctttaaaaacagctgcaaagcatctacgttttagcatccgaacaaaaaaaaaaacaagttttcttctttttacactcaagaatataaattccctgttctccagatcttttctcaagaaaatttaaagctttaacttaagaaagcttgaacctttctcttccaaccacatcttccttctttttatcctctagctcaacttagaaagaatagaataaagtggcaaaaccgaaagtgaaccaacttgtagtaaattaatagtt

SEQ ID NO: 15231 - DNA, 3000 bp, Unknown
  misc_feature (1)..( 3000): cDNA_ID_3095696_gDNA_ID_2926088_Annot_ID_196517 3000 nt of promoter + ATG
ccctagaaatatccaaaacttgacttataattttgaggactttttggtgatgtggatttgggacagatcttcgctgaaggaagataatgacaaaacgacatacggagcttttgtggatattaatcctcaccaaccactatccctcagagccttggtaattaagtctcccattttgtattttacgtatatagttttatatattaatttatgttcatatgtaaaaacgcttgcaaatatagggaagaaaaacctcctttttaaaacccatgagagtaattatttaacagcttagcctcttgatcaagactatataatcttcaactatcttgttcaagtattaaggcgaatatttaattgtggatttgttaataaaagtttctgttatttgttgttgttggtgtagattgatcattcagtagtggagagtttcggtggaaagggaagagcatgcattacctcaagagtgtatccaaaattggcaataggaaaaagttcacatctctttgcttttaattatggatatcaaagtgttgatgtcttaaacttaaatgcttggagcatgaactctgcccaaatcagttgatcacgtaaagatacacacatgtaaacacattacatctccattgatttagcatttatatgagttgattttggagagatcttatatggtccactttgtttggttgtcaataaaattgtccaatttgtttgtttgaaataattctaaaaggctaatatatatgacattttatttgacttccttatagtatgacttactattataaaaaggacaattctagagtcggtagtcaaaatcttccaagttccaacgaacgtgataatagtggactttcaatgaatataaacgtaaatatgtatacatgtacatactatatgaaacaaattgagtacgatcttaaagtttggccccccaaaaaataactagtatgtgtatgtataggatcattctatgtaaatcagcacacgtaacttttttctaaaatgcccgacggctatattaccacaagtatgaaattgcccaatatgacgtaacgaacctataacactagcgcctatctatccatagcgatgccaacatgatttattatttattacaacggcgttgggtttacattgttttcatctaaacggcccaccgtttcagcatttaagaccaacaacttcacgtcaacgggtctggtcaactaattaaagcgatcaaaccatctccaccgtccgatactaatccaacttcgtctgtcccgcccaagggcaagcccgtaaatatgttcaccagcaatgatgggagtagcatgtgggacataacattgcatggtagtgttttttccaacagcgcgctaaggctaaatcgttgtcgtttagtaaactgctggctctagatttagaatacgtgcgtgagatgtagccagagcccagagggaagttatggttgaatccggtttgtgtccactttaatttggtgtgtagtgattctcgcctgcacatctctctctttcgaaatattcaagtctcaagcaatagtgatgatatggacatgtaagtagcgaccaaatcaggtgcagtttcatttcattttttgcatttaattttatcagaactcagaagttgaaagtacatattttattaagcaaaaaaaccttctcaaattcagattaatcagaattcagatcgcagagtttagttaaaagcacatatttaagaaatttaattttctttttaagactattatttcttatttaacttttaaaagatcaaccaattgtaaaagagactgcagaatatatcaaaacatttaaaatttctattgaaacttctaaaacatcttatacagtgaaccaaaataaaatttcttaaacatcctatataataaaagagagagagtatactttcaactttagatgtgggattttagtttacacgtcttctcgagactatggttttataggttcatcgttattactaaacttgtcctcaaaaattagttaagttcttagtttcacagtcatgcaatttacaatactacacacccgtgagtctcgattagttgttataatatggattttggaaagcacatgcactgatgcacagcatctaaaagtgtgattacccattacggaaaaaatcccatcaaaatgattaggagaatgtgataatcaaaggagaaaacttagtggagccaacgcactttttgaggacattttgattgtctttctaaattgagttccaagagagagttcaagaagaatcacgtgtcattgtactagtaggtataatcctattcaatttcaaattgacttctcaatcaatattttttacctgttacagattgagcatttcaatagtggagagctatatatggtgggggaggcaaggcatgcataaacatcaaaacagtatccaaacctggcgatagaagaaaatgaacattttcgttgctttttaacggacgaaatcaatagtgttgtttattttacaccgcagcaatgatgagacactgacattccataaagtactcaatactattactgagtggaaaatatttgcaattatgagaagacaaaagtctatgagatcttgaacattcctgactgtcgggaatacgttatttagcattatgtttgtttatttaaaatttgtattttcatacatatccaatgtcaaccgaaattggtgaaacaatcgtttagaaatgtaaccatcccaatttcatcatgatgctagttataatttatgagaatatcttataccttgacaaaatatatatatctttccaaaaaaaaaaaaaaaatttggatctcaagattctcaagtctcaactaacatgaaaaggcatttggatcgagattatagcatctaattttcacaaaatatggaccaccaccacctcaagaacgcaccaaagacccccactgtctataaatttgaccaatttttcataagtaaaactcaaacataaacacgaaaaaaaggattgcaatg

SEQ ID NO: 15232 - DNA, 49 bp, Unknown
  misc_feature (1)..( 49): cDNA_ID_3095690_gDNA_ID_2926088_Annot_ID_196518 3000 nt of promoter + ATG
gttcattcaaacaaaaaccaagccacaaagaaattaaatacacacaatg

SEQ ID NO: 15233 - DNA, 3000 bp, Unknown
  misc_feature (1)..( 3000): cDNA_ID_3095710_gDNA_ID_2926088_Annot_ID_196514 3000 nt of promoter + ATG
tacatctcaggaattttaaccccatacaacattaagtaaaagataaaatattaaacttgtcaccttagcaaaaagcggcttgtagagattatcatatgttgcctccaatgcagatttctcagcaagaaacttctcttcgagttcatcgtgtgtaacctaaaaatttactctacaagtatacataaaccgaacatcgagcctctctactttagttgtaaaagagcgaaaatttgaaagtacctgaatgtctttgaggaacagaacacgtttggtaactttaggtgagagttttttcacatcaaatggtcgctttaaggttaggttctgtaagttaatcaacacccaaaaggatcataaaaacagaggaaacacaagaaaactactgtgtgaatttttatcaacaatttgaagtgacttgccttaagctctgcaagaagatcacattcctctgccccaatatctacaaagcataatggttagctagcttcaattaaccctattccttgttgattccaagatcgaaaatatataaaacagggcatttacttgaggcagaagtaaatgtgagagggtagatttttggttggattatccagagatttattgttttatcgagaataagatgtaaaattttgtgagttgtttatgaaaattacctaaggcgggaatggtagggagatcagaggaatcgccgctcttattatcagatttgatgttttcttcgttgctcatgtttttattgtgtttttgattgtggtgatgggaagtcttcgttgtttcgtgagaaaatgagaattttcctgggaagaagaaaaatgaggacgacggagaaaggaaggaggagaagacttcgcggctttttcatttgtaaaaattcattcacacgtgcgagagaggttaacaacgtggatccttagtggggtaccatgaactgccatataacaacagcaaaaggaaacggcaacgttttttagcaatcaaacccccaaattagaagctgtaatgttgtagagaatttcacaagtactgtactcgtacaaatgaacaaataatatatcatatgatcagaaatctcagttcagacagacacagtacactattgaacaaaagattgtcgttgtaaaaggaagaagattagatttgcttacatttcaggtttattaggagacttcagctattattcttcttcttcttcgtcttcatcttcttcatcatctacatctgattcgtcttcttcttcttcttcttcttctaacttagcttcttcatcactaacaatgaaacctcccaatgtttcatcatcatcatcttcttcctcgacatctgctcttccacgctgtttagtttgagcaccattactactactactactagcgtttgaatctttcttcgtcttcttggatctagtcgagtaagtaggagtcacaactctttttgatttcaccatcaactctttatcttcatcactttccacactccaatcatcatcctcattccctttcttccttcttctctttttccctaatcccttccttcccttcttatctccatcttcatcaccatcgctatttccattagtggaatcctctaaaaaccattcccattgctttatgtcacgcaccctactctttggatactgatcaaattctttcccaatcacaagaaatccaaactctgcaaccacaccacacagtacacaaactacacattcagcctcattcttactaaaaagaaaaaatcctctcaagagcataattctagacattataaaagaaaagcaatgcagaacaaccaaaatgttgtttattgggacacaaatccagaaacacatcaagttgcaaaattgattacctttaacaggatcaatattcaattcgatttcaccatgatccaatgctcgctcctccataacttcatcgcgtctcttcaaagtgaaccaaatggggtgattacccgatacacaaaattgatcgccggtggcgatttctccagtctcgggtttcctcaaagtttgaatctttttgcccttttcaacggcccttatccagactggattcctcccgagaacctcgaaggaaaccatatcggacggttcggttccggcggcggcgggtttgaatacgagtgaaacatggcggcgtgacactgttaggtcttcggtgttgaatcccgctcctcttccgaatacatccttaactccggtcttcaggaagagcttcgtgccgtcttcgccttcgatttccatggtggtttcttcactttcacagagactttttgtgttcatgtctttttttttatttttttttcagttgccggcggcaacaaaacgcatcgtatcgttttttatttattttattttgaataaactctttcaattcgacatactaatctcttcattagtttgccagaaaaaaaaaaatgttttttcataatgtccttatcatcataatcaattaatcatcatctaactttacttaaggaatggttcatgacaaaatctacagcttaagttatttcttgacaaagttatgtattttacacaaacttaggcatgccaacagatatctctttgtttagacatgaagcttcttctgattcatcagattcattaaccaataaaatcacatttagtttgagtttacatgcacaaaatcttgtctgaaaatgggttgtctgcatgtaagaattgcattcttaaattcccaatatattttctatattcccacaacataacaaatgtcatcaaggaaaggaaattatgtcaaatctattcctcttaattgacaaaaacacacacatcctaattcttagtactaaatattttattattttttccctttcatatttgtaagcaatccctcaaaacgacttcgtatttgtactcacctttcgtcatctttgttaaataaaataaaaacgcatccttttctaattgctccggcaactttcatctgaagaagaagaagaacctctgaggagattagacagaagaaaaagatg

SEQ ID NO: 15234 - DNA, 3000 bp, Unknown
  misc_feature (1)..( 3000): cDNA_ID_3095728_gDNA_ID_2926088_Annot_ID_196509 3000 nt of promoter + ATG
atcacttgtcgacacctatgagaggaccctgctggttttacctcttcttttgcataagattaaagttagaaactttatctccattttaaagtgacaatgtttttttatcagagaaccaccttcatgacattccctggtaatctaactatctaactatcaaagagtgctatgtttttgttgttctgtagtagctgcaaagctggtttggggctgatgagccactattattatagaagcaacaatgagagatctttgtgagaatgttggaggcgaaatctaacgccaaacaaagaagcaaatcattggtagagaaaccaattatgcagattatatttaccaaaattatgcattaactcacttgtgaatatattttatagcttttgatagatttgagtttgattttgaagcataccctcttgttgatgttggcttcagtcaatggtcatgtgggcattaatgaaatactgagtacttataaagatttgattgctataaagtttgttcaattttaacatttcctaactaacagcatatatatgtgtcgttgttccttatactttacacattgtccataaatttcaccccctcccctaacccccccaaataaaaatcgaaagcataaatttcaacgaagggacaaattgttaagtggttttgcatcaatttcgtaaagaggacaaaggatcatgttctcagctatccaaaaccctagagattgtgaaatcaattgggacaaaaatattctcctggtcaagtggttcttcacatggagatatggtccaaatgaaaacaacaccacaattcccaaaattatatatgcatattatttggctcttgttgatttcaaattgttcattttattattctatttctgtcaattctcaatcttggtgacttttttgagcaaacaaatactatacagattttacaagtttcaattttttacaaaaagctacaaataaaataatagataaataaaagctttcaattacttaagtcaaaaaacctctcggatttccaaagattcacgaccttaaattaaagacactcatgcaataattagatatgatcaaagcactaatttgtattgtatctatcccttttttctttatcaaattgattatacaattaaaagtgacgatcatcataaggtaataagatagctcccgtgttaggtattgcttgtatgaaaagcttaaaaatggcgttaatagatatgataaaagaatcataggtttcccaaaagaattaatatttttgacaacactattataaagtgaataaaaagagaatgggaaattatcttgtttggcattagtcaaaaggtttgatctataattacaaaatgaaaagattagctttttaggctcaatacaatcaacgatcgccaaagtattcaagcggctaaagaatctcacttccttggattctaatatattataccgctcatagtcatacacacactatttaatatgacatacgtttatatgaaagtgagaagatgcgcttgtggtctaatcatgaggagattgaattagcattagataagtgtatcatacttttcttgtagagcttcgtttcattacgtaatgtactccaaggttaacattaatgtatagagccggtcctataattgactctgtttatttaggttgctggcccgggtcagcctcaattctatagacttagttttggtttatttccaaataaaatagaacaaaatacattttggctaactaatttctgttctcataccaaccaaatcaaaagcaaaccatattttttcaaagtcccaagaaaccgttctgatccgcgtacgtatatatagtatcgtagccattaattactacactatatattgttgtagatatctaattataccgaatttcaaaaggtcatttgattcgacgacatctaaaatagaataatcaactgattttcacaagtcacaactatagctacgtattggcatgtgtacacacatttgtatacaagtacatgtcttctcatgcatatctttacatgatatatatgggcatgcatgtatcctgtataatcatgacaaaaatgtgtaaatatatgtgaaataagaaaggtggcctaatggaatttcgcacgaaggcgcacccaaaataccccacaagccaaaagacacttagcacacttttcttcgatatattatttgtctattttctataccaaaatttccttatacaaccttacctcttcaattagttagactttttgaacaaaataattgatatatgtttggctcaaataatcgatatactagtgccagtttgatcaaataatggataatgataaatagtttctaattttctatattgttattttcccttttttttgttatgttagaaatcatataataataaatacctatttattaagttacattattagtttaattaatatttattaaggttaatataacaatactaaattatagtatttttagttaatgcattaatactgagaaaaatgaaatttgaaaaattagaaattatattttgaaattttgttaaatttatcataaaatttaagattgaatgaaaaatatacttttaacaggaaaaaaaacatacaaatttttaaaaattaaaacatagaaatgtcaaaagatattgatgagataccttgtatctcaccaatggaggcaaaattttagacaaatttctcaaactaaattgaactaaaataaggatatcatatttggtgagataccttatggtcttatggagaagctctaacaaagtaacaataaaaacttttttagatataagatttatatcaaaaaatctaagataaaataaaataagtaccagccacatgatttgttgccacaccgcaccatgattaaagttatataaagagataccaagacagattcaaagtgaaagaaagtcccaaaaacaaaaaaccaattttaaaaaacacaaacccattcgtgcgtctctggctaattaagttaaaacactaatg

SEQ ID NO: 15235 - DNA, 3000 bp, Unknown
  misc_feature (1)..( 3000): cDNA_ID_3095749_gDNA_ID_2926088_Annot_ID_196504 3000 nt of promoter + ATG
aaaaagtgtatagttaatgtgtgtgacaggaggagactgatagcagctgtgacagcattggccgccgttgaagatgtgtcccgtgacggtgacagagctaacgtcaaaggacgttcgggacctacaataattaagccctaacttagattaattatctcaactcttttaacactaatcagattcaaacacaaaccaacatattgaagtattgaactatattcacagataaaagaatatataacttgttccaaattctaaaatagacaaataatgaaacttgatttaagagagatcgtgggatcatgcgtcgtggaaatttgcatagaggaggaccacatgatctaaggattttagtttttaaaatttttgtagtaataatgagagaaagtaaaaaaagaaaagaaaagagagtgaaattagagagataatgattaggggatggaatcggaccccacggaggtttactagatgacaccgaacctgaactactcacctgtgattgtgctctgttctatacttacacattttggaccatttcctctttattttgtgtcttacacattattctaattgtaattaacttccatatcttatactaataatccgatctcatttattctactttgtttgatttcatgcaaagccaatcacgggttcttgttaaagaatttgttttttttatataattaacaataagtaatggtgcgtcgtttagtcttgaatgattcttaatcaatagattattgtaaattacaagaacaaaactatgcatttcaagtattttaatgcaactttcaaaatttgatcagatgtgtcggctgtgactatacgtacttgtttttttttaattgtcaactttgaaaattttatttaaaatctaagtacttgtttagaaaatcacgtttatgagatggagactgcgtttgattcaaatttgtcatatattacaacgttgcttatcgtttcccgaggtaacaacggacggtatgtcagcttggaggattttggtgatcgagagggtatttatgtgaaactaaaatatggtgtcataaagctacaaaattttaaatttcaaactaaagagttttactacattattaaactacttctgctaaaggagaaaagtagaaagaacaaaacaggctatctttcagttcaagcaatttttgagctaagcaagcaatttcaaatgtcttgttattaccaatagattgtaaacaaaaaataattacaccaccccaagtaataacatgacattttcttatggtatttaagtaagcattttaacgaatttaatttcatttacatcacataattagttttattttagaaaaagtagtagacaaaactatacaaaattctaaggagattgagttatgaccctaagcctattcaagctgtacataaattgttagtcacaaaatttgagtctttcacttttcagattgtagtccctcccatattcaaaactgggacctataaaggtaaagtttggcttccccaaagcctaaactaaatctctccaaagtcaaaaactaataatattttaaatctgagattagtatttgtttattctccaaatgcatgttttgctaaagaattagcagctgatcaaagcttaaaaaaaatatgtaaaggaaacactttggtgggtatcataaccaaatgtgttggactatggattaaaagttcaaactagatattattataagattaattatttgaaaaggcccaaaacatattctactatattttttttttatgaaatcatgaagagtagcattggaaaagacacaacagataatagtaataaccagaagatggtaattttgttgttactacaaagcaacacagaagcaaagagagactagtagactagagaagaaaaaccaaaaaccctaaaaaaagaaaaagagagagattgttttcacattttcgcggttttcttcttctccttgtatttatctctgaagtcgtgcttttgatgtgaaaggagaagaagcttgaagacagacaactttaaagttgacgaaaccaatgcttctggtaatatcattttcttcacaattgtttgtgttcttcttcttcgtctggtctcactcctatagttttgtttaatcgttttcgtggcggtgaaattcatgagagcttaactggtgaatcttttttttggttctgtaataattttataatcttctttctctggcagtttgcgacgaaactaatttaatatataaatgtaaatctagcagccattcttattggtttattgttgaaatctctacgaaaattcctttttattcgatttcgtggttttaatcttcaccattacgatttttcttcagctccttctctctttcaattcaatttttactctttttgtatattgcaggtgaagttttgagcttttgagcgatcttttgggtcttgctcttgctcttgaggcagagaacccatagacagttgttttgtctgtttgttggtgtcagatccaaaatcaagaggctgttatagctttgacttggaagtgatttgacacaatgaaggaagaagattcaaaaaaaataagagggtaggaatctatttggtcgcttttgcttcctcctattctggggagaatttgggatcttggagttgaatccgttgtgagaagaaggatctttttgagcttgtgtactgtgtcctctcagttgattcatcgcagagagaagaggtcctgtcatgtctatgagttttgtattcatctgaaaggtcttactggaatgacttatcaaaggggagagtctttggttcctgtcttgatttccaacttggtgggggcataggccaaataatgcaaacctaaaatccttgtttcttccagaatcttgtgagctttttaatctctccaacaaagtacaatttctctgaggattgtgttattacacagagaaaacaaaaagagggtccaagaaaatctcttgcattctcttctcctctctctggtattggtatcttcaa

SEQ ID NO: 15236 - DNA, 3000 bp, Unknown
  misc_feature (1)..( 3000): cDNA_ID_3095766_gDNA_ID_2926088_Annot_ID_196499 3000 nt of promoter + ATG
catatggaaatagatagataagttaagagaatcatttactgcctctgtttataaaaaaacactcgaggtattggaaatgtttcatttgtttgatggtttggtggtctgatgcatcgtgttctgtgttttggtttcttaaactcttgaatgaaattaggcataaattttgagtcttccctcagctttatccttgaacaacctttttaacatcttgaatttacccatttggagtacacaaatgcaaccattcacaaaccttctcccacattcgcgccaaggacaattccacccatgccacgcttatagcttagcttggattgctcccatctctcgcacttcaaaacatagcttctttgaatgcaagaccaatatacaactccattcctaacgattaatgggcgtctcacttcttctctgaatgtgccatttacttccaatttgagcgacttgtgggttttcatcatccgagtgtcactatcgggaaatatgttacggcctaaaggaaactcatcccacaaactgtggtatattattctcaacttcaaactcaaaccgtttcattgcatcctcatccaattgatcaatacaaagggaaaactaaaacatacaattaaaaccaataaacaccaacttcttaagaaactagcttgttgccatgtcattaatcaacaagcaatctcgagtaaaaagttatattacattagttccttatacatcaaaatctggattttacaaggagagctgtgtgaatagcaattccaactccttctcttgagacaatgttctctgtccaacaaagaaacataagttagttagtttcaaaggtgtttcatatagagtagtaatgtgaagaagaagaggattgacttacttggacagataaaaggtcgttgattttgttgagaaccttgagacgatgaactgcataaacactgtttgatggaagtttacaaacccttttgatctcttcctgaatcacactcgatttctcatcacaatccatctcattccatctttctcccacacgattacctctgcttcccatttcgtaactgattcctcagctgaaacttcaataaacagacatatacaatgaaaacggaatcagttattacaaagataaagggctcgaaaaataacaactttgtgttcgatcgaaaatagaacaaaacagaacagtgggaagaaagattgagtttttacatcaagggttacgaattcagagctcgcagtttccgattttgtcacactcaagagaatttgcgaaaagaagtgatcgagaattgtcttccagccctaaattcgacaccggtcttcttatcaaataattttggctttttcagttatttacttacccgacccgtaaactaacctgtaacccgacccgggacctagctcactaagaaccctttaagccctaaaatctccgatcacatctgaattttgcttcttcctggcaatggcatcttcaagagtgttaggcagattctcgtctcgattaaagtctctatgtcaaaatctcagcaacaagaatgccaatgtttcatcactcccctctcccatcaaatctgcatcaccttcctcagcaactagttgtcgtctcaatcgatcttcaaggtttgtcttttgtatcatttcacactatcaaatggagaagacaaaaaccttcttttttcctcactatcaatgggtctgcaacaatgtagattacttgctgataattttgaaatctgaatcaacaaagtcaaaatctttctaagcaaaattacaaatttgatgaacttgttggatggttgttttcagattaccagtggagttgagctcgatgatacctctgcacagtgctatagcatcgtccaggctcgtctcaagtttgtccgttgaatccaaaatctggggattagttcctcaaggtcagtttttgttttgttcttgagcactggaattaccatttgggtttactttacataggtgtatcagcacacaacacattctgttgtttctctgtgttgcaatttgtatcctttgtactgtgtatatggcgataaatgtgatgatgcatcaatttgaatccgatagttagctctacggataaggatgtacataagttcctttgataaacttgacagcaacagaagtatgtgatcatatagcatcatcatttgtaaatctgatgaagttgaacccttttatgtttgtgtatggatctgaactgataaaatcacacattacttctaagtttggttttgatagagtttcgttgcttagttagttcaatagattgacatgaatcttttctttggaattgcaggtctttcattgcctttatgacagttttcttttctcatcttacaacaagtttccaggaggatagagacataaacgaagctcggattgtatcgttctttttagcttttattcacatccgaaagtcctgtagtttagattctgttatcttgcggttttgagttaatcagaaacagagtaatcaatgtaatgttgcaggctagatctttcatctttggaaatttatttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctatgtggttgattgtatgtacatatgtacaaacgtacacctttctcctctttcacttcatcacttggcttgtgaattcattaattcctgcgaaatg

SEQ ID NO: 15237 - DNA, 128 bp, Unknown
  misc_feature (1)..( 128): cDNA_ID_3095815_gDNA_ID_2926089_Annot_ID_196525 3000 nt of promoter + ATG
cttgagcatgttggtctagagatggacttacctgttatcagtaacgttctttttactccctcaaatctcatctaagtttgaatctttttttatagattattgatcttgtattcgtttaactagtgatg

SEQ ID NO: 15238 - DNA, 3000 bp, Unknown
  misc_feature (1)..( 3000): cDNA_ID_3095811_gDNA_ID_2926089_Annot_ID_196526 3000 nt of promoter + ATG
ttatcttacagaattttgccattatttttttgtttttttattaataatccagtcatcattcataagtttttaaaaaattcatttgttgcattgattgtaaataaaaccgacgtaaaactttattagtttattataaattttgacattagaaataaaataaaaccaaaaactgaaaaaaaaaaaaacgtgaaaacagattattgtcaggacagcgaccaataacaaaccctagccgcaaaatttgaaagcggctagttttaaaaaacaaaaaatcaaaacattgtttcagattttagttataagtttttgggcgggtggcacaaaattaataaaagctcccgctcgagggtattttagtcaattcaaataacccgaaatactagggtttccgcccccgccttcctcctcaattataaaattcctctccgtttgtttaattctgttgctactaaccgccgtctctctctctctccctcttccttatcatcaaaacttgctctgctccgatctcttaaaaaaaaaaagatgtctgagggatcagaagatacgaaaacaaaactcgactctgccggagagttatcagatgttgataacgagaactgcagtagcagcggaagtggcggtggtagtagttctggtgataccaaaaggacttgcgttgattgcggaactatccgaactcctctttggcgtggtggtcctgccggaccaaaggtgagatttttaactaaccctttcatttcaatcttcttatagtctattgggttgttgttagattccgatctagtagatctaatcaatggatcgcgaaatagcatctatattatgcatgatcctattttaggttttatcgtttttcaaatttatttaggtgatgaatcaatttagtgaccggaaagatctgatctcatattgctctgaagttcaaatttttcttatttctttggtttgtcttttgctatgtagtcattgtgcaatgcttgtgggatcaagagtaggaagaagagacaagcagcacttggtatgagatcagaggagaagaagaagaacagaaaaagcaattgcaataatgatctaaacctcgaccatcgaaacgccaagaaatacaaaatcaacatagttgatgatggcaagatcgacatcgatgatgatccgaaaatttgcaataacaagcgtagtagtagtagtagcagtaacaaaggagtgagtaagtttttggatttagggtttaaagtaccggtgatgaagagatcagcggttgagaagaagaggttatggagaaaactcggtgaggaagaaagagctgctgtgcttctcatggctctctcttgtagctctgtttacgcctaagtgtttctctgtattaggtcataatcaagtgagagcgattttgattaacttaattagatagagataatatgtaatgaatgtgtaagttcctagttttttggttccactaatgttttgtgttcattttcttgatgaattcaaatatcaacacttttttttggttcttagtcattcaatgccataataatgagaattggtcttaatttttagtgcctcaaatgtcattctctgtgtatgggcccatatggcccaagatattgggctttatcgggggaatcgtgaggcgcgtgattctagttgtcttgtctccgtcaactccaccatttttttgttttttggtccattgatgtcgtttttcatttgatttgaatttttatatgcttttgaattcacaactggtttcaaattcagattttgtatggtttagagttttttttatatatatatcatgctgaggttgtatacttcgatttgttttttcattttattgaaggatggcaatttttcgatttgcacttggcagagtatctgtttgtgtgattaaaagttgttatggtaactttgtaacagggacagtgtaaattttcgatttgcaattggttttgtttttcatgtaagcgtatgattcaaccttaataagccatcattaataattaataatggtggaccaacaaaattttaagtaatgttaaatatggcaaagtcatgaatcatacttataatttttttttaaaaatctaaagtggtgacgaaaatataattcatttaaatggatcactggtggacgaatggtgtgagtgtgacatggctaggtagagccgtgaacctcgagaatgattcaaattaacggggcaacttcgttcaacgggggactttcttttgaccaaagcttctatttatgtgtttcacccttatattatgcagtttcttcgatttaggaccattacttccattgattcctttattttcctaagcaaagagtacaatttaggaataacttgtcgatattttccataaacaccatttcttaattttggagatacgttttccttattatttttcacaaattcaaacaaaatcttcataatatattttagctatcaaatcacactctcaatacattcaaaacttccataaacactcttagaaatcactaaaatttagtagacagaaatatcagtaaatatttgaatataagtcatttaagcgaacattctataaactgtgtttggtatcaatgttttatagctaacgattaggtgtaaattacacattcacataattactaagatataggttggggttgcatttttttattaacagaaatatatggttcatcttgtaatttgaaaacttaaacccactattttataattttgtcagaagaacaaaaccttgtctttggcttttgttcgtaacctttgtttacttgatcaagaaaaaacattaaaatccgaccaaacaaggaaatatacacattttcaacgcggacataaattttcattacagcgtcttactaagctgttctgttctttaacgcggtctcttcctctcttcaaaattaaacttccgatttttcaccttttcatttccagaatttgttttttaaaaaagagatttttgtgagtgaagagatttagagtaatcatg

SEQ ID NO: 15239 - DNA, 2615 bp, Unknown
  misc_feature (1)..( 2615): cDNA_ID_3095920_gDNA_ID_2926090_Annot_ID_196531 3000 nt of promoter + ATG
gatctttgatttagtatcattttgtctctgttagggtaggattgatccaatgataagaagtagtaagagatcattgagcagagatttggtgaggtttgtgcaatatgttgatgattgtgttgttaaaaggtatggttttgttgttaagtctggtagtggcatcaaacttaatggcaaaaagcctcagggttttggtacttctagtgaggatgaagataacaatgcagacatgagtgatgatagtgaagaagttccagtgagttctattgataagagaaaggttgctagttctaagtctagaaccggggttgtgatagaaggtgatgtagtgaagcctccggttatgaaatttgttgtattggacaagaacaggaatgtgtgtcaggtatatggaaataggcatgatctaacttcgagtgcagaggatgattcagttgatggtgacgaggaaacccttgtgatgtccagggataatggaaggaagcagagtttgaaagctaggaacggggtttcggtgaaaggaggtggagggaagacaactcgggtggtgaaaactgtgagttttgatgagaatgggaatgtatgtaaggtttatggagatacacatgacctaacttctagtgcagaggatgatgattcagttgacgttggagaggaaaccctcgtgatgtgtagggatgagggaaagaggcgtagttcgaaaactgggagcagggttttggtgaaaggaagtggaggaaaaacaaaccgtgtggtgaaaactgtgagctttgacgagaatgggaacgtctataaggcttatggagatacgccagagtcaagtattataagtgaggaagatgactcgacaagcggatcaaatgaaggaaatggagaagagaaagggaatgtgaatgaggttgaggaaatcaaatacgttcccaaggaaaacgagagctttgaagaagaagaagaaaaagaaactgattctgaaaatgaagtttcttcttcagagggcagtgaaggggacaaaagagttactaaaaaggaggtccagcatcaaaaaggaagcttaatgttctctcctccattgccactaaaaatggagccttgaccagtgagtcatgaaagaatccaagtcttctaaagttctttgcttatgactagactagtttaattccaaaacctgcattttggcatgttctgtgaacccaataagataacctttttttagttgtagaacttgtaacataactgcattgtgagtgttttcttggtttgatcattctgtttctgtttatctctactctctaggccattttcgagtcaagtcttcgtcatagataaatgctattctttgagtgatggttgctctgtttctgtagaaaccagtttgactaggtagatcaattggagtgtaatcttgtttttgttcttgtacctttccttaaaactcaataaaaaggttatgtttttttttgcattactctttagtgtaatcacgaagttacatcaatcgaatctttttacttatgttaggagtagcaatgtcaatgggatctgtacagatcattatatggtcacattgttaaatgttaagtaacataaaggattgttcttggattttgacggcaatgtgtttatgttattatgcaaatgttttttttaactaatatagtaataaaacccgatccgaacccgaatggatcttaaagttcaaaatccgaaaatctgaccccgaatccgatccaaacttaaactcgaacatatcaagtaatttattagaaataattatatttacgacaagttaagtgtcaaaaatatttggattttaaattattttgtatatttttgggtactttacctacttttagatagatttggatagaaaatattcaagttttcaaaaaaaaaatttgtgtattttcaactaatttgaatatattttgatacaaaatcttgagttttgaatattccgggtaaatccgaatccgaacccgaaaaacccgatcgaacccaaaccgaactcaaagtcttaaaatatccgaacggatcttagatttccaaatccgaaatatccgaactcgaaaaacccaatacgaatctgacccgaatacccgaatgcccaggcctgtgatacacagtcaaaatagtatatcttcatctcaccgcattgaaccgaaacaagtactattctaaattttcaccagtgagcactaaactcttgagtattattataacgagtcactaaattaacgatgaagaaaccttacacgtgtacggtgctcataacttctattgtcactttctctcagaaatatcttcttcctcttaaacccagtgagaaatgtcacggatagtacactcccaacatccaataacaccatgacacgtggatatcaacgtcacgtggcataatcaatcacagatcacttacaactgatcactcactgataagatttgcttcgtgaaactgaaaaaaagcttgaacactccattgttctctactctaccactatctcacagagattcatggatacgatgcgaatctccggtgtatcaaccggagctgaggttttaatacaatgcaattccttatcaagcctcgtttctcgtcgttgcgacgacggaaaatg

SEQ ID NO: 15240 - DNA, 588 bp, Unknown
  misc_feature (1)..( 588): cDNA_ID_3095839_gDNA_ID_2926090_Annot_ID_196552 3000 nt of promoter + ATG
ctagttgaaacaaaatttgtttggttgaattctagaaattcatcaaagagaaaccagaataattttgtaataacaaaatataaaattaatattcaaaaagttttatttggttcagtcacacaagtttagaacaaatttttggtcatattttttattcattttaatccaaaacttcaaaagttagaaaccatattaagaaaaataaaataaaataaaatgtgctaagctataaattgattttactttatataacaaattataattgaaacttatttctttatatcgccaaaaaacaacaattaaattctgaaataaaaaaatcgtaaactcaaatttaaaaagtataaattacaaactaagttgttttatttcattttttaatataatagtttatttggtttaatagtactaggtgttattttaccatttttaaaaagatgagggtttaaactaaaattcatctagattcaaaagatctccttgataccattaaagatggtaatcaaactccatctccatgaggatcttaagaatgagtacctcagtgtgaaagatccatagatcatttggaacgatctataggatatg

SEQ ID NO: 15241 - DNA, 3000 bp, Unknown
  misc_feature (1)..( 3000): cDNA_ID_2990170_gDNA_ID_2926090_Annot_ID_196549 3000 nt of promoter + ATG
cccacggtacaccgcgaatcaatatctaattagcaacatcatttgttttaagacattaaatactttgaaaataaagtatagcatttaaagcttctaactttttgttgaattactcatgttttattttatcaaattgaagtactctctttggtaaagaattcctctacttttattggagtcattctgtatttcagaaacattatttgttgttaaactggtttttaaattactcagctttagtatctattatatttatgtatttcaaaagcttattttctgcattatgtttttactttttagttaaaaaccaaaaataataaataatactaattaaataaaatatagctaatcccctgttaatctcgaaaatatgtaggatgataatgtaagataaatcataaacgaatcttttttttcaataagagaagaatcttacctgccattaaagatttaaattatataaataagattatgggacaagaaaaatgacatacgaataaaatcactaactttctttatacataataacagccaatggcggaggcacaatattagtaaggggtcagatgaccgacccccataaatctttgaatttttgcttacaagcttatgctctatttgattattgtggtaaattgattgctttctaataaattgacctcatgtccagtggtcatatcttttctttgcacctatggaaacgatattatatttattcaactatatcttttgcaattatgttttaagaaataattactgaaactatcacaaaatatgtaaaatggaattatatatatactgtatttgatgaataaagaacaataatgattatcttttattttatttatttttaaatacaatgaattttaaatttttaaagttagatttttttagaaatgaaatattatatttaaatatttaattaaaactaaaaataaaatatgacccctaaacaattttttctagctctaccactgataacagctagacattgcatgtctatcaacaatctccccctgtattatattcttaatcagaacctcttggggatcacaaggaaacgaaatgaagattaccaaaaagaaaaagaaaaaaaaagtagaagaaaagaaatggatgatatcaaaggtccaaaaccaccgtagaggagtactctttttgttccttattaattgtgtttttagagaatttttttttttcaaaaagattgatttttatatttctatgccttatttattagttattattgatgaattttaaactgaaaaacaaataattgaataacattgatgtagaattacacaaaaatgtaaatcacaaaacaatacatttgtaaatcaattttaatataatttcttaataaatttgttttttctaaaaaaataattaaaataaataaaggaaatatgaattaaagacatgcataattcgaacatgggggttggttgcctatctactctccgtttccgaggcattaaaataaatttaatttagtgtacttaatgtaaattgaatataattaattagtctatacttatccatcggttaatttattttattctgtaatgacccttctatttttttagtaatcctacaagtacaataatatatatatatatatatatatatagtacaagtacagtaatatatatatatatatatatatatatatagtacaagtacagtaatatatatatatatatatatatatagtacaagtacagtaaataaatgtgaaaatttgtgataattattggattagttttgtcattatactaacatttgggtattatattcctaagaccatattcaatggtatgagtgcttgagagaatcttacctattttttaattttaaattttgacaatttgaaagtttagcaattctattggcctcttaacaattatcttgttcaatggtaaggtccttaagaaataaaatttggtgtttggtgttttgaagttttgaatagaaagatagaaaagagacaagtgaagtttggcattagagtcttgataaacacattttgaataacaaggattcatgaaaaaaaaaaaaaatacaagaggttttgtattaacaaagattcatgacaatacataacaataatatgacaaagtatacaaactgtgtgatgaatcgccatgttgtaatcaccgccttgtcctaattccataaacttgatctcagtgttccctagattccacagtccacttgaaccatttcatcaaaaatgacacgcgatgttaagctgtgtgagacaatcacaaagtttagctcatgagacgggttgatgtggagtctgttcatgtcgtcgatgtctctgtagagacttgagaaaacctgtacaacaacactcaaaaaagaccaacttctagggtttgatctgaataatgcggcatctgtggtggctgttgctagttacattgctggaagacacaattgagctcttgctagttacattgctaggttggtttaataagaatctaggataaaagttttatccaaagttccccactttcaactgttttggctgcattgctcttaggacatcagaattgtgaagatgagcatgacgtttgacttgttagttcaaaactcacttgatcctgacaaaaacaggtgcttcgttggtttaataagatggatgctcaaggaaaaaagttttacctaaagctccccactttcagctgcttttgatctaaggactgagcatgacatatgacttgttcaatatttacataatcctgacaatatcaggtgaaccattttatacaccagcttatgttatatgatttttctatggatccgcttgttagaatatgtacataaaatgtgacttattcgaccaaacccataattgaaaattcatataattttgttggcagattacagttttaagacaacagtaaggacgttgaccttcattgcttccaagcattcgaaacctattaagagctccacttaatataatattatatcggagaaggtggatcggcc

SEQ ID NO: 15242 - DNA, 3000 bp, Unknown
  misc_feature (1)..( 3000): cDNA_ID_3095890_gDNA_ID_2926090_Annot_ID_196538 3000 nt of promoter + ATG
atcattagggtttagttatattgaatcaataggtatttgtataagacttgattttttgggataaatatattaatttcctgggaaaaattagaacgagaagaataggaagaagatgaaagaagaaggaaacaatgagatattccaggggtaaaatcgtcaaacatttgctgagaaatacctattcttataaactcatcatgaatgtaccctttttctagtttttgtcttaaatatgcctatttgaacaaaagcccccaaaaaatttggataaaagttgtgtcttttataaattgtatttattgttctctttaggtttaaggaaaatatcaattcagcatggataatccgatggttatttcaaaaaaaaaagaaaaacagagcaactcaggagaacgaataaaagagtatgcaaaaaataactttcttaaggaaaagaagacaactcatcttgtagcaaaacttcaaaaacactagattcctaaggaaagtcaactatcctattcccaaaccatcaatatttggaaacaaagaaagtcaactaccctattctcaattctcaagccatcgaaatagggaagctaggtccaaccttttttcttaataaatattgtactaaactaaaattagaaaatgtacaaattagaagatttataaattaaaattgaaagaagccacataagaaaacaaagtaaaatataaaacagaaatacatccctgtaaacacaaaaataaaagtacatgagcaaacattgtttttagtaaattgtttttatctatattaatcactaacatggaagtcaatgtcctttagctatctcttgagtgatagaatcacgtacaacttccatcactctatcatcagtcatggtacatgatcaatgtttggaacagttttttctacttcaccattctctactacttcatcaccatgatgttcatattcttccattgcattctaatgtgcaaaatctgcatcctcttgacatataatctttgataaaattatggcgaggcatagttgatgttaaaagtttcatccactttctcaactcatatttagagtgtttgcaatccttgttgagcacatcatccctcagcccgacttacatgaatagcaccatagacttttttccaataaatccatgtttgccactggttatctttaactttttgtagcttttggtcattcctcaaatcaaagaataagaacacatataaatataagagcatagaaggctaatataatgaaaaggccactcaaagagctgatataagaagatatataccttacaacatccattccacgagtcttaactcatgtcgatggatctatttaaactttacgagttctattacgagtcaatttcttgcaagttttatttcatagaacttgtctataattctttgtcttgtagcctcattgcaccgactgttttctaacatttcctttgaatgtctcttccatccagagttgaatctattgcacaattttttttttgggatctagggttaagaaatgtgagaaaagtgtcgattaattattattaagtatagctatgtaatatattagtttaagtaggatgttttagtcatttgtaaattttggctcactctgaagcatatgactgcgcctccgaaacgcatataaaagcatctttaaaaacgcaaagacttcagatgagttttaaatatacatccagatgcattattcaactaatgtatcaaatgtacgttcaacgaacatcaatcctcagattatctgattgatacatctggatgtacaaacgaacaacacctcacttaaatatgaaattttgttagattatacatttgcatatttaagagactaagtttatatatttctgaatcaagggtttcaatttagtttataaaatttataggtaactttctgattatagatgattagctaaatttcaataaattcaagttatatatctagctatataaaatgtgtaactttctgattgtataactttttccgagtatagatgattagaaaaagtttgtgactctttttcaaatctttcaattaaaaatgtgagctaccatgaacttgtttatattgatataataagatattacaatatattaatacgaagccagaacaaattcattcgattaagttattaaatatttaattttatctataaatcaaactaaaatcagtttagttcgtaaatatacagatatgttaatgtaatagttttacaacgataaatatttgcactaaactacatcaatattatatatttcgtataatttaattttattcttggagaaaaaattatctcgctcattcacaggtactaacataatagtatattttttattattactgaacttttaaaaaaattgtaagatattagagtaaaaaaaactatagataaacggccaaatttatatgattcccaaaattaggatttgtcaaagatttggttgactattgtatgattctctaagccgtgctttaaagttttatcactttatgggaacggctttttgcacaaaggccatagaagaagaaaattaacttagaaggacacattttttctatcaacgaggcttatgtattttggtttgatgaatgtgtttggacactacacatattgaccaaaaagagattccaataatattttgtaaatttaatttatagtttccaaaatatttcatggaattccaaattcacatcgatttcaatatctacactgagaatttttataagaaacgtatcattctctcggtgcttactaaggaagtaaataaatacagcgagtatgtagttaatgcccggacaatgaaattccgcaatcaatctcgagggttaataaggcaaaataaaatttctgctgattctcataattaccttaaatataaaaattctatcaaaaaaccataacaccaacgttccatattcttctataaataaatcattcttcttttcactaaaattgctaattaactcggagagaaaacaaaagc

SEQ ID NO: 15243 - DNA, 3000 bp, Unknown
  misc_feature (1)..( 3000): cDNA_ID_3095868_gDNA_ID_2926090_Annot_ID_196543 3000 nt of promoter + ATG
gtttgttttgttatatattttaaattatataactgtattttaattgttagttataggatttcacccattgtataccgtctcgtattactataaacccaaatccgtcttacctcagtgaaattaaatatatttaatggattttaccagtggtatactgtctcatattactatcgatccaaacccgtcctaccatctaaccccgttcagtaaaattaaacattattttattatttttgttttaataatactttaattttaaaaatatataattcatatcaatttaaattttttatttaaatgcttatttaattgttataaagttcatatattataatattctaaacccgtcctgccatctaatcccgttcggtgaaattaaatattattttttatttttcgtttaaataatatttttattaaaagatttataattcaaatcaatttaaaaggtgtctttcaaatggttatttaatttttatagatttctcattttataaatattctaaacattttttcctataaatattataaacgtttaattaaataactacaatatttaccttttaataaagtataatattaataatattgtgaatgattatgtgtagctaattttaagaaatttgatttgaagttttttgtttggattaaatttgaatgataacgtgattgatattttaaatcaagaattaaaaatcaaatcaaataattaagaatttaatgccaatggcatgccattgtaaataagttccaactatacgatttattttacaaaatggctgcaaaaatgtatatgtagatttaattacagtttttgaattgtctagtcatgatgtaaactcttaaatttaattaaagacaaaattgtgttgtctttaaaagagagtatgtttcagaaaataaaaataatatatgttacgttcttataaatgataaacataaattagatatgatatagaaatatttaaggttaatttaaaagatattatcatgattatagaaaatattggtaggaataaataacgagcctaatttcaaccaactatattacattgagacttgaagctacgattttttgaaaccagtatgaatctccataatttcgttttctacaattcttatataattcatatttgattttgattacactgttttaaattttattccaaaataatgttttctacaatcttggtaagattcatgttcactttcgatgttcattgtatgtaacgttatttatgatatttattattatttagactatgatatgtgatgcataaataaaattccgtggaatttagattcgattttggtattttatagttataatgattggattcatattcgatttgattatgtattatgatattgtaatttgaatatgatataattgtatattgtgtgtactgaattttgattgcggtgttcactgtgtttgatttttctttatccattctatatcaatattcaatacattttgtcctttgttttttttggtcgaaaatatattacgtctttatgatttacttctacgatttcttaaacgagtatacatcttcaaaacatttgttcttcataactttgtagtaagaacctaaccttattgttgaaaaaaaaatttcatatgcgcttactgatacccaaatcataagagatcaagcaaacatatcagatttctgttcttggtggttcagtgatatatgtcaaattaaatctaagaccactctctcaaatctctcttaatataacacttaaggatcgatttctacaaagttttttattcaaacataaaattatttatctcataattaagcaaaaccaaatgagtaaattaaaaacaaaaaaaatagattaaattgattgtaaattcagatgattaaaacgtcatatttaggaaagttctcaagaaatagataaacagtagatttaccaattagataggattattagcaactgttttagaactcaaatcacaaaagtataactttgttcgtaacttatgtttcaatgaaatcatttagttctttgatttttcaactttatcttagatttcgaatttttgttctattttaagtccaaaaacaagaaaagcctttttaaaattaaaaaaaataaatattgacggcaggaccaaaacgaagttgtagttgaaggagttcaaggaggagttgctgaaaacaaaaatgaggttgcagctgaatgagctcatttccatgagattcacattgctgatatatgggcaaatgacaactggttgttttactatgatggagttgatatgctacaatggtgctactagtgtcagtatacttcagcctcgtgtgttggaaggaaacactattaaagctgcacaaatagttatatatgtgtttgcatgcttatagttttaaacttgtattatttcatattaactaaaatcttaaattaattgacgagtgcacaaaatgttcaacttgttagaagtgttatgagttagttttagtaatttactactgaaccactagaaagttttaatagttttttacggacaaaatttataatatgatcgatatcacggaaactactatcgaccattctaccggataagtgattaagaaagtattatctgaaattattttaataattaaaaataaatccaattaccaaaaacattaaaaatatttttaagctaattatctcctaaaataataatccatatgctcaacatttttttacatgcacctctcatttttcactttctcaataaaactccaaaattatttttatttataaataaatcccaactctttcctatctatcaaattaacccaattttagtttagagagcccaaaatttctaatgagacccaaagtttctcaattttcgtaagggcaaaaaagaaaagtttttagaccgtccgattttgaatcctttaatctcttccaagaattctgaattcttctcttcgtagtctttgaatcctaaagtaacaatctttcgtttcagagcacgtctgtaag

SEQ ID NO: 15244 - DNA, 3000 bp, Unknown
  misc_feature (1)..( 3000): cDNA_ID_3095855_gDNA_ID_2926090_Annot_ID_196546 3000 nt of promoter + ATG
gtaactagcaacagccaccagaggtgccgcattattcggatcaaaccctagaagttgtttgtctacttctttgttcaatttctctgcaaattccttccatctttccaaaccaatcaacctcaatatttactaaaaccttaagtattgtatatgtatgtaatacaactgaaatgaaatgtaggttttatcgtttacatctcattatatattacgaaaaatgtaaaatttgaaagttgagacatttgtatataagacataaatttgaaatactaattctatatatacattttaacatatcaattaattacggcaaaaaaaacatcttaattagttaaaaacaatataaaaagaattgacaaatttttcaaaaattttcacttatgtgcgtattgttacgactcgatttcttactaataaataataataaaatgaaatgcgaaaaaatctttattatgttctatgattgttatgtgatctgttgtagcaagtggcaatagctctttccaacgggcatcatcaatggaggattctaaatgttttctctttaataccaaaatattattattttattataatttactgaaataattaaattttaaatctttttttaaaaaatgaatcaatttaacgaagacatgtgactcatttggctcttatataaaatttcaagtctcttatatacgagttttttcttattttctcttcattttctaatatttttatcttttctatacataaaaactatctaaaaaccctctattgagggtgctattaatgatacttaaaaaaagttctaaagccaaaatccttaaatattaagccaaaaaaaaaattaaaactcaataaatatttttttttttttttttttgagaagcaaggtagcactgattttttttttcatcaatctctattgaaatttgaagtgtcagaataatgcaggcttagcaagaatctagctagtcagtttcatcgttgttgttttatcttctctttgttgtgcttttcttccatcaatctctgtgtgaatgaacaagaaggtattaagactcatgctttggtcttttttgagtgttgttgtacagattttatcaagtctctacgaagacatcgacgacatgaacagactccacatcaacccgtctcatgagctaaactttgttattgtctcacacagcttaacatcgcgtgtcatttttgatgaaatggttcaagtggactgtggaatccagggaacactgagatcaagtttatggaattaggacaaggcggtgattacaacatggagattcgtcacacagtttgtatactttgtcatattattgttatgtattgccatgaatctgtgttaatacaaaacctcttgtatattttttttttttcatgaatccctgttattcaaaatgtgtttatcaagactctaataccaaacttcacttgtctcttttttatctttctattcaaaacttcaaaacaccaaacaccaaattttatttcttaaggaccttaccattgaacaagataattgttaagaggccaatagaattgctaaactttcaaattgtcaaaatttaaaaattaaaaaattggtaagattccctcaaccactcataccattgaatatggtcttaggaatataacacccaaatgttagtataatgacaaaactaatccaataattatcacaaattttcacatttatttactgtacttgtactatatatatatattattgtacttgtactatgtgtatatatatatatatattactgtacttgtactatatatatatatatatatatattattgtacttgtacgattcctagaaaaatagacgggacattacagaataaaataaattaaccgatggatcaagtatagtctaattaattatattcaatttacattgaagtacactaaattaaatttattttaatgcctcagaaacggaaagtagataggcaaccaacccccatgttcgagttatgcatgtctttaattaatacttcttttatttatttctaattgattttttagaaaaaataaatttattttggatgcttgacaaatttatttaaaatatagaatcaaaataaactagataacacttttaattttggatgcttgataaataaaactttcggctcattcatatttaaaatcagttttattctttaataataagactctgaactattgctcaatttcttaagcaatgtgggacatttgacactttttttcattgattgagtaatatatgactgtttttaaaattttgagttacattatatatagaaaaaatctaatgttttattaattatatgtattttatatacaatcaaataaattaaatataagaacaaataaaagtgaaagaaaatttatatgtttatatttaatgtagatagggagattttaagaaattaggaattaattgaatgtagttcaataaagataagatttgttaatataaaagtgatataaatttaaacaattatctttttagatagattttgtagcgactatatatgtaatagaggaaatagttaagtcaaatatttaatgcaaactaacgaattataagttcttagaaataaaatatttggttaagataaaatttgtaaggcttgtatgttatttagtaaatagtatagtgatttttggccaaaaagcctacaaaatatatatatatatatatatatatatataaataattaaaaaaatcgaattattcaacactaataagtgccataacaataagtgtcctttctaataaaaataaataacaataattgtcgtcaccagctatcaaaaataataataataataataataattgtcgtcaccaaagtagtcaagaagttacagtttctccaccatatccatgatctatttaaaacagagtaggatggggcagtgaagtaacacatacatcctaagacaagggccaagtaaagactttgatctcgtgtctctcttgtaacgagagtgtctgaaaaatg

SEQ ID NO: 15245 - DNA, 3000 bp, Unknown
  misc_feature (1)..( 3000): cDNA_ID_3095863_gDNA_ID_2926090_Annot_ID_196544 3000 nt of promoter + ATG
aaaggtatcaactttcattgtttaaccaagccaattatcagcttcaatctgatacattttttcgtgaaattgacattgagttttaaccattcgattcgtgcccttctttggattgttacttcaactacttcgattttggttttggaatctcttttgtgaataaagcttttggcttttttgatttttgtctctgaatcctcatgtttaggctatggtatggtaatctctagtctcttaatcaattttgaactgatagagaatcttatgaattgtgaataaagattgtggcttgtttgcttttggctctgaaacctcatgttaaggctctatgctcatctttctagtctcttaatcaattttgcttctttagtttttaactgagaaaattctatgaattatgaataaagattgtggctttgtttggttttggctctgtcccttatgtttaggctatgttcatctctaattcctaacctgtttgcatctgtagttgttaactgatagagaattttataatttgggtggcaggagaaagagaaagtgggataagccagcggagcaacttgttgcggctggagttgcgtttcctcagttacttcctttaggcaacactatgaatgttccttctatgtcaccattgctccaaacgctttcggtgcctctagcagttccaaaagttaatcaagtaaatgactcttacgctcttgcggtgtttgttatacttattttcgggtctaacctttttctcacttagctattgcattatgtactatggtatagatgatatgtcatgttttcatctagtttggtgtcttgatgtatgttcttagtgaattgtaataccttcttaaaattgttgcatcacttgaatcatgttgtcccatgattagtagttttaccatgtattggtccagttccctctggtcatgtatgagactccacaagcacccgaaatatactgtgtttgtgactttaacattattgcctttatactgaacgagctgtttttcgtggatacgtcttttgtctccttttatcctgtaattcaaacatggtgattcgttgtaatttttcttgcatgtggtatctagcctaaaatccaggatgaggtgatcatagcgcgagaaattgttatcaacgatgctgaggcttctcttaggcacaggcttaccaaacgctcaactcaagaagatgtatgtgtaactttgctatgcgtattagttacacttttcctatctctagtttaacttctattcgtcgtgcagattcagaggtctaccggtgctgtggtgattactaggtttgtacaacatccaactcatggagaagaaagtcttacaataatctttctagattcaattgtttaacttcttttgtaggggcaagtatcgtcctccaaatgcacctcctgatggtgaaaagccattatatcttcacatatctgccgctgcccaggtttgttatcctttttggcctaaaggatagactctataatatggcagaaagtaaaacgtttgtggcttaaagaaattcccatattcatatttgagaagctttatttgaccgcctagctttgagatgttggcctggtttttacgtatgttattgcagttgcagttaaaagagactacagaacgtatcttagcagttgatcgtgcagcagctatgattgaggagatgatgaaacagaaatcaatttcacagatcggatcagttggtttacagacggtcaaggtatatactgcgtgacacttcttttttgtagttatgaaattggaacagtaagaaattaaaccatatttccagatgctgagcacatgcgtatatttgggtttcgaagctgacccatcatctaatgttgctgctcgtattcgtgggcctaatgtgagtcttccttcaatatctccccccttgcttctttctaatttacaccaaaagaattgaatctacagtctaatatcaatcaagagaagggttagccatttggtgttaggttttcatctttgattaatagttgcacttttttttatttgtctcaatccatgaattcgagagattctaatgttgaagctctctctgacatctccgtgcaatcgggagagaactttttttgtgttggtggtggttggctttcgtacatgcaggatcagtatataaatcacattatgaatgaaacaggagcaactgttgtattaagagggcgtggttcaggaagccttgagaatcaacatggagatggtaatatttccttcgtttgtgtttttatttgcctacttatgaaggtgttatttacctcaaggtggatgtatctgaatgatattgttaatgtaaatccctttaacgcattatggtagaagcacagctaccgctgcatctattattatccggcagcaacccaaagagcatcgacgatgcaaaacgtttagctgagaatcttatggatacaatcagtgtagaatttggggcttcaaggttaatttttccttctatgtcttctatattatattcagaagcatgttcctacatctttgtcatttcatttgctgatctgtaattgtatttggttttgctacaaaatgtttcagggtttcctcaagcaaggtgtatggtgcagtaccaccaccacagcaactgatttctggagctccgggttctgaccaggagaaccaaaatttgatttcaacgtatggtttgatgacatcgatacccatcacagcaccaccatacgctgttagttcgtttccagttactccagcaacaagtctttatcctcagtttccagtaatgcaatctctaggaatatcaaatggtggcccctcgcagcccgtggctggaggaactagctatagtgggtatgctggaatataccctcaagccacaccattgcaacaagttgctcaagtccttaagcaatcaatttctcctgttatctctactgtgccccctactatgttgacagctacgtccttatcgatcccaagtgataatgcaagtaatgaa

SEQ ID NO: 15246 - DNA, 3000 bp, Unknown
  misc_feature (1)..( 3000): cDNA_ID_3095936_gDNA_ID_2926091_Annot_ID_196563 3000 nt of promoter + ATG
agtcatgggatgtgatgaatgtcataaaggaatggcttttcaagctaccttgatgctctcctgatattgctgagaggtttctttttcgtgattgtctcgtaatttaaaataaagtacaatgctcatgccttctccatcactgtccccaaggaacattgcagcaggataggttggtaactgccagtgaggtacaaaggtcaagatcatttacacatatatgtatatcaaacgctaataaagcttctgatgaaaaacacaagcaaaagttagtccacaaacaaagattacgaagcggttaatgttgagtggtggttacctgaatgttgacaacaagaagagcagggagctttgcctcggctttgatgtttggaagctcgatgtgttgggcgatatgatcaatcttccttggacagacaaacaagtcaacacctataggagtgtatggacactgatttggagctggggatttctttttgtctctgtaaacatcattcttcaagagttacggacaaagcagtatatagtaaagatacataaaacagagtggtgataggtttacttgaaataggtttctccacggagtttaaaagttgaaggcggtatctcagaccaacttccgctagactgcttttctctgcccgaggaaggaattgtgaatcccgcttttggacggtacaacaacttacgttgctcagtaacttcctcaccatcacacgacctccttttgaaagaaagccgataaacagcggattttcgtttctgagatgtgggtgagtttagagtcttgtcattaaaactgactgttggcatcaaccggctcaggctggttctcagggttttctcttgagagttacgttttggatccttcaagcctttaaagcttgcatggtccatcagtttcttcttgttgtttccagtaagaacagagagaccactcggatccttgtacatcccttttgacacaaacttctcggctttactcccgtctatcttcaagtaagtctcatggtattcttcgtactttcctttaccatccacgaagcacgaagaagattcaaactgaactacttgaccatttggtatattgttaccagtcgcaccacccgctgatggcgttgatggtacgttttctgctaggagagattgtaaaagagattcacatccacatcaacattaccaaaattgttcctcttattgtatatgacttcaaatgatcttttaaactccatgaatactgaaaagaatgtagattaacatttaccttcaggtaagctgataaagtcctcatcctcatccgaatcaagaacactgacagagtcaaaccatgcatcatcttgcgagatagctgcaacaaaacaacttataaaggtaaaaaatctactctaatcatcaacagaatcaccattatatgatctaccataagccattacagaaacactcaccaaaagaaactcggctcccaacgtcactaggccttctaatattagcatgaggaacaatatcagacactttagaaaagtgtttggaagatctacgacggcctttcctcctaggcctaatcgcttttgaatgggttgacacacatccacccattgttctatacttttatttagatcctgttcaacaaaaacatgtaatgtaagtataagaataagaaatctgcaacatataaacacagctttcaaataaagatagttaagacccacatagagaaactagttgtttcattctgtcttattactaacattgggaccaagttttgaagaatcaacaaccaagtcaaatacaataaaacaatctctcaactataaaataatgtagccagctcaaaaagtgtacccaattaaaagagtaagtgggacacaataacatgtaacaacaacaacaacaacaacaacaacaaatctcaatattaaaaactatactcataagaaaaatctcaaacagagaattctcaaataacaaaaccaacactaattggtaaaattcaatcactttcagatacaaatcttaaacataaaaatatgacttcataacgtcaacatcatcaatgagaaaaaaacgttgaaaacaggaaacagaatcatcaaataaaaatcaaaactttattcaaataatcagacactaccaaaaaaaaaagactcaaactttacgaatctatgacgatcatgtttcatacgtagcggaattagaatagatccgaacacaatgtggaggaatttaaagaagaatcttgattaggtacctgagaattttaggcatgataaagggcagtgcccttttaatgaaattgaattttgggaagaacccaggaagaagaagaagagagaagataagaggaattagattttgaaaacccgattatttcggatccgggtcacggatttagctttccctttgtctctctctctgctttctctgtaaaggaagagagaaagagagaggaaacgagagtcaggggagagaagattatctttgggttttattaattgcaaaattaccaaaacgatttttttttaaaaaagcgtaatttattatttgataattatatgagtaaattaataattgcctaattacagtcatagcagtaagttcggtaaaactggacgaaaaaaaaaaatgtaaaactgatgtatataaggttttttgaattttccaacctaaattatttataaactgatgtatattcttcgtgaaatacaatcatcaactttaatatttctgaaacaaatattgtatatttttggattcatccgagaaaatatgcctccaattaaactagttattaaagcgggtttaaccacaaaatcgcgtttactgttccacaattacgattacccacataagtaatcatgattcttcttgaaacgacgtcgtttcacctttgttttgttttcccaaaaaaaaccaaacccaatcgattgttcgatcgattgaaaaattagggttctagagagaaagggggatttttgagatttatgggttttctttgaaattatg

SEQ ID NO: 15247 - DNA, 3000 bp, Unknown
  misc_feature (1)..( 3000): cDNA_ID_3095931_gDNA_ID_2926091_Annot_ID_196564 3000 nt of promoter + ATG
tatgtcgaaagagctcgcactacaaaatttatgaggatctctttgccacttaagacaagaatttggctgaccatgtatttagccgtttttgaagtctatctcgtacaaatgattacacttaagttttagaaccatgaattttctgaggtaaacccaagtaagtccccatacctgacagtattgtccacgtcatggccaaacattacagatgacttagcagcattgagctgttgtcttgaagcctcgccataaatgctgagaatattgataatctcttgaccctgagatggatctactttgtagaaaaaaggactatcatctgcaaacagtaaatgggatgtagatggacttgcacgagatatttgaaggccttgaatccgcccattccactctgcatctttaaggtttgctactaaaacttccgtacataagataaataggaaaggggaaataggatcgccttgtcggatttccctcgttggtttaatgaaaccccttggtgccccatttaggaggactctatacgaaacttaggagatgcaaaaaattatcatgtttacccatttctgcacaaaccccatctttaacatgagtgcacgtaaaaatgaccactccactcagtcataagctttactcatatcagtctttatacccataaacttatttctgcatgccggattggtccgtagagcatggaagttttcttgggctataaaaatattatctgtgataagtctccctgccacaaaggctgattgagtctcgaatattaaatccggaagaatttcttgagacagcaacttaatacttttgaaataaccttgtagcttacattacaaaggctcactcggctctttagtagactacattgtccattaggaatacaactatgatcaagacatatggtcttcaaaacccacatctgcagatccgaattatatgatcagtagacataccagtcacaacccttcttttgagcacacctaaaacttattttatccttctcccacctattttgcttaatgtttagcctattcttcatagcataatgtaacataacctctttgaactcaaacccagtgaaaaatgttttacctataactaacttatcacctgatgccaacctaattttcctatctttagtgaccacgggatcctaatctgcatcacaactctctggtatttcatcacgccgaatctgaaactcatcaaaccaatttgccacggcttcctctatctcgaactcgaacctctccattatgtcttcttcacacagatctttcgtctcttttctccccgatttcttctctctttgccttacttcagaatcaacatcgtccttctcgccttcatgtcgtttcctgttccttcggctttcatctccatctttctcacccttactttcattgtcggagtcgtctcctccatcattgtcactatcgccgtctccctcatcgccgctttcactttcactgtccgccgtttcgacctcattccactctccggaccctcaaaatcaggatcatctggatcgctctgatacactaaatcttcctcgtgttcataactcgacgaagccccataccagaatgacataatttcaaagaaaacccataaatctcaaaaatccccctttctctctagaaccctaatttttcaatcgatcgaacaatcgattgggtttggttttttttgggaaaacaaaacaaaggtgaaacgacgtcgtttcaagaagaatcatgattacttatgtgggtaatcgtaattgtggaacagtaaacgcgattttgtggttaaacccgctttaataactagtttaattggaggcatattttctcggatgaatccaaaaatatacaatatttgtttcagaaatattaaagttgatgattgtatttcacgaagaatatacatcagtttataaataatttaggttggaaaattcaaaaaaccttatatacatcagttttacatttttttttttcgtccagttttaccgaacttactgctatgactgtaattaggcaattattaatttactcatataattatcaaataataaattacgcttttttaaaaaaaaatcgttttggtaattttgcaattaataaaacccaaagataatcttctctcccctgactctcgtttcctctctctttctctcttcctttacagagaaagcagagagagagacaaagggaaagctaaatccgtgacccggatccgaaataatcgggttttcaaaatctaattcctcttatcttctctcttcttcttcttcctgggttcttcccaaaattcaatttcattaaaagggcactgccctttatcatgcctaaaattctcaggtacctaatcaagattcttctttaaattcctccacattgtgttcggatctattctaattccgctacgtatgaaacatgatcgtcatagattcgtaaagtttgagtcttttttttttggtagtgtctgattatttgaataaagttttgatttttatttgatgattctgtttcctgttttcaacgtttttttctcattgatgatgttgacgttatgaagtcatatttttatgtttaagatttgtatctgaaagtgattgaattttaccaattagtgttggttttgttatttgagaattctctgtttgagatttttcttatgagtatagtttttaatattgagatttgttgttgttgttgttgttgttgttgttacatgttattgtgtcccacttactcttttaattgggtacactttttgagctggctacattattttatagttgagagattgttttattgtatttgacttggttgttgattcttcaaaacttggtcccaatgttagtaataagacagaatgaaacaactagtttctctatgtgggtcttaactatctttatttgaaagctgtgtttatatgttgcagatttcttattcttatacttacattacatgtttttgttgaacaggatctaaataaaagtatagaaca

SEQ ID NO: 15248 - DNA, 3000 bp, Unknown
  misc_feature (1)..( 3000): cDNA_ID_3096020_gDNA_ID_2926092_Annot_ID_196568 3000 nt of promoter + ATG
aattcaacattttcccgccaaaaacgacattcaacattttcccgccaaaacgcaatttaacatcttcccgtcaaataacgcgattcaaaattttccgtcaacaaatgatttcacatttttccgccaaaaacgacattcaacattttctcgccaaaaaggatttcacattttccggtcaaaaatgcaatttaacattttcccgccaaaaatgatattcaatattttttcgccaaaaacgcaatttaacattttcccatcaaatatatatgtaatacataaaataaatacaatttaaaatatatttatgagggatttttctgccaaacacgacttgtgatcttcacaaatagtagattggatccatctatgagggatttttattggacatctctaaaacaacgtcttcggctcgtactccaagcttctctttaactttacttgcaaactctttgtacatcattgaatctcgcaggcaaactaatcgattttcctccatagtttcagattctaaattccaaaccaacggatcgaccttcacccattctcttataacgagcataacatgctcttaagcagtcatttatgcagcgtttacggttggtaggaggagaatcaatcaagtcctgattttttggttatttcaataataaacactaggcctgggcaaaatacccgaatccaaagaactgaactgaacccgacccgaaaagcccgatccgaacccgaacccaaaattttaaaatatccgaacgaatcctaaactttaaaacccaaaaacccgaacccaaatctgattgaacttgaacctgatcaagtacccgaacatatctaaaatatatatacatagaaataatttaatagtaacaatcatatttacaacaacttaattgcctaaatgtttttggattttaacctattttgtatatttttgggtaatttaattatttttgattgattcggataaaaaatactcaaattcttttagaagttgtgtattttcaagtaatttgaatatattttgatacaaaattttgagttttggatactccgggtaaacccgaatccgaacccaaaaaactcgatcccaaccagacccatacctaaagtcttaaaatacccgaacagctcttaaattttttctagtcatgatagttgtatctttaacataaatcttatagcaaaactatactttttttttttttttttttttttttgataaaccctatcggctaatccggtcaaccccggtagaaacgcaccgaagtacttcagagtggactttttcccgaaggaccaccacactgtctgtcccgagtttggatgctttccgactaatgccagggggtagtcaggccgcctgcatttctgactaccaggtaaatcaattgggccaaagcccaactgacagacttcccaaacaaatgtgatttttgtttccaggagcatcgaacccaggtctgaaagtttcacccttccccaaatcttctcctaccactggaccacagatgcttggacagcaaaactatacttgatattctaaatttatcaatttgctcttgtgaacctcatattagcctagagaaactttgaaattctttcaagaagttctatgtagaatacagttttagtaacatttattagccatttcgattaagattattgttagcaaaaagtttttttttttatatatataagaaaaactatgttttagatacaatgtgagttaggcttcttaaattttaaaagttaaatacatttatacttaaaaatagttagaaattcaaatttatacataaatatgtcaatttgaaccttatacccattaaatatttggtgttagatatcaaaataaaagaaaattaaccatttgttacttatattgaattggatattgttacatgtatttatgtttttttttgtttaattttgaaacgttgataaaaaccattaaatttaagttttgtactatatttatttgtcgaaaatataattgtcattaaatataacgttaactttatttttaaaatacgttgttatttttatttcgtatatagaggtaaggtaacttcattttttaaataacaaatacaaatcattctttattacgatttgtttagttaaacaaaaatatttcttgtatatttcaatcataagtagatatgtctaaatttaactctcagattactatgctattcattgttttagctttggtgtgtgcgtttgttccggctttctcaatcgaagaagcggaagcaaatttattatggaaaacttgtcttgttaaaattactcctaagtgtgcgttggatataatcgctgctgtctttgaaaatggaacaatgcatgatccttgttacaacgatctcgtcaaagaaggaaaagtgtgtcacgatacgcttattaaatatattgctgataaacccatgttaattgcccacgaaactgaatacttgaagaaaagtgatgacttatggaaacattgtgtctcaatatccaaaagtgcttgaaatatgtaatattttttactgttttgatcaataaattggtattttctgttattgaagttttcttcactcaaacatttatattttcactttactacaatttcaatcaaagcgaatttcgttctaaaaaaatgtaacataaatttatgattttctattatcacttaaaacaaagtttcttatgaatagcgaaataataataattcaatatttaattattaagaggcgctctaaacattatttttagagaattgtttttttgtattttctttttaatgagattaatatctttttcataatttaacgaagtttaacttttttcaaagcatttggagaacttatttctttaaattccggaaaaaaagaatttaaaatctttatcattattctataattcagtgaccttagccaaaaacctcaaacaaataagcaaatcattttcaagcagatttacaaattttaaatttgaatttcaatgcacaaaacgaaaaacttg

SEQ ID NO: 15249 - DNA, 3000 bp, Unknown
  misc_feature (1)..( 3000): cDNA_ID_3095995_gDNA_ID_2926092_Annot_ID_196577 3000 nt of promoter + ATG
aaagtttgatgcaagaagtgatgaagggatatttctggggtatgccacaaacagtatagcgtacaaagtttacaataagaggttgaagagagttgaagaattagtcaatgttgtgtttgatgacaaacgccctactagactattccctgtggaacaagatgatgataagcatgtagaagaaacaagacagtcaacgcctgaagttgaatcaggacctcaaaaggatctgaacagacaatgatgactacagaacctcatacatcatcttctcgccttactgttccaaaaagtcattcagagactgatgttattggaaagttggatggagacagaactaccagggggataaagatgaactacagagatatgattctgtttacttgttttgtgtcaagcattgagcctaccaacattgaaattgccttagaggatgaattctggtaccatgtttgccatgaagaactaaatcagttctgtcgtcatgaagtttgggatttagttccaagacctgttcacgtcaatgtggttggtactaaatggatctttaagaataaaactgatgaagaaggcaatgtgacacgtaacagaacaagacttgttgctcaaggatactctcaggttgaaggaattgattttgatgagacattcgcccctgtagcacgtctggaatctatccgtcttcttcttggaatctcgtgcttgttgaaaagtaaactgtttcatatggatgtcaagagtgcgtttctgaatggagttattcaggaagaagtgtttgtgtctcaacctaaaggatttgaagattctgcttttccggatcatgtttacaagcttaaaaaggctctttatggttcgaagcaagcaccaagggcttggtatgagcgtctcactctgttcttaatagaaaagggtttcaaacgtggaagtgtggacaaaactttgttcatctttatagatgaaaaagacatcctcattgtgcaaatttatgtggatgatattgtgtttggaagcacaaaatagaagcttgtcacggactttgtggaatccatgaccaaaaagtttgagatgagtatggttggagagatgaactactttcttggtctacagatcaaacagactgatgaaggagttcatatctctcagtctacttatgccaaggggttgattcagagatttggaatgcagacagctaagacctcgaaaactcccatgagtgttactgccaaactgtctacagatgaagctggtctgagtgttgatgagaattgtatcgtgggatgattggcagtcttctgtacttgacaacaagtaggcctgatctgtgtttcagtgggggggggggggtgtgccagatatcaggctaatccaaagaagtcacatctgaatgctgtgaaacggattctcaaatatgtgaaaggtacaatcgaggttggattgttttattctaaacaaactaatcaaaatcttgttggattctgtgatgttgattgggcaggaaatctggatgatcgaagaagtacaacaggagggtgtttctttttgggaaacaacttagtctcatggcatagcaagaaacaaagctgtgtatcttcgtccactgcagaagttgagtatattgttctagggagctgttgcactcagttgctatcgatgaaacagatgctgcttgactacggtatgacatctaccaccctgcttgtgtactgtgataatatgagtgcaattaacatatctaagaatcatgttcaacactctcgtatgaagcacattgacattagacaccatttcattcgtgagcttattgaaaacaagattgttgagatctctcatgtttcctctgaaaaacaattagctgatatatttactaaaccattggatttaaacagtttcttgaatctgaaaaaatctattagtctgagtgaatactaatgtgtcttggtgttaaagctattgcaacacgttccgttgtccagagttgcagcagctttgtattttcatatgtatatatatatattgtgtctgtctttctggcacttcatttcaggaaaatagctgctcttcatgctcttcctcaataaaatttccaaaaaggatgagtgtggtgtgtaataattttaaaaaaaaaaggcaaaaagaaaagcccaaaagaatgaacaaatgaaagttcaaaagaaaaaaaaaaaaggggaacatgtgtgttggcaagaaagggattgatattctttcttatctttggagtatatgtgtatctatgagtaccccctcaaatcatccttcttcattacaggctctaccaatccccctcgtcgttttgaccacacacatcatgaggctacttcgatggagagtatgacgagtgtagactaacctgctatgttcagtgtgtatggcacatctcactgggccaggaagatgttattttctccatattcaaagtaagctatgaacctctgtactttggaatttgtccttctcgctttaatgatatgaacaggtgggttccttgacttctttagaagtaccttcaaatgcttttgaattatatatataggtatatatatacatatatatatatatatagtatttggtattttgtgtttctgttttagaggatgacttgaagagatctcacattcagtttgaatcacagctcttgaacgacagtggttgttaatattcaagtgttgatttgggtgaatttgtggttctatatggtcagacttagattaatgttgcacatccgtttgtatagttgggtgtttgttttgtgtctggattttgttttgttggttttgggcctggttttaggccttatgagtgtttaacggatatgctttagtgttttgcagcctgtcttggttttcgtgttgtttttagggttttgcttaaagtgctcgtgctatttaaccaaagcagctcccacaaaagtttcattcaccttttcggctactcaaccctcagaatttaaagggtcgccttatctctaaactcaaattcatcatg

SEQ ID NO: 15250 - DNA, 3000 bp, Unknown
  misc_feature (1)..( 3000): cDNA_ID_3095950_gDNA_ID_2926092_Annot_ID_196588 3000 nt of promoter + ATG
cttctactggctaagaagaatcctgtccagcttgtcattcagcgctttgatctccttcctgtgtttgtcatcagagtcagttgtgcctctgatagttctgtcgcagtcctcgttgtaattaccatctgattgagcaaggttctcaaccaattcccaaccttcttcaacatctttgttctggaaattcccattgctggcggtatccagaagcattctgatccgtggtagaactcttctgtatagagtgctgagcagagaagctttcttgaagccatgatgagggcattggttggtgtaacccttgaaacgctcccatgcttcacagaagctttcaccagtcttctgtgaaaagccagaaatctcatttctaggtcttgcagttctggcattggagaagaactttgctagaaaagccttcttgcaatcatcctaggtggtgattgagtcatggggcagattcttttcccagatgttaacatagaaatttatttatgttagatatttcataataaaatttcgatatatcataactcattccattattttagtagattatatttaaccagccttctactgtaagtattatatatatatatcagttttaggaaatccaattagagtatttacaatttataattttgttttattgttttaaaagacaagaagtttttaattgagagagatagtgagagacaaattattattcttgtcaaccttcttctctatattgtcgggtaacaaaatttaaccttgtttttttatctattatgtatttatattttatttgaaatatcaactaaaactatttttaaatgttccaaattaaaatatataattttttttggttatatacaaaattatacattccaaataataaatgtatgaaattgaatttagatattcaagttctaacccgttactcaatgagagtttttgttaaatttattcttgtttaaaagaaatatattactcaaatctgtattttgactgttataattttttcttcttagattgaaacatttaaatttgattttaaaaatttaaatcatggcatgtgcagacaaaaatctaattttcattattatattgatgatatgatgatttatttgtttaataaaaatagaatcaaataaagatgaatggtgaagtataatgatgaaaaacaaaatcatatatcatcaaacaaataggccaattgattagtctaatttctaatcataatgaacaacaagtttcattaattgaggaaatacgattcataatatcttttttaaaaaaaactgaagtcgaaaacgtaagttatgtgtatgattcaaaattgataatttattaaatttgggaaaattccccaaaaaaccagaactatttaaaaatctgcaagaaaaccacctgaatttttttctttatcaaaaagcacacaaacaaatttgggttggaaataaaatacacgatctattatttttccgattacctcccttcgccgtaacggactgttaacgacgttaaccaaataatcaaacggtgttagttttatttagtatttgccaaaaaaaatacatgaacttttttcttctcataaaaatacacaaactaacttaattggaaatataaaacagggtctatttttattttttcgatttccgtaatcaaattgtcaaatgtggttaattttatttacaaaatattcttaaaaaacttgactattaaagcaatcctttaaaaccttaattttttgagtaatatcaactaaaatcatgttattgatgggtatgttttatcctaaattactaatatatttttcaaattctatcagatatttagattcgatgtaagcaacattaaattaaaaaaaattaccccctttattcccaaaggttctttttattaatttcttcaatttattgtggttaaattctgaaatggatatatgtgttatgttaaaactaggattcaaaataggttcaatattgataatgggctttgcccactctccgacactctctcttattcctgaatccaaaatcgtccttaactttcttttctttagattttgctccaaaatgtctccttatctccattgttgtcccactacatagagtacctgaaaagacactaagaagactcgataaataacataaaaactcaaaatcgtatacctaaaacatagataaaaatcagtgaaagtaaggatatatcaactcccccagacttagcttttgcttgcctccaacaaaacacaaaagccaaacccgtggaagaggttttgaaaacaaaggaactcccaacattctctagcctattgccatgatcatccaaactaagtccatatgccttacaagtctaatcaaatcctaaccaacatgtacttctctgcaagcttacacaacattctagattccatacctaaattccacaactatatctaccaggcttttatcgctgggtctcatcaaacaagctaacattcaagatccttttagactcattcatgtactacaccataataaatcgaccattctttatataaattttttctttggtgttctttttctcaccaagacttattctttttagagagtaaacaaaggagaactcgcatactggatcgacaccctcagcatttttccaacctttgtaattgatcattccaaatcatatatataatagcagagttttctctcctctaaaagtgtccacgtcactacatctttttaatgtggagcccacatgtttttactctgccttcacatttttttctatgcgtgaaatagatttagtgatgtttatggggccacgatttggtcaaaaagcccatgagccaaagaaccaaatagacttagtgatgtgtatcgggccaagatttagtcaaaaaacctatgaaccgaaaggacctaagaaaacccagttaaaattgcaaaccctcgatttcattttctccaattcgatcgacgcaattcagaggaccacgaaagagaaaaagagtgtttcagtcactgcccc

SEQ ID NO: 15251 - DNA, 3000 bp, Unknown
  misc_feature (1)..( 3000): cDNA_ID_3095989_gDNA_ID_2926092_Annot_ID_196578 3000 nt of promoter + ATG
ggttttcaaaaatcgacttggcctcgggatatcactaaattcgcatagaccaacggacgtgaggaaaacggctttccggacaaggtacgaccactttgagtttgtggtcatgccattcggattgaccaatgcactagcagccttcatgaaaatgatgaatggggtgttccgagatttcttagacgagtttgttatcatcttcattgacaacatccttgtttacacgaaatcttaggaagcttaccaagaacatctaagggtggtgctggaacggctaagggaacatgagctatttgcgaagttaagtaaatgctcgttttggcaaaggagcgttggttttctcggccatattatctcggaccaaggagtatcggttgatccggagaagatacggtcaataaaggagtggccacgaccaaggaatgccaccgagatttggagttttctcggactagcagggtattaccgaaggttcgtaatgagttttgtgagcatggctcaacctatgactcgactgaccggaaaagacaccttattcaactggtcggaggattacgaaaaaagcttcctggagttaaaggccatattgactaatgcaccggtgttggtcttaccggaggaaggtgagccctatacggtttatacggacgcatccatagtgggactaggatgtgtactaatgcaaaaggggagtgttatcgcatacgcgtcaaggcaattgcggaaatatgagaagaattaccttacgcatgatttggaaatggccgcggtagtatttgccttgaagatttggcgatcatagttgtatggtgctaaagttcaaatctatactgaccacaaaagcttaaagtacatattcaccaagtcggagttgaatctaaggcaaagaaggtggatgttacatgggattccggttagtatagtgtcggaccgagacacaaggttcacgtcaaagttttggaaggcttttcaaaaggccttaggaactcgaaagaacctaagtacggcctaacacccacagacggacggacaatccgaacgaacgattcaaaccctcgaggaatgttgagggcatgcatcttggattggggaggaaactgggagaaatatctaaggttagtagagtttgcatacaataacaattttcaagctagtattggtatgtctccctatgaggcgttgtatggccgagcttgtagaacaccgttatgttggacgccagtgggcgaacgttgattgttcggacctacgatcgtatatgaaaccacggagagaatgaagttcttaaaaattaagttaaaggaagcccaagatcgacagaaaagctacgccaacaagcgtcgaaaggaattggaattccaagtaggagattttgtgtacttaaaggcgatgacctacaaaggggcagggcaattcacctcaaggaaaaagttaagcccaaggtatgttggcccgtacaaggtgatcgaacgagtaggggcggtggcatacaaacttgaccttcctccaaaactaaacgcgtttcacaacgtcttccatgtatcacaactacggaagtgtttaagtgatcaagaaaaaagcatggaagatgtacctcccgggattaaagaaaacatgacggtggaagcacggctggtacggatcatggatcgaatcaagaaagggactcggggaaaatcatgggatttgttaaaagtcttgtggaattgtcgaggccgtgaagaatacacttgggaaaccgagaataagatgaaggccaattttccggagtggttcaaggagatgggtaaagatcaacttgatgcggattcggagacgaatccaattcaaggggggagacttgtaatgcccgtgatcctcaataagatcgttggctaggacttggtccgagagaagaaggtggagtctcagacaagtgagaagtagctggccacaagctcggacaaaggggaaatcatgcgggctaagctagaatcataaggaaatcagttgggtcagctcgcccgaagctcaagctcagctgaaggagtgacggttactcaggtcgagtgacattctagcttgggcagctggacgactgacagttgagctcgaggcagctggacgagtgacgattgagctcgaggtagctggtcgactgtccgaccaactgggcggttatccggacggttatttaggcggttatggtcgaacggttgcttgtccaaaggataagggcgagcagttacgggcgaaaagatgcaactcttcggaaaggtgcaactcttcggaaaggtgcaaggaacaaatgtgttgattcgaaaagcatctattcgtcccctatttaaggaagggcgcccaagatcatttaggataccacaacacacagaaaaacaccggaaactcaccaataaactctcgccctctcgggagaataaatagtcggaggttcggtagccggactgtggccgacaaggaagaagaagcgtcggatcgaccgaacaacgtgaaggaaggtgagggaatcctagacctcgagtctaaggattctaggatgcgttatagatgagtcgggattccttgaaaggaacgactgatcggggcctttcaaaacttatatgtgattgattagtttgaagattgttctaataaagtgtgtttattggagttttggtcttgttctagtcaaagtacttagggctcttttacttcaattggtatcagagcgggtaaccaatatgagattagtatatttaaacaggttagatcctagttatggaaccaacggatgttagtactggtacaggcaaagtattcttactggatactaagcggtatggatagtggaaagttcgtatgacacaactcattagaggtcaaggtgaagatgcatggactgtagtagaggaaggatgggaacctccatttgatcttactgaagatgggttcaaaatcaccaaaccaaaggcgaattggactagagaagagaagaatctgtgaaagtttaatgcaagggctatg

SEQ ID NO: 15252 - DNA, 3000 bp, Unknown
  misc_feature (1)..( 3000): cDNA_ID_3096047_gDNA_ID_2926093_Annot_ID_196593 3000 nt of promoter + ATG
attacaaaaattcacgtggaacactttgattccaaaatataaagaaaatatattaggcatgactggcctgtgatataattttttcttaaagaaaaacttggattagtttggaactaacagagtattatttcggacaaaaactaggttaggaatctcccttggtccctaattattccaaattttaaaagatgttttaaaaacaatttcaaaacaaaatgatgaagaattgtaaaattcaagaaaactaatttactattaattaattggtttagcgttacagaaaatcgtaaataacaaaaatgtgcatttatagttaaattttaatttattttcttactatatgtgaaaaacttaaaacttaggaacatatgaggtaataataatcataacctagttattcatacaagttttgaataactggtctatataatacttatgtaatcaatcaatatcacgcttcatttttcttctatgatgtctttttttttttgtgtgcaacttctacgatgtcttttctactattttttctactttttcgtcaactacaagttttatagttttaaacttaccatttaatttttgtttttttgaaccaaaaaggtataactattatttgttgttttctctaaatattatgttgtatacgaaaatgataacatgagataggtttgaaaaggattaagcaaaaccctttccacttaaagagtggaaagacaacacataagacgtgacatatgaattaatctattgattaagtaagggtatttaatgttaagagttaaagaaggaaaaatgtttgtgagttctttttctgtacaagccacgtatagcatatagttaagctttgcttcggtaggttaatatagtagttaacttggtggttataattaagtttcatttttttttgtcttaagtaaatgatcggctataaataaaaatttcattttttttgtcttaagtatatcttcccaaaagtataagcatattttattgtctggagtagtttaaatatataatatagaaaactaaattcaacttctctcaagtgaaaaattaatgctgggaaaggtgtttttttatttaccaatcctaaacgttatgtctagcactgtggattgatatactaatctttttgatagcagcctaaatatcataaacacaaaacacacgttttaataataagaattcatgacaattaaactacatatattttttatattttaattttttatcgatagaattttaataatatccatcatcccagagtctgataaaagatatgttagtgtctaatttagttggttttttatcaatgaaaattgtaaacattttaatatttctataatctttactcggccttgttaattgttattctaacgtatgtagttcttcgcaaaaaaaaaaaaatacagtaatcaatttttgtttaacaaggttttctaaaatggtgatggttactcccactgccatgctaggaaccctcaaacctaggattccgacatacaccatgttttgaagattttgaggtgtaattgccgttataaaatattgttattcgagtagaaatgattttgttttatattaaaccaccttaattttatttttttttgttttttatagtttaagaaaagccagtaaaacttattttgtttattaaatattgatcaatgttaagaaattaacatatattgaaaacaattaaggtggtttaaaattaaacaaaaaacataaaaaaagctaaatatttatgcatgaaaagctaaatattagtcagtgtttagaaaactaacatatatattggaaaaaaataaaggtgatttgaaataaaacaaaaacttgcctgaacatcagaaaaatatataatcaaatcgaataataaaactttgtaataataatagttgtgaatgctgattgggaattagaatagtaatgctagatagaagatttcttaattataattaagaaggattttttatatatatctatatatatatatatatatatatattaaaattagaattatgatttcctaagttacacatttgaagaaaaccaacattaaaaataatatctagaataatataatgtcaaatcatatatattaaaagagaattttgtattttttaaacggtagataaaatataaaatttaacaatgaaatccgaagtttgtgaataggaatgagctatatatgagatttgtcatctataaaacaatttaacatgcacccaaaaatcgtcaaagaaaccttatgataaacacttctccaaattctttgatgttcactttaataagaaaatcatgcaagttataaataagaatggagtattgaaagatagaaaggagaaagtatatactatataacttaaaaactaatttatagttgaatatattatatctgagccaatataaggtgaaaagagagtagatggcgaaagatgacgaatgaattataaaatataacagaaacaattatagtgaaatgagaaatttttaactattttgaaaaaataatgcacataaataaaaaaatttaaaatttaataactataagattcgcattactaaacattttaaatttaaatctgagacgaatttcattaaaaaataaatttttaattaaatgcttcgtgtatataaaaagtagactcaaaatgcctttttattattattttcggcagtgtagaatattccagtctacactctacagtatatgctaactaatttaatatgttttcacttttcacaataatattaaaagctatttaaaattagaaaattgtgaccaccatttctttctttttaattttcaagaatcaactttataaaaagaatttgtctcttcttcttcgatttgaaaattccttttcttccacgcatagtctcacgtacagtcagataaaaaataaatatataaattacattttttaatcataaatcttagcttttttgccttttcgagtttttttaccggtgattcttgaagatgaatcgaacatg

SEQ ID NO: 15253 - DNA, 3000 bp, Unknown
  misc_feature (1)..( 3000): cDNA_ID_3096040_gDNA_ID_2926093_Annot_ID_196596 3000 nt of promoter + ATG
tcttaaatgattataagagactttggttccaaactcgagcttttaaaaattgtcgaagaagaagatatgtggtcagtgtttgcaacggaaatagattcttttacgtaatcattttagatgttttgcgatatcactatacctagaaagttgaatatccgagctgacacccttgcaaaagggtttattttcgagatgtcattttttctatataaattctcgggttccgaagtgattggctcttgatgcctaccttttcgaacctgtttaataatatatagaatattttgtcgtaaaaaagaaaaaaatcccgatttcccgctgcggtatattgttttctgaaaggcgattctaactaagtgttgtttatatgttgtcatttggattgaaaaacgaaaaatcatctctaacatacatacatatcgtaaaatgaacataaattcatggaacctagaaaatcgatttgctatagttgtcgtgtctaatcacagtaacgaattaacacgacaatcatttaacaacatttgatctcattcgctgattgatacgatactcaaaggagcattatttagtcacggtcgtcgactgccatagaaatctatatataacaattaatattattatgccacctacatctcgtaaatacttcctcacatttcttgtgtactgttgttacaacgaatgagtgccaaccaatgattaaactaaacttactaaatatttgtacacatatattattataattcctccatatttataagaattaaacttcgtaaattcattgtcaattttttcaagaaaatacaaagcgtgaaagttgtctacttgtctggtcggccagaagcgcagagtcgacttcgtattcattgtttatcatcgtattactctcccacatattaataatcttattcttatccaaattatttgcttttgcgtacacatttcacgaaagtttctaaaattgtttttcttgtaaaataccatataaataaagcgtacgtaaatacgaaacacatcgtgatagtgagctatatatataatttagatgttaatttgatgatatatacatatatctccattttcttccctattgatgtgttatttgttattatttactcctccaatgtaatttattagaaataaagcgtatgtaaatacgaaacacaaattagtcagttttccgtcgtccaaaatacaatgtcaattaaaaaaaaattatagaaaaaaagtaaagacactttaataatagttttatatattaacagaatgtttcaggtttactgcaaaataataaaaataggccacatagcgctcttgtttgttttcacagtttctagttctaccatttggtaaatctctaatataaaattttcaatattaattgttttaaaatcatatgaaccacgaggggacacgtgtcggatacaaagacaaccaattggatcagatctggtcttcgataggacaagtattcctgggaccagagagagagagagagagggacaagatcgccgttcaatagactctttcttcctattaatcacgtggtgaggtacttaccacgtgtttatattattggcttcttacgtgaaccaatctcatggtcctagttttcacatacatcgttttcctttgtgttgttgtttttctatatgacaataactttgtatctcttttatggtttatataatgtatatgcatgcaatgattaagttctcaatattacgattactctcttggaaacaaaaattctcgtataaactaaagatttgcaaacttcaaaagattatagaagaacaagttgtataaaagtgtttgtttgatcacttcaagagttggagtttttgtgattgtgaccattagagcatccacattggtgattctctagaaatgtctttacaataattattataaaaattaatattattctaattttgagtcatttattagttctgtatgatgtctttaaagatacaaaaatgtctctatagagatatgaaagacacaggtctcccactgtaccattttcttttttttttttctttttcttttaaaaatttaaagacactgttatttttttatgcaatagggatggtctcccactgtaccatttttttttttttttttaaaaaaaaaattaaagacactgttatttttatacaatggggatggtcttagatctccagaagatacggcgtattgaaaagtactgctgatctgtccaatgtaagggctgagttggaactaaccttcaatccactgagcgacatttgtcaatttcaaccaaaacaacaccaactggatgattatattgttttcttgttatttgattttcttgatgatatgtacaaaactataagtcttttttggtatcaatttagaccattagctaggacgcaacaatatgaaaccgtatcgctataagacattttaaacctagattttaatagttctactttcaaacaaatccgatagtttactcggcctcctatatcaaacaaatgaatcactatacaaggccacatagaaaaatcttatccctacgttatacaaatacaaattcacaatttttatttataataaaaaattcgcaatttgattagaacctttggttgttatttattgtacacataatattaaaatggtcaatcattgtctcgtcttgtagtttagcatatgtatggattacatagttttctgtctgttaccctctcacaagcataagcgtcgtctcgccaaaattagacactattcatatacacaaatatagatacgtatataaatatgtagacatttacaacttataaaagaaaattaaataaaaaacaaaagtcggcaaaccaatttgcatgaaataattataataattttttaaagaaataaccaaccaccaagaagtgctttgttaacagagaaagctctgtaagaaccttaaaaaggttctgttgcagaggttccgaccaaaagccagagtttcatctttatgtgaacaaagacagagag

SEQ ID NO: 15254 - DNA, 3000 bp, Unknown
  misc_feature (1)..( 3000): cDNA_ID_3593590_gDNA_ID_2926093_Annot_ID_196595 3000 nt of promoter + ATG
aaaacttgtatgaataactaggttatgattattattacctcatatgttcctaagttttaagtttttcacatatagtaagaaaataaattaaaatttaactataaatgcacatttttgttatttacgattttctgtaacgctaaaccaattaattaatagtaaattagttttcttgaattttacaattcttcatcattttgttttgaaattgtttttaaaacatcttttaaaatttggaataattagggaccaagggagattcctaacctagtttttgtccgaaataatactctgttagttccaaactaatccaagtttttctttaagaaaaaattatatcacaggccagtcatgcctaatatattttctttatattttggaatcaaagtgttccacgtgaatttttgtaatttggaattaaagtgtttttgttgtccaatcaaagcgacaatgcctaatctattgtctttcataactgttcgcctgtcatttatgtccaaactatattgtttacgattttcatcaccaaaactctttaattatactaattatcggtttttaaatatcgaaaacactcagttaacgtattgcattcacattttaagaacccataatattttagtaaacattaatttttgcatcataagcgctaacacatatgtatatataactctattaattgacaaaaaaaaactctattaatttgttcactgccaaaaaatataactattcgtttctcaactattttatttatattttatctttgttaatgactttgtaaataatgttagaaacctaaaacatttatatacaatgaaagaagaatagttaagatctaaagttaactagtgtggcatgatggcaactttagatctaaagttagatctagacttcaaaaaaatcactttccattatattcaagttcgatatcggcttgcgtccttttttttaactcgactctcaaaatggtatgggtaaggtaacattacctttccccaattgagtggttagttctatatacgctttcgacagcatatacgattgagtgtgttgtttgtaccttctggaatcatgttttgaggtaggcaaccaaatgtgtgaggtaggcttttacgtctaaatttcttcccttgctttaatttttgaaagattcaacgggcctgttttctcctaagctcgaagctagtcaatccaaatcaatatcaggaaaattgtggaccatatatatgtaaccttaatcaagaaaagaatggcaataagcagttagctagtttaatagtctagtttagtggaagaattttagccgttaatatatttgaaagagttagttcatctatatgtttacagaattggattactcatacaaaaagtaaatgtctttgttcaattaatatttctaagacaacctaatttttaagattagaaagatatcgaagtttgtggtcctatatcaaatcatgaacgataaacggaggacgtacgtactatgaagtattttatataaacatgattttctgaatcattatacatacaaaatttaacatgaaaattggataatgacaataagaagtcgacatcatcatataactaattctgaaacttaatcgcactagagaaattaattgttagaaaataggtaatataaccaacctcaatgccacaagtcgtattcggtgcaggtaggcaaccaaatgtgttaagttaatgctaaataacatttgatgttggtatgaagagaaaagttaaatcactaatttttggtttggtgactcgctctcaatagcaatctttgtgcttaacaaatcatcactactgatgtcaataaaaaaaagagcatcattactattttatatagaaacaataaaaaaacaaaaccttaattagtttcattcctccaaatgacaaatttaagatatttactagtattagatgataaattattcattcacatataaaactgcataaacataatctatgtttttaatgactgatataggctgaaaagaaaaaaaagagactgatataggctttatatgaaaatactgcatttgaaaaaatttcattccttacatgttttttttttgtcaaccatgcataccttacatgttattttataaaatttaagacacaatttcagattatcaaaaaaatccaggaatttttttttttgtccatatttagatcaaatacatgaaatttataaataaaaaatttaccctctattctagttaaaatacgttttgatgtagattaaaaatagttaaatatgattccaagacacataatttatttttgattatatttagagaactaacgaaaatggtggcttcctgcaatgttgaacaaaactttttaaaaacctatatacttagaagttagaaagtacattgatttacgaatttccaaatttagaatttatatcatagattagttaagaaaaaatattgataattttatctaagactcatgggagatcgacaactactcatattggccaatcttaagatttcgtttgttgcatcaaatctatatttgtttaatcacgaacttattatatctataaagtagaagtaactttatttctccttaatatattttgaaaaaatgcaattcctaatgatttagtatagaggaagttcacgtagacagtcaccattatcgcttcccataggaaatattttattcaaaatacagcagacattgatttttttatttatttttttctgtgataacatctcaaattttaggtagttatgaaatagataatattgaagcgttttcatttataatgggccttataaaaccaatctagcccatatcactaccaacccatttattacatccgaatctaaattaatcaaacccgtatattaaaccgggtttaaaattctgacccgtaattgatccactgacctagaaattggggggaattgaatcttatccataattcaatctcttccaatttctcttcttcttcttcttcttcctcgcgacgcgtta

SEQ ID NO: 15255 - DNA, 3000 bp, Unknown
  misc_feature (1)..( 3000): cDNA_ID_3096101_gDNA_ID_2926094_Annot_ID_196605 3000 nt of promoter + ATG
aaagtcccaagtctttctttttccagttttagataattatggagaaactacaaaacattacatcgtaatgaattggtacgtattaatttactaacatgagtggctttgttgtggtcttaaaattctttatggtttcggattttcctattgggctttcgtctgtcaattattggagcagcagcccccttttcttcatattgggtctgatgtaccatcaccagttttatttctctaagatgttttacattattatccaaattaaaagggctttccaatctaatatttaaagcttttgctacaatgataaaagggaatttaaatgtttcaatatttaacacttttgcagcaaaagttttgctacatattctccatacaatagttatggtcttgcggacgtagaaaagttataattgtttcagtaaagcttatcttgtttttttatctgaattacaacaacataaacctcctatgtgaatgctatcggaagaaaagaagatatgtgtgtgtgactgattttgtttcattaatggttgtcaggtgaatgaactttcttcttttatgatatctagaagctttgattccgatccctttttttattcgaataaattgcagattatcgtgatattaatgacaactacgaatccatgacgtcattgatgattataaagtcacgtgtcaaggaagtcaagaatacttccaaagtcaactatacaccctattatattgcaaagggttaatttctagaattccatgacgacgaaacatgatctttttcctattctctaaagtcatacataaaaatttaagtagtgccataatcgacagaagaaaatatatatttatttagtgacatggtctgatttcattgaattgtttggttttagattttgttaacaactaagttggtgtgtaggattactgttaattttaagttattgaatcgcttaatatcaccattatcaccattgtttaaactagtagttacatctgaatgggttagtgaaattttcattatccaagaaacctaatttcaacaaagctaatagtattaaatgattaaatttcaaaaagttctaaccactattataaaattataatgccgcacattttttagtcaaagcaataatgtgtttgtattatactgtattagaaaactcatttatagatacacgaatatgttagaaatttggaatggtcgcgcagccagacattatgatgataatacaagtaggtgatcaatgcatgtgactgaaaaatatcacatgaagaacgtttagtgaactggtttcatacttattggtattggattagcattctaatgacttaggggtctaaacattggtccaacgaaatatactattgctatcccatttgtaaaatgaggtattaaattacgacgaaattattagcttgtagtgatcgctaatttttttttataaatttatttttcataagagtttttgttaagttagtaaggttcttctgtcgataaaatctatagaaaccactaatgactaaacctaaaaacatactttttgttacttagcaaacaactatttattgaattcgactagtcttcatatatactacgatttgtgttgaactttattattttttgatgatttcaacaatagtaaactattatttattatgaagattcaaataactcatggaattggaagattcaaattcttctattatgatttcatcaatagtatatattatttatttttaaaatgagaagatcttttgattctcgtaaatctatattttagttcaaatttctggatataaacagaaaaaaaaaaatctaagaagtttcgatgtcatgcatgcatgactcataaaagaaacgaaaaacgaaatatataagtaatcagcaaatcaataaattgctaccatccacgcctcttccagctcttaataatcgtcagtttgtttgttttttctttttaacttaagaatcgtcagttttgtttttttcaaactagaacaaaaaaaaaatctaattagtaattactctagagacctggcacaatgattttattaatcgtgattggttattaacttattatatgatttatcaaaatgaattaattcctttccacgttgttttggttactcattaccgatggaagacctgacacaatgattttattaatagttttttttttggttaaggtgtttttaatatgatttatatttttggatgaattaattcttttccacgactaaaacattttctttttgtaatcaacaactttactgcaacaaaaacaaacttttacattcagatttactgttctgaaattttagaaatgaatgaaagaagttaaagaatgaaaatatcgtattcgttagaatttaaatttaatcgatgtaaccatgcaattagtttttaatttttctaggcaataattaaacaaaattctaaggatataggtaaaataataccaattaaattacctttttttttttggtatcaccaactaaattaccttattctagaactagaagcaatctatttcagctacgtgtaaaagtcatttggaaaattcgattgattattctcgaccatatgcattatttcccccggcaaataagaaacccgcgtacatttttttgatacctttcgaaacaaacaatactcatgatcaaagttatatttttagattaaaaaagaaaagaaacatccatcaaaaagtcaataaacgagcaaaaaagtgttaagattcaaagtcgttgttcaaagttgggtctcttttataaaaaaaaataatcttcttagcttcacacatttttgaaaagctaaaataaaaagactccatcttccatttttgttccttaattcatatcttaagattcaacatttttctaacattctttatttcattaaccaagtttgttctccaagtatttttatagatttaaaaacccaaaaatatttctttcgagttttctcaaaattttcagacaaagaactaaactaaaaaagctatg

SEQ ID NO: 15256 - DNA, 3000 bp, Unknown
  misc_feature (1)..( 3000): cDNA_ID_3096096_gDNA_ID_2926094_Annot_ID_196606 3000 nt of promoter + ATG
ttacgtttttggcgagaaaatcacgggtttacgtttttggcagaaaattataggtttacgtttttggcgggaaaattacagatttacgtttttggcgagaaaattattggtttacatttttggcgggaaaatcacgggtttacgttttttgcgggaaaatcacggatttacgtttttagcgggaaaatcacgggtttagcgggaaaattacgggtttacgtttttgacgggaaaattatggatttacgtttttggtggaaaaatctcgggtttacgtttttggcgggaaaatcacgggtttacgtttttgacagaaaaatcacgggtttaattcaattttacaacacttgatgggttaattgggtaaactattgaaaccattaaccattacaacccaactcattttactcctcaaaccaattgactcatcaactcatttgacccattaactcatttgagttaaaaatttcaactcattaaaattcatgggttgaattgaattaaattgacccataaattttaacccattttaacaccccgtataaccatcacttatatctttctatatcaatttctgaattcaataacttctccatcgtgacaaatactttatatctagcaacacgattacacattaggattgagaaagtggaagataattaactatataaatactatatacaatatcttcaaccaactcacatttagcattgttttttattacaatagtattctattgcttgttaatatctttaaatgtcatgtactcttctttatttttcttcaatgtgataataataaagataaggaaaagcaactgaaacgtatcatcattaaagctgaattagaattacaaagtcacttagtaaatgattagtgtttaggatttggttcggcataaagctataaaatagaaaagaatttggggaaattttatattatgacgattcgattaatatcttaatcgcctcttcttcttttgtaatgtttatcgttattcgtcggacacctaaacaaatagacttcgtgataaaagattttttatttttttttgtaaatctcataaaatgttttttattaagctgattctttttagggaaaaagacctaaatgtttggagcacattatgattcaacgaagactatctttttaagaaagagaagacacaatcttacccaaaatcggtagcatcgaactagcaagtgccacgttcgaaagagagcacctattaatcacacacaacacaaacaaaaatcgatttcagaaaattaaaatgttctgaaaatccctcaagaaagaaaatcagtatttaattgaacatatgagctcagtggagccattagtatttccaagagaatatgcattacctatacgaactttgattatgattattgacaattgatgatggtgtttatatttagtacattatatatagttttcatatgatctctttcattccaatttggatgaataatactattttttttttcctacgaaaatatataaatacttaactgaatcagattaaaagttcgttttaatagcttttggggcaacacctagctctctcaagctagctccatccaaaataaggacttggtaatatatatttttaggggtcaaggataatgttaacatatatggtcaaataattttcactgtttttagtaaattcatattatccccttattaatatctgcaacaaaaatattaattctagaaagaaaaaaacaaattgctcatatgggatggatggtggtgtgtatatacagctgtattggttaggctgatctttgaatagaatctgtagaataaatgtgtcgcaatgaagcatatataactttgttctgtaatgttcttagctttctcttttggtgtcaaatccaaccactcttgtaacaataatgttaatttctttttctcttttctggctacgtttcttcatttaattcaacgaatcacacaaataaaaaatattcagcgtcaattaaaaaggtagaaatgctgctaataattattggtgcatttgtgcccatgttaattaaaatttaaattatcaaagactcatagtatgtaaagtatggaccagaaacaacgtaaaacgctttgcttttgtcactctcaaaaaaagactttatgttttttccatgccatgacgccataaacatgctacgtgttcaagagaaagaagactttgtctatactttgtctaacagttgtttttaatatcttgtcctgtacaaaatttctgtaaaaataactgttatttttttcattaatggttgtcatgtggaattttttttaaaacaacagttatagtaaaacatatgtaacaagaccacgacatataacctagtacgttacatgttgaaattggcatgcgttctataaacggccaacggggatagtataaactgatatagcacattttttacaagacaaaatagttagctatacaagtatacaacgtttaaattaaatatttaattagaaaaaaaaattcatatttttactgtggggagtaaattcagataggacataacaacctatgtaatgtattaaatacttgtcacttatcaatttagttcatcttatgaaatgcaggtttaagtataggggttggtagtgcgacgaccactccaaattcataagtttaaggagaacatatatttctttttgtatatacaaaaggacacatattttttattgttgtaatcagggcaatgaagacattgattatttgtggttattgtaactatattataaactgaatttttgtttaccgtgtattttgcttgtttttcataaaacggtattagtttttttctcgatatcaataattcttttttttggatgttaaatgacatatcttataaagagagttcccacttctttcctttatatacacatcgcataacatgtgaacttatcaaaacaacacaccaaatctctctcttcgtctctctctttttctatctctctttccttctctagatgatg

SEQ ID NO: 15257 - DNA, 3000 bp, Unknown
  misc_feature (1)..( 3000): cDNA_ID_3096082_gDNA_ID_2926094_Annot_ID_196612 3000 nt of promoter + ATG
aatatgggcaatttggtcattttggatctgtcaaagatgggtttaagaggtgaggttcctttaggtttaacaagtttgagaagattgaggtttcttggtctcaacgacaacaacttgaccggcactgtcccatcaaaagagctcgagacattgccttgtcttggtgctctatacatcaatggaaacaatctatcaggagagctaagattctcaagaaagttctatgagaagatgggaacaaggtttaaggcttcaaagaatccaaatctttgtcaggatgttgtgtcagaatctcggcaatatgttgttggattgaagtcttgcatgatggagaaggcagaggatagtttggtaattaaacaaacttggagcaaccttaagaaggaggatgagtcaagttcatcaatgggtgtgatggttactagacatgtgttgttgtcaaatgggttcatgtgggatttgcttttggagctttctcttatattattattgaatttgttagtttgttaactttttgtttgatggttaaatagtattgatgtgttggttgatagattttgatgtcggtgtttgcttaaagagaagaaaaatcaaatccttttggatgtaacaagtctggtttcttctccatctgtcttaatctaaaaatttgtatatgtttgtaatgtaatttcctcttataactaaacttaacatatttcggatcgagagaaacaaacgaatttgggaaactccaattatttttcatgttaatttgtttgatattcttactttgagttttggttttagatattttcaaatttgtgtttactgtttagtgtatatttttcatttttaattttgaacattttggacaacaaaaatattttgatacctatgatgtttttggcattggcgtatttttttttgtattgaaaaaatgagaatatgttttgtaaaaaccacgacaaattgtgctaaatgttttgacgatcctaaattgacattttaatcgtataatgtataaactaaactctatagacaatagtataggtttaggttcaaacatttggttttgactataaatgtgaaatgctttaaataaacatgcaaagcatttaagcatatatccaaagatagctaactttggtgtctcaggctctgtcattggtttcaaacagacaatacaaaccaaaccaaacaaagccttgtactgcctggaattttctgacttcatatacagaatttaatgactcttttattttttcaatattttttttggtgaattttaaaagtagatattgatgttcaattaaagatgagacagttaggggtttttagtatagactgaaaaaatcttcttttactatttactttgttttttcttagtttgcagttagctttttacgatcatttatagctatttttttctctctttcttttgttgctttcataggctctgtctccataactccacaagtcattattagttgttcataggtgacggcttctgtactttttctcagtatttactaagacaaaagcaaaaataattgtttttcttgttttataactcggctgcaacaagttttggttttatgtaaaagattttagcgacattagatattgaattagacgaaaaagatgtcgaattcgtgtctgaattatgtttaacaagttttttattcccattagtaatattttacggacttgttgagttaaatactgagaaagtctatttcccaaaacactctttttcctctatgtttcaataggaataacataatatttctaacattttttcaaacttttgattatttatataattattgaaaattacaatttatgtctatcgtatcattcttaaaaatttcaatggagaataaagtattttcattgttaaatacgttcttacgatctttttttccatttcatcttttcttactatcttatccacaagcttgtgatttgtgaatcaaaattaaaaagaaatttatattttccttttaatcagttaaatccaatgagatgttcttggaattgaaaacaatgatgatatttaataaatgattcttgcaagtttcaatgagccgtacggattaaatagtaaagttagtaatgagtttggttttcttgaacaatttattaactcaaccctctggccaagagttgaatgttcctgcagtccttatttcctggctcttttttcacttttttaccgtaaagtaatttatatacagttaatgtaattattaatttccgtacaagtttttgacacttttatcgtcttgatttgattgattttgttggatggagtaaatactttactctatttacttacaaattatatcgagctcttttgtttagtgtcatatccttaaaacatgtataatgaatgactaatacatgtcaacaagggaaagcacaaataaccaatgacataagttcgtcatatttttcaatttttacgtcatacgaataacattgattggctagttcgattaaaactcaaaagcatggtaaagattttacagcggaaatacttgaatgtatatttttaccaatgttacctaatttctaaagaccttctcattgtcaactgttttaagcttaacataaaatatatataattatcgttacgttaaatacaattttgggaacatacatataacataatagataatcgtaagtcgtaactattcataactcgttctacagtctacaccatcgccgccttaacttttattgggctttaacgataagaaaaaattgtattgggctttattacccatttaatttcggcccactaataaatcttctctccatgttttgaacactgaaaaaagtcttatcctgatgatttctctccttcctcgaacagtcgccgaaacattttcgccggcgttacaccggagaattcatccttctttgtcttattactctactacccaatttcagtttaaactcactatcttcccaatttgatgattcagtgattcaaattcgaaacttcaagcaatg

SEQ ID NO: 15258 - DNA, 3000 bp, Unknown
  misc_feature (1)..( 3000): cDNA_ID_3096072_gDNA_ID_2926094_Annot_ID_196614 3000 nt of promoter + ATG
aataaaaattaattcagcttctttctaacttttcttaacttagtaaaaataatattttaatttaaaataatgttaaaattgaaaattaagaaccaattggggttgctcttacaagaatgggaaaattaaatagaaaaaaaatgaaatcgagggactgtaacgagaaagacatttggttatatgttgttgtctctgtcacataaaaaagtaaatgtggcatttgttcccatatcccatacatgttaatatacacgtatttacttcttcaactttttagtttttctcttttgaagtagagtatgtgaaaagaagagggctaatgtggaaaataggatcacaacttcacaaggatcaaggatgctattgcacttctttaatgtctattgattattgataaagatttttttctttacttctttaattttttttttcttatagctcttccagatgtcccgttgacatttatttgtagttaattattggcatagctttattcaaaataaagggataaatgtgttttattattctttgtagcttccataggtaagagcatctccaatggaaaagctttttctatggttctcttcattttttaaaattaaatttttaaaaaaacttacaagagagcttttggattttctttttagtttttcattctccaataatagtttctcttacacaaattctctaaagaaaggaaattattttactattattttattaataataattattgcaaatcataaaatattaaaaatacattattttgaaatattttaaaatagatattccaaaaaggaaaattgaaataacgatcagttgttctgttgattgatgatacgatgatgcatctattgagattgataacgttagaaacgagatccaacagagtaatatccataacagaacacaagaataaaaaaagaataaaaggcaaaaaaaaaattgttaaaaattttaaacagattaattatagcttgccacgtagcaggctcctcaagttaaaaaaaaagctcttctctccatattaatgtattttcatttatttttattacaattaaattagagaacccgtgatttttgagcagagaacctcctattggaagtgctctaagttcgtcgtagacaaagttaatcaccgtcctggtattaaccacacgacctcaaatagacatagattttttttttcttttacctttttaaatagagagttatagttataacctttctatatatctttgtttttatggaacttcgttcttattaatttacaacgtttctatgttttacttataaactatttatctatctctatttacttatcagttgatcgattttgattcttaatttgtaacatgtgtttttatggattttgcttaaatctttttatttatctgaagccgaaaaatcttatatgttgtttgatgtagaggggttgaagtctcctatcatttatgtttttttgcttaaatggttcttttgtgacattaattattaagttgctctattttatgcgtatgtgtgttttaccatcgaagcagtagtagctgactatactggacgaatccctaaccttttttttttcgtccggaatccctaacctacgtttaaaatttgaggcagactttagtgttgctaataatagtttagggttaatatcattggtttgtaaaaaaaaagaagaaatcattgacttatgtaagtttttattattgtgtgtcgtttgatatgtcaatgttgacttcatgtgtctaaagatgattcattatcttctttggccaaacaaaaactatttgtctgcatatccgaataaaaattatttactttgcactgattttggtggagaattaaactttgaaaatgttccctaccaaaaaagaaaactttgaaaatgtttattttattgcaagcatgcgttaatattttttttccaagatttcatatccactcatctacaacttgatagattttgttctttcacattacaaaatatgcatttgtaagaaattaatacaatactagaatcttctcatggaaaatacccacgatgaaagatatgttcatgtcatgagctcaatgtttgagcttcctttcaatttcagttttagaattttagcatataaaagtttctaaatttttaatgtaatcactaatttgattgagaaccaacttttatcattgcacaaaagaatacaaaataaaaaatattttaccttgtgttatgtaccttcaaaaaccaagtaagtactatatgatgttttactattttctgaatttcgtatttgaaatcaaatttctgtcaatagtaattatttttttttgaaaaattacagcaattataaagtcttttatatattagatacttattattaccaacatcaatatatatatatataattaatattctgacaactattattaatcatactctctatgttttttattaatgtatattaaaggattttccacatattatgatatgattatagatgcaatatttttgtgatttataattttgaattttttataactcgaaatcatctgtatttaattattattttttgaagtttataattcattaaaaataactaataaatattgcattgagaacttaaaatatctttttttttgaaataaaacaattcctaaacatagagtaacaaaaataaaaagagagtatatatatttcaccaaaatataagataactgattaaaaaactattagtatatagtacatttcaccaaaatatataaaacaatctactactttaaaaataataattaagctctctcgaacttaaaaattgcatagcacaaaccgagactaattgattcaaccgagactaaaccggagaataagcctaaaccagaaccctcggaatcatttagaaggatagtcttgttgtatcacagcgagacagcttctcttccccatcttctctcgctgcttcttcgatcattgaagcatccacccagaaaaaccctaattctcctgacaaa

SEQ ID NO: 15259 - DNA, 3000 bp, Unknown
  misc_feature (1)..( 3000): cDNA_ID_3096194_gDNA_ID_2926095_Annot_ID_196623 3000 nt of promoter + ATG
atagcttatgatccagggatgacaagagaagctttggcctatcatggttgtgctgaactgttccaggtactttaaagtttatagtattgtctagttttggaaagaaatgatttcttagtgtattacgatttacttgtttattgcattttggagctactcaaaggatgttcataccgagctgattcaacataaacgagcttggatgataaaacgtggtattgtcaaagggaagctctctgtagactcagccgagcaacgcctcgcggggttatgtcctcttatgccagaagaagtaagaaatagtataaatatttacgggttttcgctcggtaaagtaacgaaaacccgcattaaatgccttggttgtctctcaggttggtattcttttacgagcttatggatactcatgggatacaatcatatatgtcgctgggggagaggtttttggtgggcagagaacgttaattcctttacatggtatgtttgagaatgtcgttgaccgtacttctctaagtactagctgggagcttgctaaaatgtatgggcgtgaggcaaagcataatgatatcaagaaaatgacacctccttcgatcgaggtagaaacgaaacatgattcattgaaaagcacaagacaaagacctcaaccgcttccacctccaccagctagaccaaagtactacaacatcgaaggttggtggggttgggtagccgagagtgacaacgagcccgaaagcacggttattgagttgagaactaatgcccataagttgttgtgggaagcgatagattacgttgttagcgtggaagcagatgtgtttatctcgggttttgatcgcgatgggaaaggacatccgagtttcgctagtttggtcatgggacaccggctttatcagtctgcttctgctaaaacatttagaccagacaggtaatataatgaatgcatcattctatttagaagatattaacagattatgtaatcttgaaatttctcatacttgtaggaaacaaattgcaatgcttttggaagagattcgagaccatatgtacgaggcgaatcacacttggataacatcagttaggaagctactaaagagaagcatactcgagggtctaatggaatcttccaaaagatcaaaagcatttagttttctttcccatcctgtacccgaatgttcttgcattacgcgaacccatccggtttcaaatgccacaaatcttggggtgacacaccgttgtccgcaatgggtggatggtgctgtaagcgaaagattaaaggagtataagaacgcagagaaagaagaggatcttgatgaagaggacttgtcttcttcaggattgttctttggtcacaaggaaagtggagggaataataatggtaacaatgagactgtaaattccgaagctaacaataaggaagaaggtcagcttgaagatcaagaagaacttgaaggcagcgaaagataaggcttgtggttgaagatgcaacaatgagcaagtcgcagatagatctaaccttttctcaaaaatagtttatagcctggttattacttattaggttgtgtattagaatatgtctttttttttttgatgatcaattttacaacagtttagtgatttttaagaacataattctatggtactatatatttttgtaacatgatctcagtggccaattggatgactcaactttttttttttctactaatgcttagtaaattgtagtagaggtaataagagtagatgaatgtcttagctcagccgaatactcttcatgttatttgagtaacaaattagtatcaagcttatatttgtagataatttgcttccttaaagaagagatcaagaaactggtttatgaataccatcaatatctagcggaggagcagcaatgaatgagataatcaaaaccccaaaccatccaatgtaaaaaaattcaatggaatataatctaccaaacgaacgtgaagactcattcataatgtaccaagaacaaggtaatggaaccaccagtcaatctgataagccactatatgtgtatacaagaaagaatagagcagaggaagccacaggtgtgaaagaagaagcttgaagaagctaatgttggcacgtgtgaataatgactcgtgtataataatagtttctcatttgattaggctttatgcattgtgtgaataatgactcgtgtaaaataatagtttctcattggttaggcgtgaagaaactaatggtcggtgacgtgtcactagagtgagagagagagttatgaattggtgatgtgccggtggctcaatctctttataaacggtgtaaaaggagaattgtaacaatccttatcacaatccacttgtcaatttcatgttggcttcgagattcatcaacaacatgcctactttatgcttatttgatggcaaaccatcgagatcaacagttgttcaatagagctgaccctgaaccgtttgtgagcaaactaattcgcattatggagaatccactcgtcaatcttacctaagattcaaaacccattggcagcatgcatattttaatgtaaaccaagaagagcacactagttatggccggcgaagaacttgctttaacttttctttatgaagaaaatcttgaatctgtaaatgaggattagataacaaaagttcattgtcacgtttcagaaaaagagcaaaaaaaattatgtttccacgatttgattcaacattcaagattggttagccgagggaagacatctttaaaaaaaatctaaaaacaataaatgtaaataaaagtggtgctactaagaatgttgaatattgtcacttttctttatgaagaaaatcgtgaatttgtaaatgaggactatataacaaaagttcattgtcacgtttcagaaaaaggtacattatattacagctgcaagtataaaaagagagttcctccctcatataatcatgcaacgataaaccataaaacaaacacatacaaaatagttgaaagagagaaattaatatg

SEQ ID NO: 15260 - DNA, 3000 bp, Unknown
  misc_feature (1)..( 3000): cDNA_ID_3096161_gDNA_ID_2926095_Annot_ID_196631 3000 nt of promoter + ATG
gaaatatattggctaacaaaggggaaaacacacaaatttcgacctaaatatatataatccaacgatggtgagaatgagaaagtatgcttacgacggtttaaagaaccaaataacccgttatttacgctacttctctatttttaagaggagataacaaaactcaattacaaaaaaaaaaataacaagaaaaacttgagaagtataactagttgtttatatccatcggacataaccgcaaaggatgcgaccagttgtgaggagaaaagtgctttactccctgccatcggacgtctcactcaagaccatttacgtcaacttgcccaaaagacaattactttccaataccactcagcaaaaaattcacaagcaaatttttctgataagaaaagtctttgtttggtttagtttatttataaacaaagagtaaccgttgacgttgagtatttatcacccaattaatctttctatattgaactagtcgtggagtagttcactcacctaattttttcttttatcatccacttttagttaaaaagtaaaaaagccattaatgtgaaacattgtttatacataactgatgtgatacagtttaaaatgaatttttgtatcaaattatctgtttttacatttgcgtatcgaaaaatttaaaataaagagaaatttgtgaactcatccttatcgctctgaaatttttccaaatattttgaaaatgcttgtcatttagttgaaaaacacataatcttcaccacatatgaaaaatctgtaaaaataattactaatcatacatttcactcacctaattttttaataaaaatataataaaatacaattttgactagcaaaataaaaatggtttgataataacacgttcgcaaaatttgatccatgacctaaaaaagagtttgttgttatagtttccacaaaaaaattgggatactattcattttacatggcaagaaacgtaaaggaaccgaatcataataaacaaatgaaagatacttagagctaagcattaagcatcccattttgcgacaggatttgacgcattatgcttacctccattttaaaatttgatatctcttgtcaaatctttatttatatatattatacatgatatgtataaatatttcacgaagaaacaaagtatagatgcttcttattgtctgatcagatctctactttttattgagaatcttgtatcaaatatggttctttttgagccaaacacgccaactttcaataatcttcactttgctgactactacttcatgttgattaacatacttattccaaattacggctctaaagaaagtgaaactaattaaaacgtgcgtgttgatacttgatagtatatatacttcttacgcatcgcctgattagatatttgtttttattaggattccatgagagctatattgcatggttaattggataaatggtcagagagacgattaggattaaagtaaatgacaaggacatttttgattatttctcgattatcatggtgggtgtaatttaacatgctgtttaattgaacgaagatactgtactaatattttacacgccctaagtaagactcactttatcccattttatatagatttttttaagaaataataaacattttatcatgataaaaattcaaccaatagaaaaaatacggcagaattcaaatagtcataaaatatcaaattaatagttatgcatagaaactataaaaaaaaaaaaccttataacaaaccatcaatatattgcgacaaaggcagttataagtaatctcaaggtaatataacatgcttatacatccatattacaaaactcatggataaattataatgggttttctgcaaaagaacctttcaagtcaatctcgtttgcaagtttaccctccaaatccgagttatgcaagtcaaccccatcatctctaaagtcatccgcaatacagccttcatgtatatcgataacgtggcactcaataactctgtttaaaaacataagggttttatggaaaaaaaactctcaatataaatttgttttgcaaaataaaccttcatgtcaaataaatacagatcaaactacaatctaaaaatctcatgaaatataccccttttgtgtatcgatgacatgacagtcgatacccattcagagcatgtgcaataggtatagattttatgagtcgtttatttaagattttctgctatcacaattccattaataataattttatatttttatctattcactattctcgatcctggtttatctaaacatagtaaataatttttcttattttttattcatgataaatcaattacttatttaatttaacgttctataatttatatttcttttaataatttattcaattaatacttaaataataaagggtgtgctggtaaatttcaatataaaaagagtaagcatagttttttcaaatttgcataaatcatttgaactcgttattttcttaattatataaatggtatgtctttcactttgtacggagtatcccaatgtggggtacataaatattaagagaaaaaaagagatcaagcttactagtttaagcgttaataattatactgactgaccaatctacttgttcatgtagctctaatgttattaattaatatatagtcttagattgatctaattaatgtctgtgtatgatgtcactttgtgatgatggaagtcatgagagcttccattacttaactctctctctctctctctatctatttttacggtcatgtatagtgtaatcaacaataacaagaaaaagccaagttcaaagcactatactattagttaaagacaaatgcgataatgatacgattctgagcattacttgagtcacaatatatagtcacaccctcatcaaattctttctatcttaccaacttctgaaaaaaaagaaaaaaaccaaaagacaagtaaatacatatataaatatacactcacacacacacacatatattgatatacttataatcataaatc

SEQ ID NO: 15261 - DNA, 3000 bp, Unknown
  misc_feature (1)..( 3000): cDNA_ID_3096143_gDNA_ID_2926095_Annot_ID_196636 3000 nt of promoter + ATG
tgtaagcacttatttttaataaaatggttttaattgatttttatatttaaataaagggttcaattaataaattaaagaggaaatacatttttttaaaactattaatctaactacatttttaaccactcttaaaaatcattttcagatcattattggttatatattaagtttcgttgggacgaacacaaaaagacaattaataaaagaagacataaacattatctaaagatgtgtcttatcatttctgttagttgaacaaataaaaaataacaaagaccaaagagatttttatttttgaatttgttggtattctccttcttgcaaagatctaaaatagcacagctcctcgagtaacacgtgtcataatttcacgacttcatcgtatctattctcatctaaatttatggaaacatcactttcacacttccacaacaagccacacattccaaataaccaaaccaagctactaattattcttccaataagaaaatatttacatctaaatccttaatttataagagcatttaacctaaataaactattttgtaactattaatatatatgcaccctaccaaaaaaatctaatatctatgcatatttctatttatagaacagttaaataaaaaaatgtttagggcttgttctatgcaaactgaaagtctttttttatgttatgataagttcccgtttcttctttcttttttgggtaatattagaaagtaaccatagaattgaaaagaatgtagtaactaaccattgtcagtttatatgtgagtaaataaccttatgacggcataagaaaatacaaaaatatccttgcaagttgaaccaaaagcaagagtatgaaaatagcatgatatttataaaaaaggtgacattttataatgtgttataagaataaataatatgttatatgaaaaagtagcatgttgacagagaaagatttccagttataacgtgtaattcgaaaaagtagcatggtacaaaagaaaataacatacaatttaaaaagaaaacataacgacgatgattccaagaaagaatcaaaatcgaacaaaataaatagcacgatatttatcaaaaaagtgacattttataatgtgctattagaataaataatttgttatatggaaaaatagcatgttgtttgagagagattttcaattataacgtgtaattcgagaaagtagcatggtaaaaaagaaaataacatacaatttaaaaagaaaacataacgacggagattccaagaaagaatcaaaatcgaacaaaataaaatgagaaatcttctgcaaattgagggaaagatgatccgtcaatataaataacgtttagcagcctaaatttatcgaaaaagagacttggtggttgtgatggtggaagatgtggtggttgtggtggtggaagaaagagagatgagtggtggtttgttcggattcatcaaaagtttttcgccatataatcatctaagtgttctgtgtgattttgtaaaatagcatgtaatacatataaaattcgacaatgggtataaaagtaattgcaaatgatgaaagagagtgtattctgacaccatagttactttgttaattcttttacaattcatagtcattttgtgcatattctcttcttttttttaggtaagaatatgactttctatttcaattcaaaagttcttgttatccaacaaaatagttaccatggatttgtatttatactatactctaatgttattgaaataagatttagaacatctttaaatcgtaatacagtgacaatgattatgtcatttaaattaacaaaatttgatctataccaaaaagtttgataacacaagataacttgattgtttagattcaaactcaagcatcaaatgtccttaaagtagaacttaggaaaaatgattagcaactgcataaaaagactccatcatataatcaaactttaaaaatatcttattagctatacacaatattgtcattatataagcacatctctaaacaaacataaatcatattgtaaacaccataaccattatacttaccattttttttgtgtcaaaatccattatacttactatgtatctacagaaaaagacgccatcacatatggaaacttgaaaaatatcttattagctatacaaaatattgtcatcgtatatgcacatttctaaacaaatataagttatgttacaaaacaccataatcattatatttacttcttttttttttctcgaaacctattaaacttactatttatgtgtaatggttgccaaaattcagaattaaccgagattgactagtgctgataaaaaactatattatttatttttaaacacataattaaatacatttctccaacacaaatattttatatactattgaaaatgttttaaccaaataaaaataatatttactctcttttaaatattcaaaactctagctattttaacatatcattttgtaagaaaattatatgaaactcaaaaatcacaataactcagtgaataaaattaaattaaaagagctactcacttatgactatgaagagtcatgctcatgaacaaaagaattaaaaaaagaaaacacgtgctaatgcttctcctcctcctcctccacatcgccgggttttcctcttcctcccccgtgaaaactgcatttatatcaattcttcagattccccaaaccctaaattctctctctctcccaatttttctccgtcgttttcccccaaatttcctctcttttttatgtcttcaaacttcaaatccaatcttcttctctctccagctcattgactcaaccaaatctagatcaaagtttgaatttttaaaacctttcttttttttgttgcttccttccaaaaaaaaaaacgtttcttttttttttcttcttcttcttccttctgcatctgaaagtttgtatttttcctgggtttttacctttcttggtttgaatagacaaaagggttttcaaaattctgtagatttcattgttacaaaaa

SEQ ID NO: 15262 - DNA, 2324 bp, Unknown
  misc_feature (1)..( 2324): cDNA_ID_3096137_gDNA_ID_2926095_Annot_ID_196637 3000 nt of promoter + ATG
cttttggcggaattttaaatgataaaaagttatcttttcacttttacaattggggaagatgttgtttaatacgcaaacttttaaaaggtggtcatttaatacgttaacttcaaatatgcccatttaatacatgtaaaaattgttgaccggccatttaatacatgtaaaaattgttgaccggccatttaatacatataaaaatcattgaccagaccaaaatctacacgacgttatctaacattaacaaattctgataacagtcgttaactaatctccgttagtacccaatactgacgtcgttttaccataatcgaaacgggaaaaacgtcatttaatacactaacttttaaaacatggcagttttatacactaacttcacatgtgacaattttatacatgaactaaatgttgacaagccgtttaagacatgagaatgtgttgaccatgccaaaaagatataccactatctaagcctaaacattaagatttgggtcagattcggtttggatttattctaattcagttaattcagataggagagtttattatatgttaggattttataactattcacttcagatagatgttagattcatatcagttttggatccaaatctaacacctatcaaaactgaatagttataaaatccaaatggataatacactctcctacatgaattatctgaatccgattaaatccgaacaaaatccaaaccgaaatctgaatatctaggcctagacagtgatatgtctttttagtctggtcacatattcttatatttaaaatggctgatcaacgtttagttcatgtataaaatgatcacatgtgaatttgatgtataaaatatctacaatttaaaagttgaacaatcaaacgacattttttcccatttcgattgtggtgaaacaacattgtattgaaaactaacaaaaactagttaacggttgttatcatgtctgttaacaccaaataacatcgtataaattttaacttggtcaacgatttttacgtaatataaatgagtggtcaatgaattatacttatattaaattacaatatacgaaattcacgtactaaataaccagtttttataagttcgcgtatcaaactatattttttccttttacaatttacgttttttaagaaaccagaattagaaaactgttaatcatgcaacataagtaaatttaccaatactacataacatacaaaataaaataaaatatcatatgtttagttaaaccaattacataatgtttttacctttatatatagtatctttttgagaccataattctcttctattttataaactttcaagcatattatatacaattcagaaaatcctaaacactgcgtcgattttctccaaaatccaatcagcaccacctaagatcaaataaatagtcaacataatacagtaaatttgacaatttaatttaatctaatctcatttaattcacctttcctggatacacacgtacctcattatccaataaacaaacaaaatccatttttaaaagattatagtgtcgtacacaatcacaatttccatcgtcagcaaaaccaaaatcgtgaggcctataatttcccttcatctccaaaatcatttctcctcaaatttcttctttagaagattaaaaatcttctctctaatctctccactctttcataaatattttcctaattcttctaccttggtgtctgattctagcaccaaaccattttctcctaccaaaatctgggtttcgatcaattttaggtcttttgattcctacttgtctaatcgtgtaagttctgaatcaaaacagtcaaatttcatttcttcaatcagaatccattttctgggtcaaaccaatttcgatcaaaatcaattggttttgaatcaattttagatcttttgattcctacttgtcttaatcacttgaatccaagttttgtctctttttaaggttgtaataaaattggtttttgtaataaaatcaattgggtttggatcaattttagagctttttgattcctacttgtgtataatcttgtaatttttgaatcaaagttcaaagtctttttttcaaacagtaaaatttcgttttttaatcaatttcatcagaatccaatttctgggtcaactttcgatcaaaatcaactgggcttgaatcaattttaggtttttcgattcctacttgtctaatcagttgaatcaaagttcgtctcttttaaggttcgttgcttcaataatacgtataaagatttatttttgtacgatgtcttatgttatttttgttctctaaatgaattttgacagcttgcaatttcaaagatg

SEQ ID NO: 15263 - DNA, 3000 bp, Unknown
  misc_feature (1)..( 3000): cDNA_ID_3096156_gDNA_ID_2926095_Annot_ID_196632 3000 nt of promoter + ATG
caagaaaaatcataaatccaaaattctaattcagcttaagcattgatgaatatatatgaaattaccttgtttgctgcagcaaaaccacaacgcaagtatctccggtaaggattcgaatcggatttggaagttaaagccacgattccttctccgcaccaacatcttttaggcactccgacgactcttcctcttccacgaggacctgtagatcccgtcgaactagtagatagattgctcatcgaaattgaatttgggttttcaaatcgaactaagggaattaagatttcgatgttttagggttcttagagtgggaattatcgattgagaatggcttttgattatttggggatgaatattgggtcgggtctttaaaaggaattggatatattttcggtttacttacgaccaataattggtttggtatagggttaactcaccaaaccgacaaaacccagtctcggggacattaagctgtagaacttcgacttggtggggatataggcatttaacttccatattatggataaatagaccgagatgaaagaacgggctctatctggcgtgatatcgatagttcccgtggggaaataggtttttctcatatatttttttaaaaatatttatgcaggtaatgtggaagattaaaatgtagacgctcacatgattttgttaaagtatgtcttgctttctaattatttatcttttatgcgaagtaataagttaagctttttttacctctctatatatttataagatgagtaattctgattgaattttttgatagggattacggtctttttcctgttaatttgcataaacacgatgatgatttataatttgactactatcttccaatgaacaacaaaattataaggtatacaatattttttcttaaatctgatcgatagattctctttcactaatatattgagattgtgtaaatatttttgactgtagtttagattttaatatattggtattgttaattaaattaattgaattttaatataagtttttattaataattcttttaattttttcttctataattctgattttgataaaatttatttttgtcttattaatttatcaaatttgataattaatatatatattaataaaatacactaaaccccgacacaccatgtatacaactacatatactaaatatacaattatgtattcaaagggatacatcaattctgtaataaattcaatagtatccatgtttaaatgataccaataataaattgagaaacttttaaaatttataaattatacaaataattatttatagataaaccgaatatattaaattcgtaatatatacagaagtgaaactgataaactaattaaagcatgactacgttaagtgattcttagttaaaatttttttgaagaaattgaatatattaaaagcatttcattttcccatttacttaatgcaagcttttttaataccaatggagaattatgtaatctattctttttttttttttttttttttagttattagttttaagtacgaaaaaagacattttccaattattatttgtcaaattttataattcacttacatgttaatgacatacacgaaaatatacaaattttctatgtgtacaactacatatacaaaatatacaattacgtacccaaacgtacataccaactatagacatatattttccatgctacaaaccgaggaaactatatatactaaacaaaatatggtttgaccagagtaaatatatttagttggtaccaataatacatgataaacaactacatgtttaaagataatgaaaatataatagagtttctgtggaatacacagaactaagatttgataattgattaaattaaagataccgtgtgtagcacaggtactgacctagtatgtgattataatgaacgactctacaaaagaatttcatgataggcacctagctattttcataacacttggatctcctttttgaaaattgtgtggtgccataataattaaggatagacactcgtatatgtaacattcaagacgagcaagtgtcgttagctcaattgataaatattctaggtgaattttagagatcgccggtttaaatgacgcttgggacgaaactaatattatatgttatggtttcaggtctgaaataattacgggtttcgacccagcttcgacccaaaatctcctgtattcataaaaaaaagaaaaaaaaactattcgtgaccaagacgaacggttctgcgtgcaatattctaaaacgtatgattagtattacaccaataatctgtatataaatgcgttattttaaagaaagtccaaacctagtgtaaaaatctttaaactttttaccacttggataaaagactttcacaataaactatagtttaacaaatcacttatgaggtaatgaatctcatattttgctctctattgccttacgtcgaaggtaaaaatgtttgtgttatgctcctccaactacacatttctttttatctagctatctacaaattttgtgggagatgaatttaatttatggaagatgaatttaacttggtataaatttaacttggtataaatcccaactttaaaagatataaaacttctgaacttaaaattttaaatattaaacaaaacaaaaaatccctcaagaaaaatgtgaaaagatcagataattactttgttgtgtgtggaggccattttattttcctttatataatcaaggggccagccaatattatattattacatgcattgataataaagatgcacctagaagtaataatattctttttgttattactagacgacagaagccgtgcccttttgactcgggtctttactcttaacctatcgatgagaccacagaaagaaatataaaattgtaacgaacatattttattgagcttctttaccctcatatgtatgtaaatcttcttcaaaattaaagagagagagagagaaagaaaacttggaagaatctgtctgtgataatcatg

SEQ ID NO: 15264 - DNA, 3000 bp, Unknown
  misc_feature (1)..( 3000): cDNA_ID_3594434_gDNA_ID_2926095_Annot_ID_196624 3000 nt of promoter + ATG
ataggaaaggatgaaatcgagcagcaccatatttctatggttttgtactttagtccatgaacttttctctatttacagattatgcgtcaagcttttgaaatgatcataaaaaccctgaaattaaacagtttattttgatcaagtcaacccaaatttgattcttcattttgttcaaattcggggtgttacacaactcttatgccattgaaagttttactgagtaaaatgcaaatgactaacttgtaaaggttggcatcaacatgatcaataccatagccacatatatcttcccaaaatcgatattttattacgtaaattgtagacaaaatatgaaacgtttatattttttagaataaatggatctctaataatagagcatacaccatccacattattaaaaaaactcattctaattgttgtagattgataacaagtaattattattatttatttgatttaaaattttatcaattagtatattgatatgggtcatattaacctaaagaccactttctcaaataagagatcgttgtaacactttaaaatcgaattacacaaatttctcagatctcacaatagactaacaatttcgaattaagattaacagaatatcaagaaaattaaataacagcaaagcaagtaaaatcagttgtaaaacagatggattaaagcgtcaggtttagggaaggtctcaaaaaatatattaataatagttctgacagttaattaagattataagtgaaccgttctataacttaaatcacaataatataatcatttaactttcgtcacatcaactaactatgcctaatagtattgatcccacctctcattgtaaatccctagactagacaagcattataatcagatttgataatgtatgattatacttgataagaaccttgcaacccggccagtccataagcatctaaagcatgtgctttaggccaccgcttatattacgaatatatgagtactatgtttaatagattttggtagctaagatggttttgttgacttttgaaaattccttggtcctgtgttcaaacgaccgcaactacagtttacccctttccttcttctttttgctgcaaattgccttttttcttaacaattttttttcctttcatgttttatagtgtttgttttgtttcacgttcagataattgttatagtgttttttttcctttcatgttttgtagattaactaatattatacatttacttttagtatattttggaaagacgtaaaaaatgctttaggactggccatgactgctatacgtataatcatgcattatcaaacctgattataatggttaagtgatttaatagatgatgcacaaccttatagcccacgccaaacatatccactgtcatctaacttttatatcattccaacttgtgaattatcacagatatcattgtagatatcatctccattattatctttcaaagttccaaaattatgaagagtgtagttatggtgcatgctcctcctctctaaaggtgattttccttccaaatagagtgtaggagggtacctcctcttttcactacctaatcacatgtttgcacatgaatcaaataaacacattatgttagttaaatcactctgctaatgctaagctacaacttattcctatatatcattcttaaaaagctacaactcattcctatatagttaaatcattcctatataaattttactctatcaattgtttatgtcaagacattttgtctcaacttctctaacggctctaaaactatatcacagacatgagcttttttttttcatttctcggataaatattcacatatatctctctattcaacacctaatgatgcctaaactatgtttacatacaattaaattcccatataagtctactaaaacttcaaaaattttgtcttaaaaccttctatgaattgataaccgtatctaaacaaaccaaccacgccaaattaaaattaaaatttttctaacttctaacttctctttccttccagaaatgccttcacaatccaacgattacacttcatatcgatcggaaattgaaaaaaaaacaattaggaaaaagcaaaacacttcattttaaattcgacattaacatatttgtgaaattgtttcaaactcttacctccacacaaaagttgtcgtttcgtgctgctaactctttgtcctccatcgaatctttgctccgccttgaatttggaccaaccttcctgtgagacatccttaggatctcttttgcttcacaaacttaataagaccatttagatttaagaaaaatagacaataaattagattaactaccttactagaaacacttcttcaccggaaatcggcccatttgaagattttgtttttctcttgctgtcggaaattactaccgaaaaaaagaacatgaaacgagaaagagtttgatttattggtttcgaattggatttagagagtttttatttcgtctttttttttttaaaatcgaagataatactactataaataaatgaaaaaactcaatcatataaacttttttgcatcgcttttgaattattgtagtttaaaaaattatataataaaattacaatttgagttatttttgatcttttaaaagtcattataggtcctttctcaaatttgaaacagacatatattttatttttctcaatattattacaatgggaaacaaaaaaaaaagttatcctagaggtaacaactgtaaatcactcgtagaataagcgcgtcagagaaacatagaaaaaaaaaaaaaaaagtaaattcaatgaaagcagattttcagagagagggaccaaacaacccattgtccgatcaacaccgatctacttctccagacatgttctcacacgtgtctcttctctctctctctctcttccgattcaacttttcttctactctcactttagtctctgttatgtcctccattagcaaaagaaccacttcacttcacttcactttcacatcttgaagtagagatg

SEQ ID NO: 15265 - DNA, 3000 bp, Unknown
  misc_feature (1)..( 3000): cDNA_ID_3076789_gDNA_ID_2926107_Annot_ID_138553 3000 nt of promoter + ATG
cggtaacaaaagttacaagtgaaagaaatcagtaattttttatttattttagaagtgaatttggtttgagacaaacacgaacaataaacttataaatctacttaattaattttctgcttgctgatgagttctaaaaatttggtgctattaaagattaaacaaatgccgattgcagatctttcacgtggttaatcaatttataaatttttaaaacaaaacaatcgaagttcaattttatttttgtcgtaatcgaagttcaattgttggatacaggtctgacgcgatcgtgataagattttatatgctatttaaaagaaatcatgtggcctggccaaacacacaagtgttattagtaaaaaactatcttcagacttgtcttatataaatacatttatttgtatcacctattatgaattgttttttctccatatatatacgttgggttatatcttatttcaagtgggtagcttatactctctctgttcctttttgtttgattgtttagaaaaaacacacatattaagaaaatatattaaatgttgattataaatgtattatttttagtgttttacagttttctataactctaaaccaatgatagttaactatttttcttgaaaattacaattcaccaatactaaccaataaatattacatagaaaacttaaaaaattaatcttttagaaacaatttttttttctaaacaatcaaacaaaaaggaacagagggagtatttaattgcatcagttacaattttgagaaactctcttactaaaaataatataaacaattaataaataagtagagagaatgacaaaaataaaaaatagtttctctgcagagaaactttggagtaatgatggaaaaactatatgtataggtatgtgtttataattggacagaaactaaattatattaaatatatattttttttttttttgaaaaacttttaaagtatatgtaaatctattggtgagatggctaagtttctcttcttctattttttccttctggatattaagatctattatctcattattatatgtttaatccaagataatcacttacctgccggaattgattctcgttatatgtaaatcatcatgttaaacagttaaaaaaattgtgatatgatcaagtcctataaaagtttgaaatgatgatcaaacccaaacaaaattaagcttacaaaaagagaaaaaaataatatataagccttatgtttaacaaaatgtttagttgatataagtcgtttttaggatctgattggtgcacattttagctgaagaaaatgactcttaacgtcagctcaaaacataccaatcaagtaaaaagacaagagaaaataactatgctagctctactcttcatataactgtaaaaagaaagagatgttttcaccaatacaataggatgaaaatacttttcttttttgtttactccatttaaaagagttacttttactctatatttattatttataccaatgaaatcagacatttatatcagtttataagaggaaataaaactttaaagaaaagagagaaacatagcttttcgccaattttcactgtgtatctgtattcaaataattagagtaaaacagaaaaaaattatacccaatcttaacataattattttcagcctttatttttcagctaagatgatttaccaatcaatttttaggtgagatagttatgatgcctaataaattggaggtgcaaagttcaacaaaaattttacttttatgtttaattgaaaaagactgcttctcagtttaagaactatggcccatttatagatactgattaaaacgtggattgtaaaatgtgggcaatcaatattattttaaaaatgtggagccatagttattaactgtgattaaatttccccctcctccactttcacgcaaactaatatttaaaacagtcttaactgtgattcaagtaataagatttttcttttattattatttgacagtacttcctccgtatcattttaagtgatattttaggaaatgtttttagaatgtagagttgtagaggaaaaactagcagaaaaacaaaaatgcaatttatatatagtacagaaggttagtttaattgtgtttcgagttaaatctcttttttgatatggaaaattattctttaaattaaaatatttaacatttgactttggataggagaagattaaaagctgaaaagctggaacttcaacacttttgagaaaagtgagctacaatagtattaatcttaccatttactgataaataaatatatactttctgttcaattttaatagttttcaaatttattcttgttgcacataaacaacataggatatataatttttttagttaggaaatatatgcttttacgtttctatgaaaattctagatatgattataatttactcttaaaatatgaaatagaaaaatggagtggaatattattatttagaaagatatatatatatatatatatatatatatttgtttgtatgcagaatgttagaccaatataattagtggacatttctataaaaaaacaaaaaattgtggaatggatgggataaaaaaaaaagagagatcaaagataacattttaagatgtttttctttctttaattttcaacaattttaggcaatttagtagtagggggaaatgtatttctatgaaaatccaaatatatgctaatgtatgcaacaaggaaagatatagtaaccaaaactccacttcatattacaaacaataattatttttataaaagtattgacttgtcgtctgcaaacgtgattacgtgaaccttactggtaataatacaaaaatcacagctctaatttgccaacccaatccagatctctctagttctcaacttctcatataattattcattaatatatttattttgagattttggttgattttttgatatataaatattggacttgccattttctattacaaccatcaaatctcaataaagcaaaacgaacaagaaa

SEQ ID NO: 15266 - DNA, 3000 bp, Unknown; identical to SEQ ID NO: 15265
  misc_feature (1)..( 3000): cDNA_ID_3076789_gDNA_ID_2926107_Annot_ID_196648 3000 nt of promoter + ATG

SEQ ID NO: 15267 - DNA, 1208 bp, Unknown
  misc_feature (1)..( 1208): cDNA_ID_2996367_gDNA_ID_2926108_Annot_ID_138554 3000 nt of promoter + ATG
gatatctaaatttaatatgttagcgttactcaatattttatttaattttatatggttttttacacggattttaattcatctttgattgaaattttaacaaatgtcaatcagttttcaaactaataatgcaaaagcttaaatgtgaaagtaattttttttttggacaaatgctttaaatattataggtaaattctatatgtttgattttaaagttaataaattctatattcaaaaaaaaaatccttataaattataaagtacaccaccaataacctctttaagttaactattatagtattatgtttagaatgtagttggacatgttttatccgattaataccaattagaatagttaattatcaagtacacgctatgagcctatgagcaagagaaggcagcatggtccttggcctctttctcaagtcaaaatgtattttaataatcatacatgctgtaaacttcaaattcctactttttcagagtaaacaaaaaaaaatcagaaatcgtaaacatatccccatccctgaatacttaaccgtttgacattgagagtacacgtacaggaatatctagattgattaggtatatataatattttgtattaataatttaaaaaaaaaagtaattatcattaccagaactagctagttgacatctcactacttatgagtattttctaaacgcaaaagattatgttaggtgagttacgtgagtagtgcgcagtaatgcaatttggttaacgctgttcaatacaaatttgaaactagttgaatccagcaaaaaaaaaaaaaaaaattggcttccaaaatattgttaccataaattcataaactttcgttaaacttaaagtgatttatacacatagtatattcaaatatcgataaatgtattttgctaatcaaatcgtatattcttttataccagttttttaacgtcatctcgccaaaacaacaacaaatagatgtaaaataatgaaagaaaacaaaaaacaagatccatggggaagagtcacatgcatggagcatgcaactagcttacttcatccaattcccactcaaaattctctctttatatatacactttctctaccactacttccctcaaaacaagctaactcgatccttctcactaaagcgatcgtaccgatcttaatatctttagcgagcgagagagagagagatagaaatcctgagaggaaagagaggatg

SEQ ID NO: 15268 - DNA, 3000 bp, Unknown
  misc_feature (1)..( 3000): cDNA_ID_4359824_gDNA_ID_2926108_Annot_ID_196653 3000 nt of promoter + ATG
acgatatgctttcttcatcttcttctgatcaaatcaatcgcctcgctgtttccgtcgagggaccctacggccctagttccactgatttcctacggtaattcacttaaatcacaaacagagaagttcaacattctgtttcttccgacacaagtaacattgatgctctgtttttcttccaacacaagtaaaatgctctgtttttctttaagtgcagacatgaatctctggtgatggtgagtggagccagtggaattacaccgtttatctccatagtccgcgacctattctacatgagttcaacgcacaaatgtaaaatccccaagatgaccctgatctgcgcgttcaaaaactcttccgacctatccatgctcgacctaattctacccacctctggtctcaccaccgacatggcctcgtttgtagatatccagatcaaagccttcgtcacccgagaagagaaaacatcagtaaaagaatcaactcacaataggaatatcatcaaaacccgacatttcaaaccaaacgtctcagaccagcccatctcaccaatcctcgggcccaactcttggctctgtcttgcagccatcctctcttcttccttcatgatctttattgtcatcatcgcaatcatcacgagatatcacattcacccaatcgatcaaaactcggaaaagtacacttgggcttataaatcgctcatttaccttgtatcaatctccattaccgtggtgactacttctacggctgctatgttgtggaacaaaaaaaagtactatgcgaaaaatgaccaatatgtcgacaacttatctccggtgattatcgagagctcgccgcagcaattgatatcgcaatctaccgacattcattacggagagaggcctaaccttaacagtaagtctatttataacattttcatagagtaaaatgctgagttctaactctgtttattctattgtgtgaaacagagcttctagttggtttaaagggttcgagcgtgggaattcttgtgtgtggtccgaagaagatgagacaaaaggtagcgaagatctgttcttttggttctgctgagaatcttcactttgaatctattagttttagctggtgaattttaaattcagactgatgttttatcatagatgtttgggttacaaaagaactaggtggcttcgagagttcataactctaaacatgtcctagtactaatttatccgtctccggtctcctagtagactagtactaatattaaaatgtgaagcgatatatgagtcacatgttggcaggatttaaagtttgacagatctatatgcggtggatacgagttcggttagctgaaatttgtagaacaagcatttatgtcatgaacgtttctgaatggttttataatggtaattagtgaatggtttaagacattctttaggcagtcatgtagttttgtaatatcaaggaaaattggcttggctctgaatatgatttttttttctgaattggcttgttcgaatcctcaagatgattttttgaaatgtaaagttgcattttctgatataatttttttttgttgccttttataaataatcatcttttctttaacatttggttgccttttattaaaaatcatcttttctgattttttttggtcaactaatgtaacaccttttctttaacattttttttaaaaaaataaaacgcaaatgaagtcatggtaacccttttgactttcacaataccattcagtgacatctttcttacttaatattccgctgtcatgtcccactttggttaacatttgaggaatttcatcagtaaaaatcgaaaagatataaaggcatcaaaggagaaaccttaaaaagtcaaaatagagacacaagaagtgtttctttgtaggcttagatgagaagaagaaactaaggaaactgtattcctaaagtaaatactacttccttcattcctatgataatcaattattaaaagatatggagtcgcttaccaaatcataaaaccggtaacccaaatctaggaaattttattgtggaataaataacaaagcctttattttatttaaatagaacaagataaaacaccaaaaataatagctatgttctgaagtcttgaccaaactactgatacgggatctcacctagattacttacaatgtaggtgtaaaccgagtttttaaccaaactaaaacgaattaagcgacaattagttacggaagcttaaactctacatagattgatagattaaaaaacccttgaacaaaaaaagaatccaaattcagcttgaagtagattcaaccaaaccgaaataattttttaaaaatatgaattttgtttcagtttgaatttcatttgattttccaaaaattcacaaaccaaaccaaaaactgaatatcacttgtagctgtacctataaattattagagcattaaatctatctcaccaccgccaaactcaacgtgtgttaatcttttaaccctaaacttctaaattaaaaaatagacgacttttttacttatttcttcttcttccccaccatctttttttgtgctctatgttctcaactaatctcatttaattcaccacatacagctgcatcaaacatatatatatatgcatgtatttatgtacttatacacatacatacatatgatcatttaatgaaattcattaaatgaaactattcctttcgctgcaaaattaggtaccagtaaagcataaacaccactttaccacttcttgaattccaaatctgaaagctctgtcattatatatgtataaaccaatttaaacatatacatgtctcaccgataacaacggaggttcattaatgagggtttgattatgatacttacgagtgacagattgtgaatatcaaagagaagcttcttcctcccttttttctccctataaatttccgtagaaaaatcattcattcgcatctcttctcttctcaaaaatcaccacatttctttacttctctgggaaacaataataaaagagctac

SEQ ID NO: 15269 - DNA, 3000 bp, Unknown
  misc_feature (1)..( 3000): cDNA_ID_3096242_gDNA_ID_2926108_Annot_ID_196652 3000 nt of promoter + ATG
cataagtttctccttcatcgctctccctggtttctacatcttcttagtcgatcgtttccttcggtttcttcagtcacgtgaaaatgttcgcttgctcgctgctcggattcttccttccgacactatggagctcactttctccaaaaactctagtgagtaccttttgtccaattggctaattgtatatgaaaagttcacccttactggatattgatctaattctaaactattctttttgttttatagagttggtttatagcccgacgagcataatgtttgtgaacataccgagcatttcaaagctgcaatggcatccgtttacgataacttccagtagcaaactcgaaccagagaagctaagtattgttatcaagaaagaaggcaaatggtcaactaagcttcaccagaggctttcttcttctgatcagatcgaccgacttgctgtttctgtagaaggtccttacggccctgcttccgccgatttcttaaggtgatttgtttatatacactttctcaatcacctatctaataactttatattcagatttgttaagagtcctggaaacttgattgacttgcatttcaagaaacattgatttcatactttttttttttttgctttctaggcatgaagctttggttatggtgtgcggaggaagcgggataactccgtttatctctgttattcgtgatttgatcgccacaagccaaaaggaaacatgcaaaatcccaaaaataactctcatttgtgcgtttaagaagtcttcagagatctccatgctcgatcttgtcttgccattatccggtcttgagactgaactatcctccgacattaacatcaaaatcgaagccttcataacccgagataatgatgcaggagatgaagcaaaagctgggaaaatcaaaactctctggttcaaaccaagtctttcagaccaatccatctcatcaatcctcggaccaaactcatggctttggctcggtgcaattctcgcatcttcgttcttgatcttcatgataattattggtatcatcactaggtattacatttacccgatcgaccacaacaccaacaagatctattctttgacttcaaaaaccatcatatatatcttggtcatctccgtgagcataatggcgacttgtagtgcggctatgttgtggaacaagaagaagtatggtaaagttgaaagtaaacaggtccaaaacgtcgaccgtccatctccaacatcttctcctacctcatcatggggttacaattccttgagagaaatcgaaagtacgccacaagaatcgctcgtgcaacgcaccaatctgcattttggagaaagacctaatctcaagagtaatatatacatgaccttcttttaatttctctatctctatcttatatataaggaattgttattctaattatgttttttgttggtttatatgagcagaacttctacttgatgtggaaggttcgagtgtgggagttcttgtttgtggtcctaagaagatgagacaaaaggttgcggaaatatgttcctctggtttggctgagaatcttcattttgaatctatcagtttcagctggtgattgcgtatataactctgttttcactatgtgttgtgcaatttgcttgagttgcaagttaataaggtggccctgtgatttgacctatctttgtgtgctttacattgacttttcctgttttttgtttttctttatcctcttctaggaatattcagtgttaaaaaaaaaacttcctttcaaaagttccggaatatcctttttttgtttgtaacacaaggcatacagcttttgtaaattgtaaatgttgaaatataatactcatgttgggtcatatatatgattttatctctatttttcagttaaacatacttacgaaaaagtcaatttgctcgaaacgagttgggttatacacagatgtgagctacatgtaaattaatatttggatctatcagaatttatctgtcaaatacagaaatactatcttgcagatagcacaaattacctaattgttggttaaaaagacaagaagaagttacgtgaacataaaaaaaaaaaaccgtttcaattgacatgtcactaattattcgatttaagtaagaggaagtacaagaacaaattaaagaactcacctatatatacatccgtttatttaaaatctgtgttattgtgtaactctgctacaatttagtgggtaactaacaaaaaatatcatggttaaatttggtgttctgaggaaatttaatgtaaaattcataaatttacgtgtgattttttgataattgattattcaaaactcagtacaaggaataaaatcgaaaaagaaaaaaaaacgtaaagataatagaaatatacgtctacacgcatcggcgtacaaactcaatgattctgctttccgttgaatttgctaattttaagcccaaaactatagaattgcgttttcaatgtgaaatgaggaaattacacactttacctagactcttccacgagtcaagcctgttttgtaagtcagcagtaaaatgaagctgtaaatcacaaattaattataaaaagattcaattataatttctctggataatattattattttaaaataataataaaataatttcttattggtttatacaccagaccatattttcatataaatttaattattattttaagaaaataatattatgcatagaaaaatgacttaaatatcatttcttttatataagagtatattattttatatatatactctatatctttaaacatctcaagttctcaacatatttaattattggatcttttctgcatttagcataaaactactaattacattggtgtaattagcatatatatatgctggaaaaaaatatctttctatatatatgctggaaacaaatatagcacatatatatgggttttgtaaaattcattgcaaactccatttcgctttgttttttcttctcatttcttggaagttcatctctggtgcc

SEQ ID NO: 15270 - DNA, 1019 bp, Unknown
  misc_feature (1)..( 1019): cDNA_ID_3096248_gDNA_ID_2926108_Annot_ID_196651 3000 nt of promoter + ATG
gatatctaaatttaatatgttagcgttactcaatattttatttaattttatatggttttttacacggattttaattcatctttgattgaaattttaacaaatgtcaatcagttttcaaactaataatgcaaaagcttaaatgtgaaagtaattttttttttggacaaatgctttaaatattataggtaaattctatatgtttgattttaaagttaataaattctatattcaaaaaaaaaatccttataaattataaagtacaccaccaataacctctttaagttaactattatagtattatgtttagaatgtagttggacatgttttatccgattaataccaattagaatagttaattatcaagtacacgctatgagcctatgagcaagagaaggcagcatggtccttggcctctttctcaagtcaaaatgtattttaataatcatacatgctgtaaacttcaaattcctactttttcagagtaaacaaaaaaaaatcagaaatcgtaaacatatccccatccctgaatacttaaccgtttgacattgagagtacacgtacaggaatatctagattgattaggtatatataatattttgtattaataatttaaaaaaaaaagtaattatcattaccagaactagctagttgacatctcactacttatgagtattttctaaacgcaaaagattatgttaggtgagttacgtgagtagtgcgcagtaatgcaatttggttaacgctgttcaatacaaatttgaaactagttgaatccagcaaaaaaaaaaaaaaaaattggcttccaaaatattgttaccataaattcataaactttcgttaaacttaaagtgatttatacacatagtatattcaaatatcgataaatgtattttgctaatcaaatcgtatattcttttataccagttttttaacgtcatctcgccaaaacaacaacaaatagatgtaaaataatgaaagaaaacaaaaaacaagatccatggggaagagtcacatgcatg

SEQ ID NO: 15271 - DNA, 3000 bp, Unknown; identical to SEQ ID NO: 15269
  misc_feature (1)..( 3000): cDNA_ID_3096242_gDNA_ID_2926108_Annot_ID_138555 3000 nt of promoter + ATG

SEQ ID NO: 15272 - DNA, 2231 bp, Unknown
  misc_feature (1)..( 2231): cDNA_ID_3096257_gDNA_ID_2926109_Annot_ID_196658 3000 nt of promoter + ATG
  misc_feature (569)..(569): n is a, c, g, or t
  misc_feature (1467)..(1467): n is a, c, g, or t
  misc_feature (1480)..(1480): n is a, c, g, or t
  misc_feature (1497)..(1497): n is a, c, g, or t
  misc_feature (1501)..(1501): n is a, c, g, or t
  misc_feature (1529)..(1529): n is a, c, g, or t
  misc_feature (1562)..(1562): n is a, c, g, or t
  misc_feature (1565)..(1565): n is a, c, g, or t
  misc_feature (1580)..(1580): n is a, c, g, or t
  misc_feature (1589)..(1589): n is a, c, g, or t
  misc_feature (1614)..(1614): n is a, c, g, or t
  misc_feature (1622)..(1622): n is a, c, g, or t
  misc_feature (1639)..(1639): n is a, c, g, or t
  misc_feature (1655)..(1655): n is a, c, g, or t
  misc_feature (1687)..(1687): n is a, c, g, or t
  misc_feature (1702)..(1702): n is a, c, g, or t
  misc_feature (1706)..(1706): n is a, c, g, or t
  misc_feature (1709)..(1709): n is a, c, g, or t
  misc_feature (1753)..(1753): n is a, c, g, or t
  misc_feature (1797)..(1797): n is a, c, g, or t
  misc_feature (1814)..(1814): n is a, c, g, or t
gtcgacatttgccgactacatacaccttttcaccgcctaattattgaatgattggactcacgctgtataaaaacttacctataatttttatatcttcacagttatctcgtgagaattgttgatctttaaaactttcatcatgtgagcaaggctctagaaccattaagtctgtaaatttgtataccttttttaaagttgcataatgtccatttacaattacagccgctatttccccattttccacatcaggttgtttctttaatactgcataatgaccgttgggaacaattttattcatggattctccatttactacaagcccaaaaagttcatcagtattatgtgtcttaatatggaggtattgattcgatcctactatatcttgtacagcttcaattggagtacccgctgctattttccctatagacgggaattttagttagttcgtaattttcaagttctaattcacgtagctgttcagcttgagtcgtcaaaagaactttcattacatcgttaggagtaatgtcttgcttcattccgtgtacgatggcattgcgatcatcttgaantaattttagtacaccatcgacaatagcagcttttttatttttataagttgtatcaatatcagcttttgttacaccgaatacggcagccattttctcgagaacacctgaacttggtttagctctgtaattcatataatcacttagtgtacttcttgcaataccaatttgattagccaattcagattgagtcatatcgttttcttttaaatacttttttatatttttaactatagtttctttttgtaaatcagtcataatttcacctcctataatgattacgtttttaatataccatattacgaataattcgtaaagtgtacgttttgtgtgattttttcgtacttttgtattgaaattacataaatttagtaatacaatgaatctcgaaggaagggggttacacaatggattatttcaaaagaacattgtatgaactcagggtaagtgcaggattcaatcaagcagaacttgccgatatattagaagtatccccaaaaacattatggttatatgaacaagattcaactaacataccagacgaattaatcaaaaagtacatgtacttgtttgatgttccttacgaggatatattttctggacctaagtacgaaaaattcgtacagatgaaaaatcgagtaaaggaaagagcgaacaatttaaaaaatatcgcctcatgaaatttcgttataaatggatagtcctactgtcccacatacatataaatgcattgaggtgatagaggatgagtaaggaacaacattattcgtgatgaatatgggtatgtggtaaccagtaatccttacaacagaccagccgcagacattttccacaccgtcggtcccagctgcacggcagcttcttattcaaaggcaagacgacaacgcagaggtggtgtggnaggattccgggangttgttcttagttagtngtgntggagagtggagtgaagtaatgtgaagntttaaagtctgtgtaggtggagcgtgtggtgcncgncatcctcaggcgganaggctgacncccctggtgagggtaggaaactcanctcctgangtgcgcttctgacgcanggaggtggctccaccncccgggccgtcctttcttgtggctccggctcnggtccggactctccntgcngcncggtgcttttaagccgcctcccaccacaatcctattcgcattanctcccttcgctctctgtctgaggccattgtgtctttgaaccaancggcgtagttcaggtgnaaaggagcagtaatgtgcgatgcaagattttgtgggaagacgattgttggtagggggaatgcgtaaggaagcctgatcatccaagtgaagacgtctatggtgtgtggtagttgagaacaagatgataagtatgattatgtgtggacaagatcccgtacttgtggggaatctaacacgctacttgatcgcggaacacgatgttgaatgctttcgagcggtataaaaaggaagaccacctgcgccaacaggtgatttagagaaatgaaattcacagtcattatataatcaaatttggtgatgtaaatgaaactatttccgcaccaagatagagcgttaaacgatacatatgaacataatcgtgttgcgtactaccttgacatgggacttgggaagacctttgtggtctctgaatcaatg

SEQ ID NO: 15273 - DNA, 3000 bp, Unknown
  misc_feature (1)..( 3000): cDNA_ID_3096275_gDNA_ID_2926110_Annot_ID_196663 3000 nt of promoter + ATG
gggcttaggccgccaccgtaatccgcgtcggtccacgccccgaatcgatcggcggaccggattgctccgttccgcatccgaccaggacgcatcgccggcccccatccgcttccctcccgacaatttcaagcactctttgactctcttttcaaagtccttttcatctttacctcgcggtacttgttcgctatcggtctctcgcccgtatttagccttggacggaatttaccgcccgattggggctgcattcccaaacaacccgactcgtagacagcgcctcgtggtgcgacagggtccgggcacgacgggctctcaccctctctggcgcccctttccagggaacttaggcccggtccgtcgctgaggacgcttctccagactacaattcgaacgccgaagacgtccgattttcaagctgggctcttcccggttcgctcgccgttactaagggaatccttgttagtttcttttcctccgcttattgatatgcttaaactcagcgggtaatcccgcctgacctggggtcgctatatggactttgggtcatctacagcttccggacaagagcgaccgataaaatgtaatggatcaagttcaccaccgcatgtcggtacgctccaggcgtccttggctcggatttaggccaacgcgtgcggtaacacacgggagaccagcttccgtcccgcatcagcaaaggatggtgagggacgacgatttgtgacacccaggcagacgtgccctcggccagaaggcttggggcgcaacttgcgttcaaagactcgatggttcacgggattctgcaattcacaccaagtatcgcatttcgctacgttcttcatcgatgcgagagccgagatatccgttgccgagagtcgttttagacttcagttcgcagcacagcatccgcccacactccgtctccggggaggcgaatgccagccgttcgtttgcatgttccttgacacttttcgtgccggggttttgtgatatccggaagcaacgcgcacgacaagaccgagataaaagctcccgatcatgccgatacgcgaaaccacggatccggcgggcaaggaatcggctaagaaaccggcccaccgagagtggtgatctttggttcgcgggtcgttctgttttggacaggtatcgacaatgatccttccgcaggttcacctacggaaaccttgttacgacttctccttcctctaaatgataaggtttagtggacttctcgcgacgtcgcgggcggcgaaccacccacgtcgccgcgatccgaacacttcaccggatcattcaatcggtaggagcgacgggcggtgtgtacaaagggcagggacgtagtcaacgcgagctgatgactcgcgcttactaggaattcctcgttgaagaccaacaattgcaatgatctatccccatcacgatgaaatttcaaagattacccgggcctgtcggcaaggtgtgaactcgttgaatacatcagtgtagcgcgcgtgcggcccagaacatctaagggcatcacagacctgttattgcctcaaacttccttggcctaaacggccatagtccctctaagaagccggccgtgaagggatgcctccacgtagctagttagcaggctgaggtctcgttcgttaacggaattaaccagacaaatcgctccaccaactaagaacggccatgcaccaccacccatagaatcaagaaagagctctcagtctgtcaatccttactatgtctggacctggtaagtttccccgtgttgagtcaaattaagccgcaggctccactcctggtggtgcccttccgtcaattcctttaagtttcagccttgcgaccatactccccccggaacccaaaaactttgatttctcataaggtgccagcggagtcctataagcaacatccgctgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctgttaatcattactccgatcccgaagccaacacaataggatcgaaatcctatgatgttatcccatgctaatgtatccagagcgtaggcttgctttgagcactctaatttcttcaaagtaacagcgccggaggcacgacccggccaattaagaccaggagcgtatcgccgaccgaagggacaagccgaccaatgcacaccaaaggcggaccggccgacccatcccaaggttcaactacgagctttttaactgcaacaacttaaatatacgctattggagctggaattaccgcggctgctggcaccagacttgccctccaatggatcctcgttaagggatttagattgtactcattccaattaccagactcgaaagagcccggtattgttatttattgtcactacctccccgtgtcaggattgggtaatttgcgcgcctgctgccttccttggatgtggtagccgtttctcaggctccctctccggaatcgaaccctaattctccgtcacccgttaccaccatggtaggccactatcctaccatcgaaagttgatagggcagaaatttgaatgatgcgtcgccagcacagaggccatgcgatccgtcgagttatcatgaatcatcagagcaagccagagcccgcgtcgaccttttatctaataaatgcgtcccttccataagtcggggtttgttgcacgtattagctctagaattactacggttatccgagtagtagttaccatcaaacaaactataactgatttaatgagccattcgcagtttcacagtctgaattcgttcatacttacacatgcatggcttaatctttgagacaagcatatgactactggcaggatcaaccaggtagcattcatcgatcacggcaattccccgccacatcctctcaaacgcaatg

SEQ ID NO: 15274 - DNA, 582 bp, Unknown
  misc_feature (1)..( 582): cDNA_ID_3096271_gDNA_ID_2926110_Annot_ID_196664 3000 nt of promoter + ATG
ttcgttaaggagctgttgctttgttagtgtagaaacacttgtgtagaattggggattgttttttttggagtgatttaggggagggtcgaatcttagcgacaaagggctgaatctcagtggatcgtggcagcaaggccactctgccacttacaataccccgtcgcgtatttaagtcgtctgcaaaggattctacccgccgctcggtggtaattataattcaaggcggtccgaacgaccgttccgccgaacggacttagccaacgacacgtgcctttggagcctaagctcctactgagggtcggcaatcgggcggcgggcgcatgcgtcgcttctagcccggattctgacttagaggcgttcagtcataatccagcgcacggtagcttcgcgccactggcttttcaaccaagcgcgatgaccaattgtgcgaatcaacggttcctctcgtactaggttgaattactatcgcgacgcgggcatcagtagggtaaaactaacctgtctcacgacggtctaaacccagctcacgttccctattggtgggtgaacaatccaacacttggtgaattctgcttcacaatg

SEQ ID NO: 15275 - DNA, 3000 bp, Unknown
  misc_feature (1)..( 3000): cDNA_ID_3096292_gDNA_ID_2926111_Annot_ID_196668 3000 nt of promoter + ATG
caaaacaataaccattacgattttcgaaattttgctacaaagaacatcacatttattttttttttattttaaaatcacgtttttctgtagtttaattttcgcccttaactaaatcaattgctacattatctaccccaaagcatcatactactactaattagtttactctggtttaattgtctaaacgtccacttaagtgtaatcgtttccaaaataaatacaattctatatctttgttgtggtcagataatgttttacccaaaaactgatttaatcgtctaaatgcctcaagaaaatataggtttgacggaaagaatttatttttgacatttagaatattgaaatcaattaaaaaagacagactcacggcgatgtaatgagagttggtaacgttccaaccatcgacataaatattgaaatggttgagagggtcaggtcgctgtgtcctctccgccgctaacaccaatctggtcccattccctccttccaaaatttgcctcctcactcctaaaatcattttcttaaatttttatcagaagccattttttaatcaaatttgtataattgtatccaaaagaaaaaaggggtttctctggtttaaaagaaacaaaacttttaccttgaaatgaggtagaggatggacgatgatgacaagaagacgaaactgcatgagaaaaagaaaccaaactcgacgtgatcagaagcccaacggtgatcaggaggagacgccggcgactatgatatgacggcgtttcgctattaaccattattctccctatttttcttgtctaattctctctctttttttgtttttttgggggaggtttggtttctaatttctgaaactctaaaaaagggtttatcaatcaaacgtatgaataagaatcttttacttcttcaggaaatcaaggacaaagaagatgaaacgaaactgttccctttatttagattttcaccatccattgttgttattctgttttgttttaagttttcacctcattttcttagtttttaaaatccttaattaattactcttttaactcttattggctgtgtgacctaaaacttaaattaatgaatcacatttttttctataaaaccgattatacaataaaattgaaatgaaattggtaaaaatactttatactcagggtcgactcggagattagaaaaagaaacggagaatggcattaattaccaccaatactgacatgagagctactctaattttgtaacggaaaattcactccgatggaaaccagatcgctatcactaaaacctccaactccataacatttcaattccttgacattcttcatctcaaaatctgggaaatagcgcgtttgcgagacatctaccgattcgaaatccaaaccggaacgagaaacctggagaagaatcgaattgagatcctgagtgaaatcagagaacctgattcgcttcaagttgcggaatcgaaggagatgacgattgagtaaaggaacagctcgatcggtgacgacgaaagtagagcgaacgcgattggtgattgagaggaacaaggttgatacgagtgaaacagattccaggaatcgataatcgtcttcatcgatagctttgcagattaattcccaacattcttcaggtaaatccatggatgatggatttgatgaagattagctcaaatcaaactaacaacaaacacagtatgtaactaactatatatcatccttcaatttcgctggcagctggcttttaaccttatccaattttaaaatttcgaaactgggcttgttgtggctttttattccttaatggcccaataactatatttgtttttccaacagatattgggcctaacgactgattcatttcaaaatttcaaaactgggcttgtattgacccaataagatataaaaggctcattattcttgtaaggccctcaataagtctagttgttattcaactgtacagttgtgactagtcagtgaccacttgtgtcggtaattaaagtttgaagaggacagacatagagagttcacatgaataatgctcaaacttttggacctttgtcgtctgtatttttttaaaataaaaagaataaaattcttggatgcactctattaaaccatgacttgtcgttttgttcactaaatccgcatgaattgaatttggggagtgacccaatcgaatcatttggattactgtgcctcgatgcaaacaactctatcgagagattacacaatccattctcaatccatattctttccatatatcacaccattttattaatctgattaaaaataataatttcttttacgacaagatgtattttttttttcttggaaattaaaagactaaacttatgaatatgaaggaacattaaaaacaccatttatgtaattggattgtactttgattgctttatgtactttctttgtattcttgatttttctaatttaataaagatatagtataactatacgttaaagaaaaaggaacaaggctttaattaatagataaaaatctgttagctttacgtataaaaggtttaattctatttgtcaactagtagtatcagcatcatctctaacattgggatgttaaattgttgtaatggtagagagaaaatcaaaattttaaagattggctaatgggaagaaactgttttgctaactacacatcctcctcctcactctctccacaactccacgtcttatcaccacgtctgggattaggcactctttgctgctttattagcctttttgtccaccttttcataactgccacatgaagaccaaacacctaaaacctttgtccttctctctctctgtttcccaactccaacagtgtctcttgtctacatctcctccagacaaagataatctctagcatttttcaccatctccataaaagaattagatagaacacgaagcagcttcgtactctttatctctctctctctctctttttgtcttttctctgcatatttgttgataccagacaacaaaattaaatatg

SEQ ID NO: 15276 - DNA, 3000 bp, Unknown
  misc_feature (1)..( 3000): cDNA_ID_1814830_gDNA_ID_2926112_Annot_ID_196676 3000 nt of promoter + ATG
acagagaaaaaacacagaaaataagcaagcacggactccacctgtaaaaaccttcaaagttacttatgctttacacgccacaacacaacatagattcctaagatcaattagaaagaattaactctatcttgtcaagtcatttcttttatcaacagattcatatttagaaatgtgatgaaagtggatcgactcatatactagctattcgattacttctgcagaagatcttaaggctcttatgattgaatccagatcaatcacaaagaatgtgttgcaaagactctcacatttgactaattcaaacattaggtgtaaaaggaagctaacaagtaacatacataagacttttatcaacgagtgagcacatgggacttaaacaatgcaattgttgctagcatttgactatctctactaatctgaaattcctccttaattatagggatctacactagatacttcatccttaacataccaaaactcctaaatatagcaaaccaagatcagtcaaaagattattaagccataaatcaagtaaaccaaaatcaaatttaaacctttttgagtagctttgggacatttccatccatcagtagcgagagtgatgttcttaggaagcggcacattcggcggcgcaactccgaactgagtcccgacgagctcaacacgagcttgcatctgagtgacatcaccagcagtctgaatagctgatttcaaatccgacgaaggataaccagcgaaaacggtaccgttttcgacgctcaccggtaagctcgagccgtctgagagtacagcgtttgaagcagagacgaggatctctcggtgtgcgaatttgacgaagacacgccatgatttgagctcgtcgcggccgtggttgagcactgttatcacagattcgaaccggtagggttgatttgcggtgtcgttgggtgggatcttagatcctttagtgtgagtgtatgaaacgaatacaccgttgcatagatccgaatctgacggtggtgacggtgacggattagtagtgttggcgtcggattgtgatgatgttagaggaattgatacgatgagaagtgatagtagaagtaaccgagggatgaagttgggagctgaatccatggaaccctaaaatctcgctcttagtcaaaaagagaagttttttgaatttgaattttgtttgggaattgagagaagttagaaaaatggaagcttttgaagagatgatgactgataaagcgaccgcgatagtgcaagctgtaatgaaaaatgtttgtatttgcaattcaaattttcccctggagcattttttgttggctttttttgctttttcttttgttgaaaatctaagaaactttatggataccaatactcttacattattacataattattttcttaacaaaaataatgtatggatataatttcttaaaccctattttataagaaaaataaagattaaaaataaaataaaaaacacctaattgcaacaaaaacttcattttgtattcaatttttagatatatttaaaacgcactaaacaagtgagagcacatgagttctgtcgcaacataccaaattcttattttctgttcaacggtggtttgcttacttataaatggtatgagcatgagactatgagagcatcaatacatattccttaaaaccatccttgtacaactttccgagtcaatgagttcgtagactttctcctgaatagtgaagaaaatgttttgtatcatcgccaaattccactctttgcgatattaagctgtgttcagtgttctcgttcatagtcaggtgattaaaacaaaataacttcagaacatataagaaagcccaaaataataaaaagcccaaacccaaaataaaacgtatagcccgatacaatagacgatacatcactatcactagtactaagccaactagacataagacatctcccgtgaaatgtttgcttggtcttaactcttaagcttaattaagaagacaatgagataatcctcatgccaagttagatcactaatacactagtaacctccaatccattattaacagtatttctaatcatcggaccagacaagaatattaaacattcatgctactgtcttgagtgtctatgatctctttcccttaaactctcttgctgctgctgctcacaaatgattcgtccaacagaaaacggtgccgtcttttcagaaactttataaataatggataagaatactatgttttttactacttgggttttgtcacagatatcatctgcctcgtcagaaaggtaacagataaaaaaaataaataaaaaaaatgatgaccttatcttcaaccgctactcctacaacttggtaactgctgctctagatagataaatttgcatcttaaaaaattgtactatatttagaaagaattatacaaatactcagagattagttacaaagatggagaatgttgagagttaacttgcaattaattgaattgcaatcaactaaattacaatataccaaacgatgatcatatcgacatttgcggataagatcaattgtagttataagtccaaatcatatgatattggtctttcctttcttattgtcctagagagtttagataagaaaacatatatagtacttttaattatttctgcaatccattctttcccaatagtgcaattttcagtgtggaatttatatcccatatataaaattcatattcacgaaattcgttttatcttttttcttgaattgcggtgttacgtaaccatccttcgcatcataataaattattaataatttataacgattttaaggaagaaaaaaaagcttttaaaatcggagaattaatttcggttagttcagatttatgagtgaaagagcaaaattgcaaaaaaaaaaaaaagtcactgaagatttattagactctcttcttcttcttcctccttggcgcaatttcgcaatttcgcaatcgcatcagtcaattatcgaatcgtcctcccagagattaccggagaaa

SEQ ID NO: 15277 - DNA, 3000 bp, Unknown
  misc_feature (1)..( 3000): cDNA_ID_3096333_gDNA_ID_2926114_Annot_ID_196686 3000 nt of promoter + ATG
gctcaaaacctaagacattatccaccatcagtagatccacttccgccaccagggcgccacctaagctcgctttgaagtcctctttgaaggatttcggtgtcatcgcagtggcaacagcagcttcgatcgttttagctggaaatgcgatggccatggaggttcttttaggatccgacgacggttcccttgctttcgtaccatctgaattcacggtggctaaaggagagaagatcgtgttcaagaacaacgcagggttcccacataacgtggtgttcgacgaagacgagatccctagtggtgtggacgcaagcaagatctcgatggatgagacagcgcttctaaatggtgcaggggagacttacgaggttactttgacagagccaggctcttacggtttctattgtgcgccgcaccagggtgctggtatggttgggaaactcaccgtcaagtaaattgtctagatattctcttgttcgagtaggagcttacatattcatgatttataaatctaatttggaagagaatgttggattgataaagaggatcatataatgtttactatcataagttactggtttcagtggctcttttgtacattttaagtcacggtaatacaatccgataacctttctctgtgtccgtgtaaagagcttttagtttgaataaagtttgttttaggtgtatctgcgttgggtttacttgccttactttggtcccaacgtttgagtcttttagaggcccagcacgcctatatatcacaaattgggcctaacgactcatgttttttggggaaatataggaaacaggtttagctaggtcttacgcaaccactactgacccacccaaaaaaattgcattaacaaatcacgagaaagagagaatatcacgtgatgaaatcattattgattttaaatagcaaaaatgaagacggatcatggatccattaccaagggtcaggcagggaaaaatgtctatttcggtcgcctggtttgatttgatcttttgctgaaggaacagggaaagagacaaataacacagatcagcacactcatatatagctgatatgtaaccgagactctctttctcgtagagagttccacgttgaatatgattcccatatcttgacaagtctagttgcaattctgaattaattaatatgaatagtttacattggtaatgcgaagaaaaagctctcaaacagttgtcacattttgtgttctagagaaaagcacaaagtgattattaacatatttgaaggtttcatctctcttatctgtgtgtatatcagttatatataatgtttaaaatgtataaatcatgatttcgacaagcttcaaaaatagtttcttcgaatataacagctggagatggattgtcgtatgtgcattatggtctacagttggaattattagagtaaattatatatcgggttcataaaatacgataaaattggaccaatctataacgaatttgtcctcactcacacattaattatgtcgtgtgagcaaatagatcacgtgagtgatgttataaaaacaagctgtaatatggagtgatcaagattcgtgttaacatagagacagattgctaacacatcgtagacatgtgatacgatcatatgagtcatgcatgtgatacgaccaatttaccaaaaacaaaattttaatttaaacaataattgggatacctaaaggaccagctaattaattagttattaaatgagctcacggatcctggacaaaagtgtaacgattgtagtgcctttttttccttggtaatcagagttttatcattaggatataggttaatccgtatcaagaaaagtatcctacctaaacctaacgcattcgagaccataacaaaaaatcaacgtcacggacttatacccggaccgagagcttcaagccttcaaacatttcattggctatatttttccttaattcatgattcaatgttatactacacagtctcaattctatgaaaacaaatctgaagtcgtacggagagcgagagatacatacgattacagtatatgaaaaaatgttaggtgactttcacattaaaaatatattataaggagctggcctgaccctacaacgtggaaagagtgaaatgcttgtagaacttattaaggatatcacaaaaagaaaaatctctcagatatatgagttcaagatcgcaaaataatgatctcatggcatttatattcacatgtactcatgtagatctggatctataaataattgtagtttttcattgtgataactgatttgagaaaacaaatataaacgcaagaaaaattgtgatgttacaaggtgttattggattataatttaaaagtaattttgatgcctttactaaaatcatagaaagtaaataaattataaccaagtgctaaagagtttttataatcttgttattagttattctataatttagtgaagtttctcaaacaatatatctatttgatgattttttcatgattttattttgtgaagaaaaatgtataaaattataaactaataacacaatagtttaattcattaacaatcatacattttttttaattaaacaacacaaaaaatttattgactttattaaattttgattctaataaaatcagatttatgaaaattttaaaagacttttaatttacaaatcaaaaactaataatacattttaacagaaattaataaagttttgattgaataacaagagtcaaaagatctactaaagtttttaaaacaatatttcaatcacaaaccattttaggtgattttatttattttaatataatttctttctataggcagtagtgtggaccataaaattactgttaatttacttcctaaaaaggattatttaattgcaagattctaaactggattattcccacaatacacctttgtaaataaaaaccattaatccttcacaaatacagagtcgtgaacttaacgtctctctctattcctctgcttctctctttctccctgtgaaaaa

SEQ ID NO: 15278 - DNA, 3000 bp, Unknown
  misc_feature (1)..( 3000): cDNA_ID_3096331_gDNA_ID_2926114_Annot_ID_196687 3000 nt of promoter + ATG
ttactaaaatcatagaaagtaaataaattataaccaagtgctaaagagtttttataatcttgttattagttattctataatttagtgaagtttctcaaacaatatatctatttgatgattttttcatgattttattttgtgaagaaaaatgtataaaattataaactaataacacaatagtttaattcattaacaatcatacattttttttaattaaacaacacaaaaaatttattgactttattaaattttgattctaataaaatcagatttatgaaaattttaaaagacttttaatttacaaatcaaaaactaataatacattttaacagaaattaataaagttttgattgaataacaagagtcaaaagatctactaaagtttttaaaacaatatttcaatcacaaaccattttaggtgattttatttattttaatataatttctttctataggcagtagtgtggaccataaaattactgttaatttacttcctaaaaaggattatttaattgcaagattctaaactggattattcccacaatacacctttgtaaataaaaaccattaatccttcacaaatacagagtcgtgaacttaacgtctctctctattcctctgcttctctctttctccctgtgaaaaaatggactcggtggctctctactgcaccgctggtctcattgccggcgccgtctactggttcatatgcgtcctaggtccagcagaacgaaaaggcaaacgagcctctgatctctccggcggctcaatctccgcagaaaaagtcaaagacaactataaccaatactggtctttcttccgcaaaccaaaagagatcgaatcagccgagaaagtaacactgcttcgtcgacacgttctcacaatcttgtcactgatatctacgagtggggatggggacaatctttccatttctctcctcatgtccctggaaaatccgacaaagacgccacaagaatccacgaagaaatggccgtcgatctcatcaaagtgaaaccgggacaaaagattcttgacgctggttgcggcgtgggtgggccgatgagagccatcgcgtcccattccaaggcccaagtcactggaatcactatcaacgagtaccaagtgcaacgagccaagcttcacaacaagaaagctggacttgattctctctgcaacgtcgtttgtggtaactttttaaagatgccgttcgatgaaaacacgtttgacggagcttactcgatcgaagctacgtgtcacgctcctaagctcgaagaagtatactcggagatcttcagagtgatgaaaccaggatctttgttcgtgtcctacgaatgggtcaccactgaaaaatacagagacgatgacgaagaacacaaggacgtgattcaagggatcgagagaggagacgcacttcctggactaagaagctacgctgatatagccgtgacggcgaagaaagttgggtttgaggtagtgaaggagaaagatttggctaaaccaccgtctaaaccgtggtggaaccggttaaagatgggaaggattgcttattggagaaaccatgttgtggttgtgattctttctgctattggggttgctcctaaaggaactgttgatgttcataagatgttgtttaagactgctgattatttgaccagaggtggtgagactggaatcttctctccgatgcatatcattctctgtagaaaaccagagaaagcttctgaatgaatgattgagaatcttcttccttgttctcgtttttcttcttctttctttctaagttcatgttttgccccttaagaatctctttgtcgtcgtattaatgttatcactttgttgtttattgtatttttttttttcaatttgatttgtttaaattgatgatggatcactggaaattagtttttcgctcttcttaaatagtttctgaaagaattagccgggaaattctattggagtgatcctttacctttttaaaattttgtagagtttacaagtctctgtttagttttaatttctaagatcaaactcggaataaaccggattagcacgtctatagagttgcataaacttttagtatcatcaatgagggtagtttggtaagtccttaggtgtcacattgtgtctgtagtagtgagtcgggagtggtcgtgtgggattttgtgggctgtccgataatgcatatgttattgtcgtcaactgtctgatatattaatctatgtatcttttaaagatttgattttgatttattttaggcttatggtttgtcgcattgcggtagtgggtagcagcgtggtcgcacgaactccggcttaccttagaaaacgatattttatttagttatttagtttttttttttccaatttgttttgtgcattactaaaaagattgtgtcatttgtgtgtaaaagtttactaaaacactgggtcatttctatagtgggcttttataatgatgggcttaaggccaatttttattggtttacctcacttccagttccaccgggagtggatatatgcttatattcgtacgtgacatcaacaataatacgcgtatacatgtgtaagtcaatggaccaatttgggtcgaagctgtgaaaattgtcccaacttatggagagcttgcggaaatctttttggttcctttttggccaatacatttccgcttaccagttggaaaggaacccaacatggccgaattttaaccaacgggtcaaattaggccttacttggattgctgggtggaatttttcaagaattgccaacaactttgaacaaaaattaactttgaatttgcttttagaaacaggcaattctcacccaaggttcaacatattccctttttatatccccacggaaaaaaaatctaattcaacagtgaacacaatcccacacaagtttaaacaagtggacataaaagtcttggacccattttaaaacatctatccacattaaatcattcactgatctctaaccaatcccacacacactaccacaaaca

SEQ ID NO: 15279 - DNA, 595 bp, Unknown
  misc_feature (1)..( 595): cDNA_ID_3087735_gDNA_ID_2926122_Annot_ID_138621 3000 nt of promoter + ATG
aataaatctcgaatcggccagagagagcgtgtgacaaatgagttcataagattccggtatcgtcttccggattcctccaaatctccggcgaatttgcactctttacctctcttccggactgtgaggttttgttttccttatcaatcgaattccatttcgtgctcgtaacgtgattttggtagattttttttatgggggatggaaacttgtttattatctatagatgatgattttgttttctccatgagaatctatgcttttaaacttttttttttttgttttttgccttcggagctaactttttggtgctggtctctgtctcggttttctctccactaaaaagataaaaagctttttgccatctttttttttttctcaataatctatcacatcgttttttttctttgtttttttctccatttgtcttcattgagttcatagccacataattattgatttctttttcttttagtgtttctgttactgatgcgtttcattatttatacttctcacttgcagattcgaggattgttagtctcttgtgatgtgtgagtctttgaagcaggggatttttattgtattgaggaagaagatg

SEQ ID NO: 15280 - DNA, 595 bp, Unknown; identical to SEQ ID NO: 15279
  misc_feature (1)..( 595): cDNA_ID_3087735_gDNA_ID_2926122_Annot_ID_196695 3000 nt of promoter + ATG

SEQ ID NO: 15281 - DNA, 3000 bp, Unknown
  misc_feature (1)..( 3000): cDNA_ID_3100788_gDNA_ID_2926123_Annot_ID_138623 3000 nt of promoter + ATG
aaaaacagaggataaaaaacgaacaaacggttaaagctggcaaagatcccatcttccccacgctgtcaaattttgtcactacttcccaaaaaaaactctcccgcctctctctctccctctcccttcttattctcctccttcttctccttcaccatctccagatcccaaaatcttcatcgatcatcatcatcatgagagaaatcctccacgtccaaggcggccaatgcggtaaccaaatcggttccaaattctgggaagttatctgcgacgaacacggcgttgatcccaccggacgttacaacggtgattccgccgatcttcagctcgaacgtatcaatgtttattacaatgaagcttctggtggtcgttacgttcctcgtgctgttctcatggatctcgagcctggtactatggatagtatcagatctggtccctacggtcagattttccgtcctgataacttcgtctttggtcaatccggtgccggaaataattgggcgaaaggtcattatactgaaggtgctgaacttattgatgctgttctcgatgttgttcgtaaggaagctgagaactgtgattgccttcaaggtatatatatgaatcgatttctcccttttgatttatgaatctgctggtgctttgatcatattatctgattgatttgtgaatcaaaactgcaattatccgatggtttcgatcatttaaatctcgtctcgtgagtgttaatgtagttgcatatttagtaaccgatgatttcgatttcagtttgatttttgatcatcttcgcattgcactagtgaatctctcacatatcgtgttttgatatttgattaacgtttctcttcattgatctcttcatggtcatggttccaattacagtttatgaattacatgaacatgatccgtcgatgttcttgtgtttgatttgcgtttttatggtgtttctctcctgttgattactgtttaagagtgagctgttaacacttaatgattggctaggatttagattttgtctattctttatagtaaaaagttaacatcattgaaactaaggacaatatcctaatttggcggtagtgtattagtgtcccctaatgttttgttccagatttgtgactgtggatcaacaatatcacgtgaaaccttaaaaccatatcgaattttataataagaactttagggaatactcttgtgttgacactttcgaggtgaaacatatcactttgtggggatataattgaataagcaagtgggtcatgattggtttcagcaattgttaaataacatctcaatactttttggatctggtttaggtataagggacttctttagttttgtagtacattgtttcacacttgttcttaacatttctgtattacagggtttcaagtatgtcactctcttggaggaggcacgggttcaggaatgggaactctcttgatatcaaagatccgtgaggaatacccagacagaatgatgctcacattctctgttttcccatctccaaaggtctcagacacagtcgttgagccgtacaatgcaactctctcagtccaccaacttgtagagaatgctgatgaatgcatggtcctcgacaacgaagctctttacgatatctgtttccgcactctcaaactcagcactcctagctgtaagtaccatcaaaaccttaatgtttgttactttgttttcttggttcctaaattctaagagttcatatatatatatacattttgcagttggagacttgaaccacttgatctccgcaactatgagtggtgtgacttgctctttaagattccctggacaactcaactctgaccttaggaaactcgccgtgaaccttatcccattccctcgtctacatttcttcatggttggtttcgcccctctcacttcccgtggctctcaacagtacatctctctcacagtcccggagctgacacagcaaatgtgggacgctaagaacatgatgtgtgcagctgatccacgccacggacgttacctcacagcttcagccatgttccgaggaaaaatgagcacaaaggaagtggacgaacagatcctaaatgtccagaacaagaactcatcctactttgttgaatggatcccaaacaatgtgaagtccagcgtctgcgacattccaccaactggaatcaaaatggcttccacgtttgtcggaaactcgacttcgatccaggaaatgttcaggagagtaagcgaacagttcacggctatgttcaggcgtaaagctttcttgcattggtacacaggagaaggaatggacgagatggagttcactgaagcagagagcaacatgaatgatctggtctctgaataccaacaataccaagatgctaccgctgatgaagaagacgaatatgatgaagaagaagaacaagtttacgaatcttgatcttacaacacaaaccaaaagatgaaaaaacacagaagtcacatctctatctcttttattgaaatctctattcctactattaccactatatatatatatacatgtatcaagttgaagaatctgggaaatgtgtttgtttgtttgttactttatctttgtggttctctcttattgtattttgcaacttagtttcttctcattgcctttataataaagagtctgtccacgtatctccctctttagcctttatttcatagtattcaaaaaaacgattcttagaatcctttcagtttatagtatagacaaccaaaacattggaaacttggttgcatattcgttacaaaatcctgctatttctgctatataattatcaccccaaaaaaaggtttatcaaaaactacttaaattgataagaagagatgaatctattaaaaagcttctactataaagcacacatcttcttcttcatctctctttcgctctcagaatcctcttttaagtctctgtttcataaataaaactaataaagaagaagaagaaaacagagcaattaaagtccttaaatcttcttcttctccaattca

SEQ ID NO: 15282 - DNA, 3000 bp, Unknown
  misc_feature (1)..( 3000): cDNA_ID_2996375_gDNA_ID_2926123_Annot_ID_196701 3000 nt of promoter + ATG
tttgtagccttgtcgtttttatcattaacatgattgacaagactatgacctatatatcttattattatcattgctctctctatttgtttatattgattattactttttgagatttttcaatggttttatctctaactaaacattataattagtgaaacaagcttagtagaagtaaaagtattattctatgctaaagtacattgattagtagagtgtgtaattgtgtatacagataatctataaacaattggtgcatctgtatataaaactttatgatttatttattgtatttaataagtatatgaattgggtacctaactttctaaacagttccaaatttattcttaaatcaaattgcatatgatttttaaatattttgagacgattttattataacgcaaacaacagagtaaaagaagcatatgttgcaaattgtactatggcaagttcaaatcgaaacatttttgtgaaaatcaaacatgtgaaccaagcttctacagtttaattccctttcgtataatttaatttcaacaaatttattgatatccatctagaaattggtccaaagttctttcacccgtgagtcatttagtgataaagatgacatgatttttggtgataaattttccatcgttgctatatgtcgttatattattctcctatatgtatattatactatttacatcagaaaataatccaaagtttagagattcttttttacaataataaaatttcccacttactaaaaagagctccttttctgctgaagagaacctaaacctttattcccaaagttcattgagttagagcattttcagcgaatcacataagagatgctctcttcttcatcactaattgacatctcattgttttaaaggttgcacttgtacctgttgatctgattctcaatccacttaagttaaaccaaatagacacgagaaaaaagcacatttatttgttgctaagtatgcatatttttcagcgtttacttcttaatctaatgtatatcataagataatatctaaaagagaatgcacaaaagattattaatatgagaaattcgctgccatttaggaaggacctttataccaatataccgcaataataatagaacattggtccccaagtgtatgtcaaccccaagtgtatagatttctttaaagattaaaatccctttttgttgctaaagcacctgatatatttttctatcaaactaaaaaaattgttagcgggatgaagatatattcgccaagaaccatagtgcttgtataacggcagaccattaattcacaactattattattttattgttagattgttgatagaatcgattttgattgtggcagaatcgatcttgtaaaaactgcttaaggtgcttacttataattaagaaagattcacttatgtaagttaagcatattaatcatatcattcggcctaattcattaggaatattttgctattcgttttgccatcattaacaacaaaattgacacgttttcagccaaaagtattaacaactaaacctaaaacttcaaacattaaatagtttttagtatctttagtttcaaactagtgatttgtcctaatatcaacactacgaacgaatttatatacattgaacttttttctgaatcaccgattacaaaacgaatataatttggtatcggcagttgctattaatttgatcggtttggactttggactaatcacgatcaaatcttaaatggaccgaagtgaataaatccctaatgttttcaagagagtcacacgaacgaaacaaaggtaaaatatgaacatagagcgtggggacttgaagcagaaggtctgtatggtgacataccggtgagtggagtgtatgaatgaacgagaagtgagaagacaaaatacaagaaagagcgttgacttggaagttaaagccaaaaaaaccacaaggggcaaatttgtctctttaggaaaaggacacagacagactttctatacgggccaattagaaaaataggccctacttctaattaaagcccatttacttctctccttgtcttcttattcctcttttctccccatcacgtgacgacgatgctataaacgccgtcgattatataactggtgccgttgacagacggcgacagaagaaagaaagaagaaaccacaggctctagggaacgtaacgttatgtcctgtctatagcatttataacggtcagatcaacgccgtttagataaagatctgtcaatgttaaagaagagatgcatctctacaccgttaaatttaaaacgccgtgaacctcttatctattgatttttgtttgatgaagccaaaacaaatcgtgtcagaagacttatcagagaagaagaaaacgacgacgttcccgtttctccatgtctaataagtgtagtagtggcggctactaaaaactctaaagtttgactccagtaaaactgcctttctagtgtaattccagtgattttagagtttgaatagtgtgtgaccaaatttgaaagtacaatctcagcaatattattgatcactcgttataaaagaatcgaatgtaaaaatagccaatgagagactgagacgtatgtgtttgaccataagtcgtatagtttgtatctatctacctgcaagatcagcagatggttctctgatcaattgtaccttaattatcttttattttcgtaaaatttctctattcacaaatgataaatctacttaagacagtaaccataacaagatttacaagataatttgaaaaatgaacacataaaagtattttggcgcattatttttaataataacaatatttatgtaaagtcacataaaagtatatattcgctcacaaagtcttacggtatttagaacagtagtaccacatcgattctcttcatcttcttcttcataatatgccattgttcatgtctctgtgtcctatcgcataacactcacgctatcttattattttctctcgctctttctcactgagaggacactaaaaaaatg

SEQ ID NO: 15283 - DNA, 3000 bp, Unknown; identical to SEQ ID NO: 15282
  misc_feature (1)..( 3000): cDNA_ID_2996375_gDNA_ID_2926123_Annot_ID_138625 3000 nt of promoter + ATG

SEQ ID NO: 15284 - DNA, 572 bp, Unknown
  misc_feature (1)..( 572): cDNA_ID_2105101_gDNA_ID_2926123_Annot_ID_196698 3000 nt of promoter + ATG
atgcaaagttactgtattcattacgcattgatcgtcttcttctacgcactattattgaatttttgtttctcgatgttttcagaagtcataacatataatcaagggtggttgtagctagtcgtgatgaaattcgaatagtaaaagattcatcaaatggatcaagatttgaaactagaatgaatgatcgatacttgaaagctatcacacttaaatagttaaatggacgatataattcaacaatatcttaaataacattaatcattcactttgtagaaatttcaatttgacggtgctaacaacaatatgtgacatttttgtttgcagcaaaaaagtcaaatggtaaaaaaaaacatttttttaaaaagagagtatagtaaaaaaaacagaggataaaaaacgaacaaacggttaaagctggcaaagatcccatcttccccacgctgtcaaattttgtcactacttcccaaaaaaaactctcccgcctctctctctccctctcccttcttattctcctccttcttctccttcaccatctccagatcccaaaatcttcatcgatcatcatcatcatg

SEQ ID NO: 15285 - DNA, 3000 bp, Unknown; identical to SEQ ID NO: 15281
  misc_feature (1)..( 3000): cDNA_ID_3408947_gDNA_ID_2926123_Annot_ID_196699 3000 nt of promoter + ATG

SEQ ID NO: 15286 - DNA, 681 bp, Unknown
  misc_feature (1)..( 681): cDNA_ID_3087770_gDNA_ID_2926124_Annot_ID_138627 3000 nt of promoter + ATG
aatctgttactgtcctgccttgcttactatagtagacagtttctgtggttttgtaatacttaggcatgtgttaactatgattagaggacttacagtgagttaaggtgtcttcgtgtgtgtttctctcaaaatgatatatttgttactctgtatatatatatatatgctcgtggaatcctgatgagaatttggttacagctttatcaatcctctaaatagttttcaacagtgcaaggttttgtgttcctctcttgaaaatatagtctctgaagtgttaacaagctatgtatgactgtttgcagagttcaggcagcaatgtaaatgagctggagaatataagcaatgataggactgagtcaatagttcaagaacgtgaaggttccgacaactaagcaaactgcttcttcaatttggttcgataactgtagataaattgtgataaaatatcttttatttgatcaatcattacattattgtagagaatcctcggccaagagattggtagctagatagataaggttgacttggagtcaacttcttgcttagagttttgataaactttatagctttcttcatttattatagtaaacgtttttaactcattttttttccagagaatctgtacccttggcgttcttgtactggttcatcgtagatgattctcgacgactagttgttatg

SEQ ID NO: 15287 - DNA, 413 bp, Unknown
  misc_feature (1)..( 413): cDNA_ID_3087761_gDNA_ID_2926124_Annot_ID_196711 3000 nt of promoter + ATG
ctacgaatattagtaaattcggatctgataaaatcatatatatatatatatactgtataaacttttttctgaaatatggttctcatatttaaaccaagattcccaagttaaaaatattgtcctaatatttaatccaagattcccaagttaaaaatatggttcttttgtcgaaagtaaaaaagtacatattcttctcggagaaatgaatcgatcgtataaaatatagtttctcgttgggaattaaaatttaataaattcgataatttttttttttttgaaatgttaataaataacctaaaccaataaaaccgcagttttttcctcctcgccgaaacgaagaagattctccttctctccgtcagacaaatctacgaacaagcgagcctgagcttaagaccaaactcatagagatg

SEQ ID NO: 15288 - DNA, 3000 bp, Unknown
  misc_feature (1)..( 3000): cDNA_ID_3087755_gDNA_ID_2926124_Annot_ID_196709 3000 nt of promoter + ATG
ttgtagcaagtttgttgaaggcggcgtgaactctctcttctgtgaacagtctatggttttcataggaatctaatatctccattgcaatattcttaacctgccaatatgttcacacattccgatgaccaactaagcaagaccatgccttctagtaacaacagagataacagtgcatggacttacaatgttcatgtcgacagaaagctcttcaaaccatgtctttatatctttctctttgtgtacagaagcaatgtaaatgcaagcgagtgtgatgagaaacggcggatgtattaggatgaggtccattctgtatatgtcgttgacaagacccctacagtttccacacaaaactttaagcatcaagagagcatttacttttttgcctgcaaatcaaaacctgtttagctctcttccaatttcagatttactgtgttgacttattgattacaacaacacttgatcaagaagcttaatgaaggacaaaagttttggacacttaccaagttaaatgggtcatactagtgtcattgattccagaattctgcaagaacctgtaagtaatgcaagaaggataattaaaacgaaacacatagtatagtcgcaaaaaacatttcgacatcgacatatgagatcctaagcaaacaacttactcaggcagggatcggtatgggtggaatacaacaagatagaagttcaatgcttccaaaaccttcatctccatttcccgaatatctttaatctcatatctaaacttttcatgaaactcagacaaaaaaaactcaacaaagtttgggaagcagaaaacaaaaaagaatttacaaagttttttcatgtagaagacaagaagtttggcatgcaccactctctcttctgccttgcaagccaaatacaagcatgtaggagcaacaagccgaggctcatattccgtcaaactctttctgccaaaacacagtacccataaatcaaatgaccaagcctcgtgctacacaacgattaccgaagaagccataccttgtgtaaacaagacgcatatacgttactgcagttgcaacaactctgaatcatttttattcaaaaaaaaaaaaaaaaactctgaatcatagaagtgctaaatcagtgagccttgttcaaattgccaatgcctaatcttaatatgtttagatatatccgaaatcgaacaacaacaagaccatgaatatgaattaatatcacatacatcaaaactaaaactaagaaaaactaacaaaaaaatggagactggttattgttccatttattagacctcagcttaagaaagtcaaagagcttaaactaagatttaaaacaattataagagataattgatggacacgtgagagtgaaaaggcaatcaaaagtcttctccacactttttttttttttttgattttgtaacagcttttaatttcttgtttacagatgagatttaccaacctcaattaggttccatgtcttcgtgtttggtgaggttagattggttttacaactaaatgggagagaacaaatttggtgttggctactccaatgatcaatgtagtgaaggtgttcgatgaaatgactaatagagactttggggaaattacttcacctgaagtgtgttcatttcatagaagagctagtgaggaaagaatctttgttgacttgatactgaattctagaagcgattatgttaccaagcgttgttgccaaggatgctactgatgatttgagtgagtaaagatcttcctgcaggctgcagctttactaaagctgttgaagaaaagatacacagtgacgtggtggtcttgtctcttaatggctttctcttccggctgaaacggtatcctctgatttccttttgatttgtatgtaatcatctgtatataatatatatagcttattaaccgatcaatatgttgctattttgccctgcttgctaactgctgtagtagacagttcatgtggtgttgtaataccctcttatgataattttgttaagagtatttataagctcgtggaatcctgatcaaggattgtttatgttcagttcaagtttgattttgcaaacaccaggtttcaactatgttttctgattacaaccccactaaactgtattcaagtttcgtgtgcatatatataatataagcctctcttgaaaatttagcctctgaagttaacaagctacacatgtaatttttgcagagttgaagcagcagtgcgaatgagctggaggatccaataggcaatgataggattgagtcatcagttcaagttacatttttgcaaacaggtttcaactatgtccttcaatacaatccgctaataattttcaacagtgcatggttttgtgctcttgaaaatttagcctctgaagttagcaagttttattgactgggggatcgaataggcaatgatagcaagaaaaattgttaccagaaataatcctcttttctttctaagctcacgatgcagattagcaatcacgacaacgagttggcctgaaccaaagaacatagctgattttagaggtgatgtttcttgagattaacaggttatgggaagaagatgcctgggagtgaataaaaggagtgtgtccgcggaaaagaggtgagatattatggtacatacatcaagtaattattttttgaatttcattagtgatgtaaaaaagagagatatgaaacccagtggtcacaaattacttttgttccttatcatgaaaatggatatgttgatgcagaattgcagatggtgttggcctgacagttgtagacaagttgaaataatttaatagtatctaacctataaaatcacttttatttaatcaaaatgaattactatatatcttttctttaatcaaaaccctcagccaatagactcgtagctacataaggttgacttggggtaagcttttagctgattcttgatctatttttccgagaatctgtaccattgacattcttgtactggttcatcgtaggtgattgtcgacaagtagttgtt

SEQ ID NO: 15289 - DNA, 681 bp, Unknown; identical to SEQ ID NO: 15286
  misc_feature (1)..( 681): cDNA_ID_3087770_gDNA_ID_2926124_Annot_ID_196705 3000 nt of promoter + ATG

SEQ ID NO: 15290 - DNA, 3000 bp, Unknown
  misc_feature (1)..( 3000): cDNA_ID_2996383_gDNA_ID_2926128_Annot_ID_138650 3000 nt of promoter + ATG
agaaaagacaagcaacaaacatacgccaaatagttttgtatctcctctttggtcatcttcaaagcaatttagttcagtcaacttggagaacctagcttcagggggtaatttgatcaagaaatttgatgcggctgttgatgagaccgattgtgctctgaatgctacacatggactatcaaataacaggtctttggcatcagatatggcagtgaataattccaaggtaaacggtttcattccaagaggtaggcaacctggaaggcctgctgatcagccacttgttgatataacaaatcgcagagatacagcttatgcatacaataaacaagacagtacccaaaagaaaaggctgggaaagacagtctccgtttctcctttcaaaaggccaaggatttcatcctttaaaactccttcaaagaaacatgctctgcaagcttcaagtggtaatatatatgattaatttttttaagaattttttatgttaatctaattggttggttctcaggtttatagttttggtgtcctgtctattatcaggtttgtctgttgtatcgtgtgatacacttacttccaaaaaggtgctttctacaaggtatccagaaaagtctccaagagtatatatcaaggacttttttggaatgcatccaacagctacgaccagggtaaattctttttgtccctttcaactgttcctgcgttacatagcttttttcttcattcactcaaacacacttacgaggtggtttttagatggattatgtgccagaccatgtcagaagaatcaaatcaagtaatgcagataaatatgtattctgtgatgagtcttcttcaaacaaggttggagctgaaacttttcttcaaatgttggctgagtctggtgcttccttacaacatgcatccagaaagtactttctctgtcccttgaaatgttaaccgtgttatttgtttattatatcagaaaaagtgtgtgaccgttcttttgaagcttgcatgtgattgtcactctattagatagacagtgagtattgatgtctatatctattaacttatccatcactacgtatgcactaggtgggtcactaatcactataggtggatagtctggaaacttgcatgctacgacatatactacccagccaaatgcagaggaaactttctgacaatcaccaatgttcttgaggaactaaaatacaggtttcccagtctcacaacacaactcgttacttaaactcatgcaaagtctaacatggttaatctttcttaatagatatgagagagaggtcaatcatggtcattgctctgcaatcaagaggattctgagtggtgatgctccagcttcttcaatgatggtgctctgcatatcagctattaatccaaagaccgataatgattctcaggaagcacattgttctgatagttgcagcaatgtgaaagtagaactcactgatgggtggtatgaaattgctactgctattctgttacctgttttcttgactcatttccatatgattttttttaaaaaaatcacaggtactcgatgaatgctgctctggatgtcgtactaacaaagcagctgaatgctggcaaattgtttgtcgggcagaagcttcgagtaagttattttcatgcaagatatactttgttttgcaacacagattttggttagatcactgacttgcagcatgcttacgttcttatctcttatctgaagatcctcggggcaggactttctggctgggctaccccaacatcaccacttgaggtttcctagactttgcattttataagattttctgatatcttctcaggttggtttgttcataagagtttcattcaaccaaactttcaggcagtgatttcaagtacaatctgtttgttgttgaatattaatgggacatacagagctcactgggcggaccgactaggcttctgtaagtagctttatgctgtgggcctcactacatcatctgagttcttattgctttcatattgttatctttccattgatcgtttataatctcttccttcctcaaggtaaagaaattggtgtccctctggctttaaattgtatcaagtgcaatgggggtccagtgcctaaaacgctagctggcatcaaacgaatataccccatcctatacaaggaaaggtcaatataaatgtgtgcctgttaatgcattttggtcttctttatacttctcgcaaagcattatattttcttgatgtatacaggttaggtgaaaagaagtcaatagttcgatcagagagaatagaaagtagaattatacagctgcataatcagaggcaagtttccttataactgtagagagcaatttttagtaacattgatgtgatcaatttagcacatgcatctctttctaagaagtgtcagattaactcatcaaagctagagacattttgttacatacaacaatttggtggcgtcaccaagttgcagccttgaaccatttgctcttttcattttaaatcctaacatgttatagagcatataattataattatcatgcgcaaatcggcatgtatcaatttagttatatttatcatgtgcaattgtgcatgtatcagtttacatacattatattatcatgcagattatgggaatcttagcggttcaaacgtcttaaagtactgcataactacatatagtttgactatacataactacttatttatggctatgatcgtaaattttagtataaatgcaatattcactgttagaatacgatattcaaattcgttttcagaattcagagaacaaaaagtagataaagtgaccttggtttatgttgttttggtcaaatttatcgtttataagtttgctagctaatgttatactatttgctaacatataattaaatgttgagtgctaatctcgaattttttattagaaaagacaatctttgtatttattagaaaagcttctggccttctgattatggatggttttcccaacaaaagagccaaagattgcagttcgtcatg

SEQ ID NO: 15291 - DNA, 3000 bp, Unknown; identical to SEQ ID NO: 7467
  misc_feature (1)..( 3000): cDNA_ID_1817868_gDNA_ID_2926128_Annot_ID_138651 3000 nt of promoter + ATG

SEQ ID NO: 15292 - DNA, 3000 bp, Unknown; identical to SEQ ID NO: 7468
  misc_feature (1)..( 3000): cDNA_ID_1817865_gDNA_ID_2926128_Annot_ID_138652 3000 nt of promoter + ATG

SEQ ID NO: 15293 - DNA, 3000 bp, Unknown; identical to SEQ ID NO: 7469
  misc_feature (1)..( 3000): cDNA_ID_1817861_gDNA_ID_2926128_Annot_ID_138654 3000 nt of promoter + ATG

SEQ ID NO: 15294 - DNA, 3000 bp, Unknown; identical to SEQ ID NO: 7470
  misc_feature (1)..( 3000): cDNA_ID_1817857_gDNA_ID_2926128_Annot_ID_138655 3000 nt of promoter + ATG

SEQ ID NO: 15295 - DNA, 3000 bp, Unknown; identical to SEQ ID NO: 7471
  misc_feature (1)..( 3000): cDNA_ID_1817855_gDNA_ID_2926128_Annot_ID_138656 3000 nt of promoter + ATG

SEQ ID NO: 15296 - DNA, 3000 bp, Unknown; identical to SEQ ID NO: 7472
  misc_feature (1)..( 3000): cDNA_ID_1817848_gDNA_ID_2926128_Annot_ID_138658 3000 nt of promoter + ATG

SEQ ID NO: 15297 - DNA, 3000 bp, Unknown; identical to SEQ ID NO: 7475
  misc_feature (1)..( 3000): cDNA_ID_1841836_gDNA_ID_2926128_Annot_ID_138659 3000 nt of promoter + ATG

SEQ ID NO: 15298 - DNA, 3000 bp, Unknown; identical to SEQ ID NO: 7479
  misc_feature (1)..( 3000): cDNA_ID_1817832_gDNA_ID_2926128_Annot_ID_138663 3000 nt of promoter + ATG

SEQ ID NO: 15299 - DNA, 3000 bp, Unknown; identical to SEQ ID NO: 7480
  misc_feature (1)..( 3000): cDNA_ID_1817821_gDNA_ID_2926128_Annot_ID_138666 3000 nt of promoter + ATG

SEQ ID NO: 15300 - DNA, 3000 bp, Unknown; identical to SEQ ID NO: 7473
  misc_feature (1)..( 3000): cDNA_ID_1817809_gDNA_ID_2926128_Annot_ID_138669 3000 nt of promoter + ATG

SEQ ID NO: 15301 - DNA, 3000 bp, Unknown; identical to SEQ ID NO: 7482
  misc_feature (1)..( 3000): cDNA_ID_1817799_gDNA_ID_2926128_Annot_ID_138672 3000 nt of promoter + ATG

SEQ ID NO: 15302 - DNA, 3000 bp, Unknown; identical to SEQ ID NO: 9186
  misc_feature (1)..( 3000): cDNA_ID_1818549_gDNA_ID_2926128_Annot_ID_138673 3000 nt of promoter + ATG

SEQ ID NO: 15303 - DNA, 3000 bp, Unknown
  misc_feature (1)..( 3000): cDNA_ID_1818556_gDNA_ID_2926128_Annot_ID_138675 3000 nt of promoter + ATG
tgttttgcttttgttttctttagagagaaacaagaacacgtttaagagcatgatgtcttgataataaaacttgggtgattctcttacaagatacaaacacacatacttattatagttttacttgaaacacttacacacacaagcatgctcttaaacgcataattaactctgatttcttgcaagctactctactacatattgggactctaacaacaagcatgctcataaacacaatttatgtttctttttatttcctcacctactttgcagtttcaagatgcagaatctcttaatttttttattatagacataataacttctgtgaaagattgtaactaaatgtatatgttttattttggttgcatttggtacttgagaaagaggaactagtgtcaccagaataactcaaactgcacgtaattatcataaacaataaatatacaatttacaaacatcatttcagaatccattttgtttaatgaggttgaacctatcaccatataagctatttagaactcttgttgaatatgtttgtgaatccattctattgtgtgtttctttgttttgtaataactctggtcatgagttttgagtagagagacattaaaaaaagaagcacatttacaaaatcctaaaagttcattacaaccatcgaccaaaaggtttgttagacaacttatcttaatcttgttatagctaattctcacacgagaatccaaaagactaaaaatccataaacgtagatagaaagataaaccctaagatagataacaaaagagggcattacatccttagattaaccctatacaatccctaagatagcttcttcttcttcttcttcttagttggtttgagcaagcaccgaagtcacatccttcaaaacatccatctccgccaacaacaactcacatttcttagcgtccacaaccttcatcttctcttgaatcttcttcttagtctccagagacaccttgctccacttcttcttcacagaatactcatccaaaccgagattcgcgataaccggaacaagaaaagactcctcaaaccactccgaatctgctccaagaatcacttgctcatcttctataaccaaaggtttctccaccttcttctccttgctattagccttacccttaacaagaatagattcatctttcttcacaggagattcaacgttcataccatcagatccccaaatcaaaacagccaaacccaaacatttcttatcatgattcgattcaccacttttgttcttccggttaacaaaatacttattctttaatcttctaatcttgtcaaagaactggacatgactaacatcaaagcttatagatttcttggcgatatcaaaaaacgcattcttatgatcccaaggacttgtacctgtctcagctttgaaatcaatcactgcctgtagaagagagatctcatcttcttcactccatactctctgaggattcgcctttttgttatcgtcctctttcttaactcttttgacatgcatgtcccttgaggtgcttccttcaccagctcgcttcttccctgacttcaccgccggtgattcagcagcaccttctttcttcttccgcctggttaagacgaatgactgcttctctgagtcatcagaagaatctgtcttagaattcacagcggcggaaggagattttagggttttagaggaaggaactgtgacaggatctttgggtttgctttcttcagaagaagacttaaagatctcttcagaagaactctcaacttcgcttgaagaagcggttgctggactttccaaaggagccattggattttcttctttcagattctcgggtatgagtaccaagtgggaactgaagggacaattttagggtttgtgagttgcgagactttttatttttttacactgtaacatctcttatatttaagaaacaattaaagtaaataaagctcaacaacaaaaactaattaagcccaacaaaataaataaaccatcatccttatatgtaacactgtaacatgggaaaaaaaaacaattttttgcccaaatgtataagaaatttgtataacaaaattcatactagattttcttgttgtaattcttggtatacaaaatgaaaggtttctttgttgtaaaacaaaaatatatgtactaaaagtaattttacaaagtcgctttatatttttacatttagaaagatcatttgatcaagtgggaaacctttattgaaattaacaaagtggaaaagattgtaagtagtgaaatttagtgtcatctatagacaaaaaaaatgtaaattagaatttaggaatatgaattcggttaggattagtcgattaggtttattgagtaaactcaataaaaattactgtagtaatacttcagtactcggttcggtttatagttaccgaactgaaaccaaacgattattctaatttaattgaagttaccaatttttatcttaagtttaattaaaattattgaaaaatatgaactctctcttacagtaaaccgacctgaaattggtttttggttccaatttgacaccaatattttatcttgaaccaaatcgaaatttatgctattaaaattgaaccgagccgaactttactttcggtctacttcggttcaagaaatttcaatccaatacatatgaattctgaaagtcctgaaccgaaccagagtgtttaaccacaataaaagtctcttcaatggtctcttcttgagtatatcaatggtctctcatagtttcaacaacaccaataaactgtcatcttcaagttggagtttattacactcgttccttcaagaaactgtaccgtcgactttcagatttagccatttaggacttctcaagattttgaaaatggcgcatcaacatttcttcaagcctcttcttcctggcttccacgcctccttggtactctctttctcgctctttcccttcttctatctctgtctatgtctctctgagaagctaaagatgagtctggttttgtatttgc

SEQ ID NO: 15304 - DNA, 3000 bp, Unknown; identical to SEQ ID NO: 9200
  misc_feature (1)..( 3000): cDNA_ID_1818559_gDNA_ID_2926128_Annot_ID_138676 3000 nt of promoter + ATG

SEQ ID NO: 15305 - DNA, 3000 bp, Unknown; identical to SEQ ID NO: 9187
  misc_feature (1)..( 3000): cDNA_ID_1818567_gDNA_ID_2926128_Annot_ID_138678 3000 nt of promoter + ATG

SEQ ID NO: 15306 - DNA, 3000 bp, Unknown
  misc_feature (1)..( 3000): cDNA_ID_1818571_gDNA_ID_2926128_Annot_ID_138679 3000 nt of promoter + ATG
atccaagtcatcgatctgcagtgggatcttggatgctattgctcgccactgagcacgtgacttattcacaatcacctatatatgttattatacttcagggtcagattcaaacaaatgagataattaaatcattgcgagtgttaactcagtgtggcattatgaaagctagagcattagcttctgcaatatgaagatgaatagtgagaaacagataaactaacctgactcgaaaacagtgaattgggtaccaaaaccggaaatttttctgcattcaacaaagatgttgtcgtaagtcccatttcaataacttgaccttctacggatccagcctgcaaagtggggacaaggaagacactatatcttgagaaaaatatgagtgagaactgccaatatatttgcttgctctatgaaactaaataaaagaagagagcagaaaagaaaaaaaggttcaactaactttgatagtatcacccatagagaaaggccgcgagaattgcattgacagaccactcagcacattaccaaggatatctctggcagcaaatgcggtggctacccctgaaaacgcaaatcaaaattggtatgttatgagcaaatactatagaatcagtaggatatctaaaaatgttagcaacccctgaaaaagataagactatatgcttgtgatggcctctagaggcctttattttctgttgaatcctagcaattagcattataggctgagcaaaacgactaatatgaaatggagaacattagacagacctccaactccaccaactgtcaagatagattgaacagctacaccacatgcttcagcagaagccatcaaaccgatagcgaaaagaccaacagatgatactttgtctaaagtcaataccttctccctatcaagcccaccaaaactcttagccgacaacattcgggtaatcacattggtcttccaccgatataggaaccacacaagtgagagaataaccgctcccttcacagtcggggaaaagtattgagctgctatagttgttggcgccaccattgcagcactgcagcatatcacattcatcaagtctatctattttctacaacatacatgtcaaaggaataaagctagagagactcacatttgtgcaaaagcaatgaaggtcaccaagtaacgagcaggatcctctaaagctccccaaaagcttttctcataaggaacatcttcgttagagaagccaacgggaagcagtttagcggaactttgcatagcataagtgtgaaaccttctaagaatcctaggcatcacaacccaagcaaataaagtaccagtcatagtgagactaacaggaactataacatctttaagataagggttagagtcaaggaactgctgaacatgagggatcatctcatcagagacatctttagtcttctttgcagtctcagtaacagcatcgacactagtctgcaacacatctttagctttctcaacccaatcattcccattcccattcccatcaccagagccagtaacaccagaggctacaatacttccgaaatcatcagatttggagctgaaagctcgtgcgtacgaagaatggcctaagtaattgaaaggcttagcatcattatgcaggcgtatgttcgatgaaaaggagatcatcgaaggagaagcttttggtccatcaagaaggtttccgcaagtaaaggccctggcatgagagtttaggagaccagaacacgattttgcagtggcatgaggttttattgatctttgaattgacttgagaagcgataacctaactccggccattgatctacaaatcaaaatcaaaaatcaggatttagaagtcttaatcacattcttaaccaattgaagaagaacacagtgttcactaattaagagcttgctagagtttcgataatggcggaccagatcaaaaattgaagtcaatggaatgtgaagagatcatagaacttgtatattacctggagagacttgaaggtagctagattcttagccaaaattctcgctgagagataaagaaagaattctaaattttgcttggcaaagagggaaagaagatgaagaagaagaagagacaggtttatttcgtcaactctgcttcttattcggtaacatcgacgtcgttttagtcaccttcaacttctgggccttttgggcctaatgattcaaatttgttgggcttaatgcaagtttgattaatttggtgcaaaaccttattaagaaacacacacacacaaagttgtgaatttgtgaatttacttaactacgtacatatatataatcattaattaatcacggtgtttgtcaaatatatatggttacaaattcaatatgttttggacaaaataatatgtgcctaaatctgcttataaatgacaaaatatatacaaccactaaaaatagaagagatatttatcatgaattgtactccaataaaaaaggtattgactttagacaaagtatcatcctaagatggagtattttgcaaatacttggctacaataaaaaaaactgatagatttgtgtgaaaaacgctattttcagttattaattactgtaatcattaatgttgaaatgtcgttttccatcttatggttttattcttgtggagaattaatgttccaaaaacagctttgactctaataaattgggaaatataaaaaggagatttctttctaaatccaaaattttttttaactaaataagattattttagacatcatcaaaatatatcttgtcttaaatttgagttaagttgtcttaattaaatttctcggagtagtgtaataattttcatatgtaaattaacaattgacagcatcgagacaaaccttgcctttttggcattagataatacagattataattgtaattaaaaaaaaataaacttggtttcatttcttaataaaaagccttcaatctcaccaacaccaccactgtcacaactcacaaagcaaaaaaaaaactagtcttcttctatgtcaatcagagcc

SEQ ID NO: 15307 - DNA, 3000 bp, Unknown; identical to SEQ ID NO: 9188
  misc_feature (1)..( 3000): cDNA_ID_1808340_gDNA_ID_2926128_Annot_ID_138680 3000 nt of promoter + ATG

SEQ ID NO: 15308 - DNA, 3000 bp, Unknown
  misc_feature (1)..( 3000): cDNA_ID_1818575_gDNA_ID_2926128_Annot_ID_138681 3000 nt of promoter + ATG
gtttgggagattgtaatgacactgctcaaaggtaattatccatttggttcttcactccactttcgactattgtctgcttccttcgttagtttcggtgtttttttctagggttttactcgtatttttgataatcgggtaatttaatttcgcccgaatccaaatgccgggcgacccggttataatttttcaattatcttattttcgattatcgtctaggtttaatagctccgtgagtagtaatcaaagtctagtctccgtagagaagcttaatctcaatgcggcggaggaggataagtacgctatatcgccggaagttgaagacccaatggatcagagcgatgactatgacaagaaatccgaagctcttgagcctaattcgccggtcaaaacttccggtgatgatgaaaaagtggttgtaacaattccgacggcgcctaaacgtggacggccacgtggttcgggaaagaaagtttccgctccggcattgaagaatccgtacgagttttactattactctggtttcgggccacggtgggggagaaaaagaggcggctccgacgacgagaagatggttataaacgatagtaaaaagagtagaagtagcgctagtagcagtagtgacgaagacggtcataaaacggcggcgtttggaggtgggagtgtgagtttcgacgagtttgattttgtggatgaggattatgacgtaatggaacaagatcaaggaagtgatcatgggaggaagaaaaagaatgagaagatgataatgatgaagaagacgatgaagaaaggaaggaagcccgtaaaggaaaggtctttgaaatccctcatgtgaaatattttatggcttttaagggtatttccgtctttttctacttgttgttattgtctggttttgttggtacgggggtttggtctgtttgtttagtttgggaacatttgtaggaagattttctacatctctgttgtatttgttagatgactgttttagttgttctttaaattgtttttttcatagactctgatgttgtctacacagatttaaagagtcttgaacaattttcaaatcaccatcggttaaacctaattgtatacatgtttcgaatcctatcctaaattgttaagttaaaagtaaatatgagggtcttttaagagtttaacaaaagatatagctttacatagaacaatttaaaatatagaaggttttaggagcgtctcaattttcaaatttaaatttatatcgattaattgaacatgtacattatatgattacaatctatcaaatgtataaaaatattacaaaagataataccttttaattttatttcagagatacaaataaaatgatataagagtacactgttttgcggagtatcataatctgaattaattttaataattcaaaatatcttttaatatatatatttatcattatataaaaaatctcaaaaaatattttctgatttaatattactaatacatgataacaagtaacaacatgcatcatattagaaaaataatatactcgcaaaaactttaaacctaaatttttttgtcctaaagaaacacttttatccctcaattttgtttatatgatgatgttggagcttgtggatctcctaatctctcagagatttgctctgattttgtgcgaagtttgttttttatatgatgatgatgttggttgtcggattaattcctccacaaaaacacttaacattcccaatttctcttttcttcatctttattttctccgattaatttttctgtaattttggggattttgtgaggttcattttgtgtttgaattgatttgatctattttaattttgaatatgtatggcaaatctatttttttttttaatttcaatctgaaaccagagaagaaattatcttaagtagagtacgagttataggtttccataagattgtgatttattcgttttcaccaaccactaaaagaaagagacaaaaaacacgttgcattagttttgttggcgtctttagcattttcaatgtagtctatattatacattggttcagcttgaaaatttgcaaccttgataattaatattgggattccctataattactggttcgcatatctcactcgacaactcgtatttaacataattatagcaacaaatcaccacaaaatatactgaatttagaagattttccataaaattcaataacatctatacattttttttgccgatcaatgcaggtttacaaacttcagttaattatgttagttaacatttttaagttttaacaattttctatattaagatctttatgaaaaggaaaaagaaaaaatgaaaataaaaatatgtataactcaatcattataatatagagaatagagaaattaatgtcattgttagtctcattatgttagcttccaaataaattaagaaaaaaatccttaattctaaaataaaataaataattagaattaaaaaaaaaatcaaatataagaagaagttttctaaaaaattaacaaaaagttagtaataaacaaccgagagcgagttttcattcattaactcgctcttggttgcttattcaagatttatttgaatggatggtacgaatgtaacatgtgcagtaaatattagatttaatgtcttagtgagcattttgcaataaaaatctgtggatttcatgtttattacaaacagtttcttataaaacatttccttcattattcattaagaaaattaattaagagcacaaacatttccttgttcgtttgccctagacaaggcaataaatcatatcctagagaagcgtaatcgatcattcgattttctttacctaagcgtacaattgaatgttttcttatattatttcttccgttcctttgtcttattattccttaagtctatgttcttacttacgttcactctttttttcttggttactcggacagattccaagtttcttattctacaagataaatgaatcttggttaaaatcaaacgtggaggttgtgaagaa

SEQ ID NO: 15309 - DNA, 3000 bp, Unknown
  misc_feature (1)..( 3000): cDNA_ID_1818579_gDNA_ID_2926128_Annot_ID_138682 3000 nt of promoter + ATG
actgtagataattcagaagacatttttcaaacacagctcactcacgacctctagtagtctactatcgaccactcaagcgagattgttacaagaaattgttgagattctaaaatcatgctcttgtcccgatttgttttaactaaaatcataatctatagatagtcagtagtgcaaagcaacacaaatgcaagatggtgaaaaggattactgacataatagtaaacaggtgttccaacaagatgtgacttcctcgaagaactacagcaacctcccattttcaccagctatagtaataattaagcaagagtagcgaacaacagtccttgaagcattttacagatgcactgccactgcaggaaaagagtgaactgaacaacgattacttgaatgcaacaagattaatcaaaagtactcttaagaaaccccaataaaaaaaaagtgattattacagtgttagtaagcaaaatgacaaaagaaaagttggtctgatggcaaagtcatccataagaaacacaaaggtatgggaagagtgaatagtgagaagaacattacgaaacaagattaatcaaagcagacttgagaaatcccaataacaagtgattattacagtgttaataagcaaaatgacaaaagaaaaagttgatctgatgccaaagttatccataagaaacacaaaggtatgggaatgttccttatgctctgttgtaatgtcccatcaatagctgaaacttgaatctatattctaaaacaacctctaggattcagtcaagttgcaatgaaaacagtgacgcgagcaaaagcatttcacacttgagccaattttaatcaaacacaacacaataaccttcaaaattggtaacatcattgatatgtaactctaccataagatcttctcataagaatagacgacaacatgaacacagtaagcacatctaaatcagaaactaaacaacactaaacagtacgcgaaccctaaaattgaagaagccgaaaagaccaaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccgatgcccagtcgtcggagacatagctacaccgtcggatctcctgcaaccacatcttccaattacagtaacactactttcaccgatcgttccttcccgacaacccctgcccgtacatccaccgacacaaccacctccatcgctcgtcgcatctccggtatcttcatcaactgcttcactcctcccgattccgtttcctccaactacatcgacaattcaaagtcctcttccggtatagtttgatcagtaattcttagattttagacttttagtggaaacagttgatgatg

SEQ ID NO: 15310 - DNA, 3000 bp, Unknown
  misc_feature (1)..( 3000): cDNA_ID_1818583_gDNA_ID_2926128_Annot_ID_138683 3000 nt of promoter + ATG
gctctgtgtgtcgaaaccctccgtcgccagcatttattcttctcacttttcttcaccggagaatcacgacaacatcaaattctccggcgacatctcaggttatcttcgtttactgctctcatcggttaattattccatctctttttttgtttcccggagtcggctttcgtgtactttttgtttttggtcttttcggcttcttcaattttagggttcgcgtactgtttagtgttgtttagtttctgatttagatgtgcttactgtgttcatgttgtcgtctattcttatgagaagatcttatggtagagttacatatcaatgatgttaccaattttgaaggttattgtgttgtgtttgattaaaattggctcaagtgtgaaatgcttttgctcgcgtcactgttttcattgcaacttgactgaatcctagaggttgttttagaatatagattcaagtttcagctattgatgggacattacaacagagcataaggaacattcccatacctttgtgtttcttatggataactttggcatcagatcaactttttcttttgtcattttgcttattaacactgtaataatcacttgttattgggatttctcaagtctgctttgattaatcttgtttcgtaatgttcttctcactattcactcttcccatacctttgtgtttcttatggatgactttgccatcagaccaacttttcttttgtcattttgcttactaacactgtaataatcactttttttttattggggtttcttaagagtacttttgattaatcttgttgcattcaagtaatcgttgttcagttcactcttttcctgcagtggcagtgcatctgtaaaatgcttcaaggactgttgttcgctactcttgcttaattattactatagctggtgaaaatgggaggttgctgtagttcttcgaggaagtcacatcttgttggaacacctgtttactattatgtcagtaatccttttcaccatcttgcatttgtgttgctttgcactactgactatctatagattatgattttagttaaaacaaatcgggacaagagcatgattttagaatctcaacaatttcttgtaacaatctcgcttgagtggtcgatagtagactactagaggtcgtgagtgagctgtgtttgaaaaatgtcttctgaattatctacagttatttgattgtgacactctacaaagtttctatttattaaaagtttgttacgcagtgtccagaatcttttgaagagcttgtcccttcaggaacccgtgctggtgtgggatcagcattcaccacaggcctcttggttgatataggtttggagacatctatacctgacaccttttgtgctcctgctcctcttccatatgatttgcttttggggcgaccacaatgcacagattctgagtccatcaaaggaaggatgagtggaagcagttttgaaacgctagcgacgtgtgaagatcttggggaatcagactgtaaaactctagccagctcagtcattctttcaccgaggaaatcagatttctcgaaacatcaaggattgaagatattggttgatgaagaggaggactgttgtcctatttgctttgaaggtaagaaatcaagaccgttgaataaaaagaactctttaactcttgtttttatgagagagctaaacagagtcgtggattgcactatgcagattatgatgttgagaatccaagactaacgacaaagtgtgagcacgaatttcacctctcttgtcttctggagtggattgaaagaagcgatagatgcccaatatgtgataaggtgtgtttcccgcttgagctttctttggcagatcgattgtcttgatgatcaaagaattgcactttactgttgggaattcgtagttagatcaaccattgatggttgcgtaattagggtaaataagtgcacaatttggcaactaactaacattctgtcttctttaacacaggaagttgtgtttgatgatcgcttgaactagcatcattactatcccctggcttgaaagtttgaaggtgtggcgctttgtttggttagtctactacataattagcatacatctattttgtttcttcctcacacactttaagtgttgggtctccacatttccacttagttttgtcgtattggttatgttcgttttgcccttgtgcgatcatatagatatacataacaattgtaaatattacctagcttcttgttcgttcgtttgtgatctccggggtgtgatagagaagaaaggaccaccatttcagtattttgattgtttgcatcttcaaaatcatgtccactcttgtcttgatccatgattctatcttagcaatattggttaatgccctgatctgggaatcataataagcatgattttgtttgtttgtttggttaaagaaagagagagattctattagatatggatatagtataattccatagtctaaagagaaactgaatattccaaatagtaaattgatccacatgcgactagtcttgtcgtgtgtaagatattaaaaagaaaatgattctttgattaacaccttttgtctgctgcataaagtaattaattagaaataattaagaaaaaggttaggaatcatttaagaagaagagaaaaaagatgtcatggctttgacttctagccacttatgtctgccactgccacctccctcttctcaattcctattctgcccttctctttcttttagttcctatcctgccggtgttgatgaatgagggttaatatagtaactttggcgttaggaactatagttccaaaacctttttctgaatgaatttactttttggaggtatgaagtcacagcttttacagattttatcttgcaaaaattctctccacatttcaaacgtctaatagttaaagagagcttttgttttttctttcccatgtctatcagtatcaccaccgagaaaatatcatcaacaccaccaaccaaacattaacccacccgagagtaccca

SEQ ID NO: 15311 - DNA, 3000 bp, Unknown; identical to SEQ ID NO: 9197
  misc_feature (1)..( 3000): cDNA_ID_1818587_gDNA_ID_2926128_Annot_ID_138684 3000 nt of promoter + ATG

SEQ ID NO: 15312 - DNA, 3000 bp, Unknown; identical to SEQ ID NO: 9190
  misc_feature (1)..( 3000): cDNA_ID_1818591_gDNA_ID_2926128_Annot_ID_138685 3000 nt of promoter + ATG

SEQ ID NO: 15313 - DNA, 3000 bp, Unknown
  misc_feature (1)..( 3000): cDNA_ID_1818595_gDNA_ID_2926128_Annot_ID_138686 3000 nt of promoter + ATG
aggtactcacctattggaccttgagattgaaagtcgtctgcacgtgcacaccaaccataagcctttgactctgaatctccactcctctcagtccactcttttttgcaggacccttgggtctcaaattccttttcaagctctgtggcagcagcaaacccactccagtcactgtcaaacttagcaataaccccaacaatcgaatcttgttcgacccaaaaggcattcacttcaacaggcttgaatttggaaagggtctgcagccaatatactgaatcaagtagaagctccttgtcatccgtttctttcaaagggttaacaacaatccccatccatggccagacatagacgttatgaggatttggttcagtctcgtctaacagaggaggaacaaccggagggcgtggaagaggttctgcataaccagcaagatcattctctaaaaacttagctaaagcaagatgattagacttctgtaaagcacttctggtggcagaacctttggaaacaccagtagcatgtgcatgcaactccttgtacttgtaatcttgcttcttcttgcctacacaaaaggggcatctgagccgtccattcaccttcaccttgtagtaagtctcactgcgtaaaaggtggtagggtgttttagaatactcctcaatctctgactcgctgatctcagactcttcatcagaaatgtccatcgtacctgctttacctggagaaaaagaatgttacaaaaacagagaagaagaacaaaataaggcccaaaagagactcaatttctaggcaatcccacgagcaagagaaaccctaggcaacaacttaacaaacaaaacaaaattgacactggataaagcaaaagagacgaaagtgatacagcatttacaaaattgagctaagagagtgacgcatgcatgataaggaacctagcgaaatcaaaaatatatttttaagtaacaagtgagtaaaggcgttaaatcacgaaatgcataggggaatcgaaaaaattcattaaacgagagatttcactgtgaaaacagagaatagaagaaatctggagcttacgctagagagggaaggaaaaggaacaacacggcgatgactcaacgcttgatgaagagtggagtagagagagagtgagtgaggaagatgaagagttattttattttggaaaatatatcagaaaaattagagggtgatttgcaagaataacacatttttatacaagaattaagaatatagcactattaattaacaaagtaatttaaaaatagataaaagagaaattttcacaaatagcataattttaagtttttttgacaaaacctattttatactatagttttttgacaaaattttaagtttttttttggacaaaattgatgaataaaacctatgatccaaattgtgaatgatttatactataagcaatatagtggccacaaaattggtcaagaatttttagtggctttatcaaatagccactgactggagatttttttttaaaaaatatgtgtctggtcaaagtatgtaattatatatctatgtgtaaaattgtatcataaaacattaaggtttccaggattatttttcttctcaaaatttaatatagtgactttgttttactctaagagcttatagtcaccaaagttgttatatatattaatatatgtctcattttttttttttataaaaagaatcaattatgagaaagccacttttgaaagtgacatttgttgattttgcaattttccatatagtttgtgaatttgccatttttagttaataatagataccagttaatacgtggatatagtcggttagatttgtttttaaaatttagtatttggtttaaagtacatattttgcaaaaacattttatatatacatacagttttaagtgttcaaaatgacaaatcctcaagattttagtaaaaactaatgacattgttgtacaattttagtgcttaattttagtattttagttattttatgggctgcactttagcaataaatgtctctttgttttcacttttcagcagttggaactttgaacaaatggaaacaaaaaaatgtagaagacaattttatttttaagcccatcaaaaatacaaatgagattgtaagcccaatatattaaccaacctacctttttcttttgtcagctctctctatttctctaaaggtgacgtcatcttcggcggtaacggctcagatattttccacaataacttccaataatacccctgccattaaccaatagtacccatgtttcctctttgcaacgtgggggtagattcatgaaatgagaacagaacggaggttccaacgagtagaagatgatgtgccacgtgtcactatatcgacccccctttcctcttccttccttccccaatagagagggattttcccgcttcagcgtctctcagtctctctctcggctttatccaaaggttccttcgtttactccgcttctatggaagaagcttgaatccttctctcttcttcttctccttcttcccttgacatttttgttctgagaagcaacatggccctcggtggcttgatttcaaatcggaacttcggttccttcatcggctcaggtatatctatccccctcctctttttgaatctgttagggctttttagttgtttatcggattatgttagtgattaggcttgagcgtagcttgcttctgtgtagcgaacgatatcactaatgtgtgcattgcttccaaatttgctaagattgctttactttgtaggcaatggttgtcagagacttggaaaaagtggtgcagaggtttccaagctttttccaaatggtatatatcggtatcttttatacctctctacctagctatattatgcaatttgtgcttaagcattttcttaatctttgtagcattgttgtgccgtaatcatcaacctctgcaagctagtttacatcatgaatcgggacacatgagaagaagttttggatgtttccttcaaccaagaatg

SEQ ID NO: 15314 - DNA, 3000 bp, Unknown; identical to SEQ ID NO: 9191
  misc_feature (1)..( 3000): cDNA_ID_1818599_gDNA_ID_2926128_Annot_ID_138687 3000 nt of promoter + ATG

SEQ ID NO: 15315 - DNA, 3000 bp, Unknown; identical to SEQ ID NO: 9190
  misc_feature (1)..( 3000): cDNA_ID_1818591_gDNA_ID_2926128_Annot_ID_196768 3000 nt of promoter + ATG

SEQ ID NO: 15316 - DNA, 3000 bp, Unknown; identical to SEQ ID NO: 9197
  misc_feature (1)..( 3000): cDNA_ID_3087810_gDNA_ID_2926128_Annot_ID_196766 3000 nt of promoter + ATG

SEQ ID NO: 15317 - DNA, 3000 bp, Unknown; identical to SEQ ID NO: 9189
  misc_feature (1)..( 3000): cDNA_ID_3087818_gDNA_ID_2926128_Annot_ID_196763 3000 nt of promoter + ATG

SEQ ID NO: 15318 - DNA, 3000 bp, Unknown; identical to SEQ ID NO: 9188
  misc_feature (1)..( 3000): cDNA_ID_1808340_gDNA_ID_2926128_Annot_ID_196760 3000 nt of promoter + ATG

SEQ ID NO: 15319 - DNA, 3000 bp, Unknown; identical to SEQ ID NO: 9200
  misc_feature (1)..( 3000): cDNA_ID_1818559_gDNA_ID_2926128_Annot_ID_196753 3000 nt of promoter + ATG

SEQ ID NO: 15320 - DNA, 3000 bp, Unknown; identical to SEQ ID NO: 9199
  misc_feature (1)..( 3000): cDNA_ID_2038555_gDNA_ID_2926128_Annot_ID_196752 3000 nt of promoter + ATG

SEQ ID NO: 15321 - DNA, 3000 bp, Unknown; identical to SEQ ID NO: 9186
  misc_feature (1)..( 3000): cDNA_ID_3087836_gDNA_ID_2926128_Annot_ID_196749 3000 nt of promoter + ATG

SEQ ID NO: 15322 - DNA, 3000 bp, Unknown; identical to SEQ ID NO: 7473
  misc_feature (1)..( 3000): cDNA_ID_2044354_gDNA_ID_2926128_Annot_ID_196742 3000 nt of promoter + ATG

SEQ ID NO: 15323 - DNA, 3000 bp, Unknown; identical to SEQ ID NO: 9194
  misc_feature (1)..( 3000): cDNA_ID_2038467_gDNA_ID_2926128_Annot_ID_196777 3000 nt of promoter + ATG

SEQ ID NO: 15324 - DNA, 3000 bp, Unknown; identical to SEQ ID NO: 9192
  misc_feature (1)..( 3000): cDNA_ID_2996391_gDNA_ID_2926128_Annot_ID_196775 3000 nt of promoter + ATG

SEQ ID NO: 15325 - DNA, 3000 bp, Unknown; identical to SEQ ID NO: 9191
  misc_feature (1)..( 3000): cDNA_ID_2038493_gDNA_ID_2926128_Annot_ID_196770 3000 nt of promoter + ATG

SEQ ID NO: 15326 - DNA, 3000 bp, Unknown; identical to SEQ ID NO: 7475
  misc_feature (1)..( 3000): cDNA_ID_3087872_gDNA_ID_2926128_Annot_ID_196728 3000 nt of promoter + ATG

SEQ ID NO: 15327 - DNA, 3000 bp, Unknown; identical to SEQ ID NO: 9192
  misc_feature (1)..( 3000): cDNA_ID_2996391_gDNA_ID_2926128_Annot_ID_138692 3000 nt of promoter + ATG

SEQ ID NO: 15328 - DNA, 3000 bp, Unknown; identical to SEQ ID NO: 9194
  misc_feature (1)..( 3000): cDNA_ID_1818610_gDNA_ID_2926128_Annot_ID_138693 3000 nt of promoter + ATG

SEQ ID NO: 15329 - DNA, 3000 bp, Unknown; identical to SEQ ID NO: 8085
  misc_feature (1)..( 3000): cDNA_ID_1809065_gDNA_ID_2926129_Annot_ID_138698 3000 nt of promoter + ATG

SEQ ID NO: 15330 - DNA, 3000 bp, Unknown
  misc_feature (1)..( 3000): cDNA_ID_2996407_gDNA_ID_2926129_Annot_ID_138700 3000 nt of promoter + ATG
gactgggtctcacagaaatcatgcgggctaagctaggatcgtaaagaaatcagctgggtcagctcgcccaaagctcaagctcagctggaaggagtgacggttactcaggttaagtgacagtccagctcgggcagctggacgagtgacggttgagcttgaggtagctggacgagtgacggttgagctcgaggtagctggacgagtgacagactagatgggcggttatgggcgaagagatacaactcttcggaaaggtgcaactcttcggaagggcgcaactcttcggaaaggtgcaaggaacggatgtgttgattcgggaagcatccattcgccccctatataaggaagggcgcccaggaccattccactcaccacaacacaccgaaaacacaagaaactcaccattaaaactctctccctcttgggagaataaatagtcttaggattcggtagtcgggctgtggccggcaataaagaaggagggtcggatcgacctaacctcgagaaggaaggtaagggatcctagactttgagtctaagggttctaggatgtgagttagtagtcggatccttgaaaggatcaactagagggctgggtagtatccgggtcatgtgcatcctacacaagactcggtccgggtagggatcggctgaggcggggacgcggctcggcggaggaccggcgggtcttaactgatctgccgagaatcggccggactgatgtgcgatcttcccctctctgaattctctccacggatccgagtagtgtatggcatatagagcattgcatggacttgcatatgattaagtaaatgagattacttatggctctatgactttcaggaacgaatggtgatcgtgggaaggacttggcttaggcgcgagagactcaagaccgggatgatgggtggtgatagttcggatagtctagggatcgattatatgacttgtaatagcttatatgcaaactcataggttgtatcgaatcctttgcttaatcaataaagtatccgattgtttgtttactctattcgtctcatatattgaatcacggaatcatatggaacggattagactaggaaagaacctcataaacggttagggccgagtcacttagtggcttgggtcgagagaactcgtccggaatttaggcagtccggatcggggcctttcaaaaaccaaggtcctgctgctcccgatgctgaaatgaaacaaatggtacaacagctgctacagggacaagcatctagctctacagaaattgctaagaagttacctgaattgcaccataagctggactgcagctttaatgacctgaatgccaaagtggaggcattgaataccaaagtcagatacttggaaggacaatcagcatctacctctgcacctaaagttacaggacttcctgggaagtcaatacagaatccaaaggagtacgcaactgctcacgcaatcactatctgctaggatcgagagctgccaactcgacttgttctgatttaatcactgggacagtgatgttcaagagggggacgcttctactcagattgaagtctctgttgttgaattcaaccattatgctggttctcgccatctcattcaatccacctcggaagagaaggccgccataatcgagaaaatggtaaaacgattcaaacctactccattaccctcccgtgctcttccatggaaattcaggaaagcatagatggagagatacaagtctgttgcagcgaaacagctagacgagattgaagcagtgatgccactaatagaagttctcaacctgattcatgatcctcacaaaaatgtgagaaatctgatattggaaaggatcaagatgtatcacgattcaaatgatgatagtgacgctactccatctcgagctgctgataaaaggattgttcaagaaaagtttggagatcctggatcttttactctaccatgttccattggggaattagcttttagtgattgcctgtgcgatctcggagcctctgtcagcttaatgccactctctatggcaagaaggttggaatttattcagtacaggccttgtgacctgactttgatccttgcggatagagcttcaagaaaaccctttggcatgctgaaagatctaccagtcatgattaatggagtggaagtgcctatagacttcgtggtgctggacatggaagtagagcataaggatcccctaatcctgggaagacccttcttagcctcagtgggagcagtgatagatgtcagggaagggaaaataagtctcaaccttggaaagcacatcatgttgcagttcgacatcaacaaaactccacaagagtcaaaagaagatgaaaaaacctctggagatgatagagtgatcccaggagaaaaatatgagactgagaaagtaaaagagcttaaaaagaggtctgataagcaagaagaaactatagagaggctagctcactctgttgaggaacttagaagtaagctgaatcagttgcagaaggaagctcaacctaaaggcgagattgacactatcctgagaaagaagttcacttcaagatggtttgaagagatagattaccctccagaagagaaagaagcatattttgaagagaggggaatcgagtattctgctgcagacctctccagggaggacgctgaatatgatgatgatacaagagaggactatgcagaccctctctatcattcattttcttcttgataagtgtgaggattcaagctagggactttaaacaagctcacttgggaggaagtcccatgactatcactgtaaataaatttttattttcttgtaatttttgatatgttttagttgtgtttgtggttctcaggaatggaggaataacgtgaaggtagagtaaaaattcaaaacttttactttagagatggcctagagatcgagtatatagggtagcggagtgcaaaacttttaaaactttttgttgcacctcgagaccttgcactcgagacattagtcgagtatgagtg

SEQ ID NO: 15331 - DNA, 3000 bp, Unknown
  misc_feature (1)..( 3000): cDNA_ID_1809975_gDNA_ID_2926129_Annot_ID_138707 3000 nt of promoter + ATG
cccttttaaaatcccttgtaaatatttttaaacccttttaaaatcccttgtaaatctttcagaacacttttaaaccctttaaaaatctttaaaaaatctttaaaaaacctttctaaatcttttaaaatcctttaaaatctcttgtaaatcttttaaaatccttttaaaacaattttaaaccctttaaaaatcttttaaaaacctttgcaaatcttttaaaacccttaaaaatcccttgtaaatcttttaaaacctttttaaaatcccttgtaaatctttttaaaacgttttcaaatgccttgtaaatcttttaaaagccttttaaaatcctttgtaaattttttaaaacccttttaaaatctcttgtaaatcttttaaaaccttttaaaatcccttgtaaatcttttaaaaccttttaaaattccttgtaaatcttttaaaacccttttaaaatcccttgtacaacttgtaattcattaacgaccgtggaagttgtactcaagaacagtgatcattttgtctttcattgacaaccacattgacccggctggttggttcccatgggatggcgagtttgcgctctccacattgtattatggagagtatgcgaatactggtcctggagcggatacgagcaagagagtgaattgcaagggatttaaagttattaaagactcaaaagaggccgaacaattcactgtggcgaagcttattcaaggaggattatggttgaaacccataggagttactttccaagagtggctttgattttaatgtctacttgttcttgtactttgtgttgtgtcacctctgttttagtttaatgtattttctgttttgttttgtatgacttacccaataaataacatgctctgtttcgcaagtattaggttaatgcatataatattttgaataactttaacactaactaattgaatattttcaatatataatcatactcgcactcatcagtcataacaccatcaatttaatttttttttatggggttattatatgtactagatgactaaaactttgagaatattttcatgaataatatgaattttgtttaagttgattacattatttatcaggaacagtagttaccaaaaataatagtttcatattaaattttacacgttggtcatataggggatccttgcttattgcattctgcatggcatgtcagcacagtgtatcagcatgtgatataattttactataagtagagcattcatcggtcgtaaattttcggaatattcagtgtatttattttctatttttttccgttttctattatttctgtatttctcaatacaataaaaattcaaactaaccaaaaattcagaaaagatcactatattatatataaaatcaattgccgcccaaaaagaaatctgttttacaatgaatataactgaacaattatacatatatctagcaaatctatcttttggcatttctaaattaataatctccattgaagagctgcaactttgtgcttgctaaaactttttcacctgcaacaaaatgagtattatgggagatttaaaaatcaacataggcatacaaaaatattccagaaagaagagagagacaataaggacaacaaattttgagtcatatcatatttgttgtgatgggctccatcccattgataaataccttaatcaaccgattgtcagctgaattcctcatgctaatacctaactatacaatattataattgccatatactggaaaactagcagattgcacaacaatatagaaaagacacaagcataagaaagaagcctacgcgacaattactacaacatctccatattgaatggtcttctgatatacaataccattccatgcgcgcagactgagactttgtaagtatgtgaagcatctcacgagagttctcagtcaaatgcaactcaacaaagaaatcataagaaagcattaaatattgaaagcattgagaagcaaattagttcatgaaccacatcacatcagcatcctggagaccaaaaaaggaagacaatgaatcactcaatagaagaactgataagtttttgctttcactgccaagagtgtaagaaacataccgcaaaaacagactactaaacccttttcaagaacaatccgaaggaaattgattcttctccacatcatttagcatccaaagcaatgaccaccatctttagttgcagctctacgcagcacatctaaagctttcttgttcttttaccaattctaaaaatctcaaagaagagatcgattccagatacaatagctgcataagattcattcaaagttgtcaaaattacagtaccatttttttacggaggaatgacaagttatgagagtgcttttattatatcttttcgggtaaacattgtaacgtagtgaaagttgagagtgaattgcctaacaaccgatagaatcaaccaaaaagaaaaaaagaacatcttttctaacgaccaaaaaaaaaacctaggggttttctatttattaggtgtatattgtcttttctagtactaaaacaataatggctaagtctcatcctcacacgtaagagattaaggttgagaatatattgtattgttgttagcataacctaaaatggatgaaaccaatttctaccaaattcatttttttttagccatttagagtacagtggaaaacaagtatttcaactaaagtactctaagacaattcttcttctatcttttatgagctgaaaattttggaccacttttcttttctgttctttgtggataataaaaccaaacttcactgaattatagcttcaattcacattgcactgaatttttagattgatctcaaaataaagtttttttcctaaatattgtcatttattgaatacaattaattaaatgtaaattgattaagttgctttgctttgtatataagaccaccatcgctccctcctctttcatcagttaagataatataaattcagtaattaagagagaagaaataaacacaaaa

SEQ ID NO: 15332 - DNA, 3000 bp, Unknown
  misc_feature (1)..( 3000): cDNA_ID_1809983_gDNA_ID_2926129_Annot_ID_138709 3000 nt of promoter + ATG
gctttatgagaagaagagaagaatagagaagaagcttcaagcgtaaaagaagagcaaggaacaaagtcaacaaaagagatgttgggctttgtgttttgttaaaatgggctgcagatgaattaggcccaagtatgtttagttaattagtgttgtgttatagaatcaaagatgttatgtagagtgaattaaggagttgggagttccaacatagtagagtagctgatgtaagtcttaagacaatgatgtggtctagggtctaagcaagtggagtaaagccactatatgtatgtgtgtcttgtgtaagattatccaagtttattatcaatgtagacatgcaagtgtttaaacgtgttcttgtattttctgttttaacaagaacaaaaacagagatcgtgagaaaagcagagaacttgtggtgaaaattagaacaaatgcacaatcatcataagttataaaagactaaacaactgcacgcagataaagcaaagaagccgtgtaatctttgtttccaattataaacgtcatgtttctcctctctataatgttagaaacataagaatctcctccagatctttctcctgatttctccattcccttctcaagaccctatcgaaagcacaaacatgcccaacaataagtaaaaaaaaacacacacagaatcaattagtatctgcaattcacgcaacaaatttgtatgcatcttgattcaatatattatcatatttataaaaaaaaataatataaaactcgtaaatttttaaaaatatcaagtttttgtgttatttattttcgtttataaatttaataaaatagaaatttacattttgataagttttatattatttggttacaaaatatttagaaaactttccatattttcttattttggttttttccattttacaaaaataaaattaaaaaaatagaaaatatgaataatttcataaatgttaattaatgagatgacttataatgattggttgtataaaatcctatgtagacgtactaaaaaaaaatagttttgacttttttataatatagattagttgtttttgatttatttaatttctcctagatccattaaaagagatgcccttagatcttagtcaaatagtaacatcatgtatttcaaatctaaggaaggaaatttatcttatgggttgtcatattgctgttaaatcaaaatcaaatatttttcttacctaaataaatggtcaaattatcaaaaaaagaaaacaatgaattgtttgacaaattgctaataaattaaatcatttattatggtacataatctgtaagtatttatttttgaaaaacttttcagcatatataaatctcacgtaaattccaaaacacacaaaacaagaaaaatggttgcttacgtcgataaaaacttttcattggcttgttttttggttttacttctttttgttgactcatcgtatgcaaggtttaatacgttggttacaaaagatcagatccacaccatatgcaccaaacaagatatcaattcttcatattgttttcaagttctaaacgcaaatcctgaaattgctagattagattttcctagtctcttcaaatttgtgcttaattatcaggctcaaaatatttcagataagctgaagcaatttaaattatcaggaggctacacgccgggtgttgaatctaaatataacttatgtatagaattttatgaaaattctttcgaccggcgtgatgaagccctcagatatttggctgccaaagactatggcagcgtaaacactatggtcggtggaacggcgataaatatgttcaactgtgctgatgatttgtcaacaatgaagccagtaccacaattttttgtgacggaaagtaatttgattaaagaattgtctaagattctcttagtgattctagaatgtttcataagtaagaaaaaagaatattgtaatagagatctataataataataatattagtatgattgttgccattatccttttttaatatataaaaaataagaaaaatagaaaacatttctccactccctctgcctaagaatctctcgtttaaagctacattcttttttttttttgtcatccaagctaaattcttctctaaatcgttttaatcaacttgttgactcgtgagttgactcgtgggctgtttctctaattgctaatagaatttttatacgatgatggaagaaactagaggaaactgacaacagataagaatccatttcttctacgcagattggtggttgtttggtagaatttgttctctatgttatgctaaggttataaattctcatattgtttttgcttaggatttgggattaatagttgaaataaatgattgatcgcatcacttttggatttaggaccgaggccttacattctattgtattcatacagaggtatgatatcagaaatggatttttgtttcatttgtgtgatggaccttaacatgatggaccttaaaattgctacatataacaaaaacacaattttatttatatgatgatttatatatccatcattctgtgaacggattagattttctttgccttgtagatcaattgtgtgtccagtatagtatagacaagttcaaacttgcttagctttgcttaaccaatcattaattcgtattttaatttcaatctcacttatcaaaatcactgatacttaacttagctcatggacagtctctacggccaacaagacgtaaatactaaaaagacccatatctagagctctctaatagacacaatcaaaaatcatttacgtaatcaaacataatctcaatttttcttatgttgtcaacctctaatgacccatatttttcctcctctctgccctcacctccttcctaaccctataaaactttctctttgttcctttgtctcttccattttcccaagaaacaaatggatcgttatcttttcttatcaaatcttcaatcaaacccacttagagatcaattgcttacaccaaattctcaaattaagaaccg

SEQ ID NO: 15333 - DNA, 3000 bp, Unknown
  misc_feature (1)..( 3000): cDNA_ID_1809987_gDNA_ID_2926129_Annot_ID_138710 3000 nt of promoter + ATG
atgaaattataatttaggcttgtattgttcatttacttacatgtgttataattttaccttttatgtaataaaacttgatttttattacttagttaaactgaaaccatctcttccaaaatgaacacaatttatgatcattcttacaaaatttatgtaagaatttatgatcattcttataattgacatgtggtacactacgggtttataattgtattcaatagtttttttattttgtttttagcatgttttataaatatatgttaatatattttttaatttaaatatattatacattttggaaggatactttataactaaaaaatgaaaattttaagttgtattagttttgttaatattgtttatttttagtactttaaaattgtataactgtaatttgattgttaatataaataatcaagttatattttgaatttatcatattattttttatatctatttacttttgatattatattagtattttctgtaaatttaatttcacaatcaataaatgtaagatcaatatgattattattggttctcaacaaaatatctttaagaatccaaacatgaattttttcacatctaagacatctgtgaaaatagtcggatagatgatatcttttttactgtgtctattgcttttagtaagacagaagccatatttctgaatcttttgattagccaggtcacgatcatatatgttctcctcttctgccaaaatccaaacaacacaaactttagacgtggcagaaatcagcatttatttctaacaataattggaaaaactaaaaaaatagaaaaatatttcgagttttagctagagaatgaaacaaataatcaaaacgaaaactaaaagaaataaggtgtctgtaaacgctaaaatatttcatacctttgtgttgggtgatggtaaatggcgtggtggtgcatagtatttatagggacaactaataggttactaacccgcatctattaaatagaaaatattccctgaagcaagatatttggaagaaaatctatgaattcgatagattttgaggaatatactattgttatgcgtttttaattttttatgcggcattattatgtttctttaaatggtttttgtgtagattatgtagaggataaaatatgaaatccgaattggtgagttattacttgattttagtaaaaaacggaattgatttttatggagaagaaacattagttagtttcttaaaatctgttttgtagggatatattgcaatgtatgaatttcaaaaatggatatgatttgtttggaagaaatcgtggagttaatatggagagattttaggaaataattttgatagagacgattaagatggcaagacgttaaggaaatcataaattgtgattagcaaaagaattaattacgtttattaaagattgactaagattgcctattgttgttggaattaattaagaaaaatataggagaatatatgtgataccaaaaacatattaaaacaaatgaatgttaaatctggcagattttgaatcaaatcatattttatcctctacatagtcccaatcgtaatttctttgaaaacagaatgattctgaatggtttagaataggaatatgcttgagtatcataagtgcaaaataataatcaaaatgccgtatttagattttgatttgattctgaatcaaactgtcgagatatggtaaatgtatttacccttatttttacgcttgtacatgtaaaacagaaagatttgggtggtttataagatggaatattgcgggatttagattatatcttgactggcaagcaaatagtaaaagattttgtagttaaggtgatatacgtaaatcaggatacataattgctatgaatgaggagtggagagaatatatgattcgatcggataaattttttggaaggcaataatcaataacaatttgaataatattatagttggcgaaatttaatttgcgaggtgatatattggaattttgaattgatgatgatttgtagaatgtgtaaaaatatattgactataccatatgtaagattatatgataaatagagggttcttttaaggtttatggaattaatgcatgattaataatcgtttaacttatagaaatgtgatatcgaaatacgaatatttggtaagagtgtagtaaatatttagagattttggaatgaagtaagtaaagatatggttagttatttggttgttcggatttttaagaaatattatttcgtgtaatattgaattagtagagatttaagggattaatgtgtgcaatttatgagggtagtgcaaaataatatttttgtttaggtaattaattagtgcaaaacgtgaatagttcatcaaaaatttggtcattgtcctaacgcagacaatcttgtctgattgattttatagggactaaacatacaatatcgaaattgaaaaagaatttttcgacacaaatctttcccaaaattgtatatgtagataatttataaatttgttatcactatcttctaagaaatctgtcaaccaaaaaagtatgatataaaaaatctgtcgtatttaaaaaattctactgaataagaataaatctggtataactaaatgatagacttttgtaaaatcgctagaaatttttttaaagaatattttgtatttattttatttttaacacatgaaaaaaatattttaaacaaaaaaaacaatttaattccaatattttagaaaatattctaataattaatctcattacttaagttaacccctaaatatgttacgttttaaaactatctaagcacgttctaatacacatcatacatcatacagaaacacatatattcctccgtgctgtaacacgggtctgatcttagtaaaatagtggagagaagaatattcttctggataccttttaatattccccaaaacttctgaatcttcttctcaatttttctcgacattttctcatcgaaagctctcttcctttccctttttggcgctcaatacaatc

SEQ ID NO: 15334 - DNA, 3000 bp, Unknown; identical to SEQ ID NO: 15333
  misc_feature (1)..( 3000): cDNA_ID_1022613_gDNA_ID_2926129_Annot_ID_196835 3000 nt of promoter + ATG

SEQ ID NO: 15335 - DNA, 3000 bp, Unknown
  misc_feature (1)..( 3000): cDNA_ID_3088000_gDNA_ID_2926129_Annot_ID_196830 3000 nt of promoter + ATG
atcccttgtaaatctttcagaacacttttaaaccctttaaaaatctttaaaaaatctttaaaaaacctttctaaatcttttaaaatcctttaaaatctcttgtaaatcttttaaaatccttttaaaacaattttaaaccctttaaaaatcttttaaaaacctttgcaaatcttttaaaacccttaaaaatcccttgtaaatcttttaaaacctttttaaaatcccttgtaaatctttttaaaacgttttcaaatgccttgtaaatcttttaaaagccttttaaaatcctttgtaaattttttaaaacccttttaaaatctcttgtaaatcttttaaaaccttttaaaatcccttgtaaatcttttaaaaccttttaaaattccttgtaaatcttttaaaacccttttaaaatcccttgtacaacttgtaattcattaacgaccgtggaagttgtactcaagaacagtgatcattttgtctttcattgacaaccacattgacccggctggttggttcccatgggatggcgagtttgcgctctccacattgtattatggagagtatgcgaatactggtcctggagcggatacgagcaagagagtgaattgcaagggatttaaagttattaaagactcaaaagaggccgaacaattcactgtggcgaagcttattcaaggaggattatggttgaaacccataggagttactttccaagagtggctttgattttaatgtctacttgttcttgtactttgtgttgtgtcacctctgttttagtttaatgtattttctgttttgttttgtatgacttacccaataaataacatgctctgtttcgcaagtattaggttaatgcatataatattttgaataactttaacactaactaattgaatattttcaatatataatcatactcgcactcatcagtcataacaccatcaatttaatttttttttatggggttattatatgtactagatgactaaaactttgagaatattttcatgaataatatgaattttgtttaagttgattacattatttatcaggaacagtagttaccaaaaataatagtttcatattaaattttacacgttggtcatataggggatccttgcttattgcattctgcatggcatgtcagcacagtgtatcagcatgtgatataattttactataagtagagcattcatcggtcgtaaattttcggaatattcagtgtatttattttctatttttttccgttttctattatttctgtatttctcaatacaataaaaattcaaactaaccaaaaattcagaaaagatcactatattatatataaaatcaattgccgcccaaaaagaaatctgttttacaatgaatataactgaacaattatacatatatctagcaaatctatcttttggcatttctaaattaataatctccattgaagagctgcaactttgtgcttgctaaaactttttcacctgcaacaaaatgagtattatgggagatttaaaaatcaacataggcatacaaaaatattccagaaagaagagagagacaataaggacaacaaattttgagtcatatcatatttgttgtgatgggctccatcccattgataaataccttaatcaaccgattgtcagctgaattcctcatgctaatacctaactatacaatattataattgccatatactggaaaactagcagattgcacaacaatatagaaaagacacaagcataagaaagaagcctacgcgacaattactacaacatctccatattgaatggtcttctgatatacaataccattccatgcgcgcagactgagactttgtaagtatgtgaagcatctcacgagagttctcagtcaaatgcaactcaacaaagaaatcataagaaagcattaaatattgaaagcattgagaagcaaattagttcatgaaccacatcacatcagcatcctggagaccaaaaaaggaagacaatgaatcactcaatagaagaactgataagtttttgctttcactgccaagagtgtaagaaacataccgcaaaaacagactactaaacccttttcaagaacaatccgaaggaaattgattcttctccacatcatttagcatccaaagcaatgaccaccatctttagttgcagctctacgcagcacatctaaagctttcttgttcttttaccaattctaaaaatctcaaagaagagatcgattccagatacaatagctgcataagattcattcaaagttgtcaaaattacagtaccatttttttacggaggaatgacaagttatgagagtgcttttattatatcttttcgggtaaacattgtaacgtagtgaaagttgagagtgaattgcctaacaaccgatagaatcaaccaaaaagaaaaaaagaacatcttttctaacgaccaaaaaaaaaacctaggggttttctatttattaggtgtatattgtcttttctagtactaaaacaataatggctaagtctcatcctcacacgtaagagattaaggttgagaatatattgtattgttgttagcataacctaaaatggatgaaaccaatttctaccaaattcatttttttttagccatttagagtacagtggaaaacaagtatttcaactaaagtactctaagacaattcttcttctatcttttatgagctgaaaattttggaccacttttcttttctgttctttgtggataataaaaccaaacttcactgaattatagcttcaattcacattgcactgaatttttagattgatctcaaaataaagtttttttcctaaatattgtcatttattgaatacaattaattaaatgtaaattgattaagttgctttgctttgtatataagaccaccatcgctccctcctctttcatcagttaagataatataaattcagtaattaagagagaagaaataaacacaaaaatgttggttaaagttttctcttttttcatccttatgataaca

SEQ ID NO: 15336 - DNA, 3000 bp, Unknown
  misc_feature (1)..( 3000): cDNA_ID_2139877_gDNA_ID_2926129_Annot_ID_196829 3000 nt of promoter + ATG
cagtgaaacaatttgatgggagagaaaaaagaagaacaaaaaatcaaataattatattttagcactaatttctcatgccggtaaaccttaaagtaatcaaagtaatcaatcttggtatataaatgtttgtgccatacataatcaaagttatcaatcttgtaccccaatttatggttgtaaaaactcttataacatgctaaaatcttatcatacagaactaaaagctcctaacattaggagattgaagcaaatgaataattgaagagagaatcagaaaatgtaaagtgtggaaagacgagagagattctacgagcaccacatattcgtattattattctaccatcgtttcaagacatgaaagaaagcaaaaaaacaaaagagaaaaaaacaaaaaaaatcagacaatatattggaggaccctagaaaacaatataccaccaaaacaacgactcttgaaataaggtttatataaaataagttactaactcaaactcaggagatcatgatatttatataaaataaagttttgaaagttacttaagatacggttttgaaaattactcactaacaagatcataatatgtgacaagtctaacaataagatgtttatatgtgtcattaaagacttaatatttttattctcttaaaaaaatagaaaacctaaaaaactaaacaaatttacatatactaatttttatgtctatatacatatatataattatttttattaatcaaaaagaaaattaacgaatttgattttacatgtgttattggtcaattaaataaatctaacatctactctattatttgagacgtacgttaagtgattctcggttaaaaaaatttttacctttaaatcatatgtttaaaatgttaatgtcatgaaaaagtttaccttttactaagaatcacttaagttacgttataatcttggccattcgattgaattgtttgtgaccgtccgatctctcgccttcacttaaaaaacacgtggatccttatgacccgggtttacaattattgggtcatacgttataatcttggccattcgattgaattaattgtagccattaatgttttttgaataaattctatagcaagatttttggagagagaatttttatttatttccaattaatatattcccttattcaatactattcataattacgtgggtttaaaattggaaaactaattatactcatatatcaacaatatttattatattctaagagatcattaatccaatcaatatttataaaacatttcataatcaaagctgctttatttatagatataacattataaatatcgaattaatatgtttgaattcgaaattgggttaaatattctaaatttatttaaataactggaaaaataattttaactaaacttttttttatgtttgataattaaaatagaaaaaatatttttaaacatttaaaaataaaattaattacatttttggtttatattaatttttgttaattaaattaatcgaattcctttttcagcaactgaatcatattaatttaaaatatccaatgcgtatattcctttcttaaatttgaatatatcacttctccataattataggtaatcaaatatttagttggatattcatttttgaattaacataaagtttccgaacaatttccataattaaataactacttataagataattgctaaacattctcctataattatgggattcatcataatcattaaacttgacttccacgatttaatattttatgcatattttaaacctaaaaatttatatcttataaatattgtacgtcccatttcaagaacttactcagcagttcctatcttcttttactctctcgtttcttttttattctagcagaagaaaacgagaccatgaagaaattaaaactgaggttgtggatcgacgagaccatggagaaaacaatatatcgaggtatcctctcacactctctgtttttctctatttttttcatgtttttctcacatctgttttttaaaatatttatgcaggtaatgtgggagattaaaatgtagacgcacacatgattttgttaaagtatgtcttgctttctaattatttatcttttatgcaaagtaatatgttaagctttttttacctctctatatatttataagatgagtaattctgattgaattttttttattgggattacggtctttttcctgttaatttgcagaaacatgatgatgatttataatttgactactatcttccaatgaacaacaaaattataaggtatgcaataattttcttaaatctgatcgatagattctctttcactaatatattgagattgtgtaaatatttttgactgtagtttagattttaatatattggtattgttaattaaattaattgaattttaatataagtttaattttgataaaatttatttttgtcttattaatttgtcaaatttgataattaatatatgtattaataaaatacactaaaccccaacacaccatgtatataagtacatatactaaatatacaattatatattcaaagggatacatcaattttgtaatacattcaatagtatccatgtttaaatatgagaatatttaatgaaaacaccaaaaattaggagaataggagaatagggcttagagagattaggagaatagggcttagagagattgattatttgatgaaatgttaatataaaatttgaatgttttatttttaaattttaagtcatttaatgtgaatttggtattatgtaaaactaatttatgagctgactatagtaaaaaaaaaaaaatgtgttcgccctaattattctctcccaagcacggaaaccaaggagccgcttcccttagaaatatgagcttctttctccgacgttcctcttctggtatcttccttgtctgatcggtgctagctgctaaggcgagatctctcaggcggacctcttttttggcggcgttgctgtttttcggtgagactttccacatgag

SEQ ID NO: 15337 - DNA, 3000 bp, Unknown
  misc_feature (1)..( 3000): cDNA_ID_3087914_gDNA_ID_2926129_Annot_ID_196824 3000 nt of promoter + ATG
tactggtcttggtaaataaagaccgatttctttcaaagattgtccttgactcttattaatagtcattgcgaaagcaacaactataggaaattgttttctacgcatgttgaatggtagtttagtatcagatggggtaatgagaatctttgaaatcaacactttatcaccaatcctacctcctgtaataataacagcctgtaaaataggcggagtcatctgtatcatctgaagccttgtgccattgcataatccaccttttgggtctaaattccttaacaacataattggggcaccaatattcaaacgtaaacaatgatttggtagacctgatatcttgatagagtttaagaaatctggagtgaacactggattgtactctgaagtagtgtcggaaagatctattgaatcaatacttaggtactgaatttcttcacctgatatgaaaaagttaaaattaaacattaaatttaacatgcaactaataatacagataatatagtattctaatacatacctggtagcttctctaacagacgctgattaatagtattaacatcctcattggtaggagacaatatagctctctcttggatgaatttgagatctttattttcgagtaaaagagttggatctccacaaatctctaaacttatagctttaataggatcttctccctctgtaattaaaaactcttctggaataccaattaacacttctccatcgtttggtttggcgaagtgatggatttcattaaccatgacttgtaagttagtgaccatttgtttaattctccttttcactaattgtcatcttttaaaaacatttggttttacaaagttctggtgtcgtgtgtttgcgcacggaaaatccacttgaaagcacaaactcagaaggagatttctacttttgtattatgactccaaaggagatgtggccaaaaagtaattcaaaatacggctagctaatggacatggtaaataacttcccattgttagacacatatatgcatggttatgctaaaatctaagttattaagttttggttcatttcagcatatgtgcccaatcatgcatttgctaaggcgaaggtcgttgcagaccccatgtccctatttgagtgataggattgcctttctcgatctgtggtttgtcaaacagttgtgtgatgaagacaagaaatttgattcaattatgaattggtttttctctgaaacctatatcaagggggtaaatggcgagtatccaataactgggaagacatgaaaaacatgggttaaagatgttgacatagtctacttggttcacaacatcaacaacaatcattgacttgggaggtagacttgttaaagcggaggatcaatgttttcgacagcattttaagttgcaacaaggataaggaggtaagtaaagcatgcaagcctttcataagaatgttttctgccttactacaagcggtagcgtcaccagagaagaaaaaagaaatcagtgttgttgcattcagtttctatagggttaaaactgcaccgcaaaacattcaagaaggtgattgtggtgtgtatgctatgaaatacattgagtatttagccataggaattaatttcgttggtctaggtgaccgtgcaatgcgtgatcagaggctaaaactggcagcagagttatttgacgaggttccagaatcagattattggatacaaatgtctgatccaaatccctgaggtgaagaaagatggggagttgagttcctatctgagactaaaaaagctgtctgaaaaatagtggtgtgtcattcctttttgttgaagttttttgccatctaatttttgtaaaacttaatattcgatagttattcggtttggtaaaaacaaaatattgatgtatccttgtttattgaggtttattaatgaagtaaaggctaaagatgaattaatagtcggtaatagagttaaatattacagcttgtgactcataattaaacatcgatgcatcaggtttttaaaatgctcccctaacacaactccttgaaacgacatgaataagtaaatgcaaagcaatcctcacatatgtctacattaagaagtagttaaaatggcaatctggtatatcaaagaaatgccaaaaccctttgaatactttccgaccacctacaccgatatctttgatctgcctttcaaccacattggcaatatctactctttcttgaagagtttcaactcttctaaagaaagctttggtgacgtaaacaccttggtcataagcaccacatcatatcagcatcatagctaaagcaaacgtcgcataaatggaagatgtacacacctctacaagcatgtcaagccgtgcttgcgttggacctaattgagtcaattggcagagagcttcgaggtaccatgctgtcaggtgtccttcagtcgcgcattataacaggaaatgacggtagatggatgtctctcttccaagccgagagttgaaaatgaattcgtctagatcaacatcggctaaaacttcaaatgtgtagacttgaatttgaagccaagggcaatctacaatgaatgggccaaggtaccgaaagccctgtcagccgacgcgacggattatgccagttactagtgcatctagaatgaagttcatattttgtttactaaattatgtccgtcgctacgtatatttatactaatttgaaatatttggttgacctaatcgacagaattgtacacatcggtgacgcataacaatatgcaatcatacaaaactagtgggccacaaattattgaccaaatatcaaactaacctcatataaaagcccacttaatgaaataggcccatttgcaaaataaaagacagttattctattataacgtaacccccgaggagggaaagtgaagggttgcgtctttattcaattatatatatattagagtctaggttaaccctaaaatcggtgagtctctcaactcttctgtttaaccctagcattttatctgcaacttttcaacttctgatg

SEQ ID NO: 15338 - DNA, 3000 bp, Unknown; identical to SEQ ID NO: 7990
  misc_feature (1)..( 3000): cDNA_ID_3047176_gDNA_ID_2926129_Annot_ID_196819 3000 nt of promoter + ATG

SEQ ID NO: 15339 - DNA, 3000 bp, Unknown; identical to SEQ ID NO: 7989
  misc_feature (1)..( 3000): cDNA_ID_3087925_gDNA_ID_2926129_Annot_ID_196817 3000 nt of promoter + ATG

SEQ ID NO: 15340 - DNA, 3000 bp, Unknown; identical to SEQ ID NO: 8086
  misc_feature (1)..( 3000): cDNA_ID_2139789_gDNA_ID_2926129_Annot_ID_196811 3000 nt of promoter + ATG

SEQ ID NO: 15341 - DNA, 3000 bp, Unknown; identical to SEQ ID NO: 8088
  misc_feature (1)..( 3000): cDNA_ID_3087961_gDNA_ID_2926129_Annot_ID_196804 3000 nt of promoter + ATG

SEQ ID NO: 15342 - DNA, 3000 bp, Unknown
  misc_feature (1)..( 3000): cDNA_ID_1809991_gDNA_ID_2926130_Annot_ID_138711 3000 nt of promoter + ATG
gtacccgaaaccgaccccaaaccaaaaaacccaataaataacggaaccaaagccaaatctgaatttttaaattatccattatcctaaaccacactatccaaaaaaattcgaaccgaacctaaaccaaacctaaactgaatctaatattcctcagtatccgaatacaaatctaaacttaaaaatattagttaagatatattttcgtaataccttaaatatccaaaattaaaattagagaatattgcatactcagacacttttcataactttagacgtgtttcgacactttaaaatcatcaggcactttgccttggcaaagttactctattaccctaaccggttgttttcaaaccaaatccgcattaaccaaagagatcccttaaccaacccactcgtcgaatttgcagttaccttaccctatttgacttttgaagactttttcagtagcgtaaaaacctaatccagtaaaaaactgcaaattactgtttgttgtagaagacgaatccggcgacatcatcctcttcagtttttccggtgactctgttcgctcagacgacgacgcagacgattttccggtgaccctgttcgctcagacgaagacgcagacgacgacgacttctaatttcgctcacaaaccctaaattctctccaacttctccgtcactgtccaccaccattgttgcacacgactttctctcttctgaagactccaccggtatttcccccaaatttctctttgttcttatatcgaattggatttatgtttcatgtaaaatttgaattgtcgaaactctaaaacagttatacttggctgtttgattattattttctagtttctatcttcggttttcgcttctcgtttttcgtatttaagttacaaactcatttgattgacaaaaccatatactctgtttatgaattttgctcactcttgttgcgattactcgtaaagccttaacctttttgggtttctttcacttactagtatttgttaggttattccacttcaccttgatcctatgattattctcccatgtttagctttttacttatagtggttgtgtctgtctgttgtttttttggattttaggttcatttacgggcctaaatactcaccagagtgttctccaagttcaggtaagctaccaccaatatgactcagtgtgttatgatcttacagttaataattagcactcgccctttttgtggacagggcactgaatcaattcacattgtgttatgattttacagtaactaatcttggtttactcactgattgtttggcattttcaactttggcagttatcttaaacatgttggatatggtctgatggtcaactatatttggataacatcaattcacattgtgttttgatttttcagtaactaatctttagttggtttgttaactttgttttgtttactctctgatattttggcatttttaggtacctttctgacttactcgcagagcgtcactagcttactccatatttgactgtgctagacgtgagccatactgttataattagagtttctttctttcatcataagattttataattagagtttctttcgtttcttgcttcagaactaaaatctttattcatttgatatgcattttagtggtgcttctaagttatatgttagcaaaaaacaataatagagtaattgtacaatcccataagtaagatatctttatgtgaattgtttcattgtttagttttcttttcgtatttcagttataaacaagagaatttcttgtttgggaaacgtaattcatttgtaacaaactcatttgattgacaaaaccatatgacctgttgatgaattttgctaactcttgttctcatttctgaagtagccttaattatttttggtttctttcacttactaggctttgttaggttcttagagttgtccttctgctggttcttcagagtgatccttttctaatccgttctattttattttagctgtagtttagtggttacacctaatcttctgctggtttgtgaactttgttttgttcactttgtggtattttgtcagtttcatttgcaacttgattttcttttgtggagatgaaaaagatacttcagattttgacttgtttaaaaaaaataatatctgcatatagttataatttccttttcctatatctattgctgccatatctaagatgagtttatctgtttgtgttacaggatttggaagacagttaaacatctaaatcgatagcattggcagataagtttattctgttacactatggaaggtactcttacactgttaatctaatctaagcaagcaatagagagacgtttgtgaactcgttttcatttggtcatattatctgttaatctaatcttaatcttctgaacttgtttcttgctaatgacagggtcaacgtctcaggaaccatcttctcagtgtgattcaaatcttcctaatagacttttcgccactgatcaatatccgaggggaaagctaaatatatactcaagaccagatattctatcctttctccggaaggtttttcaggggacaaaggaattggatttcattctgcaatcttgctttggacctctattcatttgccggttagtaagtgtgcgatgtctggtaagcttatgcatgccttgctatgtaggcagctggtaacgaagaaaaagtatgagctgtggacagtatttggtggatacccctgagatttgcattacctgaatttgcttgcgtgactggattgccctgtggggagttttctgaggattatgatccagatgatgatccggtttatgttgttggcatgaagagttactgggacgagttaattggtccagataagactgttaccttaggggatgtttcagacatgctaaccaacaaacacaagacattgtcatctgccacagacttaagctcgcgtttctacttattatagatggtgtactcatagcatcgaaccaaatcggtaggcctacatttaaatatgtagag

SEQ ID NO: 15343 - DNA, 3000 bp, Unknown
  misc_feature (1)..( 3000): cDNA_ID_1809911_gDNA_ID_2926130_Annot_ID_138714 3000 nt of promoter + ATG
ttatccaccacttttctttcttctttctcttcacatttggactgcttcctgatgcatcatccattggaagtcctgttgttatgataaactctctcagggagaatcgcataggttgatcagcaaatacaaaccacaattcgtcattgttggttagtattcttctctggagtaaatgatgaacgatatggcttgaaaatgctaagtccatttcagcgaattccactataggacccaagaatgtgtccattaatgtgttgaactctatcggctctaaagctttcctgacagtcgagacaattttgaaggatgaatgctttgatacccttgtaatattatctacttcgctgcctggttggaacagtcttttagggaagaacagtttttttgtactcatatttctcaaaacctgattaaatacattaacacagtcattaaattaacatagttttgaaatggttttaaaaaccatttttgtaaatctattatgcatttgtagttttcgaaacataaacatagtcattacaagtcgtttaaagaactttaaaaacccttgtaaaaccatttttcaaagtcattacaagtcgttttaagactttaataacccttgtaaaacacagtcattactccataatcctttttaaagaccgttttgaaacaattccaaaaacaaaattttaatccttttcaaagaacacagccgctgaaaatagaaacaaaaaacccttttccaaaccaactccaatcaactggtaacccataaattaagtgaggatctataaattaaaacacaaacccaaacatcaatctatttactgttaaagtttcaaaacgaaaaaactttgaaattgctacaacagagaagttaatcggcattcgaaatcttctttgaaggtttttggaacccaaatatcaaactttaaaacataaatctatcaaaattatataacaatttccaacactccttcaaaatctcaaatatcaatctattttacttgtttcgttttcaaccgaaaaacctagaaatgctagaacaaaaaagagattcggtaaaaatcgaacaaacccaaatgttaaacttcagtttcgtaaattaattaccttcaattgcttcctttttgctggataatcggattttcttcagattgttgaaaggaagaagacgaagacgacagtttctattcttctttttcttttgttgtcttttcacggttcccttccgtttttgtttttgggttatagtgaatttttgggctttagtgttttttgggcttttagtgtttttttactaaaacagtttgtttttctaaataacaggcgtaggcccaattagtaacagatacagtgtttaacattactgtaactttttcaacggttgatattctcttttaaaaacggttgtaaatcattttaaaaacggttgtaaatcttttcaaagtgactgaccctaattcggtaaaaatgtcagcagtcaatccctgtttaatttgtttttaggttatagtgaatttttgggctttagtgtttttgggcttttactgtttttttactaaaacaatttgtttttctaaataacaggtctaggcccaattagtaacagatacagtgtttaccattactgtaactttttcaacggttgatattctcttttaaaaacggttgtaaatcattttaaaaacggttgtaaatcttttcataatagcagctactgcagctttttcaacacatttaaaacgcttttaaaacagcttataaatcgtttaaaacccctgtttaaaagcatgtttaaagttcttttccattcaaatcaaagcacctgttaacccaaacaaccattatacagtaattttgtaaaacaggagttgaactaaataaacttcataaatcttgttccatacagatgttcataaaatattcaaatgacaaagtttataaatctatcttgtactccactactttttgattagaagtctgctacttctacaaagtaactaaccctaattcggtgaagatgtcagcagccaatccctgtttaatttgtttttagattatagtgaatttttgggctttagtgttttttgggcttttagtgtttttttattacctctttgtccatgatacatatttagagtatacaccagagagagatttcgctcccaggcacgacttccgaggaggacaaaagaagaatgttcctttcttttaaccagaactcacccacttttggcctctaaaagtagtaacttccaacggttaatagactggttcggtatgttccggcaagtttcctggttctccggtggttttcccctgctcagaagctttacacctctcgctgctggacatactcactcacgtctcccttaatgaagacccctcccaggtagccttctgctctcccccatcttgcttccaactgaaaaccctgaagaaaactttgtaaccctgttaaacctttgtaaccctggtaaacctgtttcaaaccctaaacaagtctcagcgcatttattgtttctcaaagaaatctcttccaacttaaccccacagctattactcacccacctgaagtaatagagaagagaatcccctatcaccttaaaggcaaagaagtagctagaggttactcccccccccccacctcgtaaaagaatcagagccccggatctggatacatctgagctaatcaaagagaactccctcactcttatgggaagactaactaacccctccgtccaacgcctctggtctatgtttccctttttatcaaacagatgtaatctaagaggcaaagccttaggctcagacttgggaaaaggctgtttccagttcaagttcgactatgaagaggatctactgaaagtcttggataacagaccttaccattatgaccagtggatggttattttgcagcgttgggaacctattatctctgagtcattcccttgtaagatccccttctggatagagcttcaaggacttcccaaacacttttggcaacctgaa

SEQ ID NO: 15344 - DNA, 3000 bp, Unknown
  misc_feature (1)..( 3000): cDNA_ID_1809919_gDNA_ID_2926130_Annot_ID_138717 3000 nt of promoter + ATG
gctctgaaaaccgaataggaaaccaaacattaaaacacaaaacagagagaagtgagtctcattaatcttaaacaatttcaaaaaattacctaaagtgttcagcaaggagacaagcattagtattggagtcatctccaccaattaccacaagaccatctaaatccatctttgtaacagtctcttcagcttgcttaaactacaaaatgtaccaaactgaatataactaagtccatcgataaaagcatcaatgcgcgccatacaaaacattaagaaaaacatttctacctgctctggagtttcaatcttgtctcttccactacatatcatatcaaatccaccctgcaaagagactcacaacaaaaactactaagaataaacacaaaatgcatatctttaagtaacaaagcttttagttccaactcttcatgatgaaaatttgattactccaacaatacattcttcaattgatccaaacaagcttctatctaatccggttaaagcaatccgaaccaaaccaaaactgaagtgaaagatgaaataaaccgatttggttctttttctatatctgaaatctgaagaaaccgaaaggctaagacaataaactaggcctgggagatcggtttaatcgggttaaacggttcggtttgatcggttttctggttttttcggtttctaaaaatcctgccgaattgaaccgaataaaaattcggttcggatcggttcggtactcgggtttttcggttcggttattaagatatataattcgccgagattaaaccaaatgatggtcatttccattcactttctatctatgttttcatgaacctaaacatctaaaaccgaaaccaaaccaaaccggaacaataaaccgacaaaaatctaaaagacagaacatctcatacctggtttctataagggtacacaaactcagaagtaagctcaatatatttccccttcatgattccagctggaccgccacgaaaaccaaacagactacttcctcttgcatattcttgcaagtaatctatcaaaccaacaacaaaaatacaatcacaaatcaagtttttaaagcctgaaaatgaaaaatttgcacaaaggaacaaatgtctactaaccaaagattccacaaataacattgtgtcctccaggtgcttgaccaccagacaacacaacaccaatcttaagcttttgatccgatgaaacttcattagattggttaggaaccaataaagctgatggttgtccaaataaattagggaataatttctcaatttcctctgcaacaacatccaaaaccaaaattgacccaatcaacaaaaattttaaccggttaagtgaatccggtttagtaagattgtgattgaaccatagaaatcggacctggatgtccggcggaggagcttggaggaccatcgatgatcttgaaaggggttttaaagacggaaggaagaggaagtgtgtggtcgatacgactagcttggacttcgctgtatacagaagtcacacggctattcgtcggaggattgatcgaaattccggcgatgtagtctcctccgatcaaatctaattgtgatgccatttgtgagtattaggattattttgttcctacaaaaatctgtgaatgtcagaagtgtgtgtcagaaagtgtttggataagtcttcttcaagtggataatgaacttgcaagtttccgaatattctaatatgccaaatttggtcatttattgttttatatggttattggaatttcaataactgcaattttcgttctaatttgtaaacattgaaatttaaaacctttttttatgattattattgtattgtagtattgatgttgtatcacacaattggaataaatcgtacttcacatcaacagtcaaaatcctctttctcgtagcgagtattatagcgacaaaaccgctcttaaccattaacatcggtcaagttcttttacttaacgcagcggcagcggcaaaaaaaaagaaaaatatttaagcagagagaagaatgtacagtgatgagagaaaaactgtcgtacatgatgaacgccaatgaagattaaggtgcttctattaaatttgagcgactcatccgatgctgttgcaactcatcgtctgtcatctacgaatcatctaaatctgttattttcaattttggtgtcgttttacttaaatgttacttttcataatacgtcgttttactccgtagttgccactgccgcagcgttaactaaaaaaacatgctaatcataactaaaaataactataggtttagaaacgaacactacaatttggttggatctcaagttacaagatattttggtccactatgcgaaaagcaggatagtcaaataaatctatatctttttatgttaacgatctgattaaccgtatatccaaatagtgaaaatttgaccgctttaatattttgattgatctagtgggtatctctctgattctagtataagggcaacctaatcatatttggatgatggaaatattggaaggatacaaaattggactattattttgttagagtactggaccatgcgagatctttctcgcttaacttgcgactgtacccttttcagagaccggggatcaatctccttttgatgcaaattttgaagctgacaacaatgactaaatcatgtttgttttatttatcgataacaacaatgactaaatcatgtttgtttggtagccgttggtgataataataacgagcaaatttcaaaagcaatctagcaatgaaaattgttaggcgttgcatcaatctttgtcaaaaactgagtgaatgtaaatcgagcaaaaaaatgttaaatatatattgttaataactatgaaaagggacatcgtcaatccaaaacccctttttctctctcaacttgacgactagggtttcttcttctccttgccgccgttggtgtggcctctcgcccaccggcgagaatcttcctctttctccctcctcttcctttcttctatggctttagtgatg

SEQ ID NO: 15345 - DNA, 3000 bp, Unknown
  misc_feature (1)..( 3000): cDNA_ID_1809923_gDNA_ID_2926130_Annot_ID_138718 3000 nt of promoter + ATG
agtatccatataacttttcattttggttatggatttttaattaagctgttaaactaaaaagtgaactattaaaacgaaagactaaataaaaaattgattaaagttgatctaaatacagtcagtaagtaccttatcaacttgttaagctgacagttaaaccacatgttgccattatggtccatactttctagggtttatgattgtctattacatcttccttaccattttatcattaggtctaaacttgttctttcgattaactaagaaaattataatcactttttagtctaacaactccggtccttcaacacaaaaaaaacaagaaaaagtgatgttcgtttcgcagttagtaacgacactaacacaatgtttttccttttcatagttttttttttttttttttggtcaaactagctttttataaatgattctactctccaacaatggagaaatggttcaacaagtacatcaaagaggctacaaaggccaaagaaaccactgctacaaatggcatacggaaagcacgaaagaaaaagatagaagcatacataacagttaagcaactaaagttgaagataccaatagtgctgaaacatgagatgagctttcggaaataagagagcacacatggtgatctgctgtccggagatgcaacatcctctagtggataaaacgcatcatgaaatacggctacgatagcataggcgacaaagcaccaacttcttgagcctacgagatgtgagaaaaacctcaatttcggagaggtgtggggttgcgaaaaccaccacttctcgatgaacaaatctggagtccaagacccaagatcatttcttgttaagacgtcatatgtcttttcctttatcctgcgtgaaatttcaagaaaccaaaccaaagaaacaataacatgaattgctcttaaccaaagtttttgaataacatcctcataatgaggtaagagaagcctaagcttatacagaatcaaaccaacctcatactgaggtaaaagaagctgaattcgaagtccaatcgaaaacaacacatcctcataatgaggtaagaacagcttgagcttaagcaagatcataacagcctcatactgaggtaaaaccagcctaaaactagtagaaatcatcacatcctcatggtgagggaactgaagtataaacgaaggcatgttccaaaagaaggtaaaaaattcaaagaaattactacctttcagagagacaaaaccttttgatagagtgactagaggatgagagaggtgtggaatagagaaccaaagctccaaacaagcgagaggaaatacttggtaccacgaactgcacacagcagtaatagatcgtaaagcaaaacccagatctagagggctcaaagcctgaacaagatctgatcctagatctgaagacctcaacagcaaaatcgagagaaaggagttggaagctccaacgagatagtctggtgggtctggagggtcgggaggttcagaaggagagaccaaactggtcaaatcttgcggtagagcacacggcggcggattcggagaagggaggagcaaaggtggagcaggagcccgagcaagcatcactaaagccatagaagaaaggaagaggagggagaaagaggaagattctcgccggtgggcgagaggccacaccaacggcggcaaggagaagaagaaaccctagtcgtcaagttgagagagaaaaaggggttttggattgacgatgtcccttttcatagttattaacaatatatatttaacatttttttgctcgatttacattcactcagtttttgacaaagattgatgcaacgcctaacaattttcattgctagattgcttttgaaatttgctcgttattattatcaccaacggctaccaaacaaacatgatttagtcattgttgttatcgataaataaaacaaacatgatttagtcattgttgtcagcttcaaaatttgcatcaaaaggagattgatccccggtctctgaaaagggtacagtcgcaagttaagcgagaaagatctcgcatggtccagtactctaacaaaataatagtccaattttgtatccttccaatatttccatcatccaaatatgattaggttgcccttatactagaatcagagagatacccactagatcaatcaaaatattaaagcggtcaaattttcactatttggatatacggttaatcagatcgttaacataaaaagatatagatttatttgactatcctgcttttcgcatagtggaccaaaatatcttgtaacttgagatccaaccaaattgtagtgttcgtttctaaacctatagttatttttagttatgattagcatgtttttttagttaacgctgcggcagtggcaactacggagtaaaacgacgtattatgaaaagtaacatttaagtaaaacgacaccaaaattgaaaataacagatttagatgattcgtagatgacagacgatgagttgcaacagcatcggatgagtcgctcaaatttaatagaagcaccttaatcttcattggcgttcatcatgtacgacagtttttctctcatcactgtacattcttctctctgcttaaatatttttctttttttttgccgctgccgctgcgttaagtaaaagaacttgaccgatgttaatggttaagagcggttttgtcgctataatactcgctacgagaaagaggattttgactgttgatgtgaagtacgatttattccaattgtgtgatacaacatcaatactacaatacaataataatcataaaaaaaggttttaaatttcaatgtttacaaattagaacgaaaattgcagttattgaaattccaataaccatataaaacaataaatgaccaaatttggcatattagaatattcggaaacttgcaagttcattatccacttgaagaagacttatccaaacactttctgacacacacttctgacattcacagatttttgtaggaacaaaataatcctaatactcacaa

SEQ ID NO: 15346 - DNA, 3000 bp, Unknown
  misc_feature (1)..( 3000): cDNA_ID_1809927_gDNA_ID_2926130_Annot_ID_138719 3000 nt of promoter + ATG
ataacattgttgatgtgatctataaacgagcagaaaatggttataactacggtgtcattcttgttcctgaaggtctaattgattttatccctgaggtatatggttactctcaaatctataatggtcaattcgagtctagtccctatatttgtgttcttcaacgttcatctattatgatccattggcaggtccaacagcttatttccgaactgaatgaagtcttagccgaaggaaacgtcgatgaagaaggccaatggaagaagaatcttaaaaaagagactttagagatttttgagtttcttcctcaaactattcaagaacaactaatgcttgagagagatccacatggaaatgtgcaggtctgcttctatccaccactaactgattcaaacaaattaaaaggctaaaacctcaagcaaactcgaactgaaaacctgtttattttgaacctttatatgaattttctcttcaggttgctaaaatagagacagagaaaatgttgattcaaatggttgaaaccgagctagagaaaaagaagacagagggtacatatgaacgcgagttcatggggaaatcacacttctttgggtaatgaattagcctaaaacatttgttaataactaattagcgtcaacataatcatattctcattctcattgtgttttaggtatgaaggaagatgcggcttacctacaaatttcgatgcaacttactgctacgcattaggttacggtgctggatcacttctccagagcggaaagaccggattaatttcatcggtttagaatttttcttcctttcttgataatatcacaaactgtttctttatttcaagattatttatattcccctttgtgatgttttgcaggttggaaacttggctgctcctgttgaagagtggacagttggtggtactgcactgacttcgttgatggatgttgagagaagacatggtaatataagtcgatactatcgtgaagtgtttgataagattatattcttttccaacattctcttttttttatgttgcaggtaaattcaagcctgttatcaagaaagctatggttgaacttgaaggtaattagtctttagctcaaaacatatattattcttcggtttcttttcttgctaacactataaatttcaggtgcaccgtttaagaaatttgcatcacagcgagaagaatgggctttgaagaatcgatacattagtcctggttagttcacatacacatgtctctgcataaagtagtaaatgatttcgttctttagtgtttttcatgctaactcttattctttctcttgttgccaggtccaattcagtttaagggaccgggatctgatgcgagaaatcacacattaatgctcgaactcggggctcaagcctaaagaattttggtactgtgagattcactcactgactcactttctttgttgttgttcgtttttgctgtaaaatctagttactgtgagtcaagtgaaccaacaagtggtcatcaatgtgtaagtcctgtattgtggtgtcacttgaatatagatgactcatgtgttaataataaagtttcgcaatttcatacactctacatgatgtttttccggaaacttaatttttcgataatcatatacttagtccattgttgaaaatctcttcgtctataagtcgattgatcatttatttttttatttttttaacaatatgcattaagtggatatgaagtggagttgaatttgggatggtaaccttttgatcacattaaaccaggttggtagttcagattttaacgtagtcatgtaactcatgttggtggttcatacttttcatgacctcatttttctccttgttgacctctacacattttcaggagatttagtgttcaaacacattgtcatttttcatagcagaatgaaggtctggacaaataaatcgaaccgaatgtaccaaaccaaaaccgaagcaaaagaaataaaccgaaccgaatatttaaaaataaccaaatggatacaatattttataaccgaaagattagaaaccaaatcaataccgaaccgaaatatttcgggtaaccaaaaaaccgaaatataataatattttcaaaaatattagttatttttagactaattaatttaaaacaagggtgaattaaatttttatgctcagacgaatgcgaaattaggaatgtatgaatgatgatttcatatttagttctctttcctcccgacaataaattctgacatatttgctcctattgagcagagatattgttggatacgtaatgattgtgcagcatttaattctaacacaagtatgaagataattaggttagtcgataatatgttatttgatatggtatcataggttatattagaagatacttgatagaagataagaataaataagactatgcccaatagtagaagactgttggagctggattcctggaatccacctgcgaaaataccaagccagcccacaaaagcccaccaagcccaccaagtagaggacctacgcagctgacgagcccacatacgcgaatgggtatttggaccagataagcccagtcacctgatgcagggagataagcgaataatgacctaggaactgaagaggagatattcgcggagcggacctgatatctcggaactgacctgccgaatatccaggaggatctccgcagatcccggacggagctaccacgtgcgtagatctatataagggagcaaggacgacttgtaagacacattcaatctagttcacattggcacacacacactttacacttgtaatctcatttcacattgtaaaagctctgtcataattaaagtccattcgttcttagcaatataactctcaaggtttcagtgaagatctagcactcctttctcataatcttaaatacaaatctctagtgtggatttcagaacccacatttggcgccgtctgtggggacggaaatagatcattccaacaccgaagctaacacatcaattgtgaccaacgatc

SEQ ID NO: 15347 - DNA, 3000 bp, Unknown
  misc_feature (1)..( 3000): cDNA_ID_1809935_gDNA_ID_2926130_Annot_ID_138721 3000 nt of promoter + ATG
tttgtattttataaatatataatcctaatttctatatattgtacaatctcttgattttatcatggcgtacaccgtaagtcgatttttaagactttaatttaaaattatatatgttttttttgttaaaattgtttgttttgttatatattttaaattatataactgtatttaaattgttagttatagagtttcacccgttgtatactgtttcgtattactatagactcaaacccgtcttaccatctaattccgttctgtggaattaaacatatttaatggatttcatccgtggtatactgtctcatattactatcgatccaaatccgtcctaccatctaaccccgttcaataaaattaaatattattttattgtgtttgttttaatagtactttaatttaaaatatatatataattcaaatcaatttcaaattttttattttaaatggttatttaatttttataaagttcatatattataatattctaaacccgtcataccatctaatcccgttcggtgaaattaaacattattttttattttttgtttaaataatatttttattaaaagatttataactcaaatcaatttaaaaggtgactttcaaatggttatttaatttttatagatttcacatttcaaatatttatctatatgtaacatatagttatgtattttataaatattataaacgtttttccgttaaatattataaacgtttaataaacattaaataattacaatatttaccttttaataaagtataatattaataatgttgtaaataattatgtgtacctaattttaagggatttgatttaaagtttgttgtttggattaaatttgaatgataacgtgattgatatattaaatcaagaattaaaatcaaatcaaatattaaggaaaaaagatttaatgtcaatggcatgccattgtaaataagtgtcaagtagaagatttatttgctaaagtggctgcaaaaatgtatatgtagatttaaattttttttgccattctgctagtcttggatgttatgttattcattcggttttggttggtatccatttggttatcggttctttttgttttaaagtttagtatctattcggttattttgaaatttcggttctttctttttaaaaatttcgtatgtattcggttattttgctttgaatattttcgaattttttgattatttttgagtattttactattttatatatattttcaattgttttaagggaaattgcactgggtatgctcagtggatacaatatttatgtcctaattttccaaaagtttcgacgctactgttgcataaataaagacgcatgtacccctatgtccattagaaatctaaatgtagctcttatatctctctgtgtcaggcggatagtagaagatcttgctttggatattttagtgggtgaattaaatttttatattattttgatagttttcaatcaaggcgtcgtttcggtccaatctatatttacctcatgttttttcttcgtctctttcatcctaattggtttgttatcagataatttgttaccgtacacgagtttttgcggttcagaattcgtctcacgtgtggcgagtggtgaatatattaactctattatgaatatattaactctattatctgctatcttgttatctcgatatttcatattgtttcactctttgtaatatctcgacacttcattgcgcgtgttgaaatttattgcgcgtgttgaagttttaacctctaacggatttataatcagatactttattatcgacattgcgcttcagaattctacattttatttactctccctacgtgtaataagtcgacatttcattgcgagaggacctatatctatattaactctattatctgctatctcgttatctcgacatttcattgcctgttttgaagttttaactcctaattggtttgttatcagataatttattaccgtacacgagtttttgcggttcagaattcgtctcacgtgttgcgagtggtgaatatattaactctattatgaatatattaactctattatctgctatctcattatctcgacatttcatattgtttattctgtataatctctcgacattttattgctcgtgttgaagttttaacccctaacgaatttattatcggatactttttaccgtatacgaatttttgcggtactctcactacacgtgtaataactcgacattttattgcgagtggtgaagccctacaactatattaactttattatctgctatctggttatcgtctttgtgggttctgaaatccacactagagatttgtatttaagattatgagaaaggagggttagatcttcactgaaacctttagagttatattgctaagaacgaatggactttaattatgacagagcttttacaatatgaaatgagattacaagtgtaaagtgtgtgtgtgccaatgtgaactagattgaatgtgtcttccaagtcgtccttgctcccttatatagatctacgcacgtggtagctccgtccggaatctgcggcgatcctcctggatattcggcaggtcagttccgagatatcaggtccgctccgcgaatatctcctcatcaattcctaggtcattattcgcttatctccctgcatcaggtgactgggcttatctggcccaaatacccattcgcgtatgtgggctcgtcagctgcgtaggtcctctacttggtgggcttggtgggcttttgtgggctggcttggtattttcgcaggtggattcctggaggggaatacagctccaacatttgccccccagcccattgagtgagtaggcgaactcgatgagcggacatataggtcaggtaagattgcaaaaatattcttgatgagaagataaatgtgattagatcagtcggttttgaggataaactcaacaatttcgttttaatttcagattcccttaaccgaaagattttgaggagatacgcgagataagtcgctgctgatg

SEQ ID NO: 15348 - DNA, 3000 bp, Unknown
  misc_feature (1)..( 3000): cDNA_ID_1809956_gDNA_ID_2926130_Annot_ID_138728 3000 nt of promoter + ATG
tcgctttgaagaccaagatatcaagttgttaccgtgaaaaatgcagtaaccggaagtggaacgccttgttgttgggcagcctgcccaatctgcatctgtgtatgcgattaacccggaagtatctgatggataaagctgcaaaccataattgagtgtaccttttagataacgaaggatatgtttgagggcattaaggtgaggttctcttgggtcgtgcatgaatagacagacttgttgaacagcgaacgagatatctggccgtgtaaatgtcaagtattgaagtgcgccggcaaggctgcggtagagtattggatcttcgactgctggtccatcgttagctgctagcttgactcgtgaatcagctggtgtggtggatggcttacagtttgtcatattggcccggtgtagtatatcggcggcgtagttatgttgattgagaaataatccagaggagtttcttttgatggcgattccgaggaagtagtgaagttctcctgaatctgtcattccaaattcttggcttagagatgaaatgatatcttggagaagcttagttgaagatgcggtgaggccaatgttgtccacatataggagaagataggctgttccattggcgcgatggtagacaaaaagcgatgggtcagccttgctttgcacaaaaccgattcgacacgcgtattgggtaaatcgttgattccaggctcgtggtgactgcttaagaccgtaaagtgaccgtttgagtaagcatgcgtggtcgggtttggtgggatcacggaatcccgaaggttgatgcatatacacgggttcttcgagtgtgccattgaggaaggcattttttacgttgagttggtgaattggccatttgcgagagagggatagttccaatacgaggcggatcgtggccggcttgactacagggctgaaagtctcgtcgcaatcaatgcctatttcttgtgatttcccatttgcaacaagtcgcgccttgtacctatatagtttgccatcgggaccaaacttatgcctaaataaccacatggaacgcacaatgttagtatctcggggccgtggtactaagtcccacgttccctttttaatttgagctgcatattcctcattcatggctgcgttccagttaggatcttctaaggcttttaggtgagaggtaggaagaggagaaataatgtcagtgtgaagagataatggttgtttgggtttggtaataccgtttttacttcgcgttctcatagagtgcgcaacgacggttggaggctgcggaggagctacttgtggagttggttcattgggaattgtttgaggtggatcaatttggcgaaggagaggagaaatagacaccggaagttgtggttcatctatgattgaaggagattctgagatagatttagagaaaggaaatttagattcatcgaaggtaacatgacgtgaaatgattaccttacgggttgcgagttctagacaccgatatcctttatggttagatgggtatccaagaaaaacgcacgcagtggagcgaggatcgagtttatgagacgaaaccggaagaagattggggtaacaaagacatccaaatactcgaagatgattgtatatggccggtttgtggaaaagtttggtgaaaggtacctcgttttgaatggtagatgaggggagaatgttgaagagatgagttgccatcataagtgcctcaacccaataggtggtgggcatgtttgcttggatgagtaaggaacggacagaattattcagtgtccgaagagtgcgttcggctttgccgttttgctgcgaggtgtatgggcaagagaagcgagggataattccatgagtggctaagtgattaaggaattgtctgttttggtattcaccaccattatcacattgtaatgatttaatgctgcagccaaattacacgtaagccataaactttaagaaagtggaaaacacttcagattttttacgaagaggaaaaacccagagaaagtgagtgaaatgatcaagatatataacgtaatattttattccactgatgctaggaaccggtgaggtccatacatcggaatgaataatttcaaaaggtgcagaaatagaagaaataactgaatcaaatggtaatctagtgtgtttccccaattgacatgcatgacaaagagacatgtcaattttagaacaattaattaagggaataagttgagatttagtacgtttatgaaacaaaattatggaagtagtacactcactatttataattaaggaaataatcgggtccactatcgactgtaatacgcgtcgcttgtaatacagaaaaacatgggccatgattcgtttgaggaaattacgtttaggggtcgccgtttgttttgttcgtttgcaggaaaccctttgactgagttcgggggtttgctttacaagatacaacaaacgtcatgggcctagcgtatttctagatgggccttaatcaaagtctgtttacagatttataattcgtagcgaaggcgttgaagtcaacttctttatcgtcggcttattcaatgccggagtgcgagctgagagaaacaactgcatttatgaatgtttcaaatcaacggaattagttaacaagtcggtgaataaaattttataataatcaaattctctttaggtttttctcgaaagtagctaaatttttggggggaatttgagctcgtttttttgaggattaggttatttttaagtaacaaaaggagatgatgattgtcagtttcggttgtgtttctttgttaccgggaaaattcatctttgcgtttctaccatggaaggtggaattctgatcagaaaattgttttgtaaacttgtcctcataatgtttaaaagccttcagactgataaaaagtgaattccttttttgcagtggatgatattgtcgttgtacaggcaggtagatggattttgtatagcactggtgaatgggaattcaagcttgattcttgtcgtcacggtagggcgatg

SEQ ID NO: 15349 - DNA, 3000 bp, Unknown
  misc_feature (1)..( 3000): cDNA_ID_1810033_gDNA_ID_2926130_Annot_ID_138734 3000 nt of promoter + ATG
ttattactatgcatttaaactatagatatgtttggatacccgttcggatatcggtttggatctgattcggtttcagattttagggttttgaagtataaacctgttcggatattttaaaatttcagattcaaattccgatcgggagctcggattcgaatattatggccagccctaaacgacgtcgtgtttgaagatttagacttgaaagcgaagaaacaaaatatacctcttttaaacaacactatatgtaagaaacccaactggaacatggtgggacctactagagacaatactcgtgttactaccgtcagatgcttttagatattgtcgtctatcctgcggtcgagatttcgtgtaatttcaaagctaataccgtgatccatgatctagtagtaacactgagaagagggactgtgtttttaatcggctgcgtcggatcatttcctgttgttatcaaatttttctaatccgtattcgctagttgctttctgcttgttcacgcgttgaatctcctcgtactttgcggaattcagatttctcgaacgggtatgtacttgttatgcctagaaactgttcgatgaaatgcctaactgagaatgtttttacaatttctctctgtttgatgtatctttttttataaatgaatgttcagggtttacaagtttggtttgttcttcagttcttgaagtgatttgatacggagcagtcatggatggtgagtgaatgattcttgtgcaattgtgattttgtttttgcttcaaggaaggccctttcttcacttatctttgggaattggtgaattagatgtagaaacttaggaaaatgctataaagctttgttctttgctattgttttgtatgatgtaaaacttcttagtataacttgttaaaatcccaatctgcattaccatcaatgcgtagaaattgcttggaaaatttaaattgaggttgcatggtttttgaatcctaagaccattttttgagaactgtaacattggtgatttcaaaatattcagttgattcacaaccaatgatggaggagactatactggtcggtgatgacctaatgacgggtcctccatctcctgttatccctcctgaaattgcttcacatgtgcttgaaggtgttgatttgtgcgatgggattttgaggaatctattcctgtgtatgtctatgtatcctcggtttggtttataattctacccttacttctgtcagtgagtagaattgttttttttttttttcttgttttaggtttgcaaatcaatgatattgaaccattttgccaagatgagcttgcattgtatcgacaatgtgctgaaaagagggtaattgttgtttagccatcggctcggattatagttatataaagcttttcattctcatatcatatccacatccatttccttgacttttcttgttcttctatcctttttgtaggacaaaatattgagagttagacttcaagagagcgaacacaagttaggattgtctatgcccattgaactcgctaaggaaaggattacgcagcttgaagctgaagccacatcttttgagaggtactctttcttaacaatgcagttatattttgttttggattttctttacatgaagagtttgtgctaccatgtaatcatgtatatctacagatgttcacaaatcgaaactatgttcttaaatccaaatgttcactaaaacagttcatttgttttataatcaggcacttgattctagcaagtggagctgaaggaatagaaggatttcgccggagatggagtttacacggtcggatgacggataccaagtactgtaacaaaacctaaccttataaaacaaccaatgctcataatataatatcatggaattaatatgctgcatgatagtagatgaacccatcatagtccttcccaaatgctgcgtacataaatctgatttttagcattatcgaaagtgaagcctataaaccctttgtgctacagtctgtattactttggtttgtttcttagcttaaagctaattgtttttattgtgtgtggatgtcacagaaaaagactggagtcactgaagcagggaatggagaacaggaacaaggttgaacatgaacataaccaacaccatgatcagtccccaaaaccttctgctccaaaaagatggttcttttggtgatttccatattgaatcatgttttggatcataaaaggttcataatcattacacttatggtgcagcaatgtaaccacttttagctattaaaagtaacattaaaaatctaaaaagttttatcttctccattaaattcgctcttagtctttacaaatgtcaaattgagtaatcaatttctttcggtaataatagggatgtgcattttaactaaaccaaaccgatccaaaccaaacccaagtttagattcaaaccattcggttatgtttcttctcaacccaaatggttcggttcggtttggtattaaacaaaccgaattgacaacccaatatatttatttaattaattaattaataatattgtatattactaaatatgaaatagtttgcacttttaatttcttttcatggtttttttgaattattaaaacttttgcttaagttaactattatcaaattcaaagttcaaacaataatgtacggttacaatgattagttttttaaaaccgaattaaaaccaaaccgaagaagccaaacggaaccaaacccgaacatagattgatccaaacccaaaccaaaccatactaacctcggttgagtttgattagaattttacaaaacccaaataaatcgaaccgaatcgaacacaaacgggaccagaaattaaacagaaatgccgaaccgaacttaataatttcttgttttttctgaagcccatttgaggcccaatatctccctctacgaaacgacatcgttcttaccgaaaacgtctgctatatctgacagtatctagcactctgcaagagaaacttcgaagattttgatattgtaacgatccgcc

SEQ ID NO: 15350 - DNA, 3000 bp, Unknown
  misc_feature (1)..( 3000): cDNA_ID_1030333_gDNA_ID_2926130_Annot_ID_196882 3000 nt of promoter + ATG
aaatttctgttaggagggattataatcgtggttgctcttgttgctcaattctacaacaagaagtttcctgagaacagagactttttgatctgctgcatcggattatatccttttgattcccatttgatttgctagggttaagatgaaattgaattgaatttgataattgtttccttgtgtatggcttgattggtttgtgttgtgtgcattagattttgagatactataatgtctattaggtatgaatgttatgtataatcagagaaatttctcaaagtctttatcttttggatataatttttgaataagatgtgggatttgtttgcttcttgactttggcaagtatgtggtgttgactgcggtaatgcagctgattctgtacattaaggagaagaacgctatcttgttcacctatcctcttgaggtttgttctcttgactgcttagaaaatgtggttaggttgtgtgcttttgggctacattcttgtttttgcttgtatcataaccagggactgttgtttctgtgattcggtgcatattttctcttcataactagaactatattttgatgtccttctgttttgtaaccacttagaattgttcttctgctagcttcacatgtgttgtagagttctcatatcttaggtgatcttggtgtttggcatttgagctatagcaggtgctacatctccctttcactccactcattctaaaccaactttttctcaatgtgttacttgattcgtcgatatcttgattattcggggtgtggaagttcgtgtaactcttggtatttgtgattctggcgatgtcttgttatatgagacacacttgttcaaaatgattctggaatttaatgttggtgtttgtggcttttgttatttgtctcatcagctggaaaaagtttcccatctcaattaatttgtatacgaaaaaatgcgatctttcaaaacatttgattagttctcattatggttaaggtcagaataggcaacaaagctagagaactccatttgttttgccatttcagtttctatgataatttggtttgcagattattcatatattttgctactgttaggacatgtatatttggttgttttgctgacttgaaattcggatggttaataatatgcagggatcattcaccagcactggtttggtggtatcttccaagttacctagattctctgatcagtacactctaaccatcgacagtgctgatccgcaatcaatctcagctgggaagtcggttcagttcaccaaaagtgtcactcaatggtctctttctttctgcatttttcatacacgtgctcacaccatatcctttgcattgcgtaagctgttgattttgtttttgtatgtgtattctaggctcacaaaagatggagttcttgtcgagggtttattctggaaagatgttgaagccctagtcaaagagtacacagaagcaggagaaccaaagaagaagagatgatcatctataatgggaaaagtatgttgctccttattagttctaaatgttacattttttttatgactaaaatcgatggtgacttggtttaaaagacgacagagtttttgcctcctaacagaagattcattcttataaattggaaccaaattttcaaatcattccgagatttttacaaccatcgatcttatcatgttctcttatttggaaatgttgccgtaagctagacttgttcggtcttgtctggcctaattcagttattttgttgttattgatcacttaagaaaatgttatgttgggctggtctggtccaacccaatcagtaataaacaacttaaaatattagttttcaaaaaatccgatctgaactgaatttgtgtctgtccgacattagcttttaaccagagtaacacttctactctaactaggtatgaccaaaatttaaccataaacatattttgaaccataattgtattgtttttaaactggaaccgaatcgtaacctgtcaattatgattaaaaccgaatcgtaacctgtcaatcgtaatcgtaaaatggttaaaaaccataatcgttaaccgtaaaaaatagaataattaccgttaaaatatatattaattgtaactgtcaattaaccataatcgtattaaaaccatagttaaccgtacggttaaccgcatagttaaaaccttaaaaatacaattttaactatttataatgcaaagataaatatcaaatgttcgaataaagattttcaaaaagtaactaaagttgcttataaaaaaatctacaacatacttttcattttcttaaaagcaattaaaaaaaagtcggatgatacgtaagattttgccttcagtattaaatgtatcgtaaccatcaaataaccataagcatatttaaccataattgtattcattcgtaattttatataatcgtaaccgttttaaccgtatatataataattaaagttatgtttacaaaaaatttgtaactataattattagttaataaatcgtaaccgtaataaccgtaaccttagtgatgcctaaattctctcattaaagcgtagataaaccggtgttaaaccatgaaaccatgagattttttccccctctcatttgtgaagttgattctaaaatttaatgaaaaaataatactacagtaaggtattaatgggggtggaatatgaagatattataagcttaggaatattaaaatagaacaagaacaaaacgtcactccacaaggaaagttactaaaattgacaaaaccacaagtaccaacaaatctaagttttgtattcctcctttttaagttacataattccccaattcctccaccatatcacgcgcccacgtgaattaaccagacaccacaaaccacacacattagttataacctccacgcgcttaatcagcgcgtataacaaatgaacgtctctctagcgttgttcgttttgatatcttctcgacttctccacttctttagatttgattcttcttctctgatctctgaaaaaacaca

SEQ ID NO: 15351 - DNA, 3000 bp, Unknown
  misc_feature (1)..( 3000): cDNA_ID_3088050_gDNA_ID_2926130_Annot_ID_196876 3000 nt of promoter + ATG
aatcgccaaattcgtctgattgttcttcttcttcggaaccgtcagtgatgatgtcttataattctctgttttgtaggtcaatgtggataacatcttctgtggttatgtctcgtatgaaaacttctctaacactttcttgttgcatcacaacatcatcaactagaccgactatacggcctctgggattaactttaataaccgataacgacacttcacgtttaggcctcacacgcggataagatagaaatcttacttgccctgcttgtgatgttaggatatatggttcaaactttgaataagtcttgtttgcattgacatcgaccacgcctaagttatttacccgtacccctcgaccacacctaagttatttacccgtacccctcgtccgataacaagatcaaaccaatcacacttgaaaaggacgcatttctaattcaaaagtctcggatattcgacttcaagaatttgttgcagaatctcattaaactctgtttcaccttcgacatggattccataatctgcagttgcccttcgactttcatttggatatgtatgaaaggtatagccgcgagtgaagtacatcggtgtggttgtgatcttagatcttggtttttgaacgatctcatgcaaccaaagtggtaaagcttcacttccacatccgttagtaacctacataaagtaaatattatgtaagtttatcatttcaacataagtaattaagatatcaaattttcgaaatattacttacatagaattttaaccatctggcaaaatcatgatctttgtaaatttcatattctttatcttctaatccaggatatgcttcacggatttgtgaatcaaacaacctacaaattaaaatgtagatgcttagcttctttaattagtccttaattagtatcacactaattattaaatataaaaaattatgaataaaatttgtctggctttgtacctctcaaattttttaatgtaatcaacatttcggagtatgtaattgtgagctgctctagaaatcgcatggtcatcccaccaaacttctttcgacttctctgcaagtctacctatttgggcaaagctatctggaacatcaggaacgttatatgtaggtgcaacacctccatcgtcatatcgtcgaggatgagtctttttggttctaacgtttggactaaagtaatacgatgtgaagtgagacgtttcctcggttaaacttcctgcgactatcgacccctcaactctcgcaagattttttgccttttctttaagagatttcatgaatctttcaaaaggatacatccatcggaattgcattggcccaccaagagcagtttcatgtagaagatgaatcggcaaatgttctatcacgtcaaaaaaggcaggagggaataatttctccaagttacagagtaacactgggatattcttgtctaattgttctatgacatcagttgtcaatgttcttgtacataggtccctgaaaaatgatctgatgcctatcatatatcgaattaatgtaagttaatagtcgtctattaataactgagttaaagaatagaaatagaatctatatatatatttattacctgcaattgcttcatgaatatttgcaggtagcaactctattaacacaaatggcaataatcgttgcatgaatacatgacaatcatgactcttcatacaagaaaacgtttgaccttgctctacgcattgtgagagtcgaaactcgcacaagagaaattgtattaagggtttcttcaaagaacggatctttttgagtttctcaaagaacaacagaattgttgattaccgcggacggtgttcttggttatattattgaaataatgaggattcgatcgtacaagtgtttagaaatatgaaaataagtgttttgccttcaaaatcagagcgtttttgatatcctgaaattaagagcgtttttgtgcgtgtctttttctttgtcctcagaagttctttatatagggctttatcagatcgcttctcgcgatattctcggaagatttctccttatcttagagctagcgaaggagatttgtctttatcttccgaagattctggaaactcctatatttggtgatatcgtcggagattctctaatatctcttccgggtttttcggaaatggtatgttcgatctcatattggttaagtcatttcttgaaggttctgtcccgacctgatgttcctccgagccgggttgagttgaccctcaggttgtggttgagcggctcggaccttgttagtcaaatgatgcgctcccgaggcgtcttaagacccacctcgggatgactttccgggttgccatccgaggcgcttcaagaccgggtcggggaatcctttgtggtgatgctctgaggcgttcttgatgtcgcctcgagatggttccttgacatgatccccgaggtgttttgagtcccggctcaggatggttcttcgacaagatctccgaggcgttaatcagggtcggctcggttacctaggtggaatccgaccccaacagtttgccccccagctcattgtcttgacggaaagccgatgagtttcacggatgggttcccgagccgactgttcatcttcttagatctaactttgtcgcttcatcttcccggacggtcaaacttccgttgcgtgccgacgactatttttgagaagtggaaaacgtttctcgcttattcccgaggatcacgcgggtgtttccttctgtcgagcccacgcgcttaaacgcgttttaattgtttgttgcggacccgacgcgcctccaaaaactctatatatacgacgagccattccttcgggagttcatttgaagttttcgaagaaaataaacgaggtttgcttccttctctctgatcttgatatttctatcgttctttcttttccggtgaagctccgccgttcttttgttatttttgattttttcggtttagaaattcttgttttctggtcgtttctcatctcatcgatcgtccctgagccaaaaatg

SEQ ID NO: 15352 - DNA, 3000 bp, Unknown
  misc_feature (1)..( 3000): cDNA_ID_3047095_gDNA_ID_2926130_Annot_ID_196861 3000 nt of promoter + ATG
aattgtgggtcaggagagacgcgattccactcgcatggcacatgaggtagagcgcgatatcgcgggtaaggaggtttccccccgcgaaactgggattcctgcccaggtccccatagatctgacaggtaccgtctccccgaccgatcctactccgagaactcgtctggatttcgcctttttacaggcacctgcgaacgctctcgtcgaaaacctggcaacagaaaacgaaacaagcacaacgcctgccttcccaaggctaccggccccacctttattaccgatgggctgttcgccccctaggtacacgtgtactagaaaccaaacaaccgcatccagtttccgcattcccgggaactcaacgcaacaacggacctctatcgctaatccgccatctgttcctcagataccaggaagcgacttccttaacagtccccaagcaccggtcgatccgcgtaacgtcgtggatatggaaacattccgcaattacgcagctcaaacaaacgcgaacatggctcaaatgcattctcgaatgcacctagctgtgagcgatgctcccgacatagatcgcgtgatcgaagaaaccaggcgcaccccgttcacggataggatcgcttgttttcgcctccgagatgtcgagagactccgtttcccagaatacgacggaacgagcgacccaaaggctcatctgagatccttccgtttcgctataacacgagcgtacctaacagacgaagaaaacgaagcaggtcattgccgtttcttcgcagaaaacctcgtaggtcacgccctcgaatggtttgctagcctcgaagggaactccattgataccttcgaccagctcgccgccgctttcttaaaacaatattcggtacttatcgaacacaggacgtctgaagccgacctctggagtctcactcaacttcagaacgaatccctgcgatcttacgtcaaaaaattcaaagcaatcaaatcgaaaattgcaaatcgaaaactgcaaacctaaacgaagaggtagccattgcagcccttcgtaacggcctttagttctcctctaggttccgtgaggaactcactgttaggcaaccagtctctttagacgatgcccttcacaaagctctccacttcgccaaagccgaagaggagcttagtgtgctggccttacgattcaaagaatctaaaacgcaaaacgctccccttgcaattaagaagcccttcaaaaaggaaaaccaaacgcaggggtagcataccttattcgcaatagacgaggcagctgagaacgagagtccagaacttgacctcggaaaatattgcaagtaccacaagaaaagaggatattccaccgaggagtgtcgcgccgttaaaaaattaatcgcagctgggggaaagactaaaaaaggttcaaaccccaaagttgaaacccctcctcccgacgaacaggaggaggagcaaactcccaagcaaaagaaacgggaacgaacaccggagggaagtgactctcccccaccttctagaggagaacgcatagacctagtctttgcagaactcgatctaggtggtcagtcaccacacctccccccgccccgcataagaaaaacatgaggtttccattacggctcttgaaattctgcagaagcgcaaccgagcacctctccccgaaacgcatcgatttcatcatgggagggtctcagctctgcaacgactcaatcaattcgatcaaaactcatcagaggaaggcagattcttacacaaaaggcaagagcccgatgatgggacctaaccaccagatcacattctgggaaagcgaaaccaccgacctcaataaacctcacgatgacgctctcgttattcgaatcgatgtaggcaactacgaactctcccatataatgatcgacacgggaagctcagttgacgtactcttttacgacgccttcaaaagaatggggcacctcgattccgagctgcaaggcaggaaaacgccacttaccgggttcgccggagatacgaccttttctctaggaaccatccagctcccaaccatcgcacgaggagtgaggcgactcacgagtttcctcgtagtcaacaagaaagctcctttcaacgcaattctgggaagaccatggctacacgccatgaaagccgtcccatcaacctaccaccaatgcattaaattcccctcggacaagggaatagcagtcgtatcggcagccaacgcagctcccgaaaatgctatatgggcagttacgatcttatcaaaaaggctgaccccgtagtactaatgatagaagacaaactcgcggaaatgaaaacagtcagatcctctgatccttctcaacgcggacctcgaaagtcattgataacacaggtctgcatagacgaatcagatcccaaacgatgcgatgggataggtcaagacctcgacctagcgatacaagaggatctcataacctttctcaaagaaaacaaagacagctttgcctggtcaagtgcgaacctccgaggaataagcctcgaagtaacctcacacgaactcaacgtcgatccgatctaccgacctataaagcagaaacgtcgcaagctaggtcccgagagggctaaagctgtgcacgatgaggtcgatcaattgctcaagatcggatcgataagagaagtaaaataccctgactggctcgctaacccggtcgtcgttaaaaagaaaaacgggaagtggagagtatgtatcgactttacggacctgaataaggcatgtcctaaagacagtttcccactcccacatatcgaccgactggttgaagccactgcgggacacgaactattgtccttcatggatgcattctccgggtacaaccaaatacttatgcacccagatgaccaagaaaaacagcttttataactgaccgaggcacctacttttataaagtaatgccctttggtttaaaaaacggtggagctacttaccaaagattggtgaatagaatgtccgccgaccagctaggtaaaacg

SEQ ID NO: 15353 - DNA, 3000 bp, Unknown; identical to SEQ ID NO: 15345
  misc_feature (1)..( 3000): cDNA_ID_2139126_gDNA_ID_2926130_Annot_ID_196859 3000 nt of promoter + ATG

SEQ ID NO: 15354 - DNA, 3000 bp, Unknown
  misc_feature (1)..( 3000): cDNA_ID_3088102_gDNA_ID_2926130_Annot_ID_196852 3000 nt of promoter + ATG
acccttgacgccaaactcctgcagaattgcttcgttcaacgcaaccaatattattccctcatgaattggtacaacccttgagaaaagttggttacatatctccaatttccactctccagtcgaagaacaaaaccactctccacatataaccatgatatagtcgtccatcgatccctgtacagataaacgaaaaaaataaatttggttatattctgattcccgtaacaaatagaatgcacgaaatttcgttttaatatcatgatatcagttttctacaatcgtacctccttggacacgacagttggccaaagatcgatgattgaaacccagaatcttatgtgtttcaatggatctcgtgtttcagtttgaataaagtcgaaaagcaagggaagttacaatgattaatctcggccgtttaatttactgaaatccgacgatcgtcgtcacgcccaaactgttttttctaaaccgaccataataaccgtatattttagaccaataccaaacgaaaccataaaccggtttgtagaaatatctcaaacgaattagtgggggtatatatgtcttatttcactccaaaagcaaggcaaagtgcctctagtttttaaagtgtctaaagtgaattaagtttctccgaaagtgcctcatagtgtaacaaacccttaaaattataaatccaaatatactagacttatttagtaattcatatatatttggaataaaagtaactaatgttatagttttgggtaatatgattatctatacccagaagaactgataattaactgacaaaaaaaaaacattgttgtcttctactgttttaattttatgacacttatacccctaaattaattaaactaaaaataaaaagttggatgaaacattagtaccttaactaaaacattagtacgttcaaataaatattatccatatatcgattatcttaccgtgttaagacaaatattattttgatttttagtatgttaccatgttattattcatatatcgattatcttaccgtgttgagacaaatattatttcgatatttagtatgttagcatgttattattctatgtaaaatgttgttataatcgttatcatgttaattatgtaacatgatgtattttattttgttgatatatatataaataaaaatatttattcataattttaagtagataaacatttatttaacatataatatgtaaatttaccacgttattatatatgttagcttgctaaacaaacagttatatacttatttttaagaataattcactgtaatgcccttttctcaatgcccttttgcaactctaccctttttcccattttcatttctaccctttctaatacttttctctccaaattacctttaatgagctacccacagacctaattcatttcttcactctctctcttcttcctccatcggaaattgtgaatgccgttgaatcccatgccgtcggaaatagtgagtttactcgccgtgaaaacccatcttcgccgtcggaagtagagctgtgtgtcgccgtcgaatctcttgcgtttccccggtttgattttataatgttagcttaaatcttcgatttcgaattgatttattcgatttttgttgttgattatgtgaattcgttatttgaatcctgattcaatcgacagtttgacatttgcttcagcttcgaatttgaattttgtttgagatttgatgattgaatttgtttataaaatccttgtaaattcgttaataccttttgaattcgttatactgtttcgtgatagatttgcttatgtgaattcgttatactatttcgtaatagattttggttctgatttagtgtttacctcttttacatatgctttcgtgatagatctatgccacttacgctttaaaacgatttgtaaaccatgttaaccacttttcaaagctttttaaatcccttgtaaattattttatgctacttacttacgctttaaaacgatttgtaaaccatgttaaccacttttcaaagcttttaaaatcccttgtaaatgattctatgctacttacttacgctttaaaacgatttgtaaaccatgttaaccacttttcaaagcttttaaaatcccttgtaaattattctatgctacttacttacgctttaaaacgatttgtaaaccatgcttctctctgtagtgacagtgtttttatgggtgttgatattgttgttatttatcttatcaggttataatgctagaattgtatcctgtttgtggcttgtggaagttgacaaacaatatgacttgggaatttgaattagacattgaattgggagcttctttaatggtcattgatgagcacattacctatcacgcgttggtggatattcttgtagaggattttcaaatagatagttcaaccaattctttgaagcttagttacaagttagtctccacatctacaaccatacaatctcatcctctttatattagaaacgatagacagcttgcaacttttatgcacaaattctcacagagtggaggattgcttcagttatgtttgactgtagagcaaatttctgtgacagttgagcagatttttcaataaccttcttgtgttataattttaaaaatccttgtaaaatcattattaagtcagtgattgtgcttattacaggctgagactacttcaaatccttttgtttctcattctctccctactgctcatgtactaatcgttttaaaaatccttgtaaaatcattattaacgtttttaaaccccttttaaaaatccttgtaaattcattattaacgtttttaaaccccttttaaaaatccttgtaaaatcattattaagtcagtgattgtgtttattacaggcttagacgacttcaaatcattttgcttctcattctacatctactactcaggtactaatccttttaaaaaatcttgtaaaatcattattaacgtttttaaaccccttttaaaaatccttgtaaaatcattattaaagatagattg

SEQ ID NO: 15355 - DNA, 2470 bp, Unknown
  misc_feature (1)..( 2470): cDNA_ID_1022613_gDNA_ID_2926130_Annot_ID_196843 3000 nt of promoter + ATG
attggttctcaacaaaatatctttaagaatccaaacatgaattttttcacatctaagacatctgtgaaaatagtcggatagatgatatcttttttactgtgtctattgcttttagtaagacagaagccatatttctgaatcttttgattagccaggtcacgatcatatatgttctcctcttctgccaaaatccaaacaacacaaactttagacgtggcagaaatcagcatttatttctaacaataattggaaaaactaaaaaaatagaaaaatatttcgagttttagctagagaatgaaacaaataatcaaaacgaaaactaaaagaaataaggtgtctgtaaacgctaaaatatttcatacctttgtgttgggtgatggtaaatggcgtggtggtgcatagtatttatagggacaactaataggttactaacccgcatctattaaatagaaaatattccctgaagcaagatatttggaagaaaatctatgaattcgatagattttgaggaatatactattgttatgcgtttttaattttttatgcggcattattatgtttctttaaatggtttttgtgtagattatgtagaggataaaatatgaaatccgaattggtgagttattacttgattttagtaaaaaacggaattgatttttatggagaagaaacattagttagtttcttaaaatctgttttgtagggatatattgcaatgtatgaatttcaaaaatggatatgatttgtttggaagaaatcgtggagttaatatggagagattttaggaaataattttgatagagacgattaagatggcaagacgttaaggaaatcataaattgtgattagcaaaagaattaattacgtttattaaagattgactaagattgcctattgttgttggaattaattaagaaaaatataggagaatatatgtgataccaaaaacatattaaaacaaatgaatgttaaatctggcagattttgaatcaaatcatattttatcctctacatagtcccaatcgtaatttctttgaaaacagaatgattctgaatggtttagaataggaatatgcttgagtatcataagtgcaaaataataatcaaaatgccgtatttagattttgatttgattctgaatcaaactgtcgagatatggtaaatgtatttacccttatttttacgcttgtacatgtaaaacagaaagatttgggtggtttataagatggaatattgcgggatttagattatatcttgactggcaagcaaatagtaaaagattttgtagttaaggtgatatacgtaaatcaggatacataattgctatgaatgaggagtggagagaatatatgattcgatcggataaattttttggaaggcaataatcaataacaatttgaataatattatagttggcgaaatttaatttgcgaggtgatatattggaattttgaattgatgatgatttgtagaatgtgtaaaaatatattgactataccatatgtaagattatatgataaatagagggttcttttaaggtttatggaattaatgcatgattaataatcgtttaacttatagaaatgtgatatcgaaatacgaatatttggtaagagtgtagtaaatatttagagattttggaatgaagtaagtaaagatatggttagttatttggttgttcggatttttaagaaatattatttcgtgtaatattgaattagtagagatttaagggattaatgtgtgcaatttatgagggtagtgcaaaataatatttttgtttaggtaattaattagtgcaaaacgtgaatagttcatcaaaaatttggtcattgtcctaacgcagacaatcttgtctgattgattttatagggactaaacatacaatatcgaaattgaaaaagaatttttcgacacaaatctttcccaaaattgtatatgtagataatttataaatttgttatcactatcttctaagaaatctgtcaaccaaaaaagtatgatataaaaaatctgtcgtatttaaaaaattctactgaataagaataaatctggtataactaaatgatagacttttgtaaaatcgctagaaatttttttaaagaatattttgtatttattttatttttaacacatgaaaaaaatattttaaacaaaaaaaacaatttaattccaatattttagaaaatattctaataattaatctcattacttaagttaacccctaaatatgttacgttttaaaactatctaagcacgttctaatacacatcatacatcatacagaaacacatatattcctccgtgctgtaacacgggtctgatcttagtaaaatagtggagagaagaatattcttctggataccttttaatattccccaaaacttctgaatcttcttctcaatttttctcgacattttctcatcgaaagctctcttcctttccctttttggcgctcaatacaatcatg

SEQ ID NO: 15356 - DNA, 3000 bp, Unknown
  misc_feature (1)..( 3000): cDNA_ID_1810038_gDNA_ID_2926130_Annot_ID_138736 3000 nt of promoter + ATG
agtagtcgtggtggaatccgaactctttccgatcttaaccgtaggtctggtcctgactccgacagtgattccgatggtccacaagaatactacacaggtggtgagaaaaggtcagtcttgtttctatttcgcaagtgatactaatggtgatgtggatcgtcttttgctatgattggatctagatattaattgtgaggtttagggtttcatgtctaaataatgtttttattggtcttgtgttgcagtggtatgttagttcaagatccatcgaaaaaagatgatgttgatgagatatttaatcaagctagacaactaggagctgtagaaggacctcttgagccacctccgagttccaggagtttcactggaactggtagattgctttctggtgaaaatgtgcctactggtaatcaacagcctgagcctgttgttcacaacattgttttctggtctaatggtttcactattgatgatggtcctttgaggaaattggatgatcctgagaatgcatcgtttctcgaggtgaatgactttcatgtgaaactgttttgatcttttgtttttggttattgatttagttattgtgttcttatagagcattcgaaagtctgagtgcccgaaagagcttgagcctgccgatagaagagctccggttcatgtcaacttgatgcgaaaggaagagaaatgccctgtgagtcccctctctgctttatccatattgggttactagtctctcaaagttgtgttagcaaaactagcattttggtcatacattacaaaaatcttggtagattttatatgcgataaccggtcttatttaatcgacttaccggtcttgtttgttattgtaggaaagacagaaacgtagggtttcatttcagggtgttggaagaactctaggtggtagcaatgaaggtagcggaagtagctcacctgtggctccagactccgctcccattcccatccaaaccgaaccagcaccatctcaaagtcttgtaatagatgaaaccgttccaaccacatcgatacagcttagactagcggatgggacacgtctggtggctaagttcaatcaccatcacacggtcaacgacattcgcggtttcattgactcatctcgacctggagcctcgttgaactaccagcttcagacaatggggttcccacctaagcctttgactgatctcactcagaccattgaagaagctggtctcgccaactctgttgttcttcagaaattctagaaaattctacaaggtgtggttctttttgtctatctatatgcattataatgagattttcataactgttgtagtaaccaggtctttaaaatgtaagttacttcttcactctgtatactcagcataagccggcggggacttgtggtatagtttttcttaatttattgaaattttatagtttcattatgcgtttatgggttaaatacagtgtttcaagaacaactatatatagttatatattattagtttggtaagagtataatcaagtgtcatatatgcatgtatatcattgttgtgttattcatcaaccaatagttactgggaagagtattaataagcttattgagaatttgaaatgtatatgactagttttcatgaaattacaacattttgaaactaatgtttgtgaaaggaagaactagaatcttttcatattattttcagtagggaaaatgtcataaaagtcatcagttaaacaaagcaccaactttgcttatggtgaacgggtcaagacccatttttatcttttatttgtgatttttttaaaaacataaaacgacgtcgttttgcagtttaacgaaagatgggaatgttgacttaacaccgttaattttttcaattagttgacatcacgatatgctttttttggcaaagttaatacaagttaatgatttaattgaaaaatcaattgaaattagtgatttaattcactagaagcaaagtttgtgctttgtttcaccatttttcgtaaagtgatcatttttatgacatttttcctatttttaataactttacttcttcctttttttttggtagggtctataactttacttcttacaatgatgttatgttcaaaataaaaaggttcaaacttcttatgtatattttcaattaagaaaaaaaaaacactttcaaatttattaaaatctaaaagaaagattaattcttcgttaaaatatttttataagaaaattacaaagtaattaagatacataacacaaatgtgtaatcaatgctttcaattttcaagtcaacatgatgaaatttcaacaatttattcgagaatggagacatgtagacatgtgttgtttcaacaattcaatatgactaactttgttaaaggacaacatttaagtttgttgaaatgaagaatgagcattcttgcaactatttacaacaagtttattttttacaataaggctaggttcaaaataacaaggtttctaaatcattgcacttaaagcatgtacaatggttgggactgtcaaagtccctaaaaaagtaaaaagtaataatattttattattttaattatattttagttttttaatataaattggacattgataagattacacttgcaaatatgtttgtgggaacgtcctttaaatgaggactttcagagactctctttcatccctcttttactttttaaatatttttgttatttttaagtggatgagcctgtataaagagacccacgttggacgtgctcttagagttcgaacactttcaaatttacgaaaatctaatacaaaattaatactccgatttttttagctagtattaaatacttccggacttgtaaagtagttggagtcaatggtttcaagtcaacaatgatgaaatttcaacaatttacttaaacgctacgagagtgagagaccctaccagagtcaactttgttgatttgttcggatttggtttttaaccaaaaacttggatgacaaaagaagaacagtaaggggcaaaaagcaaa

SEQ ID NO: 15357 - DNA, 3000 bp, Unknown
  misc_feature (1)..( 3000): cDNA_ID_1810046_gDNA_ID_2926130_Annot_ID_138738 3000 nt of promoter + ATG
aattacgagatagactcggttttagtgttagccggaaaataactaagtggaggcttggtcgccggaactttggttgtcgctggtgctcatggtgatttaaccgaagctatgaagtaaaagatttaatctctcctccttttagcactaaattgtggatgtcagaatccgcaattaggaatttgtggatgttacgaggacctttaaccttgttagccgagctaagattaaatcggacaatatttcagttaattggaattctattgtatagtaattttttctgtcccccttataaatgatgatcgagttctatttatacaatcaaatcgaatatctacgaagtaactgaacgcttgaattacgccacaaatcatgcctcattaatgtttacgtttcaaactgccacttcccatattaacgcatcctcatttagtccggtgattttctgttacgtaacacgcagatactcttacgcgtactgggcctcaaatgggccctcgatgcccacttcgtcacgggtggtttcaggcccaccgttttgagcccactgattgatgatgatggatcttgggtcggggcaaactgacgagatccgacatccacaacactaaggaacattggtcttaggtatgccgaactccagcacatctgtgtgctctatacaaagaatccgccaagggaaaaggaaaggaagtgaacctcgcagaacatattgaggaaatggatcacattacaaatggaacaatatccaaggcaaaccttggagatatttgcataccagatagtagaacaacgcacactattctaaaacataaaaaatatttctctgatttgaaatcaacaaaagttggagttaacatatcaggtcccacagacttaattgaagggacgagtaaagcaaattttggattacctgttaagacaaagttctcgataaataatgcattattttctccaaattcaaaaaaacttttgttgagtttcaaaaatatataccttcatggatatccttcgtggatatgacactcagtctgcaactgagaatggaagaagtacatgtgtatcacttctgaaaaatttggggaaaaaaacacattttggagaaattaacaagactcccatcaggattgcatcatacatagaatcacatcatgttatcaaaagagatcatgacgatttcacattgtggcacgatcagcttggtcacccaggcaccacgatgatgcaaacaattatagagagctcatatggacattcaatgaaatcccaagagatttatcaagggaataaaagaacatgtgttgtgtgttctctaggaaaattgattataaggctatcgccaagtaaaattactaaacaattaccagaattccttgaacgagcccaagacgacatttgtggacctatacacccaccatgtggaccattctattatttcatggttgatgcggacatcaaccttacttcacaaaccgttgaactacatcctgtaccacatcttatactacatcctgtaccagaagtcccggagggtatcatgacacgttcaaaggctaaacaattgaagaaaaggttcaacttagttgtgcaagatattttgagctccctagagctaggagtaaactggttcgtagcaccccataccggatatgatctaataggcgaacaagagcttgttgaagcattcacccaaatgagtcttgaacgaactactcccccaagtatgaaatatcatttgacaggttcaaggacctctagaaaccaagagaagactttggagcttcaagagacgaacgattcaagtgtcacatctgcaagtgatcgagagagtcaagatcaagaacaagacataaaggacatggaagagctcgaagacgttgattaagctactcaagaggaactccagaaagacccctacttcaaggaaccaaccaacaaacgagcacaagacttgactccagaagtacctcaagaagtactacaggaagtgactcaggcgacatgggcctaaaacgcatctaggtaaggtttattcagtttatattatctttgcaggtccacacagcccagacaacggctagaatcgttctcaatcgtgctcctcaagagaacttaattagtttccttattttagcttatttctttcttaaaacaatggtttttgtgttttgatttaaatttgtttccttttgcgtttttacatttaattttggccttagggatagctgatagactcttataaagtccccctgcaacagttgaacgatttttcacctttgattatcaataaagaaccgcattttctcacttcttctctttaaatgttcttaagagaataagcttgttctttgtcttgtgtgtgcaattcaccaaggccaagttcgtgtactgtatcagagacttatcacatctctgtggtgtacttcaatccgccagcacttcccctctaatagatcccacacaagagaaccgatcgccatcatgttagatctccatcttcgaccatctttccttcacaagagagaagcgaccgccagcttgtgaagccaccatctctatcagatacaagctcaccaccgagtcttgtatcatcttggtatcagagcgcagttgcacttcctttgccaggtttcatcgtttcttatagcctggcttactttctgaatcagtttctacattagtctagtttctgttttatttaaattaaaaaaacaaaaaacaagtatttcagtttcattttatttcgtgttaagtatttgtttttgagtttcgtaatattaatcaaaaaaaaatatatatatatatattgttaactttgtactacatcagcaagtgtgtcagaaagtgattcaacaagttttaggtttcttggttttgatctttcttttctattgttgtggtacgttgatttctttgttgtttttgtctaagcacatgtcagttttaggtaatactatgggagaggcagcagaaattccccaaaacaccgtaatgcaaatgatg

SEQ ID NO: 15358 - DNA, 3000 bp, Unknown
  misc_feature (1)..( 3000): cDNA_ID_1810061_gDNA_ID_2926130_Annot_ID_138742 3000 nt of promoter + ATG
tagagggttatgatttgttctgccgcttttgatatagccttctttgatttgagcaacacacgcatcattatcttcatataatcttgttgctcctttttgatgatgaatctacttgctttttgaatatggttagtcatggatctaagccaaacagattctctacacgcttcatgaagagcaataatttatgggtggtttgatgaagtggcgactaaaatctgcttttgagaacgccacaagttgcagttcctccaatggtaaaaacatatctggtatgtgatctagacttatgagggttcgataaatacactgcatctgcaaaaccaactttccaaaactcaaagtttctaagataatataatcctaaatcaatagtactttgaagataattgaagatgtgttttattgtaagaatatggagctttaggttgcaagaatgggactcttgattaagagggttgagagtgagaaatgaacataaggaagagatagtattgcggaaatagaagagagattgtgagaaaagagattttctctatttctttattaaaaacatacataagatacaagctatatatggacattaggtaagtaaagatctcctaagaatatgctaaacacgtcgcactctatacaagtccacatcgtgtagacaagtcactatcgtactaagaaagagacatgacctaacgttcagtttgctttaaacacatgcgatcttcttttgacttgggcgcttaagcttcaacggctacatgaggagtcttctaggtcttctagaagagcttaaggtgaagaagagtttatatgggcttctctcattgtgatgttgtacggatgggcttctcttcctccgtatggtcgtctagtttaacttgcggaaggggtttccttcattaggttcaatactccccctcaagcttaaccggagatgagtcgagattaagcttggaaccaaattcaaccacctcattaaaaaccttggtgtagaaaaacctctttggataaaactacacacaagggaaaaagagtatgggatatttgataagaggatcatggcctggttagatcaactacgccaagtttgttgtgaatatattcacacaccttggtgctcgctcctttggtgaagacgtcgactaattgttcctcactctcagtgtaatgtggtaggatcactccgagttgtacttgttctcgtactttgtggcagtctacttcaatatgctttgttctctcgtgaaacaccgagttagaggcaatgtgaattgcagcttgattgtcgcaatgcattggaatggggtttggtgtatcaatgccaaagtctttaaggagagctttcaaccacatgagttcagtagtgagctttctcatggctctatattcggcttcagcacttgagagagacactactttttgtttcttgcttctccatgttactaggtttcctccaatgaaggtgcaatagcccgttgtagaacgcctatcttgttgatctccggcataatccgcatcacaatatccaacaatctccgtgtttctattcatcccatccaaatgccttgacccggagctcctttgagatatttgagaatgtgattcaccatgttccaatgatgtattgtgggagcttgcatgtgttaacttactacattaacagcaaacaaatgtcaggtcaggttatggttaagtagataagtttaccaacaagtcttctatatctcgtagcatcttcaaatggtttgttatcatgctccccctttcgtttggccttgtaatcgtcctctagtggagtcttggccggttttaccccgagtttacctacttgggcaagaagatcaagtgtatatttcctttgggataagaagagaccttcctttgatctacaaacttctatcccaaggaaatattttaactcaccaaggtctttaatatcaaaaacacttttaagaaaagtttttgtatcttgaatacctaccttgtcattcccggagatgataatatcatctacatatacgagaatgactactatacctttttggcttggtaaagtgaagagagtgttatcggcttcagacgttttgaaccctcttcccatcaatgtggtgctgagtttgtggtaccacgctctcggagattgctttaaaccgtagatggctttcttaagcttaaagactttattgggagcattaatgacttctagacccggtggtggcttcatgtacacttcttcttcgagttctccttgaagaaacgcattcttaacatccatttgccaaagatcccactcgagattggtcgccaaggagagtactactcggaatgtatgtaactttgcgaccggagcaaacgtatctagatagtcctccccatacgtttgagtaaatcctcttgccacaagtcttgccttgtatctttcaatctccccatcactcttatatttaatggtgaagacccacttcgaggtgacagttttcttacctctaggaagctcatctcggctgcaatagcgtccctccatacttgatgagttatagcttcttcataagtgtgagggatccaatgttggtctacttttccaagaaagacttgatgttcttcgggtagatgagctagggtgcacacagcttgaattgggtgttccacggcattgtcaacgtagaattgggtctacttttccaagaaagacttgatgttcttcttcttcttcttcttcttcttcttcttcttcttcttcttcaagctctttgagcagattcttcttctttgtgttagtggattaccggatcgaatctggtcccagacgtaggcttaatcatatcgattagctgaactgggtaacaaatttacgtttttcgtttattgcttttgattttgttcttgagttgagattcaacgagtttaaagagagaattgaatcagagtgattgtgagcacgaaccgtaacaaagtggtatcggaacgttggttcgaaagattcgctcgatggtaatgacgatg

SEQ ID NO: 15359 - DNA, 3000 bp, Unknown
  misc_feature (1)..( 3000): cDNA_ID_1829882_gDNA_ID_2926131_Annot_ID_138746 3000 nt of promoter + ATG
ctcagaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatgagcaagaaaaatctagcgattctgttgcgtgctagaatgagatccaacaatccctccaaattttccctctctcaatttcctgtaagcttttctttttctctgtttgaattttttggataattttgcgattctgtccaaattcacacaatttgtaatc

SEQ ID NO: 15360 - DNA, 3000 bp, Unknown
  misc_feature (1)..( 3000): cDNA_ID_1841673_gDNA_ID_2926131_Annot_ID_138747 3000 nt of promoter + ATG
ttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctatggagtcatcttcttcactccttcatcactcttacctctcttaccttaatccaaaatttggaaaaagacctttggtttcttatccattaatgcagagttcgcgaaaatgcaaacaaactcgcatttgttctaacaagatgtatgttcccggtatgtaacaatatgacatattcatcacaaaatgtggtttttattcatacagaattgttctatatagattaatgcctatttttctaatgttttttttgttatataattgaattaggctttggagaagcttcaccggaggctaaggcagcgaagcatcttcatgacttctttacttacgttgcagtgaggatagtgtctgctcagcttgaggttgatttgacgatttatttgattttttaatttaggtgttttgattaataataagtatgatctatatattaattaatgacagagttataatcctgaggcttatatggagttgagagaatttttagatacaaactctgtaagtgacggtgataaattctgcgccactctcatgcgtcgctcttcacgtcacatgaacttaggtaccaaaaataacacctttatatcaataatttggttataaaattctagtatgcgttttctttttgtgaaacttgttagttggaattttaattctaggttcttaaagttatacattatacttttttaacaaatttggttttcttctagtaatttagacgaaatctctttactttttccaaacattcttttcgtacattggaagttgaaacttctcactaaaataactagttatgggagttcggtttatatattcggtttcagttatatccattcgcttatcgtttttttttttgttttaaagtttagtatcccttcggttaatttgaaagttcggttcggtttcgattatttcggttttaaaatttagtatccatccggttattttgctttaaatatttttggatatttcggttattttcggatatttttggatattttcggatattttgagatattttttttattatttttgaatatttttactattttatatatattctcaagtatttttaattatctagtctagaaataactaatacttttgtaaatatatatttatattttagatatttttggttactcaaaatatttcggttggtatccattcggtttcagttatttcgattataaaattttgtatccattcaattagtttctggttatcggttctgtttacttcggttttggtttggtacatctggttcgggtaatttgctcaggcacaaaactaacagtataacacaactaatctgtgcaattcttgtaaagaaaaactacttcaaaaattgcgtgacgaaatacaattccaccaatttgcggattactaacgaaatcactttgtagatccataagtttcgtatatcttttaggtatacatatacttgatatgagataagtaaactaaaaactttgctttttttttttggtatcatggccaatg

SEQ ID NO: 15361 - DNA, 3000 bp, Unknown
  misc_feature (1)..( 3000): cDNA_ID_1829886_gDNA_ID_2926131_Annot_ID_138748 3000 nt of promoter + ATG
atttacaagaaatgttattgacatttattattatcaaataattaatattcttaattattagcatttacttatctaatatatatccatcaattctaattacttttaaaaaggaaaaatgttaggattttattaacattataatttattaaagataaataatatagttatttaaaatttataaaatatttaggatatttaccgaaaaatgtttagaatatatataatatatgaaatgtattaaattaaataaccatttcaaaagaaaactttaaattgaattgaattataaatcttttaataaaaatattattagaacaaaaaaaaaaaaataatgtttaatttaccgaactagattagatggagagacggatgtagaatattataatgtatgacttttacaacaattaaataaccatttgaaagaagatttttaaattaatttgaattatatatcttttaaattaaagtattattaaaataaaataacaaaaacaaaatgtttaatttcagtgaacgagtttagatggtaggacagatttgggtcgattgtaatacgagatgatataccaagagtgaaatctattagatatgtttagtttcagtgaacgagattacatggtaggacgagtttgagttgatagtaatacgagacgttataccatgggtgaaatcctagatataacaatcaaaatataattatattatcttaaaaacttaacaaaataaatattattaataaaataaacataattaaaatttaaattatttaataataatctagattttaacttaatgaactgtacattattgttcctatatttttaaacagtaaaaatcaaacatagtaagagttatacattcagaaaatacaaaacattaaaggcaaaaatgcttaaaaaatcccaaacaaattttaatttggaagtttaatactcaatacttttggattgaaataaaaatacatcacttaataaattgttgccaaataaaacactgtattttaattattggtcgaatcggacatataagttaacagccgttaacaggcttaacaaattaaatttttatttgtaaaaaaccaaaatagtcccgcgatattcagcggattaaaatctagtttcttgtaaatattcaattcaaacccccaaaaaatacttaatttctttcaaaaatgatttttcaacatcttaaatgtgtttccactctcaaaaactatcgctgatccactaaatttcatatccatccaaatccaagttttacttttacttaaaagcgtaatttactaaaattggtgactcccactcccacatttgatcttaaacagctttatattctcaactttcccctttccataatttaaaaatagatcttcttttacattgagaatcagcatgattggagatggctagtgggcataaaatgttaggaatagaccacataaataaagcataaatcatataattataacaataccttttattggtaattggcatacactttcaagtttatatttggattatttcattagcttttttaaaattaaaatgtagaaaaccacttcctacaattagaagaattttattttaaaatctacgacaaaagaaaatatgttccttttcaatcattctacttaaatctttaggaccaggtttaaacaaacttcatgtcggtatgtctctcattgtcaagatctgaagatttgttttttttttttttgaaagaaagaaagaaagagacaaaacttcaataatttacattttttattctagatgaataaggagtgaaaattcgggtaagcgggtcgggttcagataaaatttgatcggatacggattcttcggttaaaaatgtttaggacccaataggataaatctaaaatattggttcgattttggttcaggtccaattggatttgggttggttcgatatagattttcaggtctttttttaaaccgatactcgaattttcgggtaaataccagaactttcggataaaatttcggatttttgattaaatttaaattttcgaataaaaattcgggtatatttggattcggatcggattcgaattcgattttttggataaagaaatttagaagtcaataaaataaaccttccggttgatttaagttcagataattagattttttggataaagaaatttagaagtcaataaaataaaccttccggttgatttaggttcagataatcagttccggttttttttggccaggcctactgatgaactgttattttggtaacttctaaatatcaaaacggtcctgaatcaggactgataaaacgttaaaaaagaaaaaaaaaagatctactcgtcttctttgtttgttcgttacagtttttacaaaaaccgacagacactttatctcaagagactgggtcaggcctctgttcaatctctatcaaaatccctttcgacatcattcataaacactgacgaatcagtgaaacaatatctcaaacccagaaaccaacaataattcatagattactactatacaaaattctatataactataatctgttctcttgtgtgtttctcgcgtggcttgcgtgttacttcattcatcactgctttagcttctcctcatatgaatctcgaggcaatccagtcactgacttttctcactccccatctctagggtttctctctttcccttattttataatttatttcattgaatctctgaatttcattctcttttgtggagtacatttgtgtaaagcttagatttttatttgggtttcaagcaaaccgagaaaagaaacgattagatctcctttttctgggtttgttctcaaagatttgttctgtttcagttcttccaatttggggggattttatgttggatccagtctctaaaggttcgattttgatgtgtttccttgatatgtaatcagatttgaatcttaaagtttctatctttatgactcctttcaggttaaaactgtgagcatttggagtagcaaaagtaacaaagc

SEQ ID NO: 15362 - DNA, 3000 bp, Unknown
  misc_feature (1)..( 3000): cDNA_ID_1829890_gDNA_ID_2926131_Annot_ID_138749 3000 nt of promoter + ATG
accattgaaggaattgagaaagttgcaccgttcttgaaagtcattatcgaaaagtgagttctcttgttctctaaaattgttccattcttcatgacattaaatatgaggaacattttgactaacagtggacctttttgttcacagagatttcataaaatcgctgatacaaggtttgctagccggtattgcgttgaagcttttcctcatctttctgccagccatactgatgaccatgtccaaatttgaaggctttacttcagtttcattcttagaaagacgatccgcgtctagatattacatctttaacttagtgaacgtctttcttggaagtgttatcgctggagctgcgtttgagcagcttaactctttcctcaatcaatcgcctaatcagtacgtgactctctatctctgttaatctttcgttctttttgggttacaggcttttctaaggactcttctttttaaaaatctgtgcagaatccctaagactattggcatggcgataccgatgaaagcaaccttctttatcacatatataatggttgatggttgggcaggagttgcaggagagattcttatgttgaaacctctcattatataccacctcaaaaacgcattcttggtgaaaacagagaaagacagagaggaagcaatgaacccgggaagcatcggtttcaacactggagagcctcagatacagctttacttccttcttggtcttgtctatgctcctgtgacaccaatgcttcttccttttatcttagtctttttcgctcttgcttatgtcgtataccgccatcaggtaaatgtagtttctttctctcctaaatttgatgaaactggctagtttgataacttgaaccttctgtttatttgttttcttattctcagatcataaatgtgtataatcaagagtatgagagcgctgctgcgttttggccggatgttcatggacgggttataacggcattgatcatatctcagttgcttctgatgggtttgttaggtacaaaacatgccgcttcagctgctccgtttctcattgctcttcctgtgattactatcggtttccaccgcttctgtaaaggccgtttcgaacctgcctttgtccgttaccccttacaggtcagtttcttctacgttatctagatttattatttctgtttagttcgatttttgtcactgtttggatcggttttacgagccccagaaatggcaaaatgttgattattttacaggaagctatgatgaaagatacattggaaagagcaagagagccaaatctgaacctgaaaggttacttgcaagacgcttatattcatccggtttttaaaggcggtgataatgatgacgacggtgacatgatcggaaaattggagaatgaagtcatcatagtgccaacaaaacgccaatcgcggaggaacactcctgcaccgagcagaatcagcggtgaatcgtctccatctttggccgttattaacggtaaagaagtctagtttaacggtttcaattcagtaaaagcatctgcatacgatttaagtatgaatatagttcgtgtatgtatgtacttttatgtgtacatagagaggtttgtgtttttgcttagacgttgttgatgggttttaattgttgaagtattgaagtttcagggtatttttagaataatatcattttaattgggtgtttttcaaacaatgaatttgtggcaatcttgccaaacaaaaatatacgaaatggtcgaatagttgaggcggttagggcggacaaattcatttgcgatttaaaccatttttgtgtacctttcataaactatataagccatgctagtgtaggttgaaaaagatagaacaagttgaactacagaccggttttacttaaagttagtccgtggtggtttattgtccgattcaaaaatagagtggtttagtcgattaacggattagtctgttttctcatgtcatccattgaaagccgaagagtttgtagaagtaaacaaaaagatataaacaataataaaacaagaattgcataattttgtattcaacagaaattataaaaaaacttatagaaagccacattacagtacaagaaatcattcttatatctaataataggagaagtacatgatttttcatcccaaaaaaaaaaaagaggtacatgatttacacctcgtcgatatcctaacgattaaaaaactgtaactactgattttactacagtatatatgtatcgacaacataacaatgtcgtgacttatatactgttgagctcctaagaaaaaaataacgctattattgatttcacaatagtagcaatctcaactccatagcgaatgacgtagagaaatgtaaccaagacattttttcagaaactatgatcgatatatttcaagaaaggtagacaaaaagtgagaggctattatgtgaatgaagtaaaaaagtagaactattgaggctaatttatagagaatgaattgtaaataagcaatgcgatgggctgcaaactcttctcgtaaatctgcaaatttattaagacagtgcacctaaatattaatgaagagagttaatgaatcaataaatttgaacatcgtgacttgttaagtttggtgagaggggaataaggaacgttctatatgtaaagcaatgataattaagagttaaggagttcatagttcatgtttttctctagtttggacttgagtccaaaatccaaattaatccaaaacaatgttgagcctaaactgtcccaagactcccaacaactcaggaagctcttgctgttttccttttaatcattgtgatattacattcttgatcgtcccacagggaaaatattttagccgttagaccaaatgataaaaaactgtaactgttgatgggaacggcgtcgtttcgctaaccttcgttttaactgatctcaattctcaaggttcaaaagagtacacacacacttatctcaattatccactgaaacattcgtctccggcgaaacaaaaccaga

SEQ ID NO: 15363 - DNA, 3000 bp, Unknown; identical to SEQ ID NO: 6120
  misc_feature (1)..( 3000): cDNA_ID_3079603_gDNA_ID_2926131_Annot_ID_196954 3000 nt of

SEQ ID NO: 15364 - DNA, 3000 bp, Unknown; identical to SEQ ID NO: 6121
  misc_feature (1)..( 3000): cDNA_ID_1830072_gDNA_ID_2926131_Annot_ID_196953 3000 nt of promoter + ATG

SEQ ID NO: 15365 - DNA, 3000 bp, Unknown; identical to SEQ ID NO: 6132
  misc_feature (1)..( 3000): cDNA_ID_2139509_gDNA_ID_2926131_Annot_ID_196950 3000 nt of promoter + ATG

SEQ ID NO: 15366 - DNA, 3000 bp, Unknown; identical to SEQ ID NO: 6127
  misc_feature (1)..( 3000): cDNA_ID_1830092_gDNA_ID_2926131_Annot_ID_196947 3000 nt of promoter + ATG

SEQ ID NO: 15367 - DNA, 3000 bp, Unknown; identical to SEQ ID NO: 6126
  misc_feature (1)..( 3000): cDNA_ID_1009437_gDNA_ID_2926131_Annot_ID_196945 3000 nt of promoter + ATG

SEQ ID NO: 15368 - DNA, 3000 bp, Unknown; identical to SEQ ID NO: 6125
  misc_feature (1)..( 3000): cDNA_ID_1830100_gDNA_ID_2926131_Annot_ID_196944 3000 nt of promoter + ATG

SEQ ID NO: 15369 - DNA, 3000 bp, Unknown
  misc_feature (1)..( 3000): cDNA_ID_2138640_gDNA_ID_2926131_Annot_ID_196932 3000 nt of promoter + ATG
attttaaaaattagggatttcgcttaagtttggaatgggttttgggtcgttgggcatggatcttaattggatcggatactttgttgggtcgtctgggtttttggtcttttgccaattatttgaattttctctcatttatttttaattcgataaaaaatgggaattagaagagtggcattcctggttactttttcgcagatagtggcattcctgccatttattcgttcaattccgtgattacaccatttctctctaccaacaggtttcaattctacaaatcttcaaacccaattcattcaaacgtctttctttagctaatatagatcagcgatactagatttactcagattcatgattaaagtgaagaaagtgtgaatctttatgtgtgaaattgttgtggttcttacaagttatgatttctagggatttgaattgtgtaaaggtttgaacttcagattcatgtgtttgttttagtctgttagatcattgttacaagttatcatttttagggatttgaattgtgtaaaggtttgaactttagattcatgtgtttgttttagtcgtttagatcattagtttggtttttgtttttgtgaaggggtttttggatgatcagtttactgaattgaagaagcttcaagatgatggaagtcctgattttgtagctgaggttctgtctcttttctttgaagattgtgttaagcttatcagtaacatggctcgagctttgtaatttcgatctttctcttatctcactcataatttttgttagatcatcattgctttgtgttgtcttaaaacttcttaaaactgtgattgtgtctcaatcacaaagtctggctagaatcatcattgcttgtgtatataactcagggataagtcgacgggaactgtagattttggtcaggtaggtgcgagtgtgcattaattgaagggtagtagctcaaggtatgttttgtgtctcgcttatatcctaataacaatcaagaagtatactctgtagtagcagaagttctgtgttgttgatagatgaagctcttctcttgtactcttgtttttgatagatgaagctcttctcttgtactcttgttttcgatacagtgttggtgcgaagagggtcaaagctttgtgtgttagcttcaaggaatattgcgaagctcagaattacgaagggtaagcttgttcaacaccgcttaaggactcatcggttgagatgtttgcagcaagtggatattgagtataagaccttgacgacaaagcttcaagatatgttcaatgtgagtagtgatgacatagaatccaatttttggttcattttatgaatcattttgttgactaatgaacaaatttattgccattgttgttgttattgcagcttgagaaacaaatcattcaagctggtggtagagttcctcaagtggatattaactaaagagagactaatccataagaaacaagatgatgacttcaaatttggattgttcagtttctccttttttaaatttattttggattttggtgttttgcttaaaaactcaatagaatgtgtggaaaaaaagagacaagtgattgttgttgataaattagtagtgtgtattggttctttgatcttattcgagaaaatttaacatctttggaccaaattaatgtgattgatgatatattggttttgcttctggttttagtttgagtaagatatagcaattaccaagtgagtcttttttggctagtggtgcttctaggactctccaaaggttgtggtttttaagatccttagttcgattctctcttggaataggtaggtatgtccatttttttggatcgcaaatccgtcctgactcgtatccgtcccgaatttttcatcccattcaaatgattatttgtttgggacaattaaatatgttctagcggatacatgaacggattagataagagacaaggtatccgaattatctttaaaattttcaaaatatttgtaacaattttaaaattattcaaaagtttcccaaatttgtccatgatttatcatagttttccgaaattatccatttgaaccttactcaaattagtgaaagtttatgtgaagaaaacttaaaagtaacggttgcttgaaaaagaaacaagcacaaagaaatttgatcaccgagttcacgacttagccgctatgttccggggaagatttcttgctccccactttcactatgagaatgaggttactgacaccacttaaagtgtgatgttgtcttttggtttcagatacaagcgatagaagaaccaagatcaaagacacaaagatgataaagaacaacttgctcaagaagctcgcgtttctctcactcttgttctatatacctaaatttctcgaacctatattgttatctgaatttttcgtcccgtattttatgaagaatattttggaaaaatatgattgattatccaaattagctgctctaattacatgttacttcctatctcgatatccaaaatagacaccctagaaaaaatggtgattcattcacgataaatcacaaacctgattctaatcaatgtagattagaagtccaaaggatactctccaaaaaaaaattaaaaaaaaaatagtgattagagggagcacaaagataaatgtaaacgcgagtgtagaagataactatctctttacaaatagtctttataccttccgcaacaagtaattgttctcatcagtctctctatgagtaaaaagctaagcgaaagcgagactccacactctcagcgattcaggcgataatacctaaactcaagtaagggtttttactctggtaagctaatcaacgctctcatctttaacaaattgcgacctttatatttctctcttcttatgattcgtcctctatgttctcaaaatagcttagaactttttacaaatttcagactttcttgtaatgattcttatgggtttaaacgtatttgatgatgaataggatttgctaaggatttggggatctttgttcggtttca

SEQ ID NO: 15370 - DNA, 3000 bp, Unknown
  misc_feature (1)..( 3000): cDNA_ID_3088139_gDNA_ID_2926131_Annot_ID_196925 3000 nt of promoter + ATG
gtggctactttaggatgctttctcctaaattatgcatacctaatgttgaactcagtcgcagtataaatatgagctaattccataaatttggccatacctgcttctttgtcacctgccagcattttcttaatgttttgagacaaatgccatacacaatgtccatgtgatgcctttgggaacacatccgcgactcccttgatgatgcttccatgtctgtcgcttatgaaaaccaattccgggtcatccggtataatggaattcaactttctgaaaaaccagttccaactagcatgattctcgctatcaattacaccaaacgcaatggggtaatgatgatgactaggatcctgagctgttgctataactaacatccctccatatatggttttcagaaaagttgcatcgatcactataactttcctcattgccttaaacccttcaatgcttgcgcccaaagcgatgaataggaacttaaaatgtgcagataagcaaacaataacttgtagctagtttcagggctcccacgcacatcactaacatgtttttttttcctcttaaagctgtggagtatgaacaatccaaaccaagtcttcctttaacaatactcattatttgtttaggtttcggagtattaagaagacccggatagtcctcatgcaacacatctgctactaatcgcggtgtgcctttttgtttttcatatctagttgcctccggacaccgagagcatttatgtatttgtgtgtttcttcacacaccaaaaatctgtctcagaagtttttgtaactcttaaataccaatcacaacccttagatgcttgactgcattctaacataagacggcccgtgtcagatttaatagttttcacaccaaacacttcctctttcgaagctctattaatcaaatcccatactgcctcctttgaacgaaattcttgacctactaaatcaccaataccatcttcccattctttgacaacggcagccacactttcttgtaccggacgtgcaagatgaacatattcttccctaacataatcattatcagaatcttcattaaccccacactctatcatcaacggttcaataacagttttagaaactccattctctagcatcataggttcactaactgtctcacgttgttcctctagttcaataataggttcattagtactcagaattcctgtatttgcatccgcaaccattacaagcttggcagccaattccccaaaattcacaccgcatgaacttcttcgctctactattggaacttggctattattactttccaaatcactgcataactctacatgcaaaacaggtctaaatccctctttatccaatgacgttaaatatatcaacacatcctcattatctacaatataagactctctacatgctttagatatcttgtaactcaatttcagattccttctctcaacacctagagcaatctttctacagatcttatctattaaatccgcatatgttattctctccaaagatgatgtcttaaacactataccgtatattgaatttttgcaactccactcatggtctgctgtatagtaccctccatagtcaaagtgtaggttcgtctggatcctcttcttcatcgcctcctacaaatataaacaatatattagtaccagttgaaccacgagatggaccagtgtctgattcaatttcagttcgtccatggtttgatgctgcttacacattgattcaattcaattacattgtactaattataatacttacaggagatggaagaactaaagaaggatcgtttccagattagccgcaacaaagatcgataaagaattcgatccaacagtaacgactcacgtagcacgcagcaccggagaaatcgacggccggagaattggattagctgacctagcaaacgctccccagactcgacggagccaatgtcgaaaatcgccgatgtcggaagttaatcggaaatcgcctatctcgtcggaattaaatgtcggctcgaattaaatgaattgggtcggaattaattgggttgggtcgggattgattatttcgatttcgattttgtttttgatttttcttttaaaattaattgatataattcattaagggtaaataggtattatccactacaagagtggcatgcagatcaaaagatggcacgccggattcaaatttccggttcagtggcattgttgatcaggactctcctgtaactgagtaatgagagcgtccatggtaagagagagtgaagcggagatttggagtaggcatgaccacggttaccgttattacggttacggtttattaaccaccggttacggtttattaatcaccggttacggttataaatatattttaaccttaaccttaatcgttatatatacggttatggttaaatacggttacggttaaatacggttatggttaaataccgttacggttatttgataattataatatagttaatatatgagacaaaatattatattttttaatctttataataaaataaataaataaatagtgatatatcaaataatatttattttacgtaattatgtgtttcaaatatttataatgtatcagctatctatttttcttaaataaaccaatgaataaacaaattaatggccataattataatgattgaattaattatattttccaaacaaaaacaatattaaagagaagatgttgtgagcattaagaaatagttttaagagtataaataataataatatgaactatttatgatttgatttatggtaaaaagagtagttgagtaacttcgatcgtagtagtggacatattaaacgatttcagttactattttagtgaaataattatttatttagaattatacacagttacaactatatttttaaggttttaacaatacggttaaccacgcggttaaccgtacggttaaccgacggttttgatacggttacggttaattaacggttatggttagtatattttcttaaccgtaatg

SEQ ID NO: 15371 - DNA, 3000 bp, Unknown; identical to SEQ ID NO: 15361
  misc_feature (1)..( 3000): cDNA_ID_1829886_gDNA_ID_2926131_Annot_ID_196920 3000 nt of promoter + ATG

SEQ ID NO: 15372 - DNA, 3000 bp, Unknown
  misc_feature (1)..( 3000): cDNA_ID_3088151_gDNA_ID_2926131_Annot_ID_196919 3000 nt of promoter + ATG
cccactagccatctccaatcatgctgattctcaatgtaaaagaagatctatttttaaattatggaaaggggaaagttgagaatataaagctgtttaagatcaaatgtgggagtgggagtcaccaattttagtaaattacgcttttaagtaaaagtaaaacttggatttggatggatatgaaatttagtggatcagcgatagtttttgagagtggaaacacatttaagatgttgaaaaatcatttttgaaagaaattaagtattttttgggggtttgaattgaatatttacaagaaactagattttaatccgctgaatatcgcgggactattttggttttttacaaataaaaatttaatttgttaagcctgttaacggctgttaacttatatgtccgattcgaccaataattaaaatacagtgttttatttggcaacaatttattaagtgatgtatttttatttcaatccaaaagtattgagtattaaacttccaaattaaaatttgtttgggattttttaagcatttttgcctttaatgttttgtattttctgaatgtataactcttactatgtttgatttttactgtttaaaaatataggaacaataatgtacagttcattaagttaaaatctagattattattaaataatttaaattttaattatgtttattttattaataatatttattttgttaagtttttaagataatataattatattttgattgttatatctaggatttcacccatggtataacgtctcgtattactatcaactcaaactcgtcctaccatgtaatctcgttcactgaaactaaacatatctaatagatttcactcttggtatatcatctcgtattacaatcgacccaaatctgtcctaccatctaaactcgttcactgaaattaaacattttgtttttgttattttattttaataatactttaatttaaaagatatataattcaaattaatttaaaaatcttctttcaaatggttatttaattgttgtaaaagtcatacattataatattctacatccgtctctccatctaatctagttcggtaaattaaacattatttttttttttttgttctaataatatttttattaaaagatttataattcaattcaatttaaagttttcttttgaaatggttatttaatttaatacatttcatatattatatatattctaaacatttttcggtaaatatcctaaatattttataaattttaaataactatattatttatctttaataaattataatgttaataaaatcctaacatttttcctttttaaaagtaattagaattgatggatatatattagataagtaaatgctaataattaagaatattaattatttgataataataaatgtcaataacatttcttgtaaataagttccaacttgaagatttatttgttaaaatggcagcgaaaatgtatatgtagaagatggagatcatatgttggtggttgctattagatgtaaaacataacgttgtactgtgaactatatgccatgtatttctcctccacaaaatctattctctggaaattaacctaaatttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatg

SEQ ID NO: 15373 - DNA, 3000 bp, Unknown; identical to SEQ ID NO: 15360
  misc_feature (1)..( 3000): cDNA_ID_1841673_gDNA_ID_2926131_Annot_ID_196918 3000 nt of promoter + ATG

SEQ ID NO: 15374 - DNA, 3000 bp, Unknown
  misc_feature (1)..( 3000): cDNA_ID_3079402_gDNA_ID_2926131_Annot_ID_196917 3000 nt of promoter + ATG
atggaggagacgctgcaaaattgctaataagggtttctagtttgcttagtgggggtatatatatatatataggatttgtgaatcatggctcgcaaatttcggagatcgccgctgagtagtggagaaatcgaagaaaggaaagtgaattagggttctaagtctcagaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagat

SEQ ID NO: 15375 - DNA, 3000 bp, Unknown
  misc_feature (1)..( 3000): cDNA_ID_3079398_gDNA_ID_2926131_Annot_ID_196916 3000 nt of promoter + ATG
ggctcacctgagagtaacgacatagaatgatcaaagaatgtggtcaacttacaatcaaagagacatgagtccagagaaagtaactaaccaggaacagatggatgaaaatatccaaagcatcgacggcctattcccaatcttcttttaagatccaagaggttgctgattggatgcaccgccttataaataatgcgttattagacaaaacttttaacattctgaaatagctgagattactataatggagactagtactgcatacctcatatgcaacaattttctcaagcaatgaagcaggatcatcccaagtaatttgatgaagctctaaagtggcaggactaagccacataccgagtttctccttcagaaaagaatctaatgttcgcaaagacggcgtgttctcttttctatacattagaaacaaccatcagtgtcagatacaaccggaaatgttttaccaactgattcgaaactatcttcaaatatttgagtttccagtcacataacaagaggacaagaaacattacgagagtatcgacagaagatcagctcggaggatggacaaaaatctcaaccctccaggatgtgtattcaacctctcaaataaaacttcatatgttggcctaagagcatgcctcagattcctctcaatgcgatagaaaacagaagataaagcccccttatcatcatcacctaaagaaaagtactcgcccatcaatggagaatgtaacgaagaatcacacaagaaaaaacaagaatggcacaagaatgactctcactagctggagtttcaagtccaagatattgcttaacaagttctcggacttgctctcggttaacatcatactccttggctaaaacaagcagtaacttctcgcggtcttcaagcgaaaggctaaagtaaccctataagcatttttaaccatatatgtaatcagattgaaaaggttaaacacatcaaagatcagaatcaagaaacaacaatgtgaagatagttttacctcttgaaaatcattaagagtaatgtctaatacaccagttttactagctgagatagctgagtgcattgtctctcgaacaacatcataaaccctaaaacaaaaaccaaactcactactgcaaagatcaatggtgctaaatcaatatctacaatgagaaattaccttccagtggtaccaaaatcattagaattttgcacaatgtgatctctagaatgattctcttgaggattagattgaatttccttctgacaacaaagtcaacaaaccattattatagagtcaaattagccttattatattcttatcttcttaaaaacattcaagctccgattaaagccatagccaatttctcactctctctctctctttttcatcaaaagatgtaaacttttcattgcccatgattacaaattgtgtgaatttggacagaatcgcaaaattatccaaaaaattcaaacagagaaaaagaaaagcttacaggaaattgagagagggaaaatttggagggattgttggatctcattctagcacgcaacagaatcgctagatttttcttgctcatatctgtttcattatgatcatcatcatcacggttaaaatttcatcggagaaaaaaaggaactcaggaagaagaaaaaagcgatttcgcaatcagacatgacaggaaccttaaaatctggccgttcaagtatcggaaaaaaaaatcgagactttgtattcccttttcaacggatagcgtaaaggcactggcttttaaaacggcgtcggttttactttacctgtcgcttcacttgccacaaaaatttgaataaatggcaggaatgtcactttctccaaaataataatcacgaatgccacttattctttataattttatttttttttataattaaaactgatgtaaatatccaaataactttttaaaaaattaaaatatacagatccaactaaaataatccgacccaagtacaataaaataattaacttggcccaaataatactatatttttaatatgtaaagtaacagttttatccaaatttaaaagcattattcttaataaataaaaacaggattcatatttagaagaaaaaaattaaaattaaataaattttgaaatataagtaatagatttttttttaaaaatctctattgataaattcgaaatgtatgtattattcgaaatatgttttagttgttgataacatttttaattatttttgaaataaatatagtttatttatctatttatattaaaatttaacaatttaatatctaaatatattttaaagtttatcacttaataaatatagtttatatatattattttaaagtttatcacttaatacatatagtttgaaataaatatagttttgaaataaatatagtttatatatattattttggacaaaattttgtttaaaatatttaagataagaattatcttttaaattatagttaaatcaaatattaacttatggattttttctgtttaaagttttaattatattaaattataatgaggttattttattaattttatatataaagtaggatatagtatttttcaaataaaaactcataaaaaaggcattttccaaatttactcatatcatacgcccgaaaaatcgattggaacttattcaattgaacaatttgaactatataagttgaactcgttcgattgaaccagatgaactagatcagttgaactatttgaactagatcagttgaaccatttgaactagatcaattgaaccaatttcagttataccattttattatgcaacaatggattggtttggggagcaacgcgattcagttactacattgtactgactaccattgcaaatatctaaacagccatttttgtttcgttcattcactttcttcaatcgagatctatagacagagtagaacaaacaaagcgcttgtaaagaaaagaagacgttgcgacggaagaaaaagcgaccgatgaaatatatgagtcgaccggagatg

SEQ ID NO: 15376 - DNA, 3000 bp, Unknown
  misc_feature (1)..( 3000): cDNA_ID_2138720_gDNA_ID_2926131_Annot_ID_196913 3000 nt of promoter + ATG
ataaaaagatagatgagttctcataagagattacaaggagtttataaagaaagaagtcttggaacacactcacaagactaccttggaaaatacagactagtttgaaagtttaaaaataacccttccacttcttggctccaaaatgactcttgatatgctattttcgtcacttctcttgaccagcaaattatccacttggtttggggtcttcttgagcttgtgatggtcataaaattggttggacttcatatatattacattgggccaacttctgaatgttataccattgtttggattatcaaatgggtgatttgaatgtgaatcatttgcctcattaaaaaccttgtcaagaaaaaccattgggacaaaacttgacaagggaaaaatagtacaaatgagacatatgcccatttgatgatcatgtatcaaaaccaatgaggttaagataacatctttcccatactctttctccgttataagttcattttctgtttcaaaatgctcctcaggttcaagctgctcctctgcttcaagctcttccgcggctacaagctcttgatcaaattccatgtcctttgtgctttccatgatcacatcacataactccaacgaatccactataatacgaccaacatcttcggtctacatgaagtctttcacgaattcgataaagttcttgtcttgtcagagttttaatataaatttaatagagatggaaattaattgatttcaataatttttgatttgactaaattaattgatttgattaagttttgaaaaaaaattcatataatcatattaccatctaatataaatatactaaactataatttaaaaaaactatagtaattttgtatatcttcaaaagtttcctttctcgttttaataaatgtatataaattttgattagtaaatactatcacaaccatttatttttcactaggttaggcccgcctaaataggcgggtttaaaaaaccaattataaatttttactgatgatatttgaattctaaatagtaaatgatacttcctatttttaaatatttaatttagtaaatttgcttaaaatcaaattttaatcttacaattttgattttgctgtacacttaatgactttaacggtattttattgatgaaaattaaattttaaatagtagtcaacacatatttttctgtattttgtttagtaattttctaaaacccaaaattttaatcttacacattctattttgctatcaatttaactatctatttcatcataatattcccgattttgattatgcacatattattttaatgaataagtgttaaattttatatcaaaataatatgtatatcatatcaaatcaatataattacttcatatgaaaataattaataaataacaaaacataatgaaccaaaaaaaagaaaaccacaaaatattttggaaaagaaaaattgtttaagatatagttttgctatattttataatctcataaattagttttacctaatgtcaaactcatattagatgacttcaaatttatgaataaaacattgaaattttatattaacattttcacaaataataaaatatcaatccctctaaaccctattttcctaatttttggtggtttctctaatgactacatgcattaaaattcttatattaaaaaataaatataactatacaaaaattcccagtgggtattcaaataaaatactatattaattgaaaatacaattttatcgaactaaattaatgttaaataaattattttgttattttatacttcagtgggttcttaattagttattatcattactaatggttttgtttaaattaataaatgctagattaatttaattgaccaatatcgcatgtaaaatcaaagtttttaattttatttttgattaataaaaattattatgtatatatatagagataaaaattagtgtatgtaaatttgtttactttttttaggtttctattttcttagagaataaaattttttaaatctttgatgacacatgtaaacatcttatcgttaaactttccatctatcatgatctcgtgagttagtaatttttgaaaccgtactttatataataagatttgtaaaattttctatgatttgattaaaatttaatactgatgttatgaatataaaaattaaaatttccaaatctccactccctcatcaaatctccctcagccttatcaaatctccactccctcatcttcactcccccatatattcacttccattgacattttaagaaaaaggattgtcaaaaggaaatggtatacattgttatattaccaaaatttgataacaaaatatagtactaaaaaaagaatttgttgtctgccttgttaaattttgtttttttgtatatctagtctatatatacatttttacagcacttttttgaagataatgttgaagatttgaggaataattcaacaattaattcaaatgggtgggttttaaccggtttaactctgtttggatcctagattgcataattttaaggaataatgttatcctgatcttggattgcagaagtttaaggaatatgtttcaatgaatattacctacaagatttcgtaaacataattaatattctcgagtgcaaatatattctcttatataatctttcaaaattcttgcaatctctacaattatgcaaataacaacctttgattcctaatatctcgatacaatatatatctcaatgacatcaatatattctcaaaatcttctgtgtaaactaaccaaggtttaaatccgtagcaaacttttcttttccctcccaaatcatcaaacgatctaatatctaatactcctattacaatattttcaatagatcttctcacacttgcagttacggaaaatctcaacaattattctcattaacataactagatcatgaaaattctgaatttaaaacgcaataagatcattttaatttaaaacttactgaattaaaaacattcagagtggatacaaatg

SEQ ID NO: 15377 - DNA, 3000 bp, Unknown; identical to SEQ ID NO: 6123
  misc_feature (1)..( 3000): cDNA_ID_1830120_gDNA_ID_2926131_Annot_ID_138755 3000 nt of promoter + ATG

SEQ ID NO: 15378 - DNA, 3000 bp, Unknown; identical to SEQ ID NO: 6124
  misc_feature (1)..( 3000): cDNA_ID_1830108_gDNA_ID_2926131_Annot_ID_138758 3000 nt of promoter + ATG

SEQ ID NO: 15379 - DNA, 3000 bp, Unknown; identical to SEQ ID NO: 6125
  misc_feature (1)..( 3000): cDNA_ID_1830100_gDNA_ID_2926131_Annot_ID_138760 3000 nt of promoter + ATG

SEQ ID NO: 15380 - DNA, 3000 bp, Unknown; identical to SEQ ID NO: 6126
  misc_feature (1)..( 3000): cDNA_ID_1009437_gDNA_ID_2926131_Annot_ID_138761 3000 nt of promoter + ATG

SEQ ID NO: 15381 - DNA, 3000 bp, Unknown; identical to SEQ ID NO: 6127
  misc_feature (1)..( 3000): cDNA_ID_1830092_gDNA_ID_2926131_Annot_ID_138763 3000 nt of promoter + ATG

SEQ ID NO: 15382 - DNA, 3000 bp, Unknown; identical to SEQ ID NO: 6128
  misc_feature (1)..( 3000): cDNA_ID_1830084_gDNA_ID_2926131_Annot_ID_138765 3000 nt of promoter + ATG

SEQ ID NO: 15383 - DNA, 3000 bp, Unknown; identical to SEQ ID NO: 6129
  misc_feature (1)..( 3000): cDNA_ID_1830080_gDNA_ID_2926131_Annot_ID_138766 3000 nt of promoter + ATG

SEQ ID NO: 15384 - DNA, 3000 bp, Unknown; identical to SEQ ID NO: 6136
  misc_feature (1)..( 3000): cDNA_ID_1830076_gDNA_ID_2926131_Annot_ID_138767 3000 nt of promoter + ATG

SEQ ID NO: 15385 - DNA, 3000 bp, Unknown; identical to SEQ ID NO: 6121
  misc_feature (1)..( 3000): cDNA_ID_1830072_gDNA_ID_2926131_Annot_ID_138768 3000 nt of promoter + ATG

SEQ ID NO: 15386 - DNA, 3000 bp, Unknown; identical to SEQ ID NO: 6111
  misc_feature (1)..( 3000): cDNA_ID_1830057_gDNA_ID_2926132_Annot_ID_138771 3000 nt of promoter + ATG

SEQ ID NO: 15387 - DNA, 3000 bp, Unknown; identical to SEQ ID NO: 6112
  misc_feature (1)..( 3000): cDNA_ID_1830049_gDNA_ID_2926132_Annot_ID_138773 3000 nt of promoter + ATG

SEQ ID NO: 15388 - DNA, 3000 bp, Unknown; identical to SEQ ID NO: 6113
  misc_feature (1)..( 3000): cDNA_ID_2997065_gDNA_ID_2926132_Annot_ID_138775 3000 nt of promoter + ATG

SEQ ID NO: 15389 - DNA, 3000 bp, Unknown; identical to SEQ ID NO: 6114
  misc_feature (1)..( 3000): cDNA_ID_1381119_gDNA_ID_2926132_Annot_ID_138776 3000 nt of promoter + ATG

SEQ ID NO: 15390 - DNA, 3000 bp, Unknown; identical to SEQ ID NO: 7845
  misc_feature (1)..( 3000): cDNA_ID_1989575_gDNA_ID_2926132_Annot_ID_138780 3000 nt of promoter + ATG

SEQ ID NO: 15391 - DNA, 3000 bp, Unknown; identical to SEQ ID NO: 7846
  misc_feature (1)..( 3000): cDNA_ID_1989574_gDNA_ID_2926132_Annot_ID_138781 3000 nt of promoter + ATG

SEQ ID NO: 15392 - DNA, 3000 bp, Unknown; identical to SEQ ID NO: 6111
  misc_feature (1)..( 3000): cDNA_ID_1830057_gDNA_ID_2926132_Annot_ID_196966 3000 nt of promoter + ATG

SEQ ID NO: 15393 - DNA, 3000 bp, Unknown; identical to SEQ ID NO: 7851
  misc_feature (1)..( 3000): cDNA_ID_1989573_gDNA_ID_2926132_Annot_ID_138782 3000 nt of promoter + ATG

SEQ ID NO: 15394 - DNA, 3000 bp, Unknown; identical to SEQ ID NO: 8147
  misc_feature (1)..( 3000): cDNA_ID_2105982_gDNA_ID_2926132_Annot_ID_196993 3000 nt of promoter + ATG

SEQ ID NO: 15395 - DNA, 3000 bp, Unknown; identical to SEQ ID NO: 8148
  misc_feature (1)..( 3000): cDNA_ID_1810562_gDNA_ID_2926132_Annot_ID_196992 3000 nt of promoter + ATG

SEQ ID NO: 15396 - DNA, 3000 bp, Unknown
  misc_feature (1)..( 3000): cDNA_ID_3088190_gDNA_ID_2926132_Annot_ID_196988 3000 nt of promoter + ATG
tctttgtttttatcatgtcatagtttatgatgactatgattaaatagattaaaatgtgcattagtttacacgtactattttagtatttttatagtctaatagttcacttacgcatttttgccaaacttgaatttggcttgcgacacatcaaacaaaattatcagaagtgggtcaaatatttgaatcgacctgaatgtcacattattccaaacggtatatattattgtacagagtaaaccaaaaccctactaaattcgatttcgtgtgttcataagttaatgactttttttttgaatttaacatattaaagatacattaaaactattaacttaaattcattattttaagtaaattttgtctataatcgaagtaaaagtttcaagccgtatcgaaagaaaaacttaatatttctaatctagtaaatctaaaatccgaaattcgaaataaaccaaattttgttttaaccaaaaaatttattttctttttttttgtcttcaacataatttttaaccaaacaatctaaaaattataaactgatctttttgtacaaaacaaataaaagatttatctttctctcatcaatcatgtaaggcccaattaaagcctcgagagcagcccaatctcagacctcaaattatatttttctgatattttaaaaaatccaaaatgctcagaattcacaacttttcgaaatttccaattccatcatattcaattgacaaaagacagtagaaattgatgaaactgaaaattccaattgcagttctagtcaaataaaaccttgtctaagagcatcattaaagggaggatattagggagtttttaggtttataaatcattaaatttatatgttaattgatcaattcagtttagaggtggtttaagctaagagatgctcttaagcaaaatgcggtggtgacatggaataatttggttggttggaagaaaaatattaaacaaaaaaacatttttttgcgtttaattatttttctcccctctttctctctttcctcgcgattgaaggtaggaagcagaagatctccttaaaatcgatatggccgtctcgcgttctccggtcctgtgtttattagacccgggcgtcctcccgatgttagctctcatctcaaccgactctggttgtccacgaccaaatcgacgagaaatcaatagttaaactttatgtttacatgtatgtttaaaaaattattatgtcatctattgatcaaatttaagttcaaaaaaatttaaaaatttaaaaattaattttttaaaaaactccaacttaatatactactattgaggttgctaaaaaattaaaaacttactaaaactcttaacaacaaaatttcaaaatttattcattaaatatgattaatatcctaccattgaggatgatctaatcttttgtacagaagaccgcctaaactcacaaaagacgttgccgtttgtatggtatccattagttagcaccaaccctctttctctaacgtgaattttctggctcaacttcaactacagccacttctgcctcaacttcaactacggcgacttcaacttcaactacaaccacttctacctcaacgtcttcctcttcctatgggcttcctcttcaacaacgtcatgtgaaacctcaacaaaatcctggttctgcacctcaattaaattatgattcccaccacctccgttcccccaccacctccattgatgttgccatccatataaaaaaacaaacataaccaggcaaccacatgcgaacatcttgcacaactgctcctttgttatgatgtcccgtgttcactgaccaagcatttgctaaactaatcagatggttccatctagatgctgataggcggcacaagacaatcaagaactgttcttgttcttaatcagccattctactgaaccaaaaagtcaaaaatcagcatataaaacacggagataaattgatttaactgaaacaaacacaagtccacaatctaattgtcatgactgaaacaataacccgtttagtatacaactgagttttgacaattcccagacgggaagtaaacatataacttcacggcgtcgttgatggttacgtaagagtaatgattcagtgcggtgcatgtgcatggtatgaaagaagagttattgtgttttttttttagattttgaaaattaccttatttttaagtttttatttgaaaaatatacatttctctacttttaataaagattaaaaaatttaatatgtaaatgacaattttgtccaaatttaaaagaaaagccacattctttataaattaaaaacaatattcgaaatttaatattttaaagtctatcacttaatatttttcacgttataaaaaagatcaatctttcatagattgtttttcctttatcttttttgttcttggacaattttgttttaatatttaaaataaaactgttatctttaaaactgttagttatcagatattaattcatgagtttttctgttttaattttatattcttttttattattaccaaatattaattagtctattttagtaattttatattggatcattggcattttgcctaacttgttttaagtttaattatttttctgaaactaatattggaccattgacattttgcctaacttattttcttattttctttttgtcttcaacataatttttaaccaaccaatctaaagaataaagattataaactgatctctttgtaagaaatataaaagagttatctttctcttatgacatcaataattctaaggcccaattaaggcctccagagcagcccaatctgagatctcgatatattttttccggtatatgaaaaaaaagtccaaaatccagctcaaaattcaaatctttcaaaaatttcttacagttcgagtcaaacatatacaataatacaaaccacaaatgtgttctcaatcaaattcctccaagtttatcttcttcttcaatccaagaagaaagtctacgaaaagtctcctcctttactaatg

SEQ ID NO: 15397 - DNA, 3000 bp, Unknown; identical to SEQ ID NO: 7846
  misc_feature (1)..( 3000): cDNA_ID_3088205_gDNA_ID_2926132_Annot_ID_196981 3000 nt of promoter + ATG

SEQ ID NO: 15398 - DNA, 3000 bp, Unknown; identical to SEQ ID NO: 7845
  misc_feature (1)..( 3000): cDNA_ID_1989575_gDNA_ID_2926132_Annot_ID_196980 3000 nt of promoter + ATG

SEQ ID NO: 15399 - DNA, 3000 bp, Unknown; identical to SEQ ID NO: 7850
  misc_feature (1)..( 3000): cDNA_ID_3088209_gDNA_ID_2926132_Annot_ID_196979 3000 nt of promoter + ATG

SEQ ID NO: 15400 - DNA, 3000 bp, Unknown; identical to SEQ ID NO: 6114
  misc_feature (1)..( 3000): cDNA_ID_3088222_gDNA_ID_2926132_Annot_ID_196972 3000 nt of promoter + ATG

SEQ ID NO: 15401 - DNA, 3000 bp, Unknown; identical to SEQ ID NO: 6113
  misc_feature (1)..( 3000): cDNA_ID_2997065_gDNA_ID_2926132_Annot_ID_196971 3000 nt of promoter + ATG

SEQ ID NO: 15402 - DNA, 3000 bp, Unknown; identical to SEQ ID NO: 8144
  misc_feature (1)..( 3000): cDNA_ID_2176125_gDNA_ID_2926132_Annot_ID_197004 3000 nt of promoter + ATG

SEQ ID NO: 15403 - DNA, 3000 bp, Unknown; identical to SEQ ID NO: 8145
  misc_feature (1)..( 3000): cDNA_ID_3088172_gDNA_ID_2926132_Annot_ID_196998 3000 nt of promoter + ATG

SEQ ID NO: 15404 - DNA, 3000 bp, Unknown; identical to SEQ ID NO: 8146
  misc_feature (1)..( 3000): cDNA_ID_3047723_gDNA_ID_2926132_Annot_ID_196997 3000 nt of promoter + ATG

SEQ ID NO: 15405 - DNA, 3000 bp, Unknown; identical to SEQ ID NO: 6117
  misc_feature (1)..( 3000): cDNA_ID_3079590_gDNA_ID_2926132_Annot_ID_196969 3000 nt of promoter + ATG

SEQ ID NO: 15406 - DNA, 3000 bp, Unknown; identical to SEQ ID NO: 8143
  misc_feature (1)..( 3000): cDNA_ID_1810580_gDNA_ID_2926132_Annot_ID_138786 3000 nt of promoter + ATG

SEQ ID NO: 15407 - DNA, 3000 bp, Unknown; identical to SEQ ID NO: 8148
  misc_feature (1)..( 3000): cDNA_ID_1810562_gDNA_ID_2926132_Annot_ID_138791 3000 nt of promoter + ATG

SEQ ID NO: 15408 - DNA, 3000 bp, Unknown; identical to SEQ ID NO: 8147
  misc_feature (1)..( 3000): cDNA_ID_2105982_gDNA_ID_2926132_Annot_ID_138792 3000 nt of promoter + ATG

SEQ ID NO: 15409 - DNA, 3000 bp, Unknown
  misc_feature (1)..( 3000): cDNA_ID_1443214_gDNA_ID_2926132_Annot_ID_138794 3000 nt of promoter + ATG
aaaaaaggcacaaacatatttctcactcataatacacaaagaaagagagtagagatattttgtagtggcgttgacttgacacgactccaagttaagaagaacaagtagacaaaagatctaaagaacagaaaattctgaattttaccttagtaatagcgtcctcctgggtacagttgtttattagataaccaaaagttatggaatcaggtttaacgccagcttccttcatttgcttgacgaccattaacgcactactcacatttttcttcaaaacatacaaaagccatcagctgaaaacgatctaagagacgttgggagctcacagaaacatggacaatctctcaggtcagaatttgcaaacatgaaatgggagcttaagatattacctccctaaaatatccagccaatatacaattgaacatgctagagtttggttccaaattgaagttctttaaattaccaagcatattatatgcaccttcaaactgcacatgaaaccaaaagatatagagaaacattttgtggttagagaaacaagcgaagcagcaactgtaagaaacagcacagacatgtcctcatctgtaacatagggtttgaggaagttacatctttgattcttgtgcacaaacgtataatgctccggaagttctcagtattaggtttcacactctttgtgcacataattgaatggattcttcgcaccttaaacagcaaaagtatgaggaaatccgtttcatatatgagcagagttcaactgtatattgtctggatatagattcaagctaaatgaggatgcacaccaaatcaaactcaagaacttcatcaatggcatgtaacaatgaatgtaggatatctgcggatatcatcaaacctgcttcacccattttttcaactacatcaagagcagtgactacctacggcacagagagaatactcattatatatagcacacgaaatacagccaaatttattataaaacaagcataataggaatacctcattcgagtcacagctatacttaacaagcttttcgtacgatgtagatgaaggcataacatcaagttcttcatgcatcttgttaaattttaagattgtatcctcaacctttaattgtagaaaaccagtaaaacatggacaattaggaggcatcgattatctaaccaaagactttaacaacactaatctgccactaatattcatgagaagtccttaccgttggatttggggtgcaagtagaatagatagagatgagatcagaaacgttcttcactccttcatctacgcatgttaatgagaaacatataaaacatgctataaaaatgatgttctacaggcataaacatgttattggacaatgcagccttaccactttctcttagctcccaaaggaatctactcgcaacagaatccaatgaaaacctcccaagatattcaaatatgtttgccaataggtccgacgaacgaacttttgttatgtctacaatctctaagagcctctcaagatggtacttttggtcttttttacatagtgcaagcagataattttctgtttttttaaggatcaaaaaggttaaatctttcagagtaagagagagccacaaaacaacagagtgcacaaaactgaatattgcttaccttgcaagactgataagctttcaccgttatcaccatcaattgtactgcaaagttcctcaatcttctctccatcaccaagatggatccaaagaagcatttcatagtaaccaagtctctcaacggaaccgggactagcctccctaatcacatccttgaaactatgaaactcatctaccatatccataccaatcaaataaccaagaagaggaccataaactctttcttcaatcaaaaatccacgatctctcatagatttcaaaagctcaaaagccttctcaatatggccaagagcataatctagatcattgcttttctcagcatgctctaagtaaacaccaatcattgcattgtactctgtcacactcatctctttagctactctatcaaaagcaccaaacatagcctcagtgcctaatttctgagcagagtctctaaatatcttagcgaaacgccgtgacagaccgttctgcttgtaaacacgtctctctttcctttcacgagacaactctttcgttcttaacgaaatatcataagggatcttagtggtgaaacttggtatctttaaaaataagttcttctccaaagagcttttatctgatgttgttactgaaatgtgattcaaactatgaatgaatgagagtttgttgaagaaaatagacaaaattggcaacacataccatgtaacaatttcgatactcgatcttgtaatgatgcttcctcaagatctacacacaattttgcatgaaatcaatcgaattctaaacattacccagatacagaaaaatatcaaatttacaacgaattcattctaaagatcacatttttcttatatttgttcatatcagaaaatccgaattacctgaggaagagtttttggaagagagaagatctttgacagcttgagaagttccggcgatgtctttgttgccggaagcaattgaagattcgccggtgggtctaatacgggatttgaagactgaacttaataagcttttgttaacctttgagacaaccatgttcggatttcaagtgagattgagaagatgaagaagagcaagtttataaaaccctgaacaaaaaccccgacagggttgttctatccaattttaaaccttaggggtgataatttaatcaatcatataaattaggggtaatcatgtaaattaacaagattagttgaagaagaatcgtcaaattttgattttgtcttgtggattcttcaattcaaagattataaatttattgatgaacatcgtcaattcaaagattctctttttatcattcacgctacttcttcttcttcaatcgtcaatcgttgaatccgattcgatttgcctctcttccggcgtagcttcgacggtggca

SEQ ID NO: 15410 - DNA, 3000 bp, Unknown; identical to SEQ ID NO: 8146
  misc_feature (1)..( 3000): cDNA_ID_3047723_gDNA_ID_2926132_Annot_ID_138797 3000 nt of promoter + ATG

SEQ ID NO: 15411 - DNA, 3000 bp, Unknown; identical to SEQ ID NO: 8153
  misc_feature (1)..( 3000): cDNA_ID_3088172_gDNA_ID_2926132_Annot_ID_138798 3000 nt of promoter + ATG

SEQ ID NO: 15412 - DNA, 3000 bp, Unknown; identical to SEQ ID NO: 7883
  misc_feature (1)..( 3000): cDNA_ID_2154662_gDNA_ID_2926133_Annot_ID_138805 3000 nt of promoter + ATG

SEQ ID NO: 15413 - DNA, 3000 bp, Unknown
  misc_feature (1)..( 3000): cDNA_ID_3088238_gDNA_ID_2926133_Annot_ID_197066 3000 nt of promoter + ATG
ttggccatgagattttggaattttgcgggaaagtattcattcaatttataaaaagaaaatattttgattggggaataataatgatgattgttgcgttggaatatttggataaggtaaaagcaacataagcgtgaagtaccagctaccaaacgaagatcttgacgcgttgatttccgtatcaacggacgaagatgtagagaacatgatggacgaatacgaccgcgtcgcacagaatcaaaacccacgcgcctctcgtcttcgtctttttctcttcaccaaaaacgtcgccggagaagaagataacgatagtcgagctagcagtatcagctctctcctcgatagctctgttaatcgggagcaatggttcctcgacgctcttaacctcggttcttccgccgccgcaaccgcggtatctaacggtgggtccggtagagtctttgagcgagttagatctgaagtctcgtcgattgtttctgaagttcctgattatctctttggattggataatttcgatgaaactgctccgccgcatgagcttcgtgatcgtgatccgagagctaagatccaacgagaagtctcgacgctttcggatcctggttcgcctcgtcgcgatgttccttcgccgtatggttcgacgtcttcggctcctgtgatgcgaatatctacaccggaacttccaccaccagtttttattaaaccggaaagtccagaaccggtttcgactccgaaatccaatcctcaaccggaacaagtaatgcaacagagtaatctcccggttaactcgcaatggcaatatgcccctggcccaggccaacaggttcattaccagggtcataccattcaccaatcaccggtttattacgttcctggttcggttccgggtaatcatatggtccagcaaggaaatcatatggttcaaccgggtaatcatatggtacaaccggttcaaatgccgggtcagtatcttcaacaataccatcatgtaccaatgggataccaccaacctcagactcatcagatggctggtccgggtcaagtatatggtggaacggttaggccggttatgatggcagttgatggaatgaaccggacgggttattatggaatgaaaacacccggtccggttcaaatgtatcagcatcacactggtatggttgttcctggtgtagaagaacaacaacaatacagaaccgaaacggattcggatacgggtcgggcttcttagctgtttgaagaagaaatatgaaaaattatcacatccggggttttcgtcttttcattggagtcgttcttattcgttactgtgtgaactgtgtattattttttgttttacttttgtaaaatttatttttgtgtgtaataattttgtattacaaaatataatgaacagtaaaacccaataataataacattataatctatcaatagtgaattacatttgctaaacttttttttgtcatcttattactcgatttatcataataatgttaatggaatataatttgtcaatcatatgttcctcttcgtctttgctggtgacttgtgaggaagtagatatgtcttagaaaccacaccgaattcaatctcatatgtttgttggtgatgtcttcatagttgtaacttttaatacaatctaacaaagcataaaatggaagggaggtaaggatattgtgttgcatcattcttctcacaatcacttcttctttaccaagattgtcgaagcatgcattataaccattataaccatgcatcttaaacacatcctcccctttttttccttttttgtcgatacctttttatgttcatttgaactttctctttatgttcatttgttctacaagtactattcttgtaaaacatgttatttgtttaattgtccctactcactagtcactacctattttactaaaatcacaatttctacttttagctaccatactattcataatcgtaacaactaacacacttacatgaccaaaaatagatttttgtaccatttaatcttaactattaatttgtaaacgatctcactactattgtaacgtttagtccgtccttactagtgtgctccacgttctttctcaggtctatggactcatccctgtccgacgatcggtccgccaaatctaagaggttttaaagacttgttaacgatcctacaaatcactatacgatatttcatcatgttttatcctcatttacatggttctgataatcatttctcggaaggtcacctatcttaaaactacttcgactcaaacacgtttaactgtggagttctccgcataaattaattattttattctctataaaagttatagaaatggtctcgtcattgtactgattgacatcatcaactggagagacatcaactttgggagctgccaatctcagaagaagtttatctcctttacatgccgaggtggaagctctcctctgggcgatgaagtgtatgattggtgccgacaaccaagatgtagtttttcttacagactgttcagatctggtggagatggtgtcttccccaaccgaatggccggctttctcatcgtatttggaggagttacagagcgacaaggatgagttcacaaacttttttctatctttaatctctcgtagtactaatgttaaagcggattttttggcacgaaaagttcgtacccaaccgcttcatattacatctgtaaacaacattcctcaggattggctcgtttgagtcctaattaattttcggatgacaaaaaaaaaaggtctcgtcattgttaattattattctaattgactattcccattaaagcaatcatagagttacttaagtttgacattcataaatttatgcgactatgattaattattgactaagaaaaaattaaatactaatagtactaacattaaagacaaatgtaacgttttacgtgaagtaatcagaaaccagaaatagtcttcttcttcttcctcacacacatacttctctcaccttatcctccgagatcggaaaat

SEQ ID NO: 15414 - DNA, 3000 bp, Unknown
  misc_feature (1)..( 3000): cDNA_ID_2035028_gDNA_ID_2926133_Annot_ID_197065 3000 nt of promoter + ATG
aaaaattgtttagtattagtaaagctatttgcaaattaaattctaaacgcaaacgaaaataaacaatcatatccacaatctttattaaggagctatatgatgagaatgcaaacactgagatgtccattagtcaatcccaaaatagaaatgagcataatcatccatccttgatcaccatacttggcagtgaagtagaattccggaatgaggaaaaaacgcgacaaaatcgcaactgtgagtctttttctattctcaattttgagccatttcaccagcggtgtgtatcttccgaccaaatcccatagtacattgctacgaggccaagcgtgtaccatgttcctagtctgtgttgtcccgtgttttcatataaaaacctgggtaccagggataatgtcaaatcgtagaggaggaatagattcactgcataatccttcataagcggatttacttcagtagtacttaacaatgggaagtttcggaaatacataaccatttattgtggaaaacatgtaaccgatcatattacattttcgtgtattgctttttgattcgcggtatgagaaaatcgtgattgttccaagctcaaaaggttcgtataccacaatgagtatccttaaaggatgggtaatcctacggagccaagaaacatagagaattcaactatagttttttataaccaaaacataaaacttcgaaaaccaaaacgaaaacaaattggaaaaacgtggtagtaataatcttcaagtgtgagcatattgttccaagaaatgttgttccaactccaagaatacagcaaaaaacagtgaagactttagatatgtcttatttatgttttcttttggaaaaatgtaataatttgaaattataagttgtgtcattattcgtttatgtatatcatagtacaatatatgatagattacgttgaaagagtaagatagatagataatataatgtttgatatagattttctcgtcatacccaacaagtaaacaaaaaaccttactaactgcaacaccattggaaacttatcctcttttcattggtcaatttcttcttttcgctattgtttagtcgaactaaaacgtcattaaatatcaatcaaactacagagacattatttttgtttaacaatacaataacatggacttcaaattagttttagtggaaataatgattagtactaataaaattcgatcgcctgtcgtaataaccaactcagctcaatgtcacatgctaagaagtaagaactcctgattatattttatttttaattctgttgctagattaattaaataaaataaagtcaggaattttgttttccttctttactcttttttttgtgccgacgtcaagaacctagttgaagattgaaaatatatattagatacaatttttaattatatgttatcttttttttttttcttgtctaaattatatgtatcttaaaatcgttaaatcacaatggtttttgtggagtcaagtcaaatgcatatggtgaatgattaggagcatctaacttctggctgatagctatttgacggctacgatgcatctgtcatataaaatggaataacggccagtagttctcatagaccgctattattttggccaacagattgatcgtaagaaaatataatagttgtatacattagtctttttggacacaaaatttttgatgaaaactttaacgaagttgagacgaaaagaaaaaaaaaaaatgtttctcatgaaaatatagttacattacataaggaatgcgtatggtaaatgtttgttttttgaaagttttattatgataaaattattatattagatttatattttttttatttttttgtcgaccgttattaattatttttttattttttgttcaaagatattaattgttgcattagataacataaaatatatataaaaaaccaagatttgttcacaagataaaaaaccaaaccaaatccaaatttcataagatattttctacactaactaaagtacttcaatcgaacgattctgttacaactttgtaatagtaaataagtaattagatttctgagtaaaacatagattatcaaagtcgcttttattattgttttgtttgcaagactcgtgcttacaaatctcccattgtaatcaactatcgttttctagagtttgtttcagtcattcttacactcttattgactactcttattgattattggaatttttttttctttttttttttcaatctttgcttttattcattgaaacaaagaacaattacaagcataagagttaaagaactcaaaaattaaaacattacaacaaaaggtattctccaataccataaaaaaaaaatctaaaattcatcgatttgaagtccatgagagttttaaggcaaagacaaagaaacacaatgcaacatatgagattatagagaatctaaagatcattgttttattttgttttattttgatcgaaagattacagaaaatcaaggaattgttttattttgttgatatatttttgtggtaatatttttaaaattactttttttctttcatataaataaaattcgatagaaattagtatttatatatatatatatatatatatatatatatatatatatatctgtatctcatttattcaaaattatcatttgtgcaaatcggttaataaatgtcgtttatgacactaacgagtaatgagtggtgataataatcaattcggtaatactctcacatttataaattatattaaaatattcaaacggttaactaattatattactttattttttgtgcaacaaactaattatattacatgagaaaaaataatgctgtgagaatgcggtacatgacagccacgtatctctaacatatcctcttcccgaacattcaccttaataatttatatggtcgttgaatgaaatcgaatcaaaaaaaacaaaaatccccaaattaccaaaatcctcggcgacaaagaggagagatagagagagagaaagaggcgaaaata

SEQ ID NO: 15415 - DNA, 3000 bp, Unknown
  misc_feature (1)..( 3000): cDNA_ID_3088254_gDNA_ID_2926133_Annot_ID_197060 3000 nt of promoter + ATG
gcaggggtatgcaaggatataatcgtaaaagccttaaaatcaaagattttgataaaattgttcctattttaacaataatcccaaatttaaaacataccttttcgtatatcataaaagaaaaactacatataatattaatataaataaaatcacatagtctagctctaacaagtaaagaaaaaaggtgaacacaaacagcaaaaaaaattactaattcatattgtgaagcaattaccaatgtgaagaactataagaaaaaaataatcaaaaaggtatgtatcaatagtacgtactataaaaatatgaaacttactaagtttgcttcgaccattttttcatacaaatcaaatccaaaacatcattttttatgaaaatgttttttaaagttttaaaaaataatattttaagcaaaagagagtttatgatttgaaaataaatatatttccactttactaaaccagaattttataatcaaagataataattagtttaaatctaaaaataataatactgtaaacctagtttggggtacaattctaacccacttgcatttaaatggcttgagaagtatgacgtggaaatgtgtttgtaggaagtctacgaagctgtagctagctaatagaatgaatgcattagactaacaatagtactattaagtggaaaataacaattaagacatcgttttgttattttgactagtatcatctaatctagtactagtaaattttgatatttgactaacacgccagatttaatgttgcatggtttaaacaaataattgttaatttatgtagcaattaagtatagtaagatttgcttagattgactcaactcttaacataaataacttaaatgacacacgtttgtttcaaaaactgtagtaatccatatctttggtaaaaaaacgaaataaccttaatgattaattgtaatcaaattaaaacaaaaaataaaaaataaaacaaatcttttatattttaaagcacaagtcactccaccaataaaattttgacaaatcagcaaaaccaaattatttttcaacagaattataaaatcaaaaaagaaaaccaaaacctatattacataattaaaacaaaaacgaaaatccagttaacgtgagaacaaactttttttaaaataataattttgaacaaaatttagataaagaagaatcttcttcacatatttcgtttttgatgttaaaaatactaaagaaaaacaatttaattttattgcatattataaattgacttgttttagcttaccaataatattttgacatgtatcaattcacaaataattgatttgatggtaggaatagaagaagaaaaaaacggttatgaaaacccttggagaatttatcatgactaataaaattcattaaaattcaaatatgacaatattatgtaaaaatctgccgacattaataaaagtctgtcgtgacgttatgaaaatttctttttaaaaaaaaaaaaaatccagtcaaacccgatttaacatacaatcagaccggaaataatttaattgagggctagctaataaatctcatataacaaaaaatttcgaaattttaaaaataaatctgccaaaaaaagtctgttattactaaaaaggttattctagtcataaacaaatcggccataacattgacatgagtaaatctgttatgctttgacactgaaaaacaaaactgtcatcactaaaaacaaatctgttatcactatgtgactgtgtagtaattttattttttaacaaaaatctgttgtaaaacaccagatttgttaacaagttaattaaatctgtgattacacaaaacaactctgtcatgcctatataacatttttcgaggttaacaaatctgttataacacaacagatttttgggtgcaaatagaaaatctgttgccaccataaagaaaaatctgtggtccggaaaacaaatcagtgacagatttggtttcaacattcttacttttgaaatttaaataaaatctgtggagactgtatgaaacaaatcagtcacgattaaaaaatctgcgaaaaaaaaaaaatctggcgtaacataacacagtaaagtctgtggtacaaaacaagtctgttgtaaaaaatctgtggttgaccaacaaatctgtgatcgataacaaatccgtcgcaacaagagccacagatttaccaaaaacgacgatggcattttcgtaaataaatgtggttttattgccttgctggaattaaatagtaatggcatttctgtaatattgtttttctctgcaaaggaaaacaaggataatttaggtataattattactcaaataactcatatttttagcattccttttgggtcattatgtataaaatatgggttactctagtaaatttccctatagtatatcaattggcacagcttattagttgatgtatatatcgtagaagatgacttcatgcatgcattggccacttttccaataactttctcagggaaagtcatacattcggattacactataatctagtcgaccatatatagaagaagtaactaaagctttcaaacttttaattctttaatctttttcttttgagtcctcatctcaaacttttttttttttttttttgtattaaattgacctaaagggacgttcacatagtggaaataaaagaaaaggtgacaacaaagatcagaccttagggtatgccaaccttttgagtcttattttatcttctcaaatttgctgtcaaaccttaaaactctataatgattttactcaatcatctccatgttgtgagaatcttgttctgattctacatgaaagctttgctcgtaataatttcaacaaattcgttgactctacaaccaaaaccctcatgtgctaactttcaagtaagtatatgtagttttttgctcgaaataacaaaaaaaaataagaacaaaacatcatcttgtgtttgatccaattcttgaatcttgaaacattcttttgagctctctataactatttaaaaaatg

SEQ ID NO: 15416 - DNA, 3000 bp, Unknown
  misc_feature (1)..( 3000): cDNA_ID_3041184_gDNA_ID_2926133_Annot_ID_197059 3000 nt of promoter + ATG
cttgctgctgctggtatccaaaatttatcagatttggtaacatcaaactcctcaagaattctttcctttcttggtttctttaaaaaaaatcatcaagaatatgtttcttgattcattctttttttctacaactttcccactctttaaacattatttagcttcatgatttttctacgcagagtgatgatgattccaagaatcaaatgctaagaaagaaagagttgttgcttcaaaacatagaccatgcagtgaatctattcctcatctacgttttgacattatccatttttcctggattcttatacgaaaacacgggacaacacggactaggtgattggtatgcacttatcctagtagcgacatacaatttttgggatttgttcgggaggtacgcaccgctggtgaaatggctgaagcttgagaatagaaaggccctaacgattgcggtcttgacccgttatttcctcgttccggcattctatttcactgcaaaatatggtgataaaggatggatgattatgctcgtttctattttgggattaactactggacatctcactgtttgcattatgactatagcccctaacgggtacaaggtaatctatctactctccctatgctgttaaccaaattaatttgaatatatctagaaacttagattagttcatatttagaaaacaaaacacattatctttacaatttttttgtgttataccctttgcttttacgatttgaaaatataacacaagttttttttgacatataaatacaaacactataataaacaaacgacctctaccttcatatttaatctgattttgtattttgtgaagggtccggagaagaatgcattagggaatttgctggtggtttttattttaggaggagcagttgtaggaatttctttgggttggttatggcttattggcaagaaatatgctttctgagttctcatcattttgtgcaattaattccgatgaatctgactctttatggcaaaaaatgagaagcttggtgcctcgctcgaacctaactgtttattcatgaaaaaagaagaagaagagaatactaacacgtaaaactttcgaaagcttgaagtgatgaattcttatttcgatgcttcaccaaattataaaatttcactttttcaactccacaatttgctgtatctattttagttaatattttagacccatttgatcattttattaactattttctaaaatcttatatggtgttatttaaccatagatttttatagaaactaaatcctaacagtctacttttgtttgatcactgattataattttatgcattaaagtttagcattgttccatcagatatttgtaaaacaaaattaatagcaaaataaagtcattcatttaagctagtaacggacggttttcttcgagagaaaaccagtccggagtagaagagcttacatgggaaaacatagaacctcgtgctcttttcttcttagcaagacaatcagcagagacattgtttaagtatgtaataaaagataaagaaaaacgagaaaaactaggctttgaagcattaaaatcttttcactccgaagaaaaagcggactactcatcaggagtgttcaaaagttgtgtcgactccttactatctgtctataaaataatgtcgaaaatggataaaaatataagaaatcgtattgcccataagagagcctcaacagatatttgtaaattatatttaagagttttaaaatttggtcttattaaccaagtgttcatggccaagtgctttcgtcatgttggtccagactagagaacacttcttttaatcatgaaaacttaactcattgtttcctttatgtaaacattttaaagtggcaaaagttttttcttaggtatctacaaatattgagaactagtttcggttacgatccaaaaaagaagtaggtgttatttagttaagattttaaatattttgctaaaataagatttcaggcattttcgtgtaatttacaaatacaaaatgtagtgtgtaatttagacccatatttcctttcaaactaaccgatcaaaacattgatcacaaaatccttgtgtgcaactaattccccaaaaaagaagaggagaatactaacacgtaataatcaatttgaggtgaagtgtttatttatttattttgctaaatatttgaggtgaagtgttattttgataaatgcttcacttatcctttttcttttttacaacaaaattagttcatccatttaaattagaaacggatgattttttttaggagaaaaccagttcataataaaagattttatatgaaaaaaagataaaactttgtgctttttctttttcggcgaggcaattaataccaatattgtttaaacgtaaaataaaaagataaagaaaaacgataaaagttaggttttaaaatattaaaattttataattctagaaatgtccaaaaactaagtcaactacttcaaatgcttcacttatccaacttcaccgattctcatcgagtctatttcatacatagtttttattttcatttattacgtttagaccgatctcacagatatgtggatatttaatgattaaggattttaaagaaagttttgctttcatactatatcgtcaacaagttgtctaaaaataggaacataaaaaaagctttcacactttgaattctttaaattctataatcttttctttttctttttgagtcttactttatcctttcatatttgctgtcacaccttgaaaaggtctattattttactcgctcatctcctctttttaagaatcttgttttgaatcttcatgaaagctttgctcgttaaaaaatcaacaaactcgttgactctgcaaaaccctcatgtgctaagtttcaagtaagtatctctagctcctttatttgctccccagcaaaaaaaaaggaacatagcatcatcttgtgtttgatccaattcttgaatcttgaaaacaggtttatgttcttttgagctcaatg

SEQ ID NO: 15417 - DNA, 3000 bp, Unknown
  misc_feature (1)..( 3000): cDNA_ID_2034990_gDNA_ID_2926133_Annot_ID_197058 3000 nt of promoter + ATG
cattaggaagggagcatatgataagtttttttttctaactttacctaataatcaaatttggtgctctctattattgtgacgtcaatagacataaggataaatataggaaataaataacattaaattttataaacttttatgaattgtttttaattcaaaaattagttcaaactacataagcgattttatacaaactttatgacatgtggcatatttttctatgttttatttccattttcattctcacttgaaaagaaatgatatacataaggtatgaattataagaaaagcttataaatagtagtttacagttttacattgatttttattttatttagcatgttataaaataattattcttatcatcaaaatatatattttcaggttttttttttatatgaagatacatcacacaaaggatctattcatccaccatttttattaagtgatgagggtttacagtcatttttgtttttgatttgcttgggcttttcttatttttgctgatctgttcaaaaaatatgggcatgattatgagacctgatttactccatatttagcactttatcaaggttgtaaatattctttttgttaaattttattagtgttttcattgttttttgttgcatttagtatccacgtgatttttcttgtgttttagaaatcctatagtgtctttgtgtgtgtgtttttagttatgtgaagttaaaataatggaatacacacatgtagatgctaagaagagaaatgatgatcatgaacaagtccaaagtgtcagaaatatcaattcggatgaaggccttactttcgaatttagattcagaaatttagttagctttccactgatggtgatttcaagccaaacggaacagaggtttaagaattatcatcgatttagtagacacatatcattttcatgcttaagaaaagctcatccagaaattttccttcaatgccagaggttatattaacttagtgcagtaggatcaacatacaattagagactttttaatgatgtaatcatctaagatatgatccactttattttggaataatccggtccaaacaaatttatattcaaggattttttagacattttttaatatagtgagatcaacaatttttagacatttttaatacagtgagaccactagagactttttcatgatatcattatccaagatttgacccgttttatcttgggtcgaccaggtctaaacgaatttgtatttaagcaatttttagacattttttaactgaaatttgttttgtgaaggattcttcaattctatcatttatatttttgtttatgcatttttcttatatctttcaccatgtttaatgagtagtcttttgtttgatcatgagttatgatagattaggataatttgatagttaaatgatgatgatttatattgcttattgtagatttcttcatttaggttaatcttattattatgtgcaccgattatgtggttcataagtatctggtgaacattttattttaagtttttttgttaggttatacagctaacattaaaaaatagtaagaaaatacaagggataatatagtgaaaaaacactgatagtgagaacatatttcctgaagtctctcttcacttcatttggaaatggaataacttattttggcaatgagatgtttgattactgaacaataacatttggtggtttttgttcggaagatttctaaattggtgaaaatagagcagcatcttgtggggtttgatcaacatatacgaatgaagtaaaagaatgcaaagaaattgcgattaaacactatgcaattaaacctcattatggtcttagtaactgaataatctactcagttactaatgtataaatatatttttgctttatgataattattaattattattcatgtaaagtttaaattccaaataaacatatggattagtcatacctcaataattactcttttaatagtgcataatatttagttacttaattacttcaatcaagttttttttttgagttttcttgtcaataaaaaatgtcccgtttttttttattttgcatcaaaaaaagtatatataaaagaatacagagtaaaatagtattttaaacataaacttttcactttaacaaaattttctacttcaattcttaactagcggcacaatacttatttattttaagtgtttgatgatactttttctacatgtaaaaatcaattaacatatataaggtaatttttcaaacaaaaatataaaaatttcaagtatatttataaaattaaaatatatcaaaactattaaaaaaaattaaaactaattttattttgcacatcacgcgaggctacttctagtgtatatatattgtttgatgatgttgtgttttatatagagaaaaaacaaactcatagcataatgctttttaatttcgtcagaaaagccaaattaattagacaaaactacatttttcttctaaccacaccttatagagtgcttttttctttcaagtgcgtttctatatctgtgacgaagaaatacgtatcgcactgctttttcttttctttttttcttcaaaaaaagagtttgaaacaaacttaatggtgagaaataagtagaaccacacataaaaagctggaacgcgtcgtacattcacgcccttactttaatctatttggttctgtttctttttcttctgtgtctcatattatatccttccatatttgctgtcaaaaaccttttaaaagtcttattattattttacttgctcatctccttgtattaagaatcttgttttgagtttttgtgaaagcgttactctttaaataatcaacaaactcgttggctctgcaaaaccctcatgcatgtgctaagttccaagtaagtgtctatagctttctgctccaacaacaaaaagaaaaagaataacatcatccagtgtttgatccatttcttgaatcttgtaaaagggttatgttcttttgatctctctgtaacaatttcgaaaatg

SEQ ID NO: 15418 - DNA, 3000 bp, Unknown
  misc_feature (1)..( 3000): cDNA_ID_3088258_gDNA_ID_2926133_Annot_ID_197057 3000 nt of promoter + ATG
ttagaaaaattattgattgtagagaggaactaccttttggattaaatttttgtaaaaaattacaaattttttaaaatctctccataaattaataattattaatttatcgataaattaatacctctctaaattaataaatttttgtactattattacctagaaagtgaaaattgacctacaaatatatcttcaatttgattcacatatacgaagtcacgtatgtttctataaatttagatccaaaatgtgtgaaaacccatctgtttttgcaaattcttgcaattgcaattgcacatgtttctattacgtttaaatcaatcgagctctaagtgatttatccatagtgatatacagatccaatatccatgaaacatatttaattcatgaaaaggctcaaacattatcaacaaataagatatggtcaactatgtagtaactagtaacacgtaggctgctgctctttgtggcaaattcatgcgcaagcaaagcctctagatgtttgacaagttactaccctaatatagcatcactagctatcttctaatttttttttttagttattttaatcctgtattcttttatttatttatttgataaagtgatgaaattttattctcctttttcttatcaactaatatacttattcattcacataatttcgcactttgcggagttttcatttgtcgttaaacccgacagattcttgaaccgcaaggaacgagacattaacctaatgtacttatatttaactatagtattataatagcataaatgtgacaatgattcgatcactactaatatattaatcaccaatctatatcgtcgtccttcctgattatttgaagattttgtctataaactagctgcttttgtttatgtatttttattacttggatgcttttgtttgttggaatattcgaatgaatttttgtttgcctgaaactatgcatatataataaggccatatgcgccaataatatagaatccaaatattcattaactataattagtttgttctagagttttagctactcatatattcaaattcttaggagatcaaaaaagtacttaattagttaataaaatccatttttattagttgtaattaaatgtaaagtgtcgaaacacgaaagggaagatgagttgcacaactcgtggttcctataagagtgataatctatctgacgtcacgccatgcaaaatgtatcaatcaattttcttctcacatttatatttacttcaaaatgattataaagccacccaatgaataataagatatatatatatatatatataactcaaaatcaaaaatttcaaatggaatttggaagcatcacaaattcacaatcatgtattcaaaatctcacgtagaaaaagctaataagtccaaaagattggtcttcatttttttcttgagaaagtttgatgggatagagagagagacagagaggaacagctaaatttgctgtgtatgtatttaatacttgaacatttatttatctattttcttatacatcaaactcacgaatttataggttggtaatgtcgtttttataacattaataaaaattgcaattgtagtttttattgaaatttacccaaaaaaaactattatacgaaaatatgttatttatttaaaatttgatattagatgaatccagaatcttttataaaacttggtgtgtgtgaacctgcgttaatttgttaaatacttttcacgtaaaaatcaaaattaattttaaaagttatgttaccaaacagtattctgatagttttacaaattttatccattgtatatgttttgtttttgcaaaaaagtccaaaggaaaaaacaaagcagaagggttgaattgtgaggaaagagagagtacgtggcatcataactttggcgacagctaatgtgaaaacagccaaaagctacggagagcgacactcctcgacgacgtccatgtctctttagattgtgattgcattgttaattatcatatttatcaattgattagttaagtcttaagtatcatcacacaagtttatacattaatctatacagtgtttaacactacaaaactccccaaaatcacgtgtttcatatcatacgtacatttgtctaccgtctttattaacaatattaaaacagaatttatcaattttctagttgaatagactatatactattatagagactcttataaattatgaaactcctaatcaattaaaaatagttaatttgaaacatatcactcgaaactagggtattagttggattgacgatatttttcttattaatatcaacgagaagaatcaagtgtcgttagctcaattggtaaaaaatttaggcaaagcttagagatgtctatttgagtgacgcttggaacaaaaattacatgctatggtttcaggcctagagaaatgcttcgatccagaatctcttgatattcaaaaaaaaaaaaaaaatcaacaagaagaatgtataaatggtttctatactatctaagttatgaaaaatatttttggttacccaaattacaagatttgtaccgaagtgtcacactagattcacatgcatgcatagttataattaacttaaaacataaatgacttacaaaaatacttacaaacaaaaaccaaattaagttatttagtggccagctttgttactagagttttagccattatcataattcacaataaggtgtaggaaaaaacattaatatatagtatgtatacatccaaaaaaaactttttggaaaaaacaaattttgggattataaaggacacgtagcccaatcgatgaacagaggacggcaccgaatcaatttgacttcaccttttttccccatatgataagagtctcatctctttcctatatatatttcgtacctctctttaaggaccctacgtctctctctttctctctactctctgtttcctcataattcaatcactatatttttttaaaaacatttgacttcatcgatcggttaacaattaatcaaaaag

SEQ ID NO: 15419 - DNA, 3000 bp, Unknown; identical to SEQ ID NO: 8037
  misc_feature (1)..( 3000): cDNA_ID_2025014_gDNA_ID_2926133_Annot_ID_197049 3000 nt of promoter + ATG

SEQ ID NO: 15420 - DNA, 3000 bp, Unknown; identical to SEQ ID NO: 8040
  misc_feature (1)..( 3000): cDNA_ID_1989590_gDNA_ID_2926133_Annot_ID_197042 3000 nt of promoter + ATG

SEQ ID NO: 15421 - DNA, 3000 bp, Unknown; identical to SEQ ID NO: 8041
  misc_feature (1)..( 3000): cDNA_ID_3041167_gDNA_ID_2926133_Annot_ID_197034 3000 nt of promoter + ATG

SEQ ID NO: 15422 - DNA, 3000 bp, Unknown
  misc_feature (1)..( 3000): cDNA_ID_2154680_gDNA_ID_2926133_Annot_ID_197029 3000 nt of promoter + ATG
acgagctctataaacgtgacatgtcatcatggcattgtcgttaatcacacgtaagtgtaaggttctttttaaaacatgcttctcaattaatatataagggatacctaaaaatgtttcaaatttatttgttctttttctctcaatttttttaatttagttttgattttactaaaaatacaccttttgatttaaatatggacaaaattattattttacatataaaaactaggtaatgcccgcctaaatatgcgagtgtaaaaaataaatataatttcatatcgataatatttaaattctaaataataatctatatttttcttattatttaatttcatattttgtttcaaacaaaatttcaatcatacactttaactatttatttaataataaaaaagggcattttaattctagacactccatcttattgatgatatttgaattctaaatagtatttcgtacacttttcctatatttaatttagtacttttattgaaaaatattcaaatcttacacattccatttatattcatatacaatttaactattatttattaatgacaaactggattttgattctagacccttcatcttaaagaataaatgttaaaacacttatatcaaaataaaatgtatatcagatcatatcaaatatatatctagataagttaatgaatggttatttatttatatgtatatattttaaaattatctttcttaaaagataatttttttactttttaagtttaattattgtgttaattgaaatatcaggacactgtgaagtatgcgttgaataagcaagagaaagaatggtcacagctttgtaattctcagttcgggtatctgcttgagcacggtcgagaagtagctttttcggtccagttcgctcattacatgttagtgacggcgaaaaagcacgagatttggatggattttggtgaagcgcctatcagattttcaattcaagagttctcggttgctatgtttgcggatcatgcatccagcctaaacccaatagatgtcccaagggaattgatatgggacctacctcgaagaactgtcttctttggtacctctattcctacgatattcaaaggtataagatctttattggttctaaaattcctgagattcctcagaaattagacgaaaaagaactaaaaattgggatgaattgattggagagaatgtaaatgagattgatgatacctagatagtaaagaagctggaatccaagaagttcgatgatcatcagaaaagactggagctttgttctatgtcccaagtaaaaccccatataattcatttatatatttactatactactcaatcacatagtcactatgtatgcaattatggcaatcaatgtaatattataaaatcttaaataaagtacgccgcccatcaataggtaattaataaatgagtatatctatgatatacttttgttagtttttatgacccaggtaaaagagtgtatgtgttagccacggtatatatgtttgttttttggtttatatttttttattatgttagattatttgtttttacttccattttttgttatttttgcttttatcgaatatcttttggatagtataaaaccaaatgcgacagtctcataaatatactgcacgacaacaatcatctaaaatattaaatatttacaaaatttgtacataatttttttccatcaataaatgatttatcctaagagattagtatctcttctcttgtcctttgcccaattattggacaaagagttagtgatctatcttaggtgagtttatgtaaaacttctatatattaataatcgagaaaataataatctctttaaatcaataaatttttcggttacgagtcagaaaaatgtaaaaaaaaatgatacatttggataaaaaaaacaactataaattttactatatatttagttttgaaaccttgaatttctctacttcgattccaaaaacgcaagaaaatcaaaatcagatatataataaaggtgagttttcaaaaatgaatgagttatgatcaatgtggtgaatctgcatgtgtttctcatcctcttcccagactttgtcgtcgtgacaaagcctttgaattactcttttctcatcctaaatcaataatacaaacaacatatacatttaatttttagatgatacaaattttgaacttgtttctaaatcattctatttttaaaaaaaaattgttagaatttttcataccaaacaccaactttaattattagaagataatacaataagttttggataaagtaatacttcactacaaaaaagtaaacaacattagagtcatcttacattaaatattcttatatatatatatattttattttatgataagtttatataattattaatttatgatattgttaagaccatatgtttacatagatttttttttaaaatgattatcttggttcaattgaaattcaatatgatatttttacaattgcaaaaaaaaagcgtactaaaatgtctataaaataaacagttatcaatgatcctaagtcctaactattggggaaaaaaggtgagttgttttgggtaatttggtttaatatcatttaattcacataataagtggacctcttatgtgcatgggccttaaaaataataaagatccggcccattactgtgatcagaaacaacatttaaaaagtgatcagtctatagaagaatacaaaatatactatttcaagtaaggaaaagacaaaacttagttggacttgttgaatgcacaagtaaaccatgaaggagaggaatcttatctggcacagtccaagttgtgcttaatatctcaccacaaccgtcgatcttcacgattgttgacacgatctaacggtccttagagactcctggcttgttctataaccgaatcttttaaagaatctttaatccttagtaggccccgcttcatagccaataagagaagctctctccaaataatcgcagaagagatcaagagagagatatg

SEQ ID NO: 15423 - DNA, 3000 bp, Unknown; identical to SEQ ID NO: 7883
  misc_feature (1)..( 3000): cDNA_ID_2154662_gDNA_ID_2926133_Annot_ID_197023 3000 nt of promoter + ATG

SEQ ID NO: 15424 - DNA, 3000 bp, Unknown; identical to SEQ ID NO: 7886
  misc_feature (1)..( 3000): cDNA_ID_2154659_gDNA_ID_2926133_Annot_ID_197022 3000 nt of promoter + ATG

SEQ ID NO: 15425 - DNA, 3000 bp, Unknown; identical to SEQ ID NO: 7888
  misc_feature (1)..( 3000): cDNA_ID_1809625_gDNA_ID_2926133_Annot_ID_138808 3000 nt of promoter + ATG

SEQ ID NO: 15426 - DNA, 3000 bp, Unknown; identical to SEQ ID NO: 8036
  misc_feature (1)..( 3000): cDNA_ID_1989594_gDNA_ID_2926133_Annot_ID_138811 3000 nt of promoter + ATG

SEQ ID NO: 15427 - DNA, 3000 bp, Unknown; identical to SEQ ID NO: 8040
  misc_feature (1)..( 3000): cDNA_ID_1989590_gDNA_ID_2926133_Annot_ID_138816 3000 nt of promoter + ATG

SEQ ID NO: 15428 - DNA, 3000 bp, Unknown; identical to SEQ ID NO: 8042
  misc_feature (1)..( 3000): cDNA_ID_1989588_gDNA_ID_2926133_Annot_ID_138818 3000 nt of promoter + ATG

SEQ ID NO: 15429 - DNA, 3000 bp, Unknown; identical to SEQ ID NO: 8037
  misc_feature (1)..( 3000): cDNA_ID_1989587_gDNA_ID_2926133_Annot_ID_138820 3000 nt of promoter + ATG

SEQ ID NO: 15430 - DNA, 3000 bp, Unknown; identical to SEQ ID NO: 15418
  misc_feature (1)..( 3000): cDNA_ID_3088258_gDNA_ID_2926133_Annot_ID_138824 3000 nt of promoter + ATG

SEQ ID NO: 15431 - DNA, 3000 bp, Unknown; identical to SEQ ID NO: 15417
  misc_feature (1)..( 3000): cDNA_ID_2997100_gDNA_ID_2926133_Annot_ID_138825 3000 nt of promoter + ATG

SEQ ID NO: 15432 - DNA, 3000 bp, Unknown; identical to SEQ ID NO: 15416
  misc_feature (1)..( 3000): cDNA_ID_3041184_gDNA_ID_2926133_Annot_ID_138826 3000 nt of promoter + ATG

SEQ ID NO: 15433 - DNA, 3000 bp, Unknown; identical to SEQ ID NO: 15415
  misc_feature (1)..( 3000): cDNA_ID_3088254_gDNA_ID_2926133_Annot_ID_138827 3000 nt of promoter + ATG

SEQ ID NO: 15434 - DNA, 3000 bp, Unknown; identical to SEQ ID NO: 15414
  misc_feature (1)..( 3000): cDNA_ID_2035028_gDNA_ID_2926133_Annot_ID_138829 3000 nt of promoter + ATG

SEQ ID NO: 15435 - DNA, 3000 bp, Unknown; identical to SEQ ID NO: 15413
  misc_feature (1)..( 3000): cDNA_ID_2997104_gDNA_ID_2926133_Annot_ID_138830 3000 nt of promoter + ATG

SEQ ID NO: 15436 - DNA, 3000 bp, Unknown
  misc_feature (1)..( 3000): cDNA_ID_1396277_gDNA_ID_2926134_Annot_ID_138832 3000 nt of promoter + ATG
catctctgttatagttgctcgtagctcttcctctttggtctttgcatccaactctagaaataatgagaaatcaagtccatattcagtgtacacaaaacgatgtgagaaccaaacatgtaactagaaaactaaaattcacctttatcactgtatcttttctctgcagattgaagagaagaagaaagattttccttgtcttgaacatgagtttcatccacttgttggtaccatctaacacagaccttaagcttcttgataatatccgtcatttgctcaatcttaccctattagtaccacaatgcaaatacatattaaagtgatttttttcttagaatctcctataatcaaccaattggttattcggttcacaaaccttggtatcaaattttccagctttagctctctcgttaagcaaagccaacacttcatcttttgtaaactcaactttaccacactcctctgtgcttcccacatcgctgttcgcatcttgtctgttcactgtcgaaagcacttgtcttcttccagtaccttgcgtctccttccttcgcttgtcaaaaggaatacttgagagcgcttcctttttcttaaacatagttcaaaaaccaacaaaattaagtaaagccacagacttttatgaatcaatttctcaagagaacccacaagatcttctcaattgaacaaaaccctaaatcaaacaattaaactgaaaaatatcgttatgacttttacaatctccgcttctctcttagaagaaggaaaataaaagaaagaagaaggcttacgacgtttggactaggtaaaggagcgcgattctggttgcgaagtggcatcttcgatggattgcttcaccttaggctcgtcaataggatccaaatctcaatcccgagatcggcggcggatttcttaagaacccgggagaaatcagacctggttttttctgaatctgagatgggaaattagggttcttgcttttttcctaatgggggagattttaagaattgaggaaggaggaaggaagaaggaggagcctgttgtttgaatatttgaaaacagatcggcggactcttgtcaaaattgtaacgttactcttctcctcgattataatattaactttcaggcccatcagcattaaacaataatcttttttttccttagatacttactctcaggccaattgacttaactttcaggcccatcaacattgtaacgttactcttgtccattaatatttaaattattattatataaagtataggctccatttgagccaattgacttaaaactcggtccattaacactagtgatattccatattttgcgtgactttttgttggctaaataaattatgggaaagaaaaaaaagtaagatattaatcaaattggtttctattttatggttaaatctttttataaaattatttttcttttattttgtataaaatgaagggttttaaaagtttcaaattcttgtttttagtttgattcgcagttaatattcgattttgggataattttggagagttattacttactttaactaggattcaacccgtggtttacagcgggcctcggttttatatgttttttttttttttttgtcatcatcatcttattgatttataaatcagcagtgtagtcacaatgtaaagcatagcttattacattaggaacccaaaaatgattaaggaataaagattggttttggagaggagctttagcaagaatatcagctggaacattgtgatgtcttcttatccaattgaaatggattgattcaaacttccttgaccaccaatgaacgtctcgtatccagttgtgaacgccaaaatgtaccttggatccgttgattaggtcaaacagcatcttgttatctccttcaaagcaaacccgtttgtaaccatgactccaacagtgctgcattgaaatgattagcgcttgaatttcactctccagagcattgtccacctttcttcctatagcctgacccgccagtagataacttccattactatcccgaacaacccaacctgctttactttctacatctccattaacgaatgagccatcaaagttgcatttgatccatcctctttcaggtcgtcaatcttatatggtttttaattaagtatttgattatatttatattataaatttataaaatatttcttttattttaaatttttataaataatgattgagatttttattggttagttgttatttagtgattaaaataatgtgttttaatgtgtgtatgtaatttaaatataagtaaagtagtaacaaaaatgtaaaatagtaaaaacggtgtaattttttttgtgattataagtttttttattattattatttttgtgattataattctttttggaatgaaatatgctcatatttagataccaaaatgaagtagtgataccaatattgttgaacggttaagattgtctactttggatgctaaacatgattaggtatttgaattcgtgaataagtgactattattcctaacccacccgaaattaaaaatgtggatcatataaactttaatagattgaattgaccaaattattcttaatggctatgtacaaaatccaaaattgaaattgaggccaaaattatctatttttcaatttgtacttttttttaacaataagggatttcatttatttgtcaagttggattggatttaagttacaatttgcttagatattatcgaaaccggttttcaattaactttgactaggtttaaccgaattggtcaatttccacgtcattcagccacgtgacaatcgcattctgggaacactcgatctcaatcctatgtggcaaaactgagaatcaagaaaccacgtgtcaacatattagtagttaaaaccatatccgagtaatctaagtaacaacgtgaatcagataaggtattctttgtcacataaccaaacaccaaaaattataactcaacacttcactaatcaattattcaaagcagataaaaaaaaaatg

SEQ ID NO: 15437 - DNA, 3000 bp, Unknown
  misc_feature (1)..( 3000): cDNA_ID_2035053_gDNA_ID_2926134_Annot_ID_138834 3000 nt of promoter + ATG
accgctggaccgagtttagtaatgatcgggctcaaggaaccgtgggtttcaggctcgatatagtttcgactattcggtttaaactccataggtggatcagtaagcatcataggatgcacgctaattgcaacatcgtggttggaagagacgggttgatcttgcccaagtttaaccataaacggtgtccagtctacttcacttagaaagattgattggtttgttatttgctattctctttatattttactttccttttgaatgattttgctttctttacgttttgtaacttggatttgggagtttggtttttctcattaaatgtatgatctttgagttaaacatatcaaagaaatcatttggtaaaagtaaaaacgcaaagcaattggcagatagttcaatctattacctcagtcttcttgagtctggcaaacagaataagttatggtttcctcttgctcgaaatctgagcttcaacaatttgccttctccattgatgaattgggacctgaataagaattttttgtaagatgaaacaatgtttatcggaagcaaaagcagagtccggctctgtttttttatactggcttatgataaaaaatcaaagcaaacttgggatcttggaatcagatggaagtgaagactcaatcgaagagaaagagagatgcttacagcaggaaaaccgccgtaatcccctggttccgtaatgtttttagtaacacaactattagcagcaagtcgaacctatagtcggaaaccaaaaacggatttagatgaagcactgcacaatttcattactccaattatgtttctatttttttaccttggatacaatggagacatggtctcgaacagctactcgtcctcctagtgctacaaagtcaccaatcctacaaaaaataattgtcgaaaagacgagaagcttatagtttcaatcaacggaacataatagttatttggttgctgggattagaagcatttactctgctgatccagctatgcctacttggccacagaacaagcaacatttgccaataatcacattgtgacctatctgcaatatttaagtaaacagaatagcatctcagttgtcatttacttgtgatctatgggggagttgcaagatagaatcgaagagacacctgaactaagttgtctatcttagtatcatccccgatcacggtatctctccagctgcataaatagtaaaggatatggagctagaaaagagctttacagggaactagttcttgaaatattctgttacctgccccgatcaatgcatgtgtttgctccgatttccacacgattccctatcttcacatttaaagtctagggagagcaagaaacagaacaaaggataaaagtgatgcacaattgttatccagattcaagagagcaatctaggtgtgcttacttgaggcttcttcaccatgtttccgttgtcatccacgtaaaacccaaatcctgaacagttaaaaaccaatctcaattcaatgccaattctcagaagataaagaagaaaacatggacttggtccataccatcttgaccaatgcagactccattatggatgacacataaatcaccaatactacaattgctgactgaaacattatacctgtagacaagtatagattctttcaagattctcttcaaaaacatgtataagacattaagcaaaaccgttacccgatctttgtagaagggccaattttgactgatgatccaattacagtgttggatcctatatgaacctctgctcccaatatagcttcttggtgaaccactgctccaaactcaaccagagccgaggaatcaattagggccgaacgatggtacattcctcctccgtttcgccatcttagaaaacctttctcaacattacctccactacttgtctctaatcttgacagttacaacaaaacacaagaagtatcagcaacaatcatttacatagaatagtcaccacctttacacatataacatctttccaccatctaaatatcacaatccggactctttaatagcgtaaaatgtttcatgcaacaattgtcatcaatattcgttcatcacaatgctgttaaatcatatacagatcatgaacatctttcccaagcatcataataccacacatgtcagaccttatacacgaaactgatacgaatctaggaatttcactgcatattctcagaggcattccaacaaacaccttgcgtacacgataacttgataagataaatgcaaacaaaagtcaaaactttaaaggtacaaattcttaacaagactaaccgttatgtggagaaacattaacagtgacggattcagttgattgatgagagcaaacccttaaatttcggctactagagaaaaacctagaccgcttgttcaaaaagacaccatgagtggacactgagaacaatgttcgcaaactatttgccatagtcaacaaaatttatagagattcagaagaaactgaacaaatttagcgacacgaccaaaaaaaaaaaaactttgaacttgcttttttttttttccctccaaagctttaaactctttcttttaacaaaacaaattagaactaaaaaatcaacatttccatgtaatattttatactcaacaaacaatcttgaaaccgcttcatatcacttttgtaaacaatgttactcaggattggctattatgagttctaaataaaatctgatgacaaaaaaaaactattttgatgaatttataaattttatgattccccgaaacctttgaccaaatatgttttttaatcatattattatgtcaatgattacaacagcacattttaatttcattatctagacaggcctgcctaacctatggaatattgaagtttgaacataataatttgatttaaacaatcttaattatcaatgactaactgtagtaattagactttgaatcccactaattccaatgaagattatattaagaaactcaaagaagaagaagagcaaagaaaacaaaaacatg

SEQ ID NO: 15438 - DNA, 3000 bp, Unknown
  misc_feature (1)..( 3000): cDNA_ID_2993281_gDNA_ID_2926134_Annot_ID_138842 3000 nt of promoter + ATG
acatgtaattacctacaaagaattttgaaatgaaaattgttcttattgaataatgaagatgaattaagctaagtttgtagaattgatatgcgaattggaaactggagaaagagaacagatacattcgaatttttatccttttttaaaaacattacgttggataattttagtaagatttagattcttcgaggaggctattgacttagggaacacgtaaccgagaaggttaatatgggctaagcccaagtgagttctatttaatacgttcattaaatgatataaatactaaacaaattctctacaaaacaatcactttaattatctctctttttcttcatccgtttctattgataaagttatgaagtttctcgtcgagaatctgaatggttcatcattcgaacttgaggttgattacagggatacactgttagtggtcaaacaaaagatcgagaggtctcaacatattcctgtttccaaacaaacccttatcgtcgacggcattgttattcttcgagaggatcttactgtcgaacaatgccagatcgtccccacttctgatatccaactcgaagtctcatctgacgatgataaccctaatcacaacgactgcgatcaaaagccgcaaaccgagcaatctccagcactaccattggtttcagcggaagagtactttgagagacaagattggcctttgacagcagaagagctgagacagatttatagttatcggcctgagcatgaaggttgagagcaaccacaacgatgatcaaaccgagcaatatccaccgtcgtcgttgcgaagatgaggcttgacgagatctttggaaacttttcattattatctttggaaatttttcattattatcttcaatgtgtttactattttttttaagttagtttagataattatagattatttacattttacctaaggttttggtttctattttcttaataaatagctcattatttcccattatttcatgaagttatttgtttagttgagattttataaaaagggataataaactaataagcatactagattgtaactcgtgttggtagtagaattttaatttttaaatatttatttaaagttggatcattgtttgttttataatacagctttaatcaatccatacataatacaaaacaaagaaacttagaccatgcacatagttggtattcataaagtatcataacattttttactattaattttaatgtttatttattgtttgagaatttttataatactgataataaatctgttttcagtgatgagatccgtaatgatatcattgaaaaaaaatatttgcaaaatcgaaaatacctgctagcatcggccactacaacgataccggagacagtccgattgaagagaacagttaaaagagaagcgcctccgacgtagatataaaggagtgtgagagaatttgcgattaaggttccaagggatctgaatttggaagatgattctcgttttcattgaaaaagaatcgtatcaagatgcactgaagaggagagaagagaagagcaaatgattttttttttctctcctttcccacaaaaacgcgttgccgactaatcacaagccgccaaatcatcaaaaactagtatcagaagtatctctccagtgatacgacttaggcccaaatcagttgttttacccattaatttaatgttttttgggtttctgatactcataaaaatcctactatgtacatggtcttacccttattccattgtcggtgaaatccttcagggtttatgcttttccagtgctaaaatcgcatttcaacgaaaccgaatccctaatgaatgaaatcgcatttcaacaagtagaaaaaagtgataagactagggctttttattcaaaatctcggttttgtttaaattcgaaccaaatccgaccggtttacttaattaaaccaaattgttaaccatctctcagaagcaaacccctaatggcctaatccgatgatcgacctagttctcaatgtacttgaagattttatattgccttctactcacaatattatgcataaccctattataaagatgatcaatgtttatatacagctacaaactttttcattctcacttagtctcattgtattatcaatcaacgatatagctctataccatattgaactccgatgatcggggctataatcggagaagagagagatgtaacaaacgtttattatcaactcaaaatattgttacaaagcttaaactaaaattagttacattcacatcttatatactattcacattaatcttaaaccgaaatctagttaactggagttaaccaaattaaaccagtccatctatcccaataattcattcattcatacaattttatgtacaaggttaccaaaagaatcaaagagaaaacacttggcttaagtaagagtataacaataaacagacaattaaagaagaatcatatgcatatataatttcaccatgtgatattgaattatataaaaagaaattttcacagaagtggacgaaaaaagatttgctctcaccgtttgtcaaagtgagaactggttttcacgttttgtcttttcattcaatttcggaccaaattaccctgggaaaacttaataatggcacaaaccaaaccgtgcagcagttcgtatcggttaagttgacggcgtaaaccaaaccctacagcagttggtttcggtttagttgatgcggttcagttttgaaaaagacaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttggatagttgaattgagccactgaactcccacatccggggaagtgaaagttactgtttttctcggcgaagccaagagaaagttactgtttattccggcgaaatttgaacctccggcgagatagcatctttagct

SEQ ID NO: 15439 - DNA, 3000 bp, Unknown
  misc_feature (1)..( 3000): cDNA_ID_2110032_gDNA_ID_2926134_Annot_ID_138847 3000 nt of promoter + ATG
tagtatgatattgtcctctttgggtctacatgttcaagccctcaagaatttgttattgggttacttcccaaaatgcctcatactagttggagttggacttgacttatatattagaaactctttttcttaacttccgatgtgggacctttggtttatacccaacaatcaaaatacgaattagttacgaattataaagtataaaaacgtaattaaactcagatgaatgaaaatccccaaactcagctttcctcttacggaaataaacgaattttcatgtaactaccacattgctcgatgtttattttgatcgcgtacaagggaaaaaataaaaatttgaaaaatgggggatttgaagtatttttccaatcccttattttactcgtctaataaataagaaatgtttcgctttatcccttaaatgtttacataaatctattgatatttagtgatttgagtatcagcattcagcattattgataactaaagtgggaaaaatgctcataccaaattacaaatgtggtaaaataaagaatttgtgttcttgctctaccgaattaaagaaaataaaaattattattctttaaacaagagaattttgctgcataagaccaaggaaattgtgtccgcgtgtaagaattgttgatcttacgtggtttgtctccagtcgattttaaggttttgccttgatcctagtgtttcttgctctctccgattagttggtgaggtgtgttggtagttgtatttggtttttggtcgcgttggattcttgctttcctccctgtcggtttgctattggtttgtcgtcggtgtgaggtttctccggacttattggtgcttttggtatttacaggttctatagggatgctttgtgaaagtctctcatgcctttgttcaattctagtgcttagattgttttttctccattaattttgtatcttctttcgatttctgtctctatatttggttttaatcagttttgctatattttggagtttagtttccctcttttgggcaaatgtttcagggttattgtgagaaaaaacaaagaaacagtgattattttgacggagatcgagagagagttaggagaaatattaaaaacaatcggagaaagccgaaaagaacgacgagatattgttttctttttcctaaattattctttaagaaaaagggcgtgacggggacgatatcactgagcaatcaaaggggtgatttataaatctaagtgacggcgatttagttgtttgataagttctttgattgctgatttggaagattttcttttaaagttaatccacatggcaaaaatattattattagaagaagataaaatattcattaatttttatagattttctgatatttttagctaaaacaattctaaatttatataatatttacgagtttaaaaaaagcatttacatacataacttaattatcaaggaaaaatattaatagttagagatatcaatgttacaaagttatcagaacgcacaaaaatatacagaaagaaggtcaatatgataaatcaaattcagaaaacgtaataacaaaaaatatccaattaaaataactaaattaatatgaggttaggtagcaaacgtctaaattacaacacaagtaaatttttagccattatggattaatgactattgataaaaaaaaaagtaaaaaaaataagtagaatagaatgaaagtagtgcttggtacattattatgattttttatttagtgaatgttttcagaaaaatttatttaagagtaagattaatggagaatttaacacaacaatttttttttgacttttttttcaattagtttgctagttttttaatttaattaatgtagaatgacacatatcattatttttatgataatatgtcactcatatgagtgtttgacaattttcatatatataatttcaactaataataatttagattaaaaaaaaacaaggaattcaatgccaagaatatcatataaaatatataggaaaagtattaaatttggttgacttttcattttagtcacaaacttttattaatcaacccgatttagactcgtcataaaatattttgatgaaacgcattaacgaggttaactatgtgttacttattatcagttatctccataatcaatctgctgataaatcaacacaatttattttaaaaattttagtcaacaaaaatactgatttaaagtatctaaaggaaaagttaatgtcttttcaaccaaattatttgttaaaaaatacatattttctaaaataatatgttttgctaataaataaaaagcaatttaaaccgaccgaatgatatttacttttgtactaatttggtttctattttcatcataaaccaaattttaataaaaaaaaattttttaaaaaaaacctatgaaacaataacgccggattggaaatagtgtttttttttgggatttttttaaattaacaatttgctctaatttctttatttaaaaaacgcagaaaaaaataataagataaaaagaaaagtgagcacgtagttgtcatttgcagatattatcatttgccaattttcttgtaaattcacctctttccttcgtctatctatcctcccttccgcaacattgtaagaacaccaaatcccctctcatttccaattttttgtatatcttcttgtttcatatttagatcatccaatctctaagaatgttaaaggtcaaattttaaaatttttttgtcggtttttttttcctctccggtgtcggaatccgacaacgtaaggatgattcacataggtttttaatttttgatatgaaaagagattcttctcgtgattggcccatttgttttgttttcaacaatgttcacgttttgatcgcaaatttaatttgatttccatgataaaaattggaactttcttatgttgtgatcatttacaacaatttgtgcgtgatgggttgttctcaatgtaggattttgtttgatgatcgttgggttttgaaagaagagcaatg

SEQ ID NO: 15440 - DNA, 3000 bp, Unknown
  misc_feature (1)..( 3000): cDNA_ID_3046844_gDNA_ID_2926134_Annot_ID_197125 3000 nt of promoter + ATG
aggccattcaaaaatatgaataagaataaaaaaggtttaagtgctattcagaaaataaataattcttcagaatattaacaattattttggaaataatttgtgttggaaacatgggaaaaatcgtttggatagtttgacgaagcaaaacaacatatatcataataatctcgaaacaccataattttctcagtttatcccacttcttaatgtaatttttggttactaagagaataaatgaatgagtaagacatatgtattttgtttgttgaggatatttatttcgtcatttattttaaaaaatgttgtattttaattttttattattattaaaatatatgttttgtcactatgttacaacataattcaattttgatatcatttatatttataaatatatttaataataataaatataagtaaataaaattcacagcttctacaactttttgttaccataattttctacaacataattttttaaagtcgaagtctctacagccaaactttctacaacataattttttaaagtcgaagtctttacagccacccttattgtattaagtcttaatatagtataaaaataattactttatatatctaaacagaaaataaaacatagaaaatatagtatatctattttattacgtaaaaaagttagaatatgttttgttgtacaataaaaaatgtaatgaaactcatactaaaaatttactcttttacatgtgcaaattgcaggaattatatcgagaatcattgttgcttttaaaatttaataatcaatgatatgtttttaaataaatttaactctcagataaattaacaatttatttttgaaacttatggttttaaatgattggttttgataatttatatgtttgttgtgtttattcattatatgtgaatacttagctaataaaacgggatttgtaaaacaaatatttactaatatatacacgtttataaattcttccatacactaaccgacaacgtatatactaacacatgacgttttacaaacacacaacgtatacaactatacatactataagattcatttatactataagattcaaatttgatatagactttaatactttgtaaattgggaaatatgtcagaaaaatcgccaattttcaaaaataggacgaaaaaatctccaactcctcaaacgtcgttttaatcacaaacttttggttgacttttccagaaaatacaaaagtttggttgacttggccaaattagtcatcacgttaagtctccgttaggacgacgattacagggttaataagccgttaagggcttccgtcttagcaaaacgacatcgtttctataatgacaaaatgagccataatcgatagaaacgtcgtcgttttgattcagagagatttgagaaattcccaaatcgattagaaaccctaaaagagagaaaattctgaaattctctcaatctctttccaattgatcccgatggcgaagacgcggggaggaaactggaatcctcgtcggtcgcggaggctaatggctattgcaggcgaagctaacagagcaaacataacgaatcgaccaccgaaagttgttgagatctcagaagaactggagacaaatcaaaacccagaagaaaccgcgatgaatcagatcccagaagaaactgcgacgaatcgaaacccagaagaaactgcgacgaatcgaaacccagaagacaatgtgggtgggactgttggtgaagacaatgttggtgaagacgatatggatggaggtctagaggaggaaaattgtgatgattttgaagcagattttggtgttggtgcaagagaagatggagatgcaagcaacactgatgctgacagtggaggtaaagattgtgatccccaatccacacacacttcgatggcacatcacattctccggtgactccagatgtaacagagcttgaactcattgttagagagagagagatcgaattgaagaatagaaattttagggattgaaatctgaaatcgatttgggggtttttagagtctcatctgtcattacaaaaacgatgtcgttttgctaacccggaagccgttaacggcttattaacctcataatcatcgtcctaacagagacttaacgcgatgactaatttggccaggtaaccaaactttggtattttctggaaagtcaaccaaaagttttgtgattaaaacgacatttccggagttggaaatttttccatgcaatttttgaaggttgaagatttttctaacattttccctttgtaaattatagaagataacattttatccacactaagaatccatcaaattagtataagatattaccaaaataacagacgaattaaaatgttatctcgtgcaaagcacatggtactgacctatattaatgagaatggtatgaaatttttgttattttaattacttttacatattaattattctacacaatttatgaaatactaactgtttttccttttgtatgtgcaggttgcaagaattattatatgaatactgacctactctataaaatttaacagctacatatgaccgagatatgctgagctgagattttgcagaagtgacgctttttcaagttttcaaatttagtaaaaattaaattaaaataaataaatctggcgagatatcaaatcacagccgttgattgctagcaaaaaatctgacctctttaaactgtaatagcaaaaaaatctagttaattaggctaattatctattagatcgaactttcacgttgtttcaaatttaaagagttacacagcgtgtcggccacttaaaacgatgtcgtaatgttgtttcccctcctcgacaagcgccaagcccgttaaaatccccaatttggatatatatcttttctctgtcgacgctctctctctctctctctctctctctctctctatcttaactcaactattcagtttcaattttcaaatttcagaaaccattttctctctctatctctcttcttcttctttatctcagta

SEQ ID NO: 15441 - DNA, 3000 bp, Unknown
  misc_feature (1)..( 3000): cDNA_ID_2165766_gDNA_ID_2926134_Annot_ID_197120 3000 nt of promoter + ATG
cactacttggcgactaagtattggtgactgaattgcgactatttgacgactggttacaggttgaattatcgattatacattctgtttttagttaaaactgtaattaacaaacttgataaagcaactaaaaaactgtatttcacaaacaaaactgtaattaactaacaagctgtattttataaactccgaaccttaattcaaatacacacacattaatacaagttcttaagtttgataagaaaagcaactaaaggaaggggaaatgagatgttcactcctggggtggatcttgtgaagcagtagcagtctggacatcctctgtttgatcttccgaagcagaagcagtagcaccagcagactcgaggaatgcgagaaacttggggtctctttctgtcaagtacttcttaaccatcctcaagtgtttgatctcttcttgttgctcattagcaacacgcttgatatctgcttgctcagctttcaccctcaatgcctctgcctcacgatgtgcctggagagtcgcttgttcttctatcttgcagttggcttcctaaagctgtgactgcaaggtagtgaaagcagaactgcagcctgggtacttccgctttccattgatgtacctccctaagcttcccattccaaagtatacccatctcttgtttgtgacagttgactgcaaacaaaagacaagaggattattgtagaaaagatgaagcaagtgataatataaaaaaaagacaagaggaacaagaccattacctgaaggaagacctcatcatcctcctcctgagatagttctgatcgacgggaagtaccatctgacccttcatcattctcacgggcagccaacttagcttccttgttcctcaaatatgcctcatgaatttcatgcgccttcctatcaacaaaagtcccatcttttttggtatgagtcttaacgaatatctcaccaatagtaggtggtcttcccaactcaatttcctgaaatgttgttcacaaaacaattcagactcttaataaaaatcattctataaataaacaaatgtaacttactatctcttgctcaatctgtaagaaagactttggccccgatacatgtttgtgaggaccaggaccattacggtcagacattcaagctgctgatgtggttgaactcttggcaatggcttcttttgtgtcccaatacgcacacatttccttccacaatgtcttctcaatccatggcggtcgctcatttgcacgttttgcgcaagccttagaaaccatgtccttcatacgcgtttgacatattttaaagaatttttcttcaactacaccagtcagtgatggatgccatgtgtgtgtactctacaaaacaagaggagagtttgatgttagtgatcaaacaaccaaaccaaaccaaatgtaagagattaataagagatagaagttaatttattgcgaattcgaggaagtatatgtgtcttctttcagtaggtacacagctccaactgtaaaatggcccattaaacttgtttgtgaagacctttgtgatcttccgggtcagcttaccattgtcgtgaccaaaccttcaattacataaaccaattagcatatacaaacctaatcaacttagcatatatacacacattactcaatattaacgcttaacctaatcaacttattaaatatattacacacctaatcaactttgaggatacacacacacattactcaatattaactcttattctaatcaacttattaaacacctaatcaacttaataaactaagcttaccatagggtttcacacacttaacacacacatattacacacctaatcaacttagcaactctccctaatattctcagcttaccatacggttagaggctcaaatgtgggagagataaccgttgtatacttctcacggcctggctgggcaagcatgtcatgtagatttgcaagcaaagcttcagggagagttgattccctttcaagatcagccacaaactcagcatcatcatcttcatcttcctccgcgtgtgagttttgagcttgagagctgtgatgagatacataggctcgaggtagaggatttgaggcttgcggaagtagaggattggatgcttctcgttgaaccagcgctatagactgattggaggcattcttgtgaaccgccgctggagattgtctcgccgtagaggctagacgatgaacagatcctccagatctaggttgagtcgagccggatgctcaaaacagagtcgatccagatccacgaggagaacaagatccgcgaggagacccttcgcctgactggaaaagttgcgtcggaggaggatagtccctgacggatggacccgttgaaggctgtgcagtcggatgatgttcaaaatcttgaagcggggctggacgaatcaccagcgtgaactcgtagtggctgggatgaccactgggccttcgatttgatgccctagtcttcggttcaactcgaactggctgggaagaagtgggtcgatttgagggaatgtttgatacacttcctcttcctctcttgcctccaccacatgtcttcatcacttgaagctaagaaacgagagattgagaagattgaagatggattgatgaagtttaggatcgaaaggggattagggttaggttagggttcgtcgagagtgagagagtgaagagaagggggattagggttagggttaggcgtaaaatcgtttatatagtctgggtttagggctaactttactggatcgttactaaatcaagcatgtgaaagcccaattaattgcccaaataaaacatatgagtcgctaaatggtagctgtacttggtgacctattagcgactaaattaatgagtctcacattcaagactgattagcgactattgtataatatagactaattagtcgctaatacgtcactatttagttgccaaaacttacgactacataatcagtcgccgaattaagtagctaacaacgtgatttcttggtgatgacgaattcatg

SEQ ID NO: 15442 - DNA, 3000 bp, Unknown
  misc_feature (1)..( 3000): cDNA_ID_2165774_gDNA_ID_2926134_Annot_ID_197117 3000 nt of promoter + ATG
tgtccgagtgttgtttagagatttggcgctgacttgatcagtgtcagaaacagagatgatggaacataggtgtgatactacattgttgttataacatatgtgtcgaacagagaacaaaaacatatttgcttaatggtactttattctctgattttcaatgattgtctctgatactttttcagaatgagactacatgaatctgtagaagaagaaaaaaacgtaattgcacccatcaaacccatcgtctcattatgtcctacaattaaaacagaaattgaaatccccaaaccgtgtttgaattattcttcaacattgggtgacaataaatgtatttattgcttttgccctcgtgaagattaattagggcataaattgtatttgtaacttccacttcttcttatttcatagatctgacaattttatttaccctaaaaaaattgcttcgtcgtcttcgttgtcgtcaactcccttaccttcgctgatgaaagacaaaaagttgagaaactgggcggagcttccgtccaagttgacgtcatcgattctacttcgtcttggcgctattgagatacttcaaaacgctcaaaaagtgtgcaaaccgtggcatcgagtctgcaaagacccctcgatgtggcggaagatcgacatagataaccgcaatgatagggcagccttcaagtacgacctcgagtcaatgtgccgtcacgcagttgatcgtagccacggtggtttgattgagatcgagatttggtactacggtactaatgatctcatcatgtacatagctgacaggttctgtttctccctagctctctttccatgttaaagagaatttggtcggtgctaatactagggttagagtgtttgctaactatagggctaagagtgatcggtgctaatccaagggttcgagtgattgctaattctgaagttataagtgattggaggattttgtgtcactctttttaaactagatttatttttatctgttctatatccttctactgaatctctgataaagcaccttggtttgcttagtggttttgtcaacgaagtgttctcaataaggttatgtttttgacttttttagtaacaattatttgcaggtcaagtaatctgaaaagccttggacttgtaaggtgctttccaataacagatgagggagttgccaaagcagtttcgaaagtaccgttgcttgaataccttgaggtttcatactgcttgttttcaggagagtctctgagagatataggccggtcttgtccgaatctgaagacactgaagctaaaccgagcccctgaaatcatgttttcaaatagtgggtttgatgataatgccaaagcaattgcagaaagcatgcctgaactacgccacctccagcttttagggaacgggctaaccaataagggcttgaacgccattcttgatggttgtcctcacctggaacaccttgatttacgccagtgtttcaacatcaaccttgttggggatctcaagaaacgatgttttgagaggatcaaagacttgagatgccccaatgactcagatgacgattcagatgatggctcagataatggtgcggtgacaacatttgggtcacaatttaatgaaaccgactatcattggtactagatattgaatctttctgaatcttgcggaaatacctttgttgttgttgctttgttttttgtttttgacaattgacacctttgttgtttgacttatgaatagtttcagtttcctttcttggtagtttcagtgtctttcctttgaacttttttaagaagttttgagggcgtgattttaagtcgttcgagaacgatgtcatgggtctttatattttttttagttggtacattactttcacgattgtttagttacatactatcaaaagtaataatattataattaattaaatttacttatgaaaaccactaattttagcatcaatccaaagccttgcgattgatagcttaaaaaaaatgttgagtagacccgtagctatagagagaatataatcgtgtaacacttttcccttggtgtttcatcaccaatttcatttgatctttatatcaacaatgtccaaaacacaaggtatggtgtccccatgcaaatcacaacatcatcaataatcactagctagtagactcttaatgattgtttacgtgatcacctaactgtataattgactatcagtagagccggaccataacacatgaagatgaaacattccaatggggctcccattttaaaagggcccaacaaaaattttattttagttaaatatgcatatattaatttttgataataagagaaaatagttagttttatacatataaatcacaaataattgtgtgatccaaaatatttataaatctaatatacaattaaataaataattcaaaattttgtttaaattggttttctatttactctatagtttttaagacaaaaatattttgttttcgtaatttaaatggggccccggatttcattggtccgggactatcacaagaacagaatataaggtgataaaaagaaataagattgtaaataacttttccttttggtaatattttttttttttgttcaatccttttggtaatgtgtaaaaattcacaaattatcaaaagaaaaagagtggatattgattttactctttacttttggtgaatgcacttttggaaattgattttactctttactgtatttgggaatatatgcattgcaagttacaagtcaatttgttaataaaagtgttgaatgttttgtttcatctacattattattcttcacctttgttctaccgggtttaggagtagaaaacaatcaaatggattctcagattgttaatcttctgaggtctaaacagtattgtgggcctaggcccaatacattatttcagtatgcttggcccaaattagtttcgtataaaataagttttaccgtgaggaactaaattgtaaaacagagacggatacggcaattgtatcctttagaatg

SEQ ID NO: 15443 - DNA, 3000 bp, Unknown
  misc_feature (1)..( 3000): cDNA_ID_2182795_gDNA_ID_2926134_Annot_ID_197109 3000 nt of promoter + ATG
atcttccaaatcgagtttcctgccatgtcgatttcacaaaacacgatcagttttgagattagcaatcacacagacaagaggacaaagatagaaaaaaagaagagggaagagaacataagagatgatcacatacctgtccaacaccggcaatcagaaatttacccgattttgcaaaagccaaagagttgacaaatccagtctgtaagatcaaacaaggcattgcaaggattattacttggtgaagtgaaatgcattaatcacagtcacaaacaacagattcatcagacaacactaaggaatataactagtgaacgaaaatttaccagtggaagctcgtacaaaggtcgaattgcattagtttcaacagcccacaaacgcacaaaaccattaccagctccagatgcagcaagatcactgcctctactagtagcaactgcattgacccaagaatttgctgaacagttattgttgactggttcatgatcaccgttttctgttaagcaaataaataagaattagatatttcagagcatcagtagctgcaacgaaacaaaagtgttttataactatatactgcaatgtcaagatccaactgcaacagagatgaaatggggaggatctaaattaggtttcacctaagattccattggtggtaatcccatcaggtatatcttgatgtgcattcttgaaaacgaacaccggtttcttttttaacatgccccaaagagcaacagttccattatccgaaccagacaggtactcattatcactgatgaaacagcagctctcaagagacgatgcaggagctcgatagatcatacgggtgctctcaggcacctataatcatataacaagacttacaaatacagaataataatagaaaccttatgatgatatcttccaacagtgtttacatggaggatagaactattaccttatgatacagcatggttctatctcttccaaccgtaagtgcacgctccttcctcagtgcatcaatggctagaatttcaccctggtgtccatgattttcagttataaatgctttatcttctacgttccacaccttcacagttctatcaaatgaaccagaatagagttctgaagttccgtatctgaaacatagacaagaaactgtgttccggtgacctggaaaggcctgtagacacataattgtaatacctgagcgcaagacttgatgaagaacaaataaaaaaaacactaaacaaaaaccaaatttattatcattacctggacatgctctcgggtacgaacatcccaaatatgaacatgacggtcaactcctccagtggccaaataacgaccatcagagctaacagctaaagcaagagattctctactgtgatttttgttacgaggctccctcaatttcatcccatgcgacttgagaatttcatcacttggccatatgtatttgtcagttttaccagaagatacatcccaatgcataatagtaccatcttttgaagctgaaaatcctctagaatcgtcatccgataaagctaccgacacaacagatcgtcggtgcttgacaataacactaaacccatcagtacttagtggctcctgaaccctgaatcattgaaaaactttaatcaatactactatcaaccaatcttcaaagatatcaaattgacctaagaaatgtacaaaatcactaagtttcttcacaattaaaccagctccctaaaacactaactacccacaaaccctaaattaccaacaatctcaaacctaaactatctaatttgaatacattgaggtactaaatttcttccttacctcgatgcaataagtcttcgaatcctaccactatcctcctgctgcttctgcatcaaactcttcttaatagtctcatcgtcatcttcatcatcatcatcatcattatccgcttcctcacgctctctcctcatcgcttccctccttctattcagcatctcctccgccaatctcttccgcttctctcccgccgtctcatcagcaaactcatcttcatcctccacttccccatcaactcttctcccatcttcatctccgccagtaaatccgttctcttccgcatcagagtccacagactcgatatcgtcgtcatcgtaactgacttttctccgtttcttcggctcttcctcaaaaaatggatccctttcattcgaaccctttttacctcctctcttaaagcttcctcctttcttcttctcgttgttgtacttcattcttctctctctcactccctcttagggtttaacgattttacactttgactcgtctaggtttagcctcagggtttagtggcgacggaagaagctggaaaacgattttgtttatttggtcggaaagtttacaactttaaaccttccactaggttttcttcaggaatcgggtctaccgggttgacccggactaaccaagcccatgacttacctggtctatggtttgagcccattaactatttcgttcttttaaagcagaaacttgggcctttaatttgtagagccgaagactaaccggaccgtcaatttaagtttggttcaatccgatttctgaatttttggttctgatttctgaagagtagtacgtaaaccgaattgggagattctcttatttcagtaacagtttaatacagtttttgtttagtgttttcaatttcggtattttttacaaactcgaatcggatgattccggtttaataaaatcaaatgagttcggtttagctgaatttaaaactgtttttaatcttatagtataccgaaccggaccatccatctaatttcaattgtctaccaaaaccgaccgaccagtctttgtcgaaagttgtctttcttcttccttgttcgattttcgcctcctttggcttttcattctctctctaacttctctatgttaaaattccgaaagctcgattcagaaatctagaagcttcctcgagggccctcgcgtagaaagtcgaactcaaattccctggagacaaagaagaggaag

SEQ ID NO: 15444 - DNA, 3000 bp, Unknown
  misc_feature (1)..( 3000): cDNA_ID_2182799_gDNA_ID_2926134_Annot_ID_197108 3000 nt of promoter + ATG
ccacaagagttctttctaatgtgaactctggaaagacttatgcatgcccagataacaaagttaaatgcatgtacaaaattcttcgtagcacaggcatgttaagatatttgcaatacctgatatagtactgcaatagtgggctttgcacatccaaacagaaacttgatatccagaacctgcaattcctcaagcctgaaatttagacaccacactcagtacatcatcattcagttttaaatatccccagaaaaatcatatcgtagtgattctagaggaatgagtatattgaggattaaacagtttatttacgaaagaatctgatgcctggaaacaaatgcacactagaattaaagagtacctgatattaaaagcttccttgagctgtcccttattatcaaatggaataacctaaaagaaaaaccaaggaaatagaacgcatcatcatacatgtataaacagatagattagtggaagttcagtaacatgatatatttaagtaaacaagcacatctgtcaaagtttttatagaaggtaacattataccttgaacaagccgtcatacagatggagtccaattaatctacaatctggatcaattataccaatctacaaagcaattgtcaaatcagaggtaagctacatgcccaccaaacccttaatgacaacgcatattttttgatgaaggaaagtaaatatataagcactctgaaatgcacagtcaagacgacgatattcaatacctgaccattgtctgttggccggcctatacgatcagaaacatcccccattgctctgaaaaaagtcaaaacatcatacagaatcagctgtaaagtagaaaatggtcatctgatatattgcttccaataataaccagtaagatgcaacaattacgccagcaccatacatgattttttccatgctttggatatacagcaatgtatcaattttgtgaaaggtgagaacctataatcaaactctcataaaaaatgcttaatcagaaataggttatagatcagattttgtaaagcaggaatatgctgtaaacagctatctaaaacaggcaagttggtaccatgcactaatctgtacataggtgacgagtgtaatacatttatttctaacaaaaaaatgataagataacggcgaacatgatcatgaactaaaagaaaaatagcacaactggttggttaacatcaactggatgcatggaaaaaaatttatcttttggaagctataccttgtaataagctcagaggactcaggatcccattgaagaacacagaatttgtatctctcagttgcaatgaacaaaaagtcttgcgcttcgccctacaaaagacggtggacaatactatcaacattttaactcattattaagaccatgacaaaagaacacaataagagatatatactcacatggggtcggaacaactccagagtagcgattcttccatatataggaacgtccaacataggctgcaatataggaacatccagcagattcttatattactaacaaaacaaagcatgacaacaaagtttttgaactttatactctaatgtacatggaacttaatccatataagcttgacagaatagagatgtatgtacctgaagtccttgtggggtaagcaaatggatctcgattcgagtacatttcctgagaacagatcaacactgctgtcaaactaatctactaatggatctgatagatgttacaatttaaggggacaatgctaaatcggataaatgagataactttcaaacaaatttacagtactgatagctaacgataattgaaaatcctccatatcaaaaaaggcacgatcttcaaatgtaatttagttcaggaagtaaaagccataccaaaaaaaacacaattctttgtcacagtttcaaaaaatccacctcatcaaagaacccagaggcattaaaatccttatagtcatctcccaaactgaaattgaactacaattttgtttgcaaagtgggtaaatttatgaaaattaactcgtgatgggaaattcattgaaaaccctaaacccaaatcaacagctgcaattcaaaaggggactaattgacaaacaaaaattgataacaaatagaggtagggggagagtttcgtacgcgacaatgagattgagctcttgaggacttgtgaagttgccaacgcacgagtgagtgacactggtcggtttgtgagccgtaacaacgtagttccatgagctcatcttcctcttctttgtctccagggaatttgagttcgactttctacgcgagggccctcgaggaagcttctagatttctgaatcgagctttcggaattttaacatagagaagttagagagagaatgaaaagccaaaggaggcgaaaatcgaacaaggaagaagaaagacaactttcgacaaagactggtcggtcggttttggtagacaattgaaattagatggatggtccggttcggtatactataagattaaaaacagttttaaattcagctaaaccgaactcatttgattttattaaaccggaatcatccgattcgagtttgtaaaaaataccgaaattgaaaacactaaacaaaaactgtattaaactgttactgaaataagagaatctcccaattcggtttacgtactactcttcagaaatcagaaccaaaaattcagaaatcggattgaaccaaacttaaattgacggtccggttagtcttcggctctacaaattaaaggcccaagtttctgctttaaaagaacgaaatagttaatgggctcaaaccatagaccaggtaagtcatgggcttggttagtccgggtcaacccggtagacccgattcctgaagaaaacctagtggaaggtttaaagttgtaaactttccgaccaaataaacaaaatcgttttccagcttcttccgtcgccactaaaccctgaggctaaacctagacgagtcaaagtgtaaaatcgttaaaccctaagagggagtgagagagagaagaatg

SEQ ID NO: 15445 - DNA, 3000 bp, Unknown; identical to SEQ ID NO: 15439
  misc_feature (1)..( 3000): cDNA_ID_2110032_gDNA_ID_2926134_Annot_ID_197099 3000 nt of promoter + ATG

SEQ ID NO: 15446 - DNA, 3000 bp, Unknown
  misc_feature (1)..( 3000): cDNA_ID_3088380_gDNA_ID_2926134_Annot_ID_197098 3000 nt of promoter + ATG
tcccagacgtgttatccaagagaccagtaagattcaagattcgtctgtgacggttcaagtgcctcaaatggagcaatctccagcgtcaaactcagtcaaagagatcactgacccgaagaagaagattaaagtatatgtggtggcagcttcaagtgagtgtaaaggtctgaagagatttattgaggtggatgtgaactcgacggatcaagtgaaaatactgagaaccgagttggttgaaagtggtcggaggggtcatataagaatgcctcacgaaggatatttctttgtggacagaaagaaagagagagtattgaacgaagatcagtcattcgagtggaaccgtgttcttccagccgaaacagtttatatggttagtggacgtgatacacattttgcctcgtcttttactcgtggctctaaagtcacaatgctttgtgctcaaaaagttctgtagaaagtctgtatatatgacacagaagaaaccaaaaactatgatacattcagcaacagaaagttatgtggatctttaactctttgctaataggttttaatctttcttcaagttttcttctggcccttaagtcacaatgctttgaaatttttgagtatatgtagatacatagaagaaacaaaactatgatacatttagtaacagaaatttatgtggattttatcctatttgtaggtgtaactcttttcttctaggttttaatatttttcttcaagtaaacttgttgttattgaattccctttagtcgaaagcagcgatcaagcttctcttataagttacaaaccctaatttcagcaaacacaacttggaaacactagcagcaacaactttgttattttaaaacattagcaaaagaaatctcattgcaacatcaaatggcaaaactggaaggtaaaaaaagcagaacttatcaaacaagactaccaatatgatgaactgatgatttttttttttttttttttggctcaacaacaaactttccattcacccatttatggatacacagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacag

SEQ ID NO: 15447 - DNA, 3000 bp, Unknown
  misc_feature (1)..( 3000): cDNA_ID_3088384_gDNA_ID_2926134_Annot_ID_197095 3000 nt of promoter + ATG
taacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactgtgtatccataaatgggtgaatggaaagtttgttgttgagccaaaaaaaaaaaaaaaaaaatcatcagttcatcatattggtagtcttgtttgataagttctgctttttttaccttccagttttgccatttgatgttgcaatgagatttcttttgctaatgttttaaaataacaaagttgttgctgctagtgtttccaagttgtgtttgctgaaattagggtttgtaacttataagagaagcttgatcgctgctttcgactaaagggaattcaataacaacaagtttacttgaagaaaaatattaaaacctagaagaaaagagttacacctacaaataggataaaatccacataaatttctgttactaaatgtatcatagttttgtttcttctatgtatctacatatactcaaaaatttcaaagcattgtgacttaagggccagaagaaaacttgaagaaagattaaaacctattagcaaagagttaaagatccacataactttctgttgctgaatgtatcatagtttttggtttcttctgtgtcatatatacagactttctacagaactttttgagcacaaagcattgtgactttagagccacgagtaaaagacgaggcaaaatgtgtatcacgtccactaaccatataaactgtttcggctggaagaacacggttccactcgaatgactgatcttcgttcaatactctctctttctttctgtccacaaagaaatatccttcgtgaggcattcttatatgacccctccgaccactttcaaccaactcggttctcagtattttcacttgatccgtcgagttcacatccacctcaataaatctcttcagacctttacactcacttgaagctgccaccacatatactttaatcttcttcttcgggtcagtgatctctttgactgagtttgacgctggagattgctccatttgaggcacttgaaccgtcacagacgaatcttgaatcttactggtctcttggataacacgtctgggaacaatcacaattgtatccaagggtttaacactgttacactcgtatgactgatcttcgttcaatacttgattattgtgcgtaaagatgtacccttcttgagccagtttcataagacctctcagtgttttcacctcatccgtaactttcacttgcaccagaatattcgttgggacttcattcataccaggatatggcgacacatatactagcatctgccggactcttttttttccgttagtgatctttttgactaagtttgactgtggaaattgcttcgttggaggcacttgatcgttgttgttcttactcgcaaacttcacagacgaatcttgaatgttaacggtctctttgactgagtttgacggtggagattcctctgtttgatgcgcatcttgaatcttactgatgtcttgggttgtctcaggccgataactgtaaatctttctgatctcttcctctgtcaaaggccaatcttgctccgcaaagtactcttcaactgaaatccacggtgctggaggagattgctctgtttgcgggatttgatcgtcgttgttgtgaatagggttcacgtcaggagagacttcgagttggatttgagaatcgtggaagatctggcattggtcgaggttaagatcttctcgaagaataaaaatgccgtcgacgataagggtttgtttcgaaactgggacacgttgagacttctcgatcttctgtttgaccactaacaatgtatctgtgcgttccacttcaatctcgaacgatgaaccacccagaatctcgaccacaaacttcatgactctatcaatggtgtttcaagatcaatggagactaatgaagaagagagtcaagaaacagagagagcgagagagaaagtgattgttttgtaaagatagttcacgatagaatttggttttaatatcattcattcacatatcaaatgaaccgcatttgggcttgacccatttttattgggttacgtggctcttaagtcaatgaaagcctcacataaaatcatcagtatctatgctacagtatattcttacttatattatccaacggtaatgttataaaaagattgattaaaactatctagatccgacccattaaaccgtaaatctacaaatccgacccattaaagattcttgccggagacgaaaggtattccgattgaggagatg

SEQ ID NO: 15448 - DNA, 3000 bp, Unknown
  misc_feature (1)..( 3000): cDNA_ID_3088388_gDNA_ID_2926134_Annot_ID_197094 3000 nt of promoter + ATG
tacactgcatattaactttataacataactcaagtgataaattgatttgacagccaacgcttactaacacaagtatgacattcatttcaaccgtaattgccccaaccaaattcacagtagtggttattaaagtgaagaaattactgacgatctctgactatctcatttcaaacatggttaacccgactcttcccgacgatttactctcgaagatagctaagaacctggctaaccaatgctggtccgaccttggtccactggtacgatccggcactcgtggaagagacattgtctaccgtccggatgtcctcaaagatgccaatattctcaccttgtgtaactcgcccgatgacttccaagcttgagggggccacaatccctccggatccgctgatgaaggccgacatcgaccattttttttacggtgttttgcagctaataatcccacggcagtgtattacgaaggtattcgtgttctaacgcatgaacgaaacatcaatggagccatcaggctcttacagcgtcatgctccagtacgagcaaatgcaacagttacatgcgccattgtattcatatgtgctgggtatgattatatgggcgacttgtttctacagctcttcacccgcaaccattatccattggactcggttgccactcgaatttgggtgatgagtttcttcaaggaaataaagaagtttgaccctgcatacaacaatacatatggtcctacgttctcttatcctaccagccatggaattagtatgcctccttgcgccttatattgttacatggtatcaggagctttccaaaacgtttgcaaccgctgttacctctgatcgtgtgccaggcgtgttagtcaaatgctatagttaaaatctaaagttgaatatttttcagccaaattcgcatatgatatttagttcccgaagtaaatgtaaatttggatattaaaatctaagcgtccacaactacgtacacgtgcatctaccaaataatacttaaaggttttttgtttgtctcggaaaactagatatgtacgtacactagcatgagatatcaactctaacgtacactaaaaaataacacattcaaacatatgaggtctttggtttgtctcataaatggtgatatttatgaatggacgtacactgatagtacactacagcgtacactgtttgttgggtaaatgtagaaatgtaaatgtggacgtacactacaacgtacactgtttgttgggcaaatgtagaaatgtaaatgtggacgtacactaaaacgcacactaaaacgtacacgtctagttttaagctgttattaaaaagtggttgctcataacaacaataacaaattatatatggaatactattacgttgatttgacaatatgaatacacatcatcacttaatacctttgcaataaatacaaccataacttacccaaccatatcttcaatgatgcttatttaagtgttggaatttcattttgttaaaacaccttactcctaaatataacaaacccaaatattcatgatgatttgcttgcgaagatagccaagaaaatggctgacaaatgttggtggtacctcggacctatgttgaaatccggtcctcgtggaagagacattgtctaccgtccggatgtcctcaaggatgcaaacattttcagcatgtgcgacgatcccgatgacttctacgcggtaggccacgatccaaatgacatcaactccgaaggtcgctatagacccttcttcaaacggtgcttacaagctggtaaccccacggctatttaccatgaaggactgcgtctcgttacacatgagtctgacattcagggagctatcctacacttagagcgaatctccccaaggaacgccgctgcaacccttgcatgcgcaattctttacatatgtgctggtaatgctcacatgggtggtgtctaccttcggctcttcggaagcaaccattatgctttggaatcggaggaggcacgtgacatttgtgaggaggtgctagaagatataaagaaatatggtaatactttaaaatacacatacgctaacagtttttcgtacccggaatgtggtgacttaagcactcctgaatgcgcagagatgtgttacatgagatcgagactcttcaataatctttgcaaccaatgttacatctggttgtgtgctaaacggattagccagatcctgtagagctcacattcgccacgatcctgtcatatttataagtttttcatgcaacaatatgtgagctttttacgttgattatcagtaatggaagtttgtttttaataattatcactttgtaattgattcaaacatactagctcaaactactctaatatgagacatcattaacacaaaataataataaaataataaaatatctacgtacacggtatatgataatgtacatgtggtatagtttaattccaactataaagattacatagtgagcgacggtatagtttgtaaatgaagacgaaagaaaatttgatttgacgtcgtataacacatatctagaagatttcgctccatattaattactcgctgtcaaatacacactagaagtgacctccatcacactctcattaatatctctattagacatacacggttcccgagcaacgtactcaattgatttggcagataaaataagtaagttaatgtttatttgaaaagattgttagtaaatgcgttgacccctaatatagcactatacatgaagccatattgttccacttatatgcaatacaaacagacgttaactcaaccttctgtaagaaaacgtaatgagtattttatagacatacacggcgcgattatgagaggtacacagtagtttgtttaaattaaaagttactaatatgatgcactaaatatacatccacgtcacccacccacttacattgatgattattcccctctttaaaactcatgtcaaacacacttagttgaatacacgaatccgtctaaacctcctcgtttgaaaaaca

SEQ ID NO: 15449 - DNA, 3000 bp, Unknown; identical to SEQ ID NO: 15438
  misc_feature (1)..( 3000): cDNA_ID_3088392_gDNA_ID_2926134_Annot_ID_197092 3000 nt of promoter + ATG

SEQ ID NO: 15450 - DNA, 3000 bp, Unknown; identical to SEQ ID NO: 15437
  misc_feature (1)..( 3000): cDNA_ID_2035053_gDNA_ID_2926134_Annot_ID_197084 3000 nt of promoter + ATG

SEQ ID NO: 15451 - DNA, 3000 bp, Unknown
  misc_feature (1)..( 3000): cDNA_ID_2035049_gDNA_ID_2926134_Annot_ID_197083 3000 nt of promoter + ATG
acgttgtcaatggtttggaaaagctttgcggtgagatctttaaggctttgcttctcttccttaggcttagcggagataacggtgttgagatcgtaacggaggtacgatgctcttaaacggagatcgttctgaacatagggccaagcttttttgtcgataaatgacttaacgttgatgatctctttagcagaatctttggctctagctgcagcttctgttggtgacaatggttgtatgtaaaatctatctttcaatgccaatgaaaagtctcttgcttggtctgagttatctgttccagctgctcacacacaaaaaaacaaaaacaaaagcagaaccataatcaatcaaacagaaccggtctctataatctaattactaaaacttttatcttacaaaagtgattaaagatacgtttgataaaaacctaaattataaccatgcaagctataacacaataatttcgttttgttatctccttaaccaaaaaaatagtattagtcattatgtgaaatttaattaaattagttttacttacgtaggccaccggaaggaagtggaggaccaccaactttgatcggaatagcttcggcgaaaacagctttaacgaatgaaccaccggctaaaccagccgccacgagtccaatcactgaccggcgactactttctggtactgacacgttctgctgagccctgatcacaagtccggttctctgagacccaaccgagactcttgagatgttcaaacggtttgagccgttgatctgtaaacttccttcaaggacagcctgagatgctccacgtaagccagccatcgaagtcactgcttgagccattttttttttatctgctttgaataattgattagtgaagtgttgagttataatttttggtgtttggttatgtgacaaagaataccttatctgattcacgttgttacttagattactcggatatggttttaactactaatatgttgacacgtggtttcttgattctcagttttgccacataggattgagatcgagtgttcccagaatgcgattgtcacgtggctgaatgacgtggaaattgaccaattcggttaaacctagtcaaagttaattgaaaaccggtttcgataatatctaagcaaattgtaacttaaatccaatccaacttgacaaataaatgaaatcccttattgttaaaaaaaagtacaaattgaaaaatagataattttggcctcaatttcaattttggattttgtacatagccattaagaataatttggtcaattcaatctattaaagtttatatgatccacatttttaatttcgggtgggttaggaataatagtcacttattcacgaattcaaatacctaatcatgtttagcatccaaagtagacaatcttaaccgttcaacaatattggtatcactacttcattttggtatctaaatatgagcatatttcattccaaaaagaattataatcacaaaaataataataataaaaaaacttataatcacaaaaaaaattacaccgtttttactattttacatttttgttactactttacttatatttaaattacatacacacattaaaacacattattttaatcactaaataacaactaaccaataaaaatctcaatcattatttataaaaatttaaaataaaagaaatattttataaatttataatataaatataatcaaatacttaattaaaaaccatataagattgacgacctgaaagaggatggatcaaatgcaactttgatggctcattcgttaatggagatgtagaaagtaaagcaggttgggttgttcgggatagtaatggaagttatctactggcgggtcaggctataggaagaaaggtggacaatgctctggagagtgaaattcaagcgctaatcatttcaatgcagcactgttggagtcatggttacaaacgggtttgctttgaaggagataacaagatgctgtttgacctaatcaacggatccaaggtacattttggcgttcacaactggatacgagacgttcattggtggtcaaggaagtttgaatcaatccatttcaattggataagaagacatcacaatgttccagctgatattcttgctaaagctcctctccaaaaccaatctttattccttaatcatttttgggttcctaatgtaataagctatgctttacattgtgactacactgctgatttataaatcaataagatgatgatgacaaaaaaaaaaaaaaaacatataaaaccgaggcccgctgtaaaccacgggttgaatcctagttaaagtaagtaataactctccaaaattatcccaaaatcgaatattaactgcgaatcaaactaaaaacaagaatttgaaacttttaaaacccttcattttatacaaaataaaagaaaaataattttataaaaagatttaaccataaaatagaaaccaatttgattaatatcttacttttttttctttcccataatttatttagccaacaaaaagtcacgcaaaatatggaatatcactagtgttaatggaccgagttttaagtcaattggctcaaatggagcctatactttatataataataatttaaatattaatggacaagagtaacgttacaatgttgatgggcctgaaagttaagtcaattggcctgagagtaagtatctaaggaaaaaaaagattattgtttaatgctgatgggcctgaaagttaatattataatcgaggagaagagtaacgttacaattttgacaagagtccgccgatctgttttcaaatattcaaacaacaggctcctccttcttccttcctccttcctcaattcttaaaatctcccccattaggaaaaaagcaagaaccctaatttcccatctcagattcagaaaaaaccaggtctgatttctcccgggttcttaagaaatccgccgccgatctcgggattgagatttggatcctattgacgagcctaaggtgaagcaatccatcgaag

SEQ ID NO: 15452 - DNA, 3000 bp, Unknown; identical to SEQ ID NO: 15436
  misc_feature (1)..( 3000): cDNA_ID_1396277_gDNA_ID_2926134_Annot_ID_197082 3000 nt of promoter + ATG

SEQ ID NO: 15453 - DNA, 2906 bp, Unknown
  misc_feature (1)..( 2906): cDNA_ID_2182840_gDNA_ID_2926134_Annot_ID_197080 3000 nt of promoter + ATG
ggaatatttggataaggtaaaagcaacataagcgtgaagtaccagctaccaaacgaagatcttgacgcgttgatttccgtatcaacggacgaagatgtagagaacatgatggacgaatacgaccgcgtcgcacagaatcaaaacccacgcgcctctcgtcttcgtctttttctcttcaccaaaaacgtcgccggagaagaagataacgatagtcgagctagcagtatcagctctctcctcgatagctctgttaatcgggagcaatggttcctcgacgctcttaacctcggttcttccgccgccgcaaccgcggtatctaacggtgggtccggtagagtctttgagcgagttagatctgaagtctcgtcgattgtttctgaagttcctgattatctctttggattggataatttcgatgaaactgctccgccgcatgagcttcgtgatcgtgatccgagagctaagatccaacgagaagtctcgacgctttcggatcctggttcgcctcgtcgcgatgttccttcgccgtatggttcgacgtcttcggctcctgtgatgcgaatatctacaccggaacttccaccaccagtttttattaaaccggaaagtccagaaccggtttcgactccgaaatccaatcctcaaccggaacaagtaatgcaacagagtaatctcccggttaactcgcaatggcaatatgcccctggcccaggccaacaggttcattaccagggtcataccattcaccaatcaccggtttattacgttcctggttcggttccgggtaatcatatggtccagcaaggaaatcatatggttcaaccgggtaatcatatggtacaaccggttcaaatgccgggtcagtatcttcaacaataccatcatgtaccaatgggataccaccaacctcagactcatcagatggctggtccgggtcaagtatatggtggaacggttaggccggttatgatggcagttgatggaatgaaccggacgggttattatggaatgaaaacacccggtccggttcaaatgtatcagcatcacactggtatggttgttcctggtgtagaagaacaacaacaatacagaaccgaaacggattcggatacgggtcgggcttcttagctgtttgaagaagaaatatgaaaaattatcacatccggggttttcgtcttttcattggagtcgttcttattcgttactgtgtgaactgtgtattattttttgttttacttttgtaaaatttatttttgtgtgtaataattttgtattacaaaatataatgaacagtaaaacccaataataataacattataatctatcaatagtgaattacatttgctaaacttttttttgtcatcttattactcgatttatcataataatgttaatggaatataatttgtcaatcatatgttcctcttcgtctttgctggtgacttgtgaggaagtagatatgtcttagaaaccacaccgaattcaatctcatatgtttgttggtgatgtcttcatagttgtaacttttaatacaatctaacaaagcataaaatggaagggaggtaaggatattgtgttgcatcattcttctcacaatcacttcttctttaccaagattgtcgaagcatgcattataaccattataaccatgcatcttaaacacatcctcccctttttttccttttttgtcgatacctttttatgttcatttgaactttctctttatgttcatttgttctacaagtactattcttgtaaaacatgttatttgtttaattgtccctactcactagtcactacctattttactaaaatcacaatttctacttttagctaccatactattcataatcgtaacaactaacacacttacatgaccaaaaatagatttttgtaccatttaatcttaactattaatttgtaaacgatctcactactattgtaacgtttagtccgtccttactagtgtgctccacgttctttctcaggtctatggactcatccctgtccgacgatcggtccgccaaatctaagaggttttaaagacttgttaacgatcctacaaatcactatacgatatttcatcatgttttatcctcatttacatggttctgataatcatttctcggaaggtcacctatcttaaaactacttcgactcaaacacgtttaactgtggagttctccgcataaattaattattttattctctataaaagttatagaaatggtctcgtcattgtactgattgacatcatcaactggagagacatcaactttgggagctgccaatctcagaagaagtttatctcctttacatgccgaggtggaagctctcctctgggcgatgaagtgtatgattggtgccgacaaccaagatgtagtttttcttacagactgttcagatctggtggagatggtgtcttccccaaccgaatggccggctttctcatcgtatttggaggagttacagagcgacaaggatgagttcacaaacttttttctatctttaatctctcgtagtactaatgttaaagcggattttttggcacgaaaagttcgtacccaaccgcttcatattacatctgtaaacaacattcctcaggattggctcgtttgagtcctaattaattttcggatgacaaaaaaaaaaggtctcgtcattgttaattattattctaattgactattcccattaaagcaatcatagagttacttaagtttgacattcataaatttatgcgactatgattaattattgactaagaaaaaattaaatactaatagtactaacattaaagacaaatgtaacgttttacgtgaagtaatcagaaaccagaaatagtcttcttcttcttcctcacacacatacttctctcaccttatcctccgagatcggaaaatatg

SEQ ID NO: 15454 - DNA, 3000 bp, Unknown
  misc_feature (1)..( 3000): cDNA_ID_2997128_gDNA_ID_2926134_Annot_ID_138853 3000 nt of promoter + ATG
tttgtcaactctttggcttttgcaaaatcgggtaaatttctgattgccggtgttggacaggtatgtgatcatctcttatgttctcttccctcttctttttttctatctttgtcctcttgtctgtgtgattgctaatctcaaaactgatcgtgttttgtgaaatcgacatggcaggaaactcgatttggaagatggggatgcttaaaatctgcgcaaaatggtgtcgcaatacatcccttaagactggcataagtatttcattgggataaatgaagcgttgttatggatagttttgagttgctaaaaagccaaagatctaatcgcaagtcatatagggattacatttccttgtagctcttgaagtttttgctcccttttttgtttgttccttgtaccattttttcttaatacgagagataagaacttatcattttgaggctctgaagaatcaaagaggataacagttcccaattttttcattctctcagtaaagctttttgtttcgttttcccaaatgttgaagataagtatatgaaaaggcaaattattaaaccaagatccatagtgaacacagacttgatcgtaatttatccggcgaaaagaagattgcttttccaaacaaaaaagacaagagcctactacttgaatgaattctcttaagtcaagcttagaatccctagagacaatttcttgatgtctcttggtctcgttgctgctccattctgactaatagcttcaactggataagaaaaaccagcagagaattgataagaaagttccaaatatccaaaacatacatagaataccacaaaatgaagacttgaaacaagaaaaatgcaaacagcattgaaagaataactaaacaagaacatatcctgcaaaaaaaacgaaaatgatacataataatccaaagactcgagcctatatgcagagaagttccagaggaaggtcatgcttccaaaagtttccattttaacattgcaaacactaactcatgtacaagtgagtgattctcattcacttatttgctaatatgcatataactcgatctcaaactaaccaataagtatcatactacctgaaatctagctaaccatcagttttgagatattttctacaacaaagtaaacccaagaacacagctttgacatcagagatcaatactaccaaccatcaatcctaaaccctgaatcattccattgttcgaaaaacaaactgttaaatctcatatccaaatcagaaacaagagaaaacgataagcataagacaaaaatctctaacctttattgactcatctcaacttctctttatttcagacactttctacaacaaagtaaacccaagactcagtaaactactaaccatcattcttaaatcctgaatcattccattgttcgaaacacaagcattcaaagctcatctccaaagcaaaagcaagagataagacaaaatctctaaccttttaaacgaaatcatctcaacttctctttacttgaactcttcttagctgcatccataaccttctcaagatacccttcaataggcggtgtaagagtagccatacctcgattcgccggaaacggtgtcaaatcaggctctaacgccgccttcttcagattctccggcaatgcctcaatagcagatttcttcaaattcaaaagcgcagtttcagctgcacgacgctctctatgctctctcatcaacactttactatactccttcgcaagtctctctccatcttcttccgtaagcttatacttaggcaattcctcagcttcaaaaatccctaacgaaatgtaatccaaacctggcgtcccaattcgcatcggctcatcggtgactcccattgaagcagctcctcctttcttctggatctccatatctcgttgcttctctttactaatcaaacctagcttctcacgttgcgcctcacgctcgatctcttggggggtcaagtagcgaacaggacaaggagcgtttaagcattgctcgtagagtttctgcttctcatcggaaattctaccttttcctttaactgcttcctctccttcaacaggtgctccgccgccgccaccacctttcttgatggagagtttgttacgcttcaatggctgacctgtcttcagctttgcttttcctttaggagttccacttgcggagcatctttggataagatggtaactcagtgattcgatgatcgcttttggtttcgtaactcgaatcatgcttctgattcacctgagtttctgattgctttcgtctgaaaatgttgcttgagtacagagattagggttttcgactctcgactgtggaagaagaacactgaactaacgacgtcgttttacatcaagttaaataaatcacgatgtcacaaaactgtaaattcagcttaaaccgagggttttcttgtcttttagaaaactccaatttggtttcttggttcggttttccatttctttgtataccgaatgagaaccgacgttaattttgaattgatttggttcaattcgatttaatttttggttattgtttcggcttaccaccacataaccgaagcttctttctgaaaacaaattcgattttacttttccagaactgagaagaaatttgctgaattcagtctcatgcaacttgttaaatttctcactattaacaacgaatttggctttggaaactgtaacctccaagtaccaaatacaagtaaaatacaaagaacgtggtgaaaagtaaagaagatccaacacagacaaaaagcaatttgtccactaagatctctcgagagccaaaaaaaagttgagaaatttgcagtcagtatgggctgctctgttgttgtctcttctgggccttgaaaggatcttcttcttcccctcaccttcttactataaacccagaatcatcctctgtttcttttgttcctcaaatcatttttttcctctcgattgtgagatcaattattaatattcatctggagaattatcgtctcttttctccattgctatg

SEQ ID NO: 15455 - DNA, 3000 bp, Unknown; identical to SEQ ID NO: 15444
  misc_feature (1)..( 3000): cDNA_ID_2182799_gDNA_ID_2926134_Annot_ID_138855 3000 nt of promoter + ATG

SEQ ID NO: 15456 - DNA, 3000 bp, Unknown; identical to SEQ ID NO: 15443
  misc_feature (1)..( 3000): cDNA_ID_2182795_gDNA_ID_2926134_Annot_ID_138856 3000 nt of promoter + ATG

SEQ ID NO: 15457 - DNA, 3000 bp, Unknown
  misc_feature (1)..( 3000): cDNA_ID_2993828_gDNA_ID_2926134_Annot_ID_138869 3000 nt of promoter + ATG
aatgtccttatatcctccttcatcaacaaggctggaatctcaaaacgttttgatagcaaacgtagagtccgaaggcaatcaacacagacaaatttgttgaagcaatcaaatgtgaagcttccttgtttctcctgcaagaaagttctggcttggcgaagagcttgacgggctacgatcatattcttcacatcgttagacgatagaaaggacttaggcagatgtgtatacaaatccaccatatccttctggatcttcttcattgtttcacttaacccatcaaatttttccattacaaactccccaaatgtaagaatgatttcttcttccttctccggtgtttctttcgagccaagaaacattttcattacaaactctccaaatgctgtcagaatgtttttagtttcttgattctccttcctttcacttagcaacagatatttcttataactagattcagcattttcaagaatatctatgactgcctccaaactccgttcccattcattcgatggcgaaaacagttcacccaatttactaatgcgatcatcaagaaacacgttgaggagatcatcattccccctttcgtctatccccattcggactcggtttccgactaaaacaatattgccaagtccgtaagtagaatgttctgttgaagaagattccttaaatagcgccaagagccttgatgcaactgctactacagccgtgtttgtaggagtgcacacaactgttttgcaacttaggctgagaagagcaaacagaagagtagcgactgtctttgtgttaccggtaccagggggtccccatatcagtttcacactagtcttgtcgcggatttctcttgtctcaaggcaagccaaaattgcagattcttgagaagagttcaaattcgctgatcgtataatatctaacacatgattcccccaattcctagaagaaacagattgctctgtatcctgaaatatttacaagaaaaaccacagttactccacattagacgctaaagccagatcatttcatgtttacttaccgcggtatttgcttgaaggacactcttgatgagactcaagtttccatctccgttgtgcaaagccttccagatacgagtgtttgtggttaagtatataagaaaaaaacccgaacgaaacgaatattgctcatcaatggatatagatttagaggaatgaacagagaaatgtagctcatctccaacagagaacacatacgcaagaatcagtgggtttaagtcatccacgtttccttgtgactccaatgagatctccatgtttcggctcgtagttagttctatttccttgtgcaacactcgtaagtactgatatattaaccttgtttgagcttctactcggtaattttattgccgtagcctccacggaacttatgtaaaagacaggagctttccacaaacagttcaagcttgaggacaactctgtacgtgtttcctctagtagaagaggaacaaagctcttacggtattcatcaacggaacaaaacatgcctggtatcgagtatcgacctaatctcttccttgttgatatctttgttgagaatatagttgagagaagatttgattaatcagacttgtcttctcatttctctccatgtcacagaaactttctgcaacataataacaatgaaaaacttgagttaggttcctaccttatagcaggtcatagctacatagagaagtaacttggcttacaacgcaaactaaataggaagatgataagtaggaaacagtttcttcaaaagcactgatgcaaaggaatcaacaaagccacaaacgaagacaacaggaaaaagctggcttatcagtttggtctacttataaagaaggaagaggaagaggaaaggtccaaatagaataagtaatttcttcaacttccaagaataaattgtgaatatatattagacagacatataaagtgaaaatagcacattgcttgcataaactagaatttaagtcaatatttctttttatttttgaaaactgtcattagtacttttttgtttgttttacgagaaattagttcactaagaagaaatgtcagaaacttaagaacgaagcatttacggtggagaggacaccatttgtctgctatgagtcgtcataatcatcatcatgattatacgaaattagtcacatccgtaagattatattataatttgtaaaaaagtactttaaaataccacacatacaaattttatccaaaactaataaaacatttctttcgtttataaaaaactgattcaaaaagtagtaaaatggagcaaaagaatttaaatagaataataaaaatttacacttgaagatttcacataactccgttgtaaaagacaaaaaaatcgatatggttgactatacattatacaatcgctttatagaaattagaatgggcagcaggtcaagaacaaattgacaaaatgagatatcgttttcacgttttaataattatgttaaaatttagagattttgttatgatgaaacattttataaatttttaagctcattttgagcattttagagggaataagcatttttttttttgaaagttttctacttttttaaaggtacttttttaatttatttcctaatgacgtcagctgttgcgctaatatggttaacaaattttaatcacagctgttcgtttgttttggagaaagaatcaatttggtggctattattaagagttagagaagagttggttgttgtgtggatagaaccgacaatctcgtttttttttgctctccagaaggaaacatgagcgaggaggtaaaatctaaaaatttattgcggttattaaatctgttgatggttgtggattcgtgttgatggttgtgaaatgttattgtatgtaggttccaatagagagttattgtatggtcatctgcggggaatgggaatgctcggatattcaagaatggtattttgaaattaacaaaattctaatgtctagaattgttccaattcctgcaggg

SEQ ID NO: 15458 - DNA, 3000 bp, Unknown
  misc_feature (1)..( 3000): cDNA_ID_1989583_gDNA_ID_2926134_Annot_ID_138871 3000 nt of promoter + ATG
taacgacaaaaaatgtgagaccatcattttctacggtttgtattatgtatgtttttgtggatttgtattcatggactacttcaatattcatggatttgtcactagtggatttgtcactagtggatttgtcactagtagatttgtatacttgaaaccataattatattttttatttaatttctatcatattttaatcatttacatttttatcagaacgacgtagttgtcaaatggtcataaaacccaaatttatggggtttcctatagaaacaagcttagtctcctcgtacaactttcaccacacaactacaacatggtagatcgacttggaggtatctcgattgtctgcccttgtggcgaggaagtagtgatgaaaacatcagctactccaaggaaccctggtcgtttgttttatgtatgtcccctgggatcttccgtaagtaaatctactaattatctaataatttctactacttgctatccaaaataactatcaataatacaggaaaattggaaccatttgttcaaatggacggatacatgtatcgttgaagagatccgaagattgatagaaaaagtgaataacatcgagggttctacactaaaattgcaaaaagggctaaatttttgtgattccgtgattacctctttgtcacaggagacgtgagacctagattccgttcttcgggaagacattgaagacctgagatcgcagcttagatctatgaaaatattcttgttttatttttgctctttattttattttttatgttttttaatcgctttatttccgaaattattgtaatttctgttagtatatttatcaagacctaattcgactatccatcattgcttaaccatttcgattctattatcttccttcgttttgatttattcatcctaacgagtaggattagttaattttcagagttacatattttacagaacatgacatgtaatccacttgcactagataattcaagcaacttcaagtagatatcataatctattcgtactttttagacctaatacatcaggttatcacttcaaactgacaccctttacactaatttatctgttggatattactgtttgtgaagctacacatcaagggacccatcgtcaacatgtctatttttccgatgctagtttgtagacatatccactcttatgtttttttccacattttaattatagatttatatggataacaaactaaacaattttcgttatatcaaatgatacaaaattgtcttttaatggataagacttcatgcattggagtttatatgtttacttagatggataacaaacgaaacaatttccaataacgaaaatgagaacatatgattaaatcaaaattggacattagatgtcattgtaaattaacgatcacaatctttactggtttacattcccgttcaacttaatctaatataacaaaaacaaaaacaaaaaacacctagatgttagtatccaacaaaaacaaaaacccatagaaattattattcatgagatccaccttaagcgagacaccttttgcacctttgcccaactttcttgcacctagggcacgtacgcctcaccattcttcctggctggaaaggaagatgcataatgcacattttctcgttattcatgtcaatgaacatgcgtttgtcgtgagtacattccatcggcacctcatctgatagtatcctgttgtcgactcatacgccagtcctttgttcttctctacaaactttgcatacggattatttgcggcaagacacttttggaagaaactgtagtacttagaatgaggcattgaccaccacataaaatgattgtccatgtcaatgcgaacaaaggctagggttttcctcgacataacagcatcctttccctctctcccagctagcaaccagttcttcaaatcatcaacaccatcttcagcaacttttctaacgatgatctccatcaacggctgagaaatgtgtatatccatctttggaatctcctacatattaaatgaagatatttattcacaatcattaaataaattaacattattataaaccttgctttcccgtaaatcgcccaccttatcttcaattaaacgattcatctttttataagaatgtttaaaggttttgttctatttatagattttattaaaccaataacttaaacatcgattatgtggtatagaaccggtttggtcaatgcataaatttgtcgttggttttgatttttctgtataaaatatatttaaaaatttttacattagtttagtaattcaaaaaaaattacaatccgcgtggatatttgtttccgaaaaagttgatatttgatgtgttttggcagcaattttctctctcatccaaattagatttccccatcttcctggttcaaatatttttgatgtaacattttactattttaaccatttctaaacatttgttgtaatccttgtcgttattgaaatgtttgacatgtcatggatcctcaaaaatagtgaattattgtttgtcataatctcttgtttgtggatttgttaccatgggtacaagtataaatacgtatttatccaagttaaaacaagatgatttttttgttgttttggcggcaattttccctcgcttccgaatgagaattccccatcttcccggttcaaatatttggatgtaatattcgactattttaagcaagccaaataaaattgttgttatccacgtggatcttcagacgtttaacatctgatggatttacatatatagtgatgtaatgcatggcaataacccaaattttgtggatttgttactatggatacacgttttaaaaataatttttgatccattatgtcgtgatacctaaacgatatccggttaattcgtgtagttattactagccggttgttattctaaacgattgatttattggttatgtgagatgatatttaaggaagttgcttaacccattaattgaccataaaatcactgaaacgaaaaaaacaaaatg

SEQ ID NO: 15459 - DNA, 3000 bp, Unknown
  misc_feature (1)..( 3000): cDNA_ID_3088400_gDNA_ID_2926135_Annot_ID_138878 3000 nt of promoter + ATG
ggagatgtgtctcagaagacgaaatcgaaggcaccctattgcattgccatgggtctgcctatggtggccactttgcaacgttcaagacagtgtcgaaaatcctgcaagctggtttttggtggccatcaatgtttaaggatgctcaggaatttatctcgaaatgtgattcatgtcaaataagagggaacatcagtagaaggaatgagatgcctcagaatccgatcttagaagttgagatctttaacgtttggggaattgattttatgggtccgtttccttcttcttacgggaacaagtacatactggtcgcagtagactatgtatcaaaatgggtggaagccatagccagccgcaccaatgatgctagagttgtgctaaagctgttcaagacaattatcttccctagatttggagtcccgagaattgtgatcagtgacggagggaaacattttatcaacaaggttttttagaaccttttgaagaagcatggagtaaagcacaaggtagccactccttatcatccactgacgagcgggcaggtggaaatctccaacagagagataaaagcaattttagagaaaacagtgagaagtacaaggaaagattggtctgctaagctcgatgacgcactatgggcttacagaacagccttcaagacccctattggcacgactcctttcaacctcctctatggaaaatcctgttatttgtctgttgaactcgagtataaagccatgtgggcagttaaactcctgaacttcgacattaaaaccgccgaggagaagcggttgatccaactgaacgatctcaacgagattcgcttagaagcctatgagagttccaaaatctacaaggagcaaaccaagtctttccatgacaagaagatagtctcaagagattttaaggttggtgatcaagtgttgctgttcaactctcgcctgaggctttttccaggcaagctcaagtctagatggtctggtcctttctctgttactgcagtccaaccttatggtgttatcactctagctggaaagaatggagacttcacagtcaatggccagcggctcaagaaatacatgatagatcagtttattccagaaggaacctctgttcctttggaggagcctttaaacgcctaatgagtatgaggagtcaagctagagacctaaaacaagctcacttgggaggaagtcccaagcctacctttgtacatatctttcattttccttgttgtttttgatgcatcttgttagtgttttcaggagataagtttgaagagttgctggaaatagattctggctttgaaggaacagcaatacactcgaccacagagcaatcaaactcgacattgttctggcttcttcacaccaggaaatcactcgaccacaccctatagagaccgaatgacgatgtggtcgagtatagcgaatgatgtagtcacgacttctccagtcccgtagcttacgcgaccgcggtgctggccgcagcagaagaagagaggtcgagtatcatcatagcggtgctggccgcgacgaaggagcaaaagtcgagtacccccagggggaagctgagacacaacagggagattcttcgatggcctgggagcaatcacaggcagctattgacgaccaactccgctccttcttccactgaggtatgcacctcactccaccactgtaatataccatctcttgtttttattttgtttttgtgatgtgttttgtcctgagtactctcttccaaatttagtcacacagtggactgtgtgatttaagtttgggggagggctcaggaagtgtgtgttgcattgtatataatcttgagtctgcattcatctaaggcatagaaaaactaaaaaaattgaaaaatttcagaaaatggtttcacaaaaatagagtgttcatgtagttgcattgcatttaggattgagtctagagtgtttcgtttaggattgttgcatatgcataggggataatgatgagatagccttgtaagcattttggttcaccagataagctcagtgccctcgttgttagttgtttgatgcgttgtcattgaaattgaagtaaaactgcaccatgcctagattgctctactcgaccacactgttaggatctgatatgattccctatcaatttgaacttgaatctgatttagaattatcatgtcttggcatcgaatttgaactcatggataccctaaaatacttggattttcttactcattttaaccactcttgttgatccaagtagctgactctccttattagagcagttaacccatacccaaacctgaactttctttcaagccctatatcacttgtgagtgtttgtgaggtcttatttcgattgagcttggtagaaagtgttaggttcgtaacgacagagatagtgtctcatgtagttctagttcgcgttcttcggactagataggactaggtgggcgcttatatcatgggttgggatgtgtttaaaagaaaagagggaattcattgttgatgaggaaagggaaagaattctaggggaagtaagctaaagaagttagaaaaaaaatctagtaaaggttttgggaatgttaaagaaaagaatgaggttcttgttagctaaagaagaagggttaaaagcctttggttttaaagaaaaaaaaaaacaggaaccttagttgttaaagaaatccaaacccgctagatgtatcagagcgttgagaaagcttctccttgagttaagagaaaagaaaagaatgatatgaaaaagagtttgaaagattcatgagtgcaaagggtagagttaagttgggacaagagttgggattaccattagaacttcattgttatactctgggtagatgggatcttatctttgtatgcataacctgggacttacctttagcattctaccaaagctcaatcattcttgagggatcccctgttacttaagcctattctgttagggaccatctttgtctcttgaccttcaccttagccaaatgagttcattcatg

SEQ ID NO: 15460 - DNA, 3000 bp, Unknown
  misc_feature (1)..( 3000): cDNA_ID_3088400_gDNA_ID_2926135_Annot_ID_197169 3000 nt of promoter + ATG
atgggaatggacccatgaaatcaatcccccatacatcaaagatctcaacttccaagattggattctgaggcatctcatttcttcttctgatgttgccttttctctggcatgaatcacactttggaacaaactcctgagcgtccttaaatattgttggccaccaaaagcctgcttgaagaatctttgacattgtcttgaacgtcgcgaagtgactagcatatgctgagccatggcaatgcagcaggataccttctacttcatcttctgagacgcatctcctatagatcttatctttacagagagtgtaaagataatgctcatcccagtagtaatggtggatgtctctgaaaaacttcttcctttcataactggtcaggttgggaggctctactccgcatgccaagtaattgacgtgatcaacataccatggagatcctccttaaacagcattcaagtggtgaaactctttcccactgtagctcccattgaatcgtctattggaatgggttcttcaattctcatccttgacagatggtaagctgcaccattttcaatacctttcttatctactatctccatgtcaaactcttgcaatagaagtatccatctgaacagtcttggtttagtattcttcttggcatacagatgcctcaaggcggcatggtctgtatagatagtgacctttgatccaaccaaatagcttctgaacttctcaaatgcgaaaacaacagctagaagctccttctcagttgttgcatatcttccttgagcttcatccaacgttcggctggcgtaatatatgacatgaagcttcttgtctattttctagcctaaaatagctcctactgcgtaatctgatgcatcacacatgatctcaaattgatagtcccaattaggcgctcgaacaacaggagcagataccaaaccatccttgatggtgtgaaaggatttgaggcagtcctcatcgaattcaaattcggtttccttgcacaatagtctggttaacggcctggctatcttggagaagtctttaataaatcttctgtagaacccagcatgaccaaggaaacttcttctgtccttcaccatttctggtggctgcaactgcatcatcacttcaattttccctttgtcaacctctatacccttttctgatatcttgtgacccaacactatgccttccttcaccatgaaatgacacttttcccaattgagaacaagattcgtctcctcacacctgctcaataacctgccaagactcaacaaacatgaggaaaaagaggggccatagaccaaaaaatcgtccttgaagacctccaccatctcctcgagttaatttgaaaatatagaggtcatacacctctgaaatgttgcaggagcattgcataaaccgaatgacattcttttataagcaaaagttccataaggacatgtgaaagtagttttctcttgatcattagggtgaattggtatttgaaagaaaccactatatccatcaagaaagcaatagtatgggtgattagctaagcgttcaagcatttgatcaatgaatggtaaaggaaaatgatctttcctagatgcaacatttagcttcctatagtcaatgcacattctatgaccagttacagttctagtagggatcagttcatccttttcatttttgacaacagtcattccaccctttttagggacgcaatgcactggagaaacccaagtactatcagagatagggtagatgacaccaacatcaagcagtttcaaaatttcttttttcactacttctttcaactaatccaagtccagcacgacccgctccctggagctacacaaaggagagcatggatgaccttgtctccacctacttcacctaaggtaacaccaccaccaccattgtacataccatagcatttttatttttctttgtgtgtttcgtgttttggtcttgaattctttctcagatttttattacacaagggactatgtaatttaagttagggagagggttgaagacatgtttaacattgtgttcacttttcttatttcatattttgcatcatctaaggtagagaaaaaaccacaaaaattcgaaaattttcaggaaatgatttcacaaaaacataatgtcatgtagattgcatttcatcttaggattgtatatagagtgtttgcttttgggattgctcatttgcataggggataatgatgacttcaaaccgttaagcatgttttgattcaatgaagtaagttcaatgcccaggttgttagttctctgttgcataaccgattgtttctctgaagtaagaccgcaccctgctttgaatttacaacttgactatactgctttgattcgaaactcgcttatcttatgccattccctatctattagaagctgaactgaatttgcaattatcatgtctatgcattgtttgtgaactcatggctaacatatacatatttggattatcttatttacttcaccaccccctgttaatccaagtagctgactctcatttttagagcagtttcccataccctgagcctagccttatttcaagccaaagataatttgtgtgtgattgtgaggtctttttcgattgagcttggtataacgtgttaggtatgagccgacaagagcagtcattcatgtagacctagcccacgctttttgggttagctaggactaggtggagacttgtatttgggattaggattgtgtatggattgaatgggaaagggaataggaatgaaaagaaaagaaaaaaaaaagagagtaagaagttaggcattgtgattcaaagaaaagggtaaaacgccctctatgctataagtttagaagaaaagccttaagtttaccaaagtttaaaaccaaacccgctagactcttgaatcattttaaagaagcacccttgagaacttgaaccaaaagagagaaagaatgagaataagggtagagttaggacatctaagggagtgggatcatcttctgagctttcataatag

SEQ ID NO: 15461 - DNA, 3000 bp, Unknown
  misc_feature (1)..( 3000): cDNA_ID_3088448_gDNA_ID_2926135_Annot_ID_197151 3000 nt of promoter + ATG
tttaaaaacaaaccctaaccgattttccggttcacgggcgttacaattgaaacaaaccctaaccgattatccggttcacgggcgttacatctgccgcatggaaatcatcgggatcactgtacacgctgtaatattagcatctttgagggcatccgtccggtagactatgtttcttccacgaggccttgaagttaagagaggtctgaggtaccaccaacatttgttagccatttttggctatcttggctagcaaatcgtcaggtatatttggtgtagacatatcttagaattacgtatttcaaaaataatgaaattcctactcttaaataaacaacaatgaatagtcgggtaagttatggttgtagataatgcaatcttaggtaactaataatgtagtgaaggattgtcatatcaactatattattaattggaaatcattgggaaactttacaacctttgaagagtagttttttataatgtctaagactaaatcaagtattcgtccatgggtatactggtcatttaacatattgaaaaaaacgcggaactatttcgaatccctgatctattatcgggccagtcgtattcaaagattggtacactggactatatgggccaatgattccaaatatgacccaataacacgacactcccctgcacgcaaataaatagcaactatttagattcaaaaactaatggcaatcaacaataaaatcttagctaaacgaatatattcttatcccataatatccgttttccaatgcaaaaatacagcaacaacaccacattcgaattcatattaacagatatttattctataacgcaatcaacaataaatcgtaactttcaaaagataccatatatatatctcttaactaattaacatttctgaatatctacatatcatatttaagctttccgaatatttcttgcctttgtacagaatatagattcatctcctaaactaattatcatttgacaatatactgacttaccaaaactaatccatttaattaaattgatccttttgcagaaagaatataccttatcataacttattcggtaatatcctaataaactgaaaaatattctctcaacctaacctaatgctccacgagattgatttagtaattagtataaatatatgcccaatattttcaagaacaatacactcaccttcaaaagttgaacaactgtttctcatcactcataattttttaaaaaattaattgataccaaattaatttatactaaattaggtttgattcactcaccttcaacgtttaccaaattaatcaaagattagtaacaagtttgattcctctcactataaattattgattgaggaaacaaatggtctaacatttctttgtctagctcttcttttgatttatttgtctagctcttctttgcattaggcaagcgttggtgttattaaatgagtaatgaagagaagaaatgatattgcagccaaatcgcatatgttaattttatgttactttattttctaatcaggttaactttgttttctaaaagttttcagtctaattaacttcagattaagtattatgaagttaacaatttcatatatacaacatttaggtttgttactgcttatcaaacaataggataatatagtttatggaagcaagcaatttattataatcaaaaccatcgacatacaatgataaaacaaagtgaactatgtttattcatcaaattcgaataggtgaagagtaggtacttagcaacttcaacagttaagaataacagtatatatatatatatatatatatatatatatatgtatatatttttagcaactaaacaaaggtattattgtacttaacatcaaactaatctttttcatttagctttctgtgaagttccaaagactaatctttttcatttaacattcttagaaacaagtgacgatgtataatttaggtgaggaaaacttttcaagtcaaaggaatctttacatttagaattctggaaatctccaaggtgaacatctaagccttctatcgtgtttcgagtagcttattatcaagaaattttagttcggaacacgggaaattgtagcacataatgattttgttagctgtagtgttaaaagaaaacgaaatcaaatccgtctcatttgatctacgactatatatagatttcaaaataattacccatagcagatcctgttttttgacaattcttggggacgatctattatcaaacaaattatttcaaagattataaatttaatcgacagatttgaaaacaaaaaaaactaatatatgatgcaacaaaaaacatacttctttatagaactaaatctgtaaagtatatacaaagtataacagagactaaaataggtggattatctgtgaattttgctacagatttgtcgatcgaccgacaatgttcaacaatttgggtttgcaccaaaagacaacgtgtcttcaaacaataatttaattatctgtccaaaataagaaaaacataattcattacaaacataattcattactaaatcaattacaaaacattattcggcccaatatataaatgtttttcggcccataccaaaatatcccaaacctgttattgcttggcttgactctgtaaactctgattgcatcttgattgctagcatcacacccatttagattgacaacataaaatactacaacgacaggatagtgttttaggattaattgactaaaaacctattatcaatttggcgccgttgtcaattgggtgtttgtttgttatatttaagatttcagacttgcttacatcaagttctttttcaattttcacttcaagtactaactgtgtgtttttcttgttgtcttcttgatccaggtacacctctcctgtatgcgaactcgatcaaccggcaaccataacctgcttttcaacgataacattgatcgcatagctcgcgaactaagagaaaggagaaacatagtcgaccttgtacaacaccaacaaccacttgaa

SEQ ID NO: 15462 - DNA, 3000 bp, Unknown; identical to SEQ ID NO: 7273
  misc_feature (1)..( 3000): cDNA_ID_1989612_gDNA_ID_2926136_Annot_ID_138884 3000 nt of promoter + ATG

SEQ ID NO: 15463 - DNA, 3000 bp, Unknown
  misc_feature (1)..( 3000): cDNA_ID_3088548_gDNA_ID_2926136_Annot_ID_197231 3000 nt of promoter + ATG
agaactaaaatgcaatcaacaggggatgcaaatagaggatacaaataataggtaaataaaaatacaatcaacaggggatgaaaatcaatctaatagaagttctaaggatggattcattgataagggtaactctagtgttcatcaaatggctaataggcgaaaggtagattttcatgacgatagattcaaaaactgggtcaatccactctcgtgacagagacccccataactctaccacttcctaatctcaactcttgttgatgaaacatagcagagcagggtttaagaaaaaatctaccaaagccaataggcagacaaaccaatcccttggccgagtctacatatctctagaattcgtaagtcagacatccacttgaacgtcttttggacgctggacgtctttgatcgaatctccacattagccagcgaaaaccgcataggggccaagcgaatccagaagggtataaacctaaacactaaccacctaactaaccaagagattaccctaatctaatccgtcctcaagaaccctaatcactactcaagcaacattctcaagaacacaaacccagaaattactaaaatcataccaaaatgtagatctaaacaagctaaacaactttacttaaacaatcaaatgcaaaaacgaaatagattaagagtaattaaagtttcaaaattcataaacacaaagaaaaactgaaagataaagcataaatcctttggacaaaccccaaatgatctatttatactaaaatgttggaaaccctagattcactagaagacaagagacttgaggcggtttgggcgaatactcgaccttggggatcgagtaaagagggtgctgcaaagtctgcgcctttgtgtctatgctccgactgatcaattggtcgagtagatgcttcgtcctctcctattcgtatgctcagatgtctggttgagtggggaatgaggaggatccgaagacgctttgatagctcaacaagtcttgtagagatgcttcatcatttcgtctgcttgtttttgtggtataggtactaatctttgtgcatgcaaactcgatccaaaggttctacacacctactacttttcaaagacagaatagacagaatagctcatgaattacaagaaaccaaagcaaaggcaccctgtgatcagcaaaaaccagctcctatggatcaacagaaacagaccagttgatgttcaagacccacctaatgttgatcaaccaagaaacattggtgctggtgatgccccaaggaatcatcaccaaagacaagtgatactgcctccaccagttcaaaacaacaactttgagatcaagagtggtctcatctcaatgatccaaggaaacaagtttcatggtttacctatggaagaccccctggaccatcttgacagatttgatcggttctgtggccttaccaagatcaatggtgtcactgaagatatgtttaagctcagactatttcccttatctttgggagacaaggcacaccactgggaaaagactctacccccagacttcatcacctcgtgggatgattgtaaaaaagcttttcttgccaagttcttctctaatgctcgcacaactagattgaggaacgagatcccaggcttcacacaaaaaaacaataaaactttctgtgaagcttgggagagggttaaaagctacaccactcaatgtccccatcacggcttcaagaaggcttcattattgagcacactctacagaggagctttactaaagatcagaatgctactcgacactgcctcaaatgaaaacttcttgaacaaggaagtagcagaaggatgggagttggtcgaaaatctagcacaatctgatgggtgctacaatgaagactatgatcgctcggtgagagaaactggaggaactgaggataaacagagcaaggatatcaaggctctgaatgaaaagctagacaagttgttgctgactcgacagaagtaggtacactacatcaccgatgaagagcacttccaaatgcaagaagtggggaatgatcaaactgaacagttgtgctacatccagaaccaaggagggctcaacaagggctacaacaactacaagcccaacccaaacttctcctacataagcactaatgtagctaacccccaagatcaagtgtatccaccacaagaaaatcagtctaagctttttgttcagtacaaccaaggttatgtccctaaacaacagtttaatggaggctaccaacagcagaatccaccaccagcgttcactcaacaaccacaacaagccctagcagctcaagatcctgaaattaaacaacttattcaacagatcattcaaggacaagctactggcgctatggcttttgacaagaagatagctgaattacataacaagatcgtttgtttttacaacgatctaaatttcaatttcgaagctctgaattccaaaatcaagtatgtggagagtcaatttgcatcaacctctgctctgaagcatcctcaacaactcccaggaaaagcagtctagaatcctaaggactatgctactgcaaatgctatcaccatccaccaagaagatgagtctccaccaagtcatcagactccgaatactgaagacaatatgattcaagaagggggggggattcaactcaaattgttgcacctgccacccatcaattcatctagactatagagcaaacacctttgctgaatactcaccattctggaaaaaaattcaaaattgaaaaactcaagaaggatcagaatcaagagatgattagtagtgcctccaccaaagaaacatataaaaagaaagtcatccaagaaaagcttgatgatcccggttcattcactctaccatgttctctaggactattgacattcaatagatgccttaagaatggaaagattaatctgaaccttgaaaaaggcattaagatgaaatttgacatcagaaaagcttcagggaaatcaacaacaggaggttagagttttgggattcaggac

SEQ ID NO: 15464 - DNA, 3000 bp, Unknown; identical to SEQ ID NO: 8049
  misc_feature (1)..( 3000): cDNA_ID_2165821_gDNA_ID_2926136_Annot_ID_197229 3000 nt of promoter + ATG

SEQ ID NO: 15465 - DNA, 3000 bp, Unknown; identical to SEQ ID NO: 7277
  misc_feature (1)..( 3000): cDNA_ID_2165569_gDNA_ID_2926136_Annot_ID_197219 3000 nt of promoter + ATG

SEQ ID NO: 15466 - DNA, 3000 bp, Unknown; identical to SEQ ID NO: 7276
  misc_feature (1)..( 3000): cDNA_ID_3050126_gDNA_ID_2926136_Annot_ID_197214 3000 nt of promoter + ATG

SEQ ID NO: 15467 - DNA, 3000 bp, Unknown; identical to SEQ ID NO: 7278
  misc_feature (1)..( 3000): cDNA_ID_3088491_gDNA_ID_2926136_Annot_ID_197205 3000 nt of promoter + ATG

SEQ ID NO: 15468 - DNA, 3000 bp, Unknown; identical to SEQ ID NO: 7279
  misc_feature (1)..( 3000): cDNA_ID_2165457_gDNA_ID_2926136_Annot_ID_197193 3000 nt of promoter + ATG

SEQ ID NO: 15469 - DNA, 3000 bp, Unknown; identical to SEQ ID NO: 6992
  misc_feature (1)..( 3000): cDNA_ID_2165180_gDNA_ID_2926136_Annot_ID_197181 3000 nt of promoter + ATG

SEQ ID NO: 15470 - DNA, 3000 bp, Unknown; identical to SEQ ID NO: 7274
  misc_feature (1)..( 3000): cDNA_ID_1989609_gDNA_ID_2926136_Annot_ID_138887 3000 nt of promoter + ATG

SEQ ID NO: 15471 - DNA, 3000 bp, Unknown; identical to SEQ ID NO: 7280
  misc_feature (1)..( 3000): cDNA_ID_1989607_gDNA_ID_2926136_Annot_ID_138889 3000 nt of promoter + ATG

SEQ ID NO: 15472 - DNA, 3000 bp, Unknown; identical to SEQ ID NO: 8044
  misc_feature (1)..( 3000): cDNA_ID_1810169_gDNA_ID_2926137_Annot_ID_138901 3000 nt of promoter + ATG

SEQ ID NO: 15473 - DNA, 3000 bp, Unknown; identical to SEQ ID NO: 7762
  misc_feature (1)..( 3000): cDNA_ID_1989617_gDNA_ID_2926137_Annot_ID_138907 3000 nt of promoter + ATG

SEQ ID NO: 15474 - DNA, 3000 bp, Unknown; identical to SEQ ID NO: 6919
  misc_feature (1)..( 3000): cDNA_ID_1816192_gDNA_ID_2926137_Annot_ID_138910 3000 nt of promoter + ATG

SEQ ID NO: 15475 - DNA, 3000 bp, Unknown; identical to SEQ ID NO: 6920
  misc_feature (1)..( 3000): cDNA_ID_1816188_gDNA_ID_2926137_Annot_ID_138911 3000 nt of promoter + ATG

SEQ ID NO: 15476 - DNA, 3000 bp, Unknown; identical to SEQ ID NO: 6927
  misc_feature (1)..( 3000): cDNA_ID_1816181_gDNA_ID_2926137_Annot_ID_138913 3000 nt of promoter + ATG

SEQ ID NO: 15477 - DNA, 3000 bp, Unknown; identical to SEQ ID NO: 6926
  misc_feature (1)..( 3000): cDNA_ID_1816177_gDNA_ID_2926137_Annot_ID_138915 3000 nt of promoter + ATG

SEQ ID NO: 15478 - DNA, 3000 bp, Unknown
  misc_feature (1)..( 3000): cDNA_ID_1816177_gDNA_ID_2926137_Annot_ID_197274 3000 nt of promoter + ATG
ttgattaaaagaaagataagttctcaaaagagaatacaagagtatataaagagaaggagaagagaagctgaagaggcaagtcttagaacatacttcaaggctgcctagaacacaacagtaattaaaaacaaagtttgaaattcaaaataaacccttcaactactaaggccacgaaattgtctctttattttagtgggtttgggccttgaatcatcaaaattgattatatgaagtgaaaacataagcctcattaaaaaccttcctttggaaaacccagtgggacaaaaccaaaggcagggaaaaagagcactcatgaatcacttatccatcttgatgaggtccttgagcttagatcaaaacaaagaggtagtgatttggctcaagtcatttggtcggtcccaaatgtggttaagcatcccgccaatggcatggttgaataccttagctctagaacgagtcattgggacggtcgatgtgacaagaacatcctccgctacaagcttctcctcagctacaagctcatcctcagctacaagcttacctccttcctcagctacaagctcacgttcaagctccggttcatgctccatatccttaatgttgtccatgatcatatcatcccctccctcttgaaaaggatttgacctcaaatccggttcatctgcaataaaaggtaccaagtcagaaacattaaagctagaactcacattatacttaccttgcaaatcgagttgataggcattgtcgttgatccgtttgattatcttgaatggaccgtctattcttggcatgagtttggacttcctttgagctcgaaacctctcctttcttaaatgaatccacaccatatctccaacttcgaagatttgttctcgtctccctttattagcttgcttagcatagagtttggtcttttcttctatgtttctcctcgcattctcatggatatgttgcactagctcagccttctttttaccatcaatacttactctttcactcaaaggcaaagggattagatccaaaggtgagatggggttgaaccaataaacaatttgaaaaggagaatacttagaagcagaatgcacgacatgattatatgcaaattcaatatgtggtaagcattcttcccaagttttaatgttctttttaatcaatgcacgcaagagagtacctaaggttctattaaccacttcagtttgaccatcagtttgcggatgacatgtagtagagaataacagcttagttcctaacttagaccacaatgttctccaaaagtaactaagaaacttagtatctctatccgaaactatggacctaggcatcccatgcaaacgaactatctctttaaagaatagattagctacatgcaatgcatcatcagttttatgacaagcaatgaaatgagccatcttagaaaatctatcaaccacaacaaagatagaatcatttcctgttctagtcctaggcaatcccatcacaaaatccattgaaatatcattccagggatgagtaggaataggtaaaggagtatacaaaccgatgggctgaaccttagatttggcttgcttacaagtattacatctcccacaaattctttcaacatcacgtttcatgtgcggccaatggaaatgttctttcatgacttccaacgtcttagcaatgccaaagtgtcccattagtccacctccatgaacttccctgacaaatagatctcgtagagagcagttaggaacacacaaacggttctcatagaagagaaacacgtcttgtctaaaatagtgaccgaaagcaaacttttcacaagctttataaacctcgtgaaaatcatggtcagtttcataaagttcttttatttgttcaaaacccataagcttaacattaagagtagagagtagggtgtacctccgggataatgcatcagcgactacattatccttatcttttttgtacttgatgacgtagggaaatgtctcaataaactcaaaccacctcgcatgtctcttgttaagtttctgttgtcccttcaagtgttttagcgattcatgatcagtgtgaatgacgaactccttagaccataggtagtgttgccacgtttggagagctcggaccaaggcgtacagctccttgtcataggttgggtattttagcgtagctcctccaagtttctcactgaaaaaggcaataggcttttgatcttgcattagaacagctccaatacctatacctgatgcatcacactcaatctcaaacgttttaagaaagtcaggcaatatcaaaacaggtgcattggttagtttatccttgagagactgaaatgcttcttcttgtgcttcctcctatttgaatcctacatcctttttgataacctcggtgagtggtgcggcaatggtactaaagtccttgacaaatctcctataaaatccagcaaggccatgaaaactccttacttctcccacagtctttggactcggccaatctttaataaccttaactttctcttcgtcaaccttaactccatctgcactcacaacaaagccaaaaaacacaagattatccgtgcaaaaggtgcatttctttaggttggcatagagttcctcttttctaaggacattcaaaacagaatctaaatgctctatatgctctctcaagcttttgctgtaaactaagatgtcatcaaagtaaactacaacaaatatcccaatgaatgctcttagaacatgattcatcaacctcatgaatgtactaggtgcattagttaatccaaatggcatgactagccactcatataacccatgtttagttttaaatgcagttttccattcatctccctctctcatcctaatacttaaccgttatattgttgatggctctgcaatcaacacacattctccagctgccatccgcacttacatacttttcatggataccctaagtcaggtaagtctagtggtttatgcaaactatggacgagtggaagatttcgtgagactcaagaaagat

SEQ ID NO: 15479 - DNA, 3000 bp, Unknown; identical to SEQ ID NO: 6927
  misc_feature (1)..( 3000): cDNA_ID_1816181_gDNA_ID_2926137_Annot_ID_197267 3000 nt of promoter + ATG

SEQ ID NO: 15480 - DNA, 3000 bp, Unknown; identical to SEQ ID NO: 7762
  misc_feature (1)..( 3000): cDNA_ID_3088578_gDNA_ID_2926137_Annot_ID_197262 3000 nt of promoter + ATG

SEQ ID NO: 15481 - DNA, 3000 bp, Unknown; identical to SEQ ID NO: 8047
  misc_feature (1)..( 3000): cDNA_ID_2165947_gDNA_ID_2926137_Annot_ID_197257 3000 nt of promoter + ATG

SEQ ID NO: 15482 - DNA, 3000 bp, Unknown; identical to SEQ ID NO: 8048
  misc_feature (1)..( 3000): cDNA_ID_2165930_gDNA_ID_2926137_Annot_ID_197253 3000 nt of promoter + ATG

SEQ ID NO: 15483 - DNA, 3000 bp, Unknown
  misc_feature (1)..( 3000): cDNA_ID_2165898_gDNA_ID_2926137_Annot_ID_197246 3000 nt of promoter + ATG
ttattgcatgttttcttgtagtgacattcaccggatctccttcagatttcttcccaaacctgggcccgaacttccggcccccaacactaccagctttgacggtttctccggccgattctccggtttcctacttggtcgcctgaccatggtgaaaccatcatttcccgattggttcttcttaggaacaccctgtgaaaaatctcgtggaccttcacttacatccgttcgaggaccctcctttgactgttcttggaccactctgggacacgtatgtaccaagtgtccatacaagccacatgttgagcaaatgttggtcagaccctcataggccacatagtacctgtctccgttcaccattattgtccctttgagtggtttggctaagttcatttctacacaaactcttgcaaaacgagctctttcatgattcaacgtcatcgtatccactttgaagggcttacccaaacctcctgcgatactcatcaaaatagatggatgataaaaattcaccggcacattggttaaacgaatccacacaggtgttgtagcaatcacatcacgtaacgggtcaaactccggcaaccaagcttgaaccgtgagattgcttccaaacactctccatggatcgcctgttaaggcagctaaatactcttcctgcaactcaaacctgatcatgaagaattgacggggtagatccattactgtcatcatccccttaggattccacaactcccgaagtttcttattaaaaatttaatatttcatttgtatagttgaatacatagtttataaacgcatgatgctttttgggccttacctatggtccaacgtgacttggacgttcttctaatttcacttctcgaatagacatctcaagaatagtggaagaacaacggccattgctattttaagcaacgtaggattttcttgcaagcgctagtataactctaaaggatgtaatgtagtggacatatattttttcgtattctcaaacatttcaggctaatccaagaggttacttgaatgattttattaataatctatctcaatacttggataagttaaatacccatattgatagtatgaataagttcacaagtggattttagctattctacatatgattcaaatctcaaaaatatgtggaacactagaacttaacaattgaaatcttatttggtcgagcttatatggaaaaaagtgggcacaaatcaatagtttaactaatcgttttcatttatatttgcctcgtatttagttaaactattatgtcatgtatgtttcaaaatttataagttgtaatagttattaagttttttaaaactaaaagagttttaatatttaaataatttttttttccttaagaactccaagctaagaacctaccattgcatcaccaaaattttaatctcttaaccaaactcttaagatcaaaattttcaaaattaatcatatatatttctaagaactattctaatactaatctaagagactatcaataatgatgttctaaagacttttgggataaaatagtacaaattttgtttttttataaaagttaatgtgttttgcttttgcttgaaatgaacaaaaaataactaaatctgtaattaccttgattggtatatagttagccaaatattaaaacatatatatatatatctatatatctatatatatagaacagaaccaaaagtgtttacaatatcatttttggattgagttaaatatgttcctttttctgtttttaaaatagaaaataattgaaatttattcatcttaggaaagattgctttcatttttttattaaagtaaatacatagaaattaatttagagaaattcctaaaaatagcactaaagcaagttgtatgggtaagaatagcacacattccaaaaatagcaatacttgacttactatgaagtttttgttctagaagtcttatcacaaatttattttttcaatatatcacaacttttatataaaatcaatttaaccaaaataaattagaaataaatttaaaatattatatttgggttttcaattttcaatttaaagtaaatatttcaacaatttaaaagaaattttgattcatttttatgttagtttataatattatatttaggttccctatttctaatttatggtatatattttcaccatttaaaagagattttttattttaatattagtttgtagtattatatttgggttgcctatttccaatttagggtatctatttccactattttaaaaaaaattgattcaatttaataatagattagtgtttgctctcatttttattttctatcttatattttagttaagtttaattgaaatttatagtgctatttgtggaattttagaaatattgtgctaattttagaagaaaaagttttttttgtgctatttttgtcaattgcccaaaaatatatcgatgtgtttagatatagatataaccaagccacgttctattctgccatcattttggaaaaactattctggtgtaccatcttttattctgagtaccactcgagcatgtgcaattacatctctctccttaatgaataactgagggagaatttcaaaataaagagtaaatcatttagtaaaaaagaaaagaataacgaccgttaccaaaatcgcgaacctactctcctgccgacgtgattttctccgacttcgccgtcggcgacttgagcttcgatttcgccggcgatttgagctctaatttcaccggcgagttagcttccaagatagccgtagcttccaagccgataatctgctcccaaagtgagcttcctcttcaacggcaaaagtaaatccgatctcgttttcatatgtagattaatgtgaatttcttgttggagttagttgttaataacataaaattgttgtattgttcattctgggctgttgtatcgttttgaatcagagagtttagtgagtgttcaatcgaaatttacgatttgtgaaacccagaattgacgaactgggacaa

SEQ ID NO: 15484 - DNA, 3000 bp, Unknown; identical to SEQ ID NO: 8045
  misc_feature (1)..( 3000): cDNA_ID_2165889_gDNA_ID_2926137_Annot_ID_197243 3000 nt of promoter + ATG

SEQ ID NO: 15485 - DNA, 3000 bp, Unknown; identical to SEQ ID NO: 8046
  misc_feature (1)..( 3000): cDNA_ID_3088544_gDNA_ID_2926137_Annot_ID_197237 3000 nt of promoter + ATG

SEQ ID NO: 15486 - DNA, 1528 bp, Unknown
  misc_feature (1)..( 1528): cDNA_ID_3088548_gDNA_ID_2926137_Annot_ID_197234 3000 nt of promoter + ATG
tatctttgggagacaaggcacaccactgggaaaagactctacccccagacttcatcacctcgtgggatgattgtaaaaaagcttttcttgccaagttcttctctaatgctcgcacaactagattgaggaacgagatcccaggcttcacacaaaaaaacaataaaactttctgtgaagcttgggagagggttaaaagctacaccactcaatgtccccatcacggcttcaagaaggcttcattattgagcacactctacagaggagctttactaaagatcagaatgctactcgacactgcctcaaatgaaaacttcttgaacaaggaagtagcagaaggatgggagttggtcgaaaatctagcacaatctgatgggtgctacaatgaagactatgatcgctcggtgagagaaactggaggaactgaggataaacagagcaaggatatcaaggctctgaatgaaaagctagacaagttgttgctgactcgacagaagtaggtacactacatcaccgatgaagagcacttccaaatgcaagaagtggggaatgatcaaactgaacagttgtgctacatccagaaccaaggagggctcaacaagggctacaacaactacaagcccaacccaaacttctcctacataagcactaatgtagctaacccccaagatcaagtgtatccaccacaagaaaatcagtctaagctttttgttcagtacaaccaaggttatgtccctaaacaacagtttaatggaggctaccaacagcagaatccaccaccagcgttcactcaacaaccacaacaagccctagcagctcaagatcctgaaattaaacaacttattcaacagatcattcaaggacaagctactggcgctatggcttttgacaagaagatagctgaattacataacaagatcgtttgtttttacaacgatctaaatttcaatttcgaagctctgaattccaaaatcaagtatgtggagagtcaatttgcatcaacctctgctctgaagcatcctcaacaactcccaggaaaagcagtctagaatcctaaggactatgctactgcaaatgctatcaccatccaccaagaagatgagtctccaccaagtcatcagactccgaatactgaagacaatatgattcaagaagggggggggattcaactcaaattgttgcacctgccacccatcaattcatctagactatagagcaaacacctttgctgaatactcaccattctggaaaaaaattcaaaattgaaaaactcaagaaggatcagaatcaagagatgattagtagtgcctccaccaaagaaacatataaaaagaaagtcatccaagaaaagcttgatgatcccggttcattcactctaccatgttctctaggactattgacattcaatagatgccttaagaatggaaagattaatctgaaccttgaaaaaggcattaagatgaaatttgacatcagaaaagcttcagggaaatcaacaacaggaggttagagttttgggattcaggacatg

SEQ ID NO: 15487 - DNA, 3000 bp, Unknown; identical to SEQ ID NO: 7427
  misc_feature (1)..( 3000): cDNA_ID_3088608_gDNA_ID_2926138_Annot_ID_138926 3000 nt of promoter + ATG

SEQ ID NO: 15488 - DNA, 3000 bp, Unknown; identical to SEQ ID NO: 7430
  misc_feature (1)..( 3000): cDNA_ID_1817681_gDNA_ID_2926138_Annot_ID_138927 3000 nt of promoter + ATG

SEQ ID NO: 15489 - DNA, 3000 bp, Unknown; identical to SEQ ID NO: 7431
  misc_feature (1)..( 3000): cDNA_ID_1817677_gDNA_ID_2926138_Annot_ID_138928 3000 nt of promoter + ATG

SEQ ID NO: 15490 - DNA, 3000 bp, Unknown; identical to SEQ ID NO: 6923
  misc_feature (1)..( 3000): cDNA_ID_2165350_gDNA_ID_2926138_Annot_ID_197287 3000 nt of promoter + ATG

SEQ ID NO: 15491 - DNA, 3000 bp, Unknown; identical to SEQ ID NO: 7429
  misc_feature (1)..( 3000): cDNA_ID_3088608_gDNA_ID_2926138_Annot_ID_197307 3000 nt of promoter + ATG

SEQ ID NO: 15492 - DNA, 3000 bp, Unknown; identical to SEQ ID NO: 7428
  misc_feature (1)..( 3000): cDNA_ID_3050474_gDNA_ID_2926138_Annot_ID_197317 3000 nt of promoter + ATG

SEQ ID NO: 15493 - DNA, 3000 bp, Unknown; identical to SEQ ID NO: 6924
  misc_feature (1)..( 3000): cDNA_ID_2165361_gDNA_ID_2926138_Annot_ID_197289 3000 nt of promoter + ATG

SEQ ID NO: 15494 - DNA, 3000 bp, Unknown; identical to SEQ ID NO: 6922
  misc_feature (1)..( 3000): cDNA_ID_2165328_gDNA_ID_2926138_Annot_ID_197284 3000 nt of promoter + ATG

SEQ ID NO: 15495 - DNA, 3000 bp, Unknown; identical to SEQ ID NO: 398
  misc_feature (1)..( 3000): 2750-1469P.txt file - cDNA_ID_19124; gDNA_ID_1590760; Annot_ID_150004
  misc_feature (2235)..(2235): n is a, c, g, or t
  misc_feature (2245)..(2245): n is a, c, g, or t
  misc_feature (2353)..(2353): n is a, c, g, or t
  misc_feature (2521)..(2521): n is a, c, g, or t
  misc_feature (2533)..(2533): n is a, c, g, or t
  misc_feature (2967)..(2967): n is a, c, g, or t

SEQ ID NO: 15496 - DNA, 1363 bp, Unknown; identical to SEQ ID NO: 55
  misc_feature (1)..( 1363): 2750-1469P.txt file - cDNA_ID_19407; gDNA_ID_1848; Annot_ID_145388

SEQ ID NO: 15497 - DNA, 1836 bp, Unknown; identical to SEQ ID NO: 63
  misc_feature (1)..( 1836): 2750-1469P.txt file - cDNA_ID_19619; gDNA_ID_1946; Annot_ID_145447

SEQ ID NO: 15498 - DNA, 2630 bp, Unknown; identical to SEQ ID NO: 109
  misc_feature (1)..( 2630): 2750-1469P.txt file - cDNA_ID_21148; gDNA_ID_2698; Annot_ID_145871
  misc_feature (2289)..(2289): n is a, c, g, or t

SEQ ID NO: 15499 - DNA, 94 bp, Unknown; identical to SEQ ID NO: 112
  misc_feature (1)..( 94): 2750-1469P.txt file - cDNA_ID_21263; gDNA_ID_2750; Annot_ID_145922

SEQ ID NO: 15500 - DNA, 159 bp, Unknown; identical to SEQ ID NO: 156
  misc_feature (1)..( 159): 2750-1469P.txt file - cDNA_ID_22476; gDNA_ID_3406; Annot_ID_146280

SEQ ID NO: 15501 - DNA, 8 bp, Unknown
  misc_feature (1)..( 8): 2750-1469P.txt file - cDNA_ID_25828; gDNA_ID_25704; Annot_ID_146507
agctcatg

SEQ ID NO: 15502 - DNA, 7 bp, Unknown
  misc_feature (1)..( 7): 2750-1469P.txt file - cDNA_ID_28712; gDNA_ID_28590; Annot_ID_146701
atatatg

SEQ ID NO: 15503 - DNA, 3003 bp, Unknown
  misc_feature (1)..( 3003): 2750-1469P.txt file - cDNA_ID_30436; gDNA_ID_1972016; Annot_ID_177933
ttaagatgggatatataatacattttgtaatattcttccaaaaaataaagttaaatacataggttctcacttgatggtgccactatgccgaagtgatgactgcaaagctcgtctagagtttcgtatccaagggtgagagagcagtgtctttgcatcaggcctctgcctggaatcctgtaaaacacaagatacaaatcagatgtacatactggatattaaataaatcattgtctaggttctggtacagaggtaggtgaataaaccctatagcagaaaattataccttcttgaagcactgtcgtagaaagtccgtaatatctggagaaagactatcaggaataggagggttgtcatcctgaaacgaaaccataagaaatagtttgtcacttctggctaacagcttttgcatttttcaggagagaagtgtttacgacatggagaaggggacggaagagacacctaaatttgattgacttaaatgcaaactcataaaatgttgtcaaatacctgaacaatacgaaagagggctggcatgggttgcagatcatagtaaggaggtacacatgtcagaagttcgataacagtgcatccaacgctccaaatgtcagaagcagcacaaactcctgacatttcaataacctgaaacagaagttgggcttctgtcaatacgtacataatcaggtaaaagttctctaaaggagcaaacaaaagcatctttcaaacaacaacaaatattgtttcaaaactgcgtacgaaagctatacagaatatggagatggaaaatatataatcaaaggtgtacctcaggagccatccagtaaggagttccaaccaccgagtgagtattaacatcagcctcgttaagtttagtggcaactccaaagtcagcaagcttcacaagaccctgaagtgtgatgtagtcaagtatctttctaaggaaaaagcctagaagaatcttatccagcagatctcaaaacaaaaacacactgaagacatgtctgagaatagataatatagaaaacacacctcctttgtcgtcaaaatatttgcacccttaatatcacggtgtataacaccctgctcatgcagatataccaaaccttccaagacctgtattcactagttagtacacaatgcataacgaaacttaactcaacttgaaagatgtatacagacctgagcaatgtaaacagccaccaaagattctgggaaaggtccaaatttatttggtttaataatgtttgcaagagagccattctcaacgtacctgcaaacacataattgaacttgagtttcccgtccatagtccagagtggaccaaaataaacaaaaaaagctacttactccaaaataatgtgaaggtgagtctttgtcttcgacgacccaagatacttcacaatgtttttatggttcaagttctgcaatgaaatattatctcagaatacatagagaagaactgcatcttaaccagcatcataaccattcatgagaagaagccaaaattcagaaggtgattgatttgacataaacttagtatcaggatcccaactctgtaaacagtacaaaattcagaaaactaccttcaaaagatcaatttcttgctggagaaattcatcccaacagcacaagaatcatccacatgtaaaaaccaggattagtcagcatagcagtggtaaggaacaaataaggaagatagatataaggaaaataacaaaccataatggtgttaagatcctcttgaacaatattttccaaagagacttgtttaatggccacaaagtcaccattctccaagtctaatcctttataaactcgaccataagctcctttaccaatttcatctcccagcatctaccctcaacatatcaaggatcaaccattgaaattaatcaaaattgaagagaaaacagcaaaaagcaccagacttaagcttaaaatcaataaaattactaaagctaaaatcttaaggagacccattagaaaacccaaatcccagaaattacggagaagaagaaagctcacatatttgttgtcgagagtctttgatttgtgaaactgagatgacgtcatttgccgcgccatctcttctcgtttcttcttcctccgtcagcagaacaaaaaaaatgcagcgaacagaacacaattgctcctcaaggaaacagaatccaataagaattagggttttaattttttgagaaaattgaaagaaaagatttcgagattggtggagttgaaagatcagagatgccagctctattacagtagtgaaaatacatgaccaaattttaataaaatcaaaattaagaaaaaggaaagaacaaaacaaaagttttgggttagaaattgactaactgtaataaaggagaggtaattatgttaatttctcatgcgcctgtattcttctttattatgtggcccatactttttatttatttacgatttcacccctttatttcccgatttgtaaaaatactagcattttgtccaattactgattaatcatctatttaaaaggtggtccaaatatttaatgctttttcactggtgtcaattttaattaaggtggttagtattcattaatgtattatcaaccattttgttataactttctcaattgtaggagctggtataatcggatgtttatagccaatcaaattataattcatagtagtatcaaatctttaatataaataactagaagcaactaacctatgcattgtaataacattagccatttggatttcaatatgattgttactgcaaaatctttaaaatgaaaggaaaaaaaaaccacgcaggtgaaataaaaaccaaatgaagattattaccaaacgccgaagctagcgcgtgagagaaaaggtcggtaggttcattggtaacatcagcagactaatggagagagagaaactttgagaaaagaaaaaaacaaccaatcgaagaactcatagagatcacgaaaccctagtggaaagagagaaagctttgttgaagacggcggagatg

SEQ ID NO: 15504 - DNA, 3003 bp, Unknown
  misc_feature (1)..( 3003): 2750-1469P.txt file - cDNA_ID_30436; gDNA_ID_24396; Annot_ID_146435
ttaagatgggatatataatacattttgtaatattcttccaaaaaataaagttaaatacataggttctcacttgatggtgccactatgccgaagtgatgactgcaaagctcgtctagagtttcgtatccaagggtgagagagcastgtctttgcatcaggcctctgcctggaatcctgtaaaacacaagatacaaatcagatgtacatactggatattaaataaatcattgtctaggttctggtacagaggtaggtgaataaaccctatagcagaaaattataccttcttgaagcactgtcgtagaaagtccgtaatatctggagaaagactatcaggaataggagggttgtcatcctgaaacgaaaccataagaaatagtttgtcacttctggctaacagcttttgcatttttcaggagagaagtgtttacgacatggagaaggggacggaagagacacctaaatttgattgacttaaatgcaaactcataaaatgttgtcaaatacctgaacaatacgaaagagggctggcatgggttgcagatcatagtaaggaggtacacatgtcagaagttcgataacagtgcatccaacgctccaaatgtcagaagcagcacaaactcctgacatttcaataacctgaaacagaagttgggcttctgtcaatacgtacataatcaggtaaaagttctctaaaggagcaaacaaaagcatctttcaaacaacaacaaatattttttcaaaactgcgtacgaaagctatacagaatatggagatggaaaatatataatcaaaggtgtacctcaggagccatccagtaaggagttccaaccaccgagtgagtattaacatcagcctcgttaagtttagtggcaactccaaagtcagcaagcttcacaagaccctgaagtgtgatgtagtcaagtatctttctaaggaaaaagcctagaagaatcttatccagcagatctcaaaacaaaaacacactgaagacatgtctgagaatagataatatagaaaacacacctcctttgtcgtcaaaatatttgcacccttaatatcacggtgtataacaccctgctcatgcagatataccaaaccttccaagacctgtattcactagttagtacacaatgcataacgaaacttaactcaacttgaaagatgtatacagacctgagcaatgtaaacagccaccaaagattctgggaaaggtccaaatttatttggtttaataatgtttgcaagagagccattctcaacgtacctgcaaacacataattgaacttgagtttcccgtccatagtccagagtggaccaaaataaacaaaaaaagctacttactccaaaataatgtgaaggtgagtctttgtcttcgacgacccaagatacttcacaatgtttttatggttcaagttctgcaatgaaatattatctcagaatacatagagaagaactgcatcttaaccagcatcataaccattcatgagaagaagccaaaattcagaaggtgattgatttgacataaacttagtatcaggatcccaactctgtaaacagtacaaaattcagaaaactaccttcaaaagatcaatttcttgctggagaaattcatcccaacagcacaagaatcatccacatgtaaaaaccaggattagtcagcatagcagtggtaaggaacaaataaggaagatagatataaggaaaataacaaaccataatggtgttaagatcctcttgaacaatattttccaaagagacttgtttaatggccacaaagtcaccattctccaagtctaatcctttataaactcgaccataagctcctttaccaatttcatctcccagcatctaccctcaacatatcaaggatcaaccattgaaattaatcaaaattgaagagaaaacagcaaaaagcaccakacttaagcttaaaatcaataaaattactaaagctaaaatcttaaggagacccattagaaaacccaaatcccagaaattacggagaagaagaaagctcacatatttgttgtcgagagtctttgatttgtggaactgagatgacgtcatttgccgcgccatctcttctcgtttcttcttcctccgtcagcagaacaaaaaaaatgcagcgaacagaacacaattgctcctcaaggaaacagaatccaataagaattagggttttaattttttgagaaaattgaaagaaaagatttcgagattggtggagttgaaagatcagagatgccagctctattacagtagtgaaaatacatgaccaaattttaataaaatcaaaattaagaaaaaggaaagaacaaaacaaaagttttgggttagaaattgactaactgtaataaaggagaggtaattatgttaatttctcatgcgcctgtattcttctttattatgtggcccatactttttatttatttacgatttcacccctttatttcccgatttgtaaaaatactagcattttgtccaattactgattaatcatctatttaaaaggtggtccaaatatttaatgctttttcactggtgtcaattttaattaaggtggttagtattcattaatgtattatcaaccattttgttataactttctcaattgtaggagctggtataatcggatgtttatagccaatcaaattataattcatagtagtatcaaatctttaatataaataactagaagcaactaacctatgcattgtaataacattagccatttggatttcaatatgattgttactgcaaaatctttaaaatgaaaggaaaaaaaaaccacgcaggtgaaataaaaaccaaatgaagattattaccaaacgccgaagctagcgcgtgagagaaaaggtcggtaggttcattggtaacatcagcagactaatggagagagagaaactttgagaaaagaaaaaaacaaccaatcgaagaactcatagagatcacgaaaccctagtggaaagagagaaagctttgttgaagacggcggagatg

SEQ ID NO: 15505 - DNA, 496 bp, Unknown; identical to SEQ ID NO: 235
  misc_feature (1)..( 496): 2750-1469P.txt file - cDNA_ID_76034; gDNA_ID_75779; Annot_ID_146999

SEQ ID NO: 15506 - DNA, 1192 bp, Unknown; identical to SEQ ID NO: 257
  misc_feature (1)..( 1192): 2750-1469P.txt file - cDNA_ID_78177; gDNA_ID_78081; Annot_ID_147242

SEQ ID NO: 15507 - DNA, 1360 bp, Unknown; identical to SEQ ID NO: 266
  misc_feature (1)..( 1360): 2750-1469P.txt file - cDNA_ID_99140; gDNA_ID_99056; Annot_ID_147329

SEQ ID NO: 15508 - DNA, 3000 bp, Unknown; identical to SEQ ID NO: 10022
  misc_feature (1)..( 3000): 2750-1469P.txt file - cDNA_ID_1007273; gDNA_ID_2213619; Annot_ID_131941

SEQ ID NO: 15509 - DNA, 3000 bp, Unknown; identical to SEQ ID NO: 5408
  misc_feature (1)..( 3000): 2750-1469P.txt file - cDNA_ID_1007534; gDNA_ID_1620785; Annot_ID_50421

SEQ ID NO: 15510 - DNA, 3000 bp, Unknown; identical to SEQ ID NO: 8915
  misc_feature (1)..( 3000): 2750-1469P.txt file - cDNA_ID_1007791; gDNA_ID_1971923; Annot_ID_177216

SEQ ID NO: 15511 - DNA, 3000 bp, Unknown; identical to SEQ ID NO: 8915
  misc_feature (1)..( 3000): 2750-1469P.txt file - cDNA_ID_1007791; gDNA_ID_2926219; Annot_ID_203224

SEQ ID NO: 15512 - DNA, 3000 bp, Unknown; identical to SEQ ID NO: 6416
  misc_feature (1)..( 3000): 2750-1469P.txt file - cDNA_ID_1007795; gDNA_ID_1621093; Annot_ID_55556

SEQ ID NO: 15513 - DNA, 3000 bp, Unknown; identical to SEQ ID NO: 6416
  misc_feature (1)..( 3000): 2750-1469P.txt file - cDNA_ID_1007795; gDNA_ID_1621093; Annot_ID_170769

SEQ ID NO: 15514 - DNA, 3000 bp, Unknown; identical to SEQ ID NO: 6416
  misc_feature (1)..( 3000): 2750-1469P.txt file - cDNA_ID_1007795; gDNA_ID_2926160; Annot_ID_139666

SEQ ID NO: 15515 - DNA, 3000 bp, Unknown; identical to SEQ ID NO: 6416
  misc_feature (1)..( 3000): 2750-1469P.txt file - cDNA_ID_1007795; gDNA_ID_2926160; Annot_ID_198680

SEQ ID NO: 15516 - DNA, 3003 bp, Unknown
  misc_feature (1)..( 3003): 2750-1469P.txt file - cDNA_ID_1008056; gDNA_ID_2926228; Annot_ID_203574
cactgatagatagagctcacgagttaggcctggtagttctgatggatatcgttcataggtagtgaaggtttacatgaaagcaaacaatgagatccaccttttggtcatttacaagtcattgaatcttccgactctctaacctgtgcagccatgcttcaaaaaacacattggatggactgaacatgtttgatggaactgatgctcactattttcactctggacctcggggataccattggatgtgggattcacgacttttcaattatgggagctgggaagtatgtaactttttcgtgaattttaatcgaaaatgtagtgaacatacaacttccttaagcactatcagttccaacagtctcttttgatcttttctaacaggtattacgatatctcctttcaaatgcacggtggtggctagaagaatacaagtttgatggatttagatttgatggtgtaacctcaatgatgtatactcatcatggactctcggtacttcaaacttttctacaatggatggctaatgcaatctttatgtttttcccatctttccaatgttgtatcagctttaagtatatcttaggtcggtctgctgaccttctattttgtgggttttggataggttggatttactgggaactacaccgaatactttggattggaaactgatgtggatgctgtgaattatctcatgctggttaatgatatgattcatgggctctaccctgaagcgattaccgttggtgaagatgtaagttttctgattggctaaataaaaaagtgctctacagaaccataagggatacatattgtgtatcatattaaagatagtccaaaaccaaattagtgtgaactgacaagagaaagttagtatatattttttggtgatctatgctaataaaatcgtttcatttcaggttagtggtatgccaacattctgtattcctgtccaagatggtggcgttggatttgactaccgtttacacatggccatagctgataagtggatagaaatgctcaagtgagtgttttctgcattttcttttaagttccatctgctttaatatttggtgaaataagtgtcttactctcctccatgttatgctgtgaaggaagagagatgaagactggcaaatgggcgacatcatttacacacttaccaacagaaggtggtcagagaagtgtatctcttatgctgaaagtcacgatcaagctcttgttggtgataaaacaattgccttctggttaatggacaaggtatagatagattagacaccgttttacattaaactcattattaaaagttatgtgagcggtgttgttcgggttccaggatatgtatgatttcatggcagtagacagaccatcaactcctcttatcgatagaggaatagctttgcacaaaatgattaggcttataactatgggattaggcggtgaaggttacttaaattttatgggaaacgaattcggacatccaggtactaaatcgatttaagcttgtttcatttactttctgtgcaaaaattttgagtgtacaatttcttcatctactcctgcaatattcagaatggattgattttcccagaggcgagcagcgtctttctgatggtagcgtgattcctggcaacaatttcagttatgacaaatgccgccgcagatttgatcttgtaagttcttacaatttggctgagtacaacattactcaagatatttttctgtgtattctgattcagaatagttcatatatagggggatgcagattatctcagataccgcggactacaagaatttgatcaggcaatgcaacatcttgaagagaattacggtgtaagtctccaagttaaaacctttgtagatgatctcagttacccattagctttattcttattttacatttgagcagtttatgacttcggagcaccaattcatatcacgaaaagacgaagcagatagagtaatcgtattcgaaagaggtgatctcgtctttgtctttaactttcactggaccagcagctactttgattaccgcattggttgctccaagcctggaaaatataaggtataatacacatctaactcttccttttcaaacactggagactttggtattggttgtgaagatagaatccgatatctttctacatttcgacattccagatcgtattggactcggacgatcctctctttggtggattcaataggctcgatcgcaaggcagagtacttcacttatgtaagaaaaataaaaccattctagtcaaagtttacattaattgtgactgttccaatctcttgaccaatcgtgccaatgcaggatggcttatacgacgaacgaccctgctccttcatggtctatgcaccgtgtagaaccgccgtggtttatgctttagcaaaccacgattagaactttcagactttggatccaatatcataatcaaggaagagtgtgtgaaaaaatgtttttccttcattagagtgaagtaaagaatctggtaacgaaaaaaatgtctgtgtatacaagatcaccgaaaatgtaaagaatctggtaatggaaaatatctaaaacattaaaccagaaatgtagcacttgattaaaaaccaattacaacaaccgaaataaaccgataataaacgccagctggccggtcttggaaatggataaacaaccgaaataaaccgatgtatgccaccaagcataattgcaacggtataatgcttcaaacaaataaatcaaactaaaaaggtatcacaacaacttttgattatgatcccactaataatagtattgttgtaaatctaaaatttcaaaggttttcaaaaagggatcatcttcataagataccggtttaatttgatttggttgcgatgaataaatccggttaagacaccagtcacgctcctttcgcttccattattaggaacaagaaatccaacggtcatcgtagagcgcatcagataaacggctaaaaagcaaattctctggaagaagaagaagacgaagatg

SEQ ID NO: 15517 - DNA, 3003 bp, Unknown
  misc_feature (1)..( 3003): 2750-1469P.txt file - cDNA_ID_1008109; gDNA_ID_2214599; Annot_ID_186983
caacaactcctaaggttttttcaggtgaacttggaatcagctgtcagtataattaagaatgcagaagcagtcactgatgctatcatttcaactgtggatgattatgctcccacggtaggtttttctggctctgcgacaaatgtgacatgatagtcgtgtatctaagcggtgtaataacctataatgttccagtagcagatggagggtattgttccacttgcttcccaactagcggaagtggttgtacaagagaagttgatgctcgagaaatgccatgaccttttgagaatgatttccgagttagaggtataaagattgtgtgtgtattaacatttaaagacctgatctgatatgtttctgttctctgatcatattttgggatgtacacagatgcaggagaggagcttgaaatgctgcttcctgattcaacacaaacagactttcgatacaaatcttcttaaacactaggactgtgtcttcccctgtcaaagctttgcgactcagttttttaaaagcaaaaattacagtattttgaggcttaataaatgttgcgactctcgtaagagtcttaggttctctgtatcagatggaacaagatggtaataaccagtacacataagcacttttgatggtaatttccacttgtttctttcttggatattgggtttagttatctctttttcaatatgctttgattgcaagaaacagagtcaagaagtgtgtagtgtcctcctctcccgagtggatttgaccatatcttctatatgaccgaaaccacacttccttgcagctctcatggacttgttaaaactcaatcatgtcacattgcaagataagtactcttcgtccgctctagaaacatttattgatgacatggactaggaatacaagaaaagagagtaatgcacaagttcaaaacagcgagagactacatgaacattaaagacatgaaacagtaatttcaaacctgatattattactcagccaaagcgtggcccagttatttgaacgactttggaaacagtaatatcatttatatactactattaagatttaagaataagcgtttaccaagaaagagaatattcagtcctctcaaatgggaaatcgaaacgtcatgaaaaaaagaggaaaataaatgaaaagagagagacgctttgttctatatataaaggaaccctaaacaagtggtaaagagcaaagcaaaaccttttagtttcaatgtctaaattctattcataaaccctaaatcgatccatgtcttagaaacgatagaaattccgctgaagatatcttcaagcgacgaagatgaaatggagactccaattagagaagaaggtgaagaagactcttcgtcggaagaagaagatgatgatatgtcttctaataacccatcagctgcaacagagaagcaaaagagagtttattgagtaaaaacgaaatttataggagataatttttccttcgtcatttcaaccataaagccaaaccacaaaaaaaaatctcttcatctccctcaaaacttgaaatatggtgaaaacaactactcaaggtacatcacgtaagatattgacaattttttatttttatcattgcatgaaaattcgttttgtcataatcttaatctctatttgatctatgtgtgtagcgaaaaccaatgacaacgttaattgactcatacactgcacaatgttgaaagtgtttcaaagtgagatatagagagtcacaagaagagtacgaaaagaatcaaagtaaaactccgaaaaaagtcttttgaatgcaagagatgtgaaaaatctagagatgtggttgtgaactttgattcccctattgtgcgttggtttcaggatggacatggtatacccaacacccctcaaggtttgaagagggttttgatcgtcagaacaagctgcgagaaagccgatgtttaatatgaaacattagctcctaaacgaaagagactaaatactgtgaagaaagtcactaagtttattgaagacaatgaacaattcaaagacatgaagattgaagaggtttcttttaccgcacccaaacagctgaaaaggaaaaagttctaaataatgatgttatagttgttgatattaaaacttgaaaaatcaacaagttaaggaaactaaagagacagaataaaccttaacttgttgatcttttcaagttttgttatcggtaactacaacatccttacttatatttttttcttttcagccgtttgggtgcgacaaaagaaacctcttcaatcttcatgtctttaaattgtttattgtcttcaataaacttagcaacttccttcacagtctttagtctctttcgtttaggagatactgtttcataataaacatcggctttctcgtagcttgttctgacgattaaaaccttttataaactttgaagggttttgggtattaccatgcccatcccgaaaccaacgcacagtatggaatcaaagttcaaacacatctccaggttcttcacatctcttgcattcaaaagactttttcggtgttttacttcgaatctctttgcattggatcttaataatgtttgagccgaccatgttctacatatgatgaacaaaactcaagcactagcgattattaaggcttttttttttatttctatcgatctttttttttttacctattgataatgttgatgttgaaatactcaaacatggaagtggaattcaaaaatacaactaaagatctgttttcttagtacatacagaattgagaaacagagagatgaaaaatgccaagagtgtgaacaaaagtccacaaaacaaaagcctctgacggagaaggaggcttttaggtgttacccaaacaaaacgcacacaatacggcgtcgtttagaatcagaaaagacatttctttatggtcacttgattctctcttccttcatcaatcaatctcgtctcctggaaaacattagggagcctctcagatcctcaagaaaaccctaaatcaaaagtcgagatcgatg

SEQ ID NO: 15518 - DNA, 3000 bp, Unknown; identical to SEQ ID NO: 7630
  misc_feature (1)..( 3000): 2750-1469P.txt file - cDNA_ID_1008152; gDNA_ID_1621154; Annot_ID_56972

SEQ ID NO: 15519 - DNA, 3003 bp, Unknown
  misc_feature (1)..( 3003): 2750-1469P.txt file - cDNA_ID_1008299; gDNA_ID_2214454; Annot_ID_182627
cactttggagatcttagggaaatgatttcagaaaccagtttataactaaagtcacctggaataatgttagattgcctcaaccacagagaagctggtacaagggcgtttggttcccctactccacgcccaagtactccttcattttgtggctcgcaatacacaacagactttcaaccggagatcgcatcaaaacatggaactccggtcaacaagtcgcatgcaatttctgcaacgatgccgaggaaacaaggaatcatctctttttttcctgcaggtattcctctgaggtttgggaaaatttggctcaacgcctcctctccactgactactcgagtcactggaatcatctaattgccaaagaatctgctcttcctgttccggtatgtctttcaagcttccatctcccatatttggtgagagagaaatgcaagacgtcatggggaactcagcttaccatcaaacaggctcatcaagctcattgataagactgtccgcaatagaatcagttcaatacgagacaccggaaaccatagctacaacacatgcctgcagttatggttctccacacggccacgctcatctctgcaacttctctaaagtctcctctgtttttgtaccttctgcttttgcaatttcagcttttgtatcctctgtttttcttttaaaacactcaacacacggttgcattcattgtacaaaggattttgattgaagaaaattttacattctttcaaaaaaaaaaaaaaaagtgtagataaatataacctagtgaaaaaagaaaaaaacaaatttgtaaatacatcgacggctaagattacacatagaaccaaaataaaagaattttactattatattgatagaataatactggaaatagatctcagatatgtagctatataaatatatacacacatttgcaacctatattttgcaacgtaacaaaacaaataaagaaacaaaattttgttccttcctcttctacaagcaagtacgatcttttgctatattttgcagacaaaagtttcatcatggtctattcctctaagaagctgttcttgttcttcctctcgtgcattatgctgactttcaactataacactagtggcttcgtagccgcagcaaatagcataggcttgaactacggcctcctcggagataacttcccaactccatccaatgttctcaacctttacaagtccataggcattacaaaaatccgaatcttcgacccaaaaacagaggttcttaacgccttacgcggccaccgtaatattgaagtcactgttggcgtgagggaccaggacttgggtgctctttcagctaacgaagaagctgttaagggctggtttgcaaccaacatcgagccttacttagccgatgtcaacattgcgttcattactgttggtaatgaagtcatccccggaccaatcggtcctcaagtgcttccggtcatgcagtctcttaccatcctcgtcaagtcgatgaaccttcccatctcgataagcaccgtggtggctatgtcgaatcttgagcaatcatacccaccttctgctggagagttcacgtctcaagcgcgagaacaacttgtccccgtgctgaaactattgtctcaaacaagtacgcctattctcgtcaatatttacccttactttccttacgcatccgacccaacgaacatccctctagactatgctaccttcaacactaaggccaccgtcgtccaagatggaccattgggctattcaaacatgtttgatgcaatctttgacgcattcgtgtgggcaatggagaaggaaggcgtgaaagatttacccatggtggtgtccgagaccggatggccatctgccggaaatgggaacttaaccacaccggatatcgcgggtacttacaacagaaatttcgtgaaacatatagtaagcgggaagggaacgcctaagcgacccaacaatggaatggatgggtttttatttgcaacgttcaacgaaaatcaaaagccggccgggactgatatgaagcccatctataagctattttaagtttgaaagctgcttggactttccctattcactaataataatctctgctagtttgttagtgaactaagattaacacatgttattggctattggcttatgtgaaagtgatgagatctggtagcgagcttagttgactttttaataaatctgaaattggtagttgatcctcttactgcgtcgtttatggttgagccccaattttgtttctcgttagttaaaacatctttagcaaacatattcaaagttaatcgtcttctataatccaaattaaaattttcacttctcactttgaaatataaacattcttaaatggtcttgttaatcattactccgaccccaaaaaccattacaataaggtcaaaaccttataatgtcatctcatgctaatgtatatttgtacacaaatgttccttctcaatccaatgaatctctttttttactccacattggcaatccacaatagtagattaagagtttaaaagaagacattacatagacaactagacatgcattgccattactacaacacgttttcacatactaacttcgattccaaactaccacgaatgcaatttaccattgcttcttatttacaattttcttgagactccttcattttgaatccatgtcttctccttcctcgcatttatcaaaacacattaaaagcctgtttttagaattgccgacaaggaaaaaaaaactattctacactaagccacaaaaataacttaaaaccaaaataaaaacaaaaggaaagtgatgcttagattgcgatgtggtagggactcggtgagggttttggaagagcatgacaaaagatccgtgccattgatctctattaacacaccaaaagcttcttcttcttcttcctctcgtctctaaaaatccttcctttctttctgggttttctcgaatcttcatctctcattcaaacccacaagtccgatctcgcgatccaaacaccatg

SEQ ID NO: 15520 - DNA, 3 bp, Unknown
  misc_feature (1)..( 3): 2750-1469P.txt file - cDNA_ID_1008299; gDNA_ID_1591205; Annot_ID_150666
aaa

SEQ ID NO: 15521 - DNA, 3003 bp, Unknown
  misc_feature (1)..( 3003): 2750-1469P.txt file - cDNA_ID_1008621; gDNA_ID_1621128; Annot_ID_56418
ttgtttttgttcttcgatgcaaatctaggatggcaatgatggagaagaggtcaacaaggaagccgatgagcgtgatgagagacgtttaactgaattgggtagacgaactgtggagatatttattctttcccatatcttcaggtaacaatgtgtaatatgtttctatacggtatgccattgtgttcttccttgatgtgcttacatatattacttccatatctctgagaactgcagcactaaaatcgaagttgcacatcaagaagctatcgcgctaaaaaggcaggaagaacttattcgtgaggaagaggaagcgtggttggcagaaaccgaacagagggccaaaagaggagcagccgagcgagagaagaaatctaagaagaaacaggtgtgagactttcttctccttctgcttgtcctgtacaacttgttggatgctgatcggagtttctttggttcttgaatatttataggcgaaacagaaacggaacaaaaataaagggaaggacaaaaggaaggaagaaaaggtgagttttgcaacacatgcaaaggatctcgaggaaaaccaaaaccaaaaccaaaacgatgaggaagaaaaggattctgtcacggagaaagcacaatcttcagctgaaaagcctgatactcttggagatgtgtccgacatatctgattctgtggatggttcggctgacattcttcagcctgatttagaagatagggatagtagttctgttctttgggatactgatgccttggaaattcatcctccatcatcagaagggagcagtagaggaagaggcatttcgatatctacacccaatggaattacagaaggaaagagtcattccactatggatgatagttcttcaacttgttctaatgattctatccgatcgggggtaaccaatgggtcctaccaagggaattccttgaatttccgaaaccagaagtcgccgaacaagtaagtttgtttcggctgtcctttgtttcttgtcagtcctgaatccttagtgatacgctttgtgacttgcagaggaaagaaccaacaagtgaaagcaatgactgatgcccacagtttagcgagtgaaacagatgatcaaccctcaacacttggaacagaccccaagggtcagaattattcttccgaggcaagcaacgttggtgaatctgattgggttgttgtctcccacatccaggagccagagggttctcgaaatcgtattcctgttgggagggttcgtcattcatgcttttaatgttttgaaattagaagatcgctgattgaattattggtttcgtgcaaagaggtccagaatttcacaatttagttgtccctttttcaaattcattttgcaggaacgcaaaacggttcaatccattgtgaactcggtcgacatggatcgacctaaagagaaaagcactgctgtactttcttctcccagaaatgttgccaagaatccttcaccattaactcagacaaaaccggagaaaaagagcatttcaaccgcagacggtattccaaacaggaaagtactggcaactggaccaccttcatcaagccaagtagtgcttccttcagatattcagtcgcaaactgttggtctcagagctgatatgcaaaaactctctgctccaaaacaaccaccagcaacaactatatcaaggccttccagtgctccaataatccctgcgatgcgaccctccccaatcaccgtctcttcctcagttcaaacaacaacatcccttcctcgttcggttagctcagctggtcgtctaggtccagatccatccctacacaaccaacaaacatacactcctcaatcctataaaaacgctatagtcggtaactctcttggttcatcatcatctagtttcaaccaccacccaagctctcatggagttgtcccgaccacattgccatcatcatcttactcgcaagcaccaacatcatcttatcagtcaagcttcccttacagtcaagatgggctcttgtggacaggaagaagtcccagttctgtaaacatgggcatgtacaacaacacttactcacccgccgttactagcaacagatcgctgaaccacatggacgttcagatagcgcagcaacaagcacaaagcatgatgacggatgagttccctcacctagacatcatcaatgatctgctggaagacgaacagtgcagcaacatggtgtataacggaagcatattcaatccacaaccgcaagtgttcaacgggcagtactcatcataccatggtgagttattgtctggtggcaggaccaggagtttcggagaggaaggattgcattacatggcacgtggaccatatggtacagacggaatgatgccgagacagtggcaaatgacgaacatggacttgtcgttgccagcaatgaggagcaatggaatggaagatggaacatcatcagcagctaattaccatcacagttactttggtttggacgcttcgaatccaagttttacgtctggtattaatggctacaccgagttcaggccatcgaatggtcattgatcagcaaatggagagaggggatttgtaatgtttttattttttttaaaaaggaaaaaaaatcatgaatatacaatttgtgtaaagagagttgtcttcttgtcatcctctacgtttcaaatggtttttttttttttaaatatagtataagatagttttcgcatagaaaaactcttccctgaaagtccctgaatagtttttataaataaattatactcctctttatctttaatcaaaagaaactgaaatctgtctaatataaaatgtgtgtgtgtgtgtgtttttttgtctaatttatttttttctttctttgtctaatttgattagatcacttctttatttgaatgagtaaaaactagaaaaaaatgtgagccatttaaatctgattcatatcaaaaaattttcgatttaaaaaaaaaaccctcaaaaggtgttgatacggaaaaagaaaagggaaagaagaagagaatg

SEQ ID NO: 15522 - DNA, 3003 bp, Unknown; identical to SEQ ID NO: 15521
  misc_feature (1)..( 3003): 2750-1469P.txt file - cDNA_ID_1008621; gDNA_ID_1621128; Annot_ID_172404

SEQ ID NO: 15523 - DNA, 3000 bp, Unknown; identical to SEQ ID NO: 8989
  misc_feature (1)..( 3000): 2750-1469P.txt file - cDNA_ID_1008840; gDNA_ID_1971953; Annot_ID_58658

SEQ ID NO: 15524 - DNA, 3000 bp, Unknown; identical to SEQ ID NO: 8989
  misc_feature (1)..( 3000): 2750-1469P.txt file - cDNA_ID_1008840; gDNA_ID_1971953; Annot_ID_177402

SEQ ID NO: 15525 - DNA, 3000 bp, Unknown; identical to SEQ ID NO: 9096
  misc_feature (1)..( 3000): 2750-1469P.txt file - cDNA_ID_1008855; gDNA_ID_1971984; Annot_ID_177696

SEQ ID NO: 15526 - DNA, 3000 bp, Unknown; identical to SEQ ID NO: 1709
  misc_feature (1)..( 3000): 2750-1469P.txt file - cDNA_ID_1008901; gDNA_ID_1620437; Annot_ID_157062

SEQ ID NO: 15527 - DNA, 3003 bp, Unknown
  misc_feature (1)..( 3003): 2750-1469P.txt file - cDNA_ID_1008994; gDNA_ID_2214619; Annot_ID_135852
aaagtgtaaaacagattgtccactttcgtgtcaataacacaattatttgaaaacaccaatcaaacttgtcatggttttgcaagtccaaaagaccaaaaggccctattctttgtctacataaagctcacatgcatctctctctctctctctctcgttcataatgagatattaagatcaacaaaaggaaagaatggcaaaagctatggagctttgggtgggagagatgaagaagatgagtgagaagataaacactagaaatccattgatgcaaaggaagaattcaacatctgttgtgtccaaacaacaacaaggatcagaagaagaaagaggacttattaaccaaaagattagagagaaaaatgaagctgtaactatgtctgagctcactgtttgtcttctcatggaccgttttgttccttggtgatctttccatacccaactacttctagatctcttctttggtgatgtgtatatatatatctagaaactacatgtagtatgtctatatatcagattttgtttgtgcagaccatgtttttaagtttccttgtaaacctgtgaaagtaatgtgtttgagaaacatatttttattactttaatcaatagtgttcaattattattaaccgggatttatatgaagatggaactttctattcactctgtaattaggaacattcgcatcattcagtaagaaataaaacaagaaatgattataatttttctaataacgtaggaattctgagggaacccaaaactaaaatttgattgaaagattttgaagtggccaatcatgaatgagattgctggaagatatcatcaatattcaatacagataacgatttttttttttttttattgataccaaatgagctttcggcttttggcccagacggaaacaacggttacaaaaggtttgggctttgggctttgggcttttgatccacatgacgatcatatagttctttccttcaacacaaaacacttgaagtgtatcttatcaactaaactctattccagcaaaattatttcaaaattagatatatgggagaatttttacaggccattctagattttcattaacgctgtgatttatccgttaataagtacgattaagagtaaaacgacgtcgtttgcaattgaaacaaaaatccccaattcagaaataagaaaccctagatcctcaaatctcttcttcttttcttcttcgaattcactcctgtattttgaaatcaaagtgaattgcaaggcacaaagttcatgctttaaagcactgcaaatggcgaagtcatgatttatatggcatttttcctgtttttgtttcaattgcaaacgacgtcgttttgctcttaaacggtctcattaacggataaatcacatcttctaattgctctgtttattcagttgatgttgtgactaatttggctctgtcaacgaaagttagtgattttatctgaagtcaacacgtaattgatgattttaatcacaaagtacaaagtttatgtttaaagcaccacaaattgcgaagtcgtgatttaaatgacatttttcccgttctggttaaactaagtttctattatttaatatggatattgtggagcgtagtgtcagcactcagcagcttatttaacgtgatactctttaaccgagtaacaactagtgaggtcatattcaggaccgatccaacaatattgagggttttactccaagtaaaattttagttttatttttaattatcataaacgacataaatataatatggaaagatcacaaatactgattaaaaactaaaatcatcaaaacgaaaaagaaaaaagaaaaaattgggttcaactctcatgagttattaaacattttaggttttaggcttaaatctttaaaaaaaatcagaactgaaaaacgaaaaattctaattttattttggactctgattcatagcttatgtcgcttatgtagttatgctagggatgaatctgtatttcgttaccgtaatgagagttcgatactctcttacttgttacgattctggagcatgttacatttttttctttccgtcaacaacaactttaatatggtaaaacaaaatttatttttatttggctggtcctactcaagacaaatcttctgccgacatcacataatcatattaaaaaccataacttctgccactctgtttttttttttttttgtaaccattaactgattggattttgatccatctcatctgattttttagctcaacaatttacttgcacattttctatttggttttatttatacttagttacatatatgattatcgaactagtatctctttataattaagtatttttctatttttttttaatttagatttttgtgaattcatttacagtagaaaactgtaaaaccatatggtctaattatagaatgaaaacttcaacgaatccatacaacttattggctaaatataataaatctgcttgaagcatattgttattatttagttggatttgacgatctctgactttaatgtataccgacataccctatgatttagatgttgatttttcccattcttaatatatccatgttaagagattccaccataacatatctaattatttgcattgtaataaatattatcattaaaaaaaaatacaactggacagctggctcgtcccattgtttcttacgtccaccaattacatttgttaaagcaaacttattagaacgttcatgtgtgagaagttggtgtcgacatgtgtctaaggtctatgtcagaaatcggattagcttattaagtaaactatactatatcattgttaatatagataaaatatctagttcgtccaaattaaactattttcataactgccacgtggcgtaaacgtatccatcgagtcacttgtaatatctttataaccaaagtcttccaacacattcatcaccatctatctactctttactctcttctcttctcacatcaattattcatagttctctcttctccggcaagaaaagatg

SEQ ID NO: 15528 - DNA, 3003 bp, Unknown; identical to SEQ ID NO: 15527
  misc_feature (1)..( 3003): 2750-1469P.txt file - cDNA_ID_1008994; gDNA_ID_2214619; Annot_ID_187621

SEQ ID NO: 15529 - DNA, 3003 bp, Unknown
  misc_feature (1)..( 3003): 2750-1469P.txt file - cDNA_ID_1009030; gDNA_ID_2926226; Annot_ID_203516
gactcatttgatgctgttgcgactcatcgtccgtcatcagcgaatcatctaaatctgttattttcaagttttggtgtcgttttaaattgttatttttcataatacgtcgttttactcagacgttaccgttgctaccgctgccgcagcgtgaactaaaagaacatgctaattatcttttgaaatatcgaaactaaatgaaaggtacatgaatcaatggggctcttttagctccaattttccgctgaaactttgattatagcggtgatgggaaccagctgagtgacgctggttacaaccaatcgtttatagacacgtggagagttaggagtttgctttgtgcgacaggtttcctaccggcatgtgactctagagcctggccgcatataacattgaagcccgttaactcaataggcccaataatgttattttaagaaaagaggcccagaatcagctcaagagtacagacagtgtcaaagatttttctacaaactagactagagtctagtcactagactacaaattgcatacagctttagagtttgtaacatggaactcatgatcttagatcaattttgtagacaaatctacatgatgacaacagtgagtgtgagatgcctgaattacccgcggtcctcggctttattactgttaatacccgctctcacttcctctgcgttcttggctacttcaacaaatattagtctaccatctacaatctgacacaaacaaaataacccaatacaacttcaatacatttctaaagaagcaaaacaacgttattagtcacaatgagaggaacaaaatcgatatagcttcagaccctaattggcatttctacaatgaatttagagccctatggaacttatggatatgttaatgattcattacagaacaaatttcttaagctaatctcttattagcgtacattaaacaagaaagctagaaacctattgaagtgttgttaatggagaaattcaattgtatttttttactcaccttcccatctaagcttttcaatgcctttcgtgcatcatcttcagaatcgaaggtgataaagccgaatcctttaggtctctgtgtttctgaatctctaataagccgagctaaacaaccccacaaacacaaatttagttcataaccgagccttaaacaaattcaatttcaggtttttaccttctttgatttgaccaaaaggagagaacaattgcctcagagattgatctgtggtataagcagataaccctgcaagagaacaatttcagaaaccagagcaagtaaaaagagcaagagactaaaatcagaaagaagaaaccattctcgtactgcttacgaagagttgagctgagattctcttagccatctttaacagtaatccaaacggatttcggaaatgactcaaaaataaagcttttctaggttaaatgctcgagcggacgacgccgttttcagaagaaacacagatacccaacgaaacgacgacgtttttaaatgctgcgagaggctaattcaacaaccgattcatttgcagtgaagaagagataatttagcagacgtttcagcaaaagattttacttgatagatttgatttaagaaagaaatcggatccgatttgattaacatcgcaacaagaaaacgaaacagaaatcgatcaaagagtcaacaacaaccatcaaatctaaaaaaccctaattttacaaacatcgatttcaacaagatccacaattcaagagctagtaaacttagtcaccgccttagttccttcagaaacagcatgtttcgcaagctcaccaggaagaacaagtctaacagcagtctgaatctcccgagaagtaatcgtcggcttcttattatacctcgcgagcttcgacgattccgatgccaatttctcaaagatgtcgttgatgaaactgttcataatccccatagctttgcttgaaataccaatatctggatgaacttgtttcagaaccttgaagatgtagatcttgtacgtctcaacactcttcttcttcatcttcttcttcttatcgccgccggcaccggcttccttcgggagtttcttgccggcttttggtttcttctctgcaggagctttctcggcttttgatttctcctctactggtttcttctctgccggcttcttctctgcctttggtgccattttcttcacacgaaaaaagtttcaaagaaagattctgaattttagaagatggagtcgtgagatcaagttttgtgtttgttgtttagacgattcggtagctcatgtatatatatgaccatgaattagatacagattggttaattctcgtttcacgaggattgatgacgtggaatatattacgtaccgttagattagaataaatccgtcgttggcagtgaacggctaagcatctctcacctttttaaatgggccattaagcagcgaatcaaaattaatttcgagttttatcttttaacgggctaaaatgggcttaatacctaaataataatctgttagtcctagacgtgaatcagttaagagaatgccatcaatgttgatacaaagtccatgtttggttacaaatgggcctaattatgtatcaataatgggcctagttatgtatttataatgggcttagttatacatgaatctgtcccgtgaaagcgataaaagcgaaaaccctaaaaatagttccgtcttctgtttaatctctttttcaaggccaagcgagcaagagacgtcggagcggcggctactacttaggtttcaggttagtaatcgccggaatctccatctctcctctaatccgatgaactgctttattgttttgttggaacaccggcttagttaatctccccaatttgatgtttctccagagaatctagattccaatgtcattttcagagtgtgtaatttttagggaatcgaattcgttccctctgtagatgtttttatgtacatgtcaataagattcgtgaagctgttgatttatgtttttgcagtttttgaaattttgaagaatg

SEQ ID NO: 15530 - DNA, 3003 bp, Unknown
  misc_feature (1)..( 3003): 2750-1469P.txt file - cDNA_ID_1009053; gDNA_ID_2213640; Annot_ID_132241
ataggattttgttgaattagggcacatgatcttcagctatcgtctccaactgtggtttcttagatttcgaaacagagatccgatgaataaactctgccgccgagaactcttctatgtcttcaagattcagcttcggtccgatcagcctcacgtcatcattatcttcattttccggagacactctcctatgaccgcagtttttcgtgcgtttctttccggtgaggtagagcctagccatgtcggaagcgttggctgcagaagtggcacgtgtcatcggaaatgcgacgtacacatgacagcctccaagatcaagatcgtcgtcggcggcgagtgggataaatttacggcctactttcaccgacttggtgtcgacgaggaaatagcttggcatctccatcatgagctcggctgctttcgtcggcacgtggatgtcacgcactccaccgtcagggagaatcacttttgccaacggtgacgatgacgttttgtttagagcgcatgaaacgtagttgcccattgttattgtgttttttactagctatatcaagaaatcgaaagattttacgagtgaagttaaaattaattttggattttgagaagatggaagaagacaaacggaagcttaatatagaaaacgagtggaaattttatgcattataatagaaaataataatagtagtataaaatatagtgaagatggacagcgttgcagatagaggttgacattagatagttgaatccgcgtcttagcatataatatcattaagccgtgttttcagaaatctatggacattatttattttcagtttaacccgcataaaaaggtaatgattaagagatgataatgaagtcgatttcataatgttaaaactaaatttgacatttgtagtgttagtatacttggtttttctgatggtgtcgaatattacttcaaatattttgataaatttatggaaaaaaaattaacattattttcatctaaccaaaataatttggataataaaaagaatgcaaaaagtcaaaagctcaaaattattttcaattagaagaaagttatttttttaatgtgttgagtcaacgtagcttacccattttacacatcgtgaagagacggtgacagtattaataattttgttgtattaactaatataaagttccctaatatttaggggtccaaagtgtgaagggaaaggacgcacaaattattgtactacattattagtttaaccaaaatcaaatattatttatatagtattcgcttactcttccagttgttatcgcaaaatttaaatcacgtgtgggatccacggtcacttcttaagacacctgtgttttcggtttattgagttcaatgacgcgacggttccgttgtctatgggatcggactgttcttgttgcttcaaggcctaaccttttctttcagctaatgtatttcaaatttgattcctaaattcaaatttgaatgtaaacgggatacttgtgcttcttctactctaaagccatcatagctttttcataaatgaggacaaatttacccaaaacacctcctgttacaaattcgtataagtttgatactataattttttgtaaacaactcgtaagtcgtatataaaccatttaaacttcgcttgaaaaatcagagtaagctagtccaatttaaacgatatttaagcactagaatcataacggaaagatctttttatattgttagtgtaactaaaagatcttcttctagcgaaaattattatttcctttttatttcttgtatatttacaaaactctgaaacccgttagaggcttcaccaagattcaagcatcaaagccactatatatatatcactcacacttgttaattaattatcagtatttgtttcttcatcatgatgaaaccattttctctagtactcgttcttgtcctctcatcatctttagcaagtgcaaccgcatcctccttattctcgcctccacttccattttcgctctcttccatcttcggtgggattatcggtaacagtgataatagcgagttagctaggatgtgttttccagacctaggagacggagaagcctgcgtggcggaaatcttcggttcattctttagtcctcaaattacgataggaccagaatgttgcaaggccattgttgagatcgacgaagactgtgctcaagccatttttaaaccactcagcaattctttctttagtagttctgtcaagcagtattgcacttacatcaatagttgattgaattttctttaggtttactttagtgcttgttttgtttaatgtcttttatttgtttcttgttttctatgttttatcaacactcaacagtaacttcattttaataagtttaaacaaaattttgaattggaataatatttcaccgaaggtgttggtacgtgttccatcaatcaatgaataaaaaaaaataagccaataaaggaagaaaagttgaagaatcaaattcgcctttgctgaaagttgacaaagaatattacttttcttggagagcaagtgagataaagagaattcactaatactctacgtgtgcaaatacatatcttgaatcttctatggctttcatcagtacacaatttaagatttcgactaaaagaaaaccaaaatgtattcgctcacatcactttaaaatcatgttttcaatatcaagtatattaaataattcttttcaaactatatgaggttactgaaatgttatgcacacaaaagaaataaaaagacaaaactattcaaaagaaatgactagtcattaatactctcagtaacaaagaattttaagaaaagaagcgagagagagagacctagtagtttcaagaatctccccatagaagaaaaagacaatcattaaatatctcgaattctgtgtgcgccaataatattctccaaagtctaaaccatcaaaccggttattatatacatataaattagactaccgtaatcaatttctacttagagatcatcgagagggcaagagagaaaaatg

SEQ ID NO: 15531 - DNA, 395 bp, Unknown
  misc_feature (1)..( 395): 2750-1469P.txt file - cDNA_ID_1009053; gDNA_ID_1564175; Annot_ID_148984
cgactaaaagaaarccaaaatgtattcgstcacatcactttaaaatcatgttttcraymtcaagtatattmaatmattcttttcaaactatatgaggttactgaaatgttatgcachcaaaagaaataaaaagrcaaaactattyhhaaaagaaatgactagtcattaatactcggttgcaaaaaaaattaagaaaagaagcaagaaagagacctagtagtttcaagaatctccccatagaagaaaaagmcaatcattaaatatctcgaattctgtgtgcgccaataatattctccaaagtctaaaccatcaaaccggttattatatacatataaattagactaccgtaatcaatttccacttagagatcatcgagagggcaagagagaaaaatg

SEQ ID NO: 15532 - DNA, 3000 bp, Unknown; identical to SEQ ID NO: 939
  misc_feature (1)..( 3000): 2750-1469P.txt file - cDNA_ID_1009090; gDNA_ID_1620340; Annot_ID_153924

SEQ ID NO: 15533 - DNA, 3000 bp, Unknown
  misc_feature (1)..( 3000): 2750-1469P.txt file - cDNA_ID_1009158; gDNA_ID_1620756; Annot_ID_49888
taaaagaacatattcctattgtttaccttctaagagtttgaggaaattcattcctggaagacattttggctttgctgcacaaaaaacaaaacatgaatttaaagccttttagaatcgaaatcgtatgtgaaaataacaagtatgacctgaataaaatggtgacagtttaagaaacttacgattattttgtaaatcgagcatttggatcaacatgaaggagatgttgattccggccactgcaaaagggtactcccactttgcccggtcgcctctttgttttaacaatagcctccggaaacaaaccttcacaatttttatttgtataaacacattattttgtggagcaaagaagttcccaaaccatgattattaaaaaaagtttaagtatatatgaacatgtatttacgagtaatttaccggataagttcttgcagaaaatagtaaattttctagagcgataaatccgcaacccctacaaaacaaatgtttaacaaaacaggcgtcaacactaagtatttttccttaagatcttttttgcaataagttaagtatagatcaaatcttacctgaaatcggtagatggattgggaccttgccatcccatttctttccattgttctgttactaaacccgtgagatgaacattcggaaacgcgacgttccacaatgctttaagtgattcctgccattaatcacgcaaatatatttcacagaattcttatagctaaaacaatatatctgcatgttgtttgctcactgcgttaaacatcttactgataaagtgaattcacctacctgatgatcaggacgtgtctcgtcgaaaggtacaaccatacgatcttgcagcctttgaagtctttcctcctatgtatgattgatttacacagatccaaaagtgttacaaactatttataatgtcttgatttcattttatgaagatatatgaaacttgtgattatgctaacctgaagaggagacaaagtgtagtcgactgccttgtcttgacgtctattggagcgtgtgaagagccctcctatccatgatcttgttccaaccatacccgtagctgtaaccactggttcactaatagaaaattatattcatatatgagataatagatctaaattatgtatctaataaactaatcacatgcatatttctatggtgtgtcatttataccctatgatatatctagcaatatatactcactaaaacaaatatttagccaaatgagctattacgtgagcggaactacttgaccgctgccatcgcggctctttgttgcctttttctcgcctttcccacgcttcatcctcctctacctgcaaacgttttcagacatatgtttgcgtataacattagctgcagaacataaaaaaaaaaaaagatcaactctgaagatcagaaagtttgagtgagcttaattcacttacaagttacaaccaaaacgacactcaattacggtacattgaagattaaagaaacgggtggaatacacaagaacaatgtatatgcaagattgcagtggtgtcgttgattactctcaatttgatgataagattcaaatttgatatgagtttggagaagaagaagatgacgaagagatcattacttggcgatgagacgaacaagcaggaaagtattgcctacgcttcctgaacttcatgagatggacacaaatgttcaaagaatagaagataactaatattgatatcttttaaactaagagaacaaagatgtcaaaaccgacataaatgcatggaaagaaagaatttaggtataataatcctacatccaagttatctagtcatcaaaacagagattagttaatgattttgcaaaagctaagacttctctgtagagaattggacagaaagaaagaggaggaagatttttatacagagctaagttgatcacagataagttttagtgttttatttggttgcgtacaggtcagagcttattaatttttaaaaatagaaaaagcattgcgtgactattttaacacgtttaactaaactagacagaattgtgggttgttctgtataaattttgtatttgtatttttatttactcctttgagttaatttagagaatgacaagaagatgatagaatcaaaatgactaaatataaatgagctaaagttctaattcgatttctaaatattcaaaagttccatcatcatttccattttcacttagtcaaattttggtataattgggctcaaaaaggtttctctaaaagttgtagctaacataatagcgcaattaaaggatgttttcttttcataacttttatgtaaagtttaaaactttacaatgaaattacccttgaaaatataattagcaaacaatgatgatcaaatcaaatttcacaagcaaaaatcgttatgattgattaaaaagatgaggggggaaaaagttacctgttataggcatatgaacaagacaatggaggaggaggaggagatggtctagaaaccgtgacgacggaggaggaaaagaaaagagatgaagtagaagaagaaaataaaataaaatagaggcaaaaatggaaattttcattggaattttgcaacttttagaaattgtagaagatgaagagagctgtgtgatccaaaagtgtttttttttctctctcttttttcgtttttgttttctttctcccacctctccattgaccgttaagttgccgccttcttctctcttccaccaaattgttcttgacacatttggacggtccagattcattacagttcacctatcaacggtgatcagatcagttgagagttaacaaaacaatattaaagcccatctcaaggcccaataaacgagagatgaagaatctgaaactagtgatctgattggttgagggaaaaagctgtagcctggaagacacgtgtcactaacccaaaactaccttatcttctgtcgctcctcaattcggggaaaatcgaagacactgtgacactctagcaccttcagttccgtacaacaatg

SEQ ID NO: 15534 - DNA, 3000 bp, Unknown; identical to SEQ ID NO: 15533
  misc_feature (1)..( 3000): 2750-1469P.txt file - cDNA_ID_1009158; gDNA_ID_1620756; Annot_ID_166969

SEQ ID NO: 15535 - DNA, 3000 bp, Unknown; identical to SEQ ID NO: 13279
  misc_feature (1)..( 3000): 2750-1469P.txt file - cDNA_ID_1009169; gDNA_ID_2214611; Annot_ID_187385

SEQ ID NO: 15536 - DNA, 3003 bp, Unknown
  misc_feature (1)..( 3003): 2750-1469P.txt file - cDNA_ID_1009211; gDNA_ID_1620769; Annot_ID_167434
ccagcaaaatgaatgaaacaagggaaacaaaagtaccaataaactagcactcgtgaattaacatcatctgtctctttcaccattccagcttaattagtaactctaaaataatctaaattcctagtgaatcactacaagtgtaggaagagttaaattgacacaacggaacagtttttaacttccgactaatggccgggaaatactagtacgtcaatcgaatctaaaaactccgtctcctattcaccaaggatccaagcatccgataatcaaatccatttcggccaaacgaacaaaaccacaaaaatttgagatactaggaagaaattaacgaaggcgcgcacctgagattgccttgagaacagcttcttgaggcggaccttgatcggattgatcgttatggctgcaattaagccgagtagcccgctcgggaacagatgcaaaaccattgaaacatagactctttggcgccgggaacaaaccatggactggaactgatgctggagaaggagggagaaagaagcatctacgtgcgccggaagtccgtcgtgattccgatacgaaaacggaacgcaaaatcgttttgcaagccattttttgaagcttctctttggagatgagtcgaacgaaaaaaagacacaacgctgcgtttggttatttataaaatttctggcgttggcgagggataaggtaaagacagttatgcccataggtttttgtcttctgttaccattcgctttggggttattagagtctttcactaggcccatttgtgcaagcattttaattaaagttagcaagtgaatctaatctaatcattttaatcaaagttagcaagtgaatcgcacacgaaatcatcttaaagcgtgtttagttaagagtatgtattaaagtacgtaacaaaaagtacatagcatatagttgagaatacagaattgttgcaacgggaaattttctcctaccttctttagagtttcacttctcataggttattcttacaggaagtttcagcatctttctgtaaataagaaactcatagacatcgtgcaacacagataagaagaaaccaaaaaccgatatgaagagacaaaacatcctaataataaagtaaacaaataaatttgttggtactatagtcacaaacggttactcttcaacttggtaccaggaaatgtaactaggtgtttcagtgtgcaggcattatttcttacggaatgctcatcactactatggctttaggctttatctggcaggaggtggagggccaagggattttgccatgccaacccaagcaacaatcccacaagcgagaattatccaaccgcatacatcataagtgaattcagtgttcctcttcttcttcttactactctgctgcaaaagcaaggcaatttctcagagcaaccacgaaaacttataacccacatatgatatgagattctttcactctctgcttatgttcttctgaacatgctgctactagataataagaagatgacacttttcaaaacattggacagcatacttaaacacatgataacttacgctaacattagatgaagccattcctcctccacctcctcctcctcctccacctagtatttgctgtcccattccttgattcataaactgcatatgcagttccggggcctattcacatagacagacaaaaacatgagctcaaatgtaaaagaaatacagaagaagaagatggaataaaatgttctctccttgttattataacagcagcaattgtctccatgattaatgttataatttgcgtacacaaagattgactctgaaaatggaatgttgaaataatacctttagtgaggaatccaaggacttgcgatatgtgtcattacctggatcctgaaataatataatagtaagaagttggtctcacagcactcacaacaacataaaagtttcaaattcaaaagcataaaatctgaaaatgcacctcattttctgctctctggaaatattcagtggctttatcaaagtgctcttttgcttcttcaggatcgtgaacataaaacgcgtgggcggtgtacgcgttggcaatacaccaaagagcctgatgcttccctggatttattgtcaaggcctcttccaacttggaaatagcatctacatgatcaataatatttcgttacatttcagagcaaagatgaatttgaggcgtttattttaagacattaaagaagagatcataccatttaacatgagcttagcttcaggaataggctggaactgtgaaagttcaagtaaagctccaccccatttcagcagattctacagaaaataaaaatgttcgcaaaggtattcttaatatgaccacatatcaaaagaaactcaggaaaaaatgtaatttcagagaaacatataatcaatctcataacataaattataatatttccatcgaattcaagacctaaactacacatagtgacaatacattcacgaaatccatctccacaaaacatccttaatattcgttacatatcaggtccgatcatattaatcgaaatgaagcaatttcacaaattctgaggagaggggaggacaagtagaagaaagaaacctcggaatcaagaggatcgttcttgtactgagcctcagaatttttgcgagcatgttcgaacatgataagcctttcaaagtcggcggtagagaactccatcttcagattcaggtgaaagaaaatctagggttcggtgtttttgttactgagaaaagtctaaagagttgtctcgatgtgaaacaagttccgagggttttagcctacaagtcgggtgttaccagcacataattgggctttttaagcctacttatcaagataagtggcccagaaggcccatatgaacaaatagtactttaatacactagttcaactaatgtattcgccgattagggtttcttctgtttcactatatattaagtgtctccaactactgagatctctatcctctccgtcctctgttcttctcattggccgccatg

SEQ ID NO: 15537 - DNA, 3003 bp, Unknown
  misc_feature (1)..( 3003): 2750-1469P.txt file - cDNA_ID_1009222; gDNA_ID_2214519; Annot_ID_184564
caatattcttgacgaaagaattcaatcatatgaagaaaacaaaaatgcagttgattgtacctgagaggtaggaaatgatgcgtagatctttcaaccaaacagttggaagaacaatgagagcagttaagattccaaataaatgcttagagtcaagtcggaacccgagcaaatccaaggatgtaccagggaaaagcccggtaaggttatctccttccaaaatgatgaattcaacacaatatgactacagaaagtggacagcgaatctagtaagtttaaattatagagacagaaacaagctctagatccatgagtaaaattcggctacaaaaaatcttcacttacatatagttctgtgtacaatagcatctgcacaaaagacacataacattgcagaaaccataagcaactgaaaacagaacaactgatcaaaataatcaaaaggaagataaaatctatggaaccacttacacagataagaatacgaccatatttgccaaaagctgcttctccaatatcaggataagtgataatgccggtcttgttctcgaaacagtctttcattaaagtagcagtgtaacaacaaataacagcaaataagagaagaattaccatacttgcccaaccagcttctttcactgtataaggtgttgagagaagtccaactccagccattacattaatagctgcaaccaatatagagttacacatgttttcttaattaggccaagaatcataatcagtttttagttaccattgaaaatggtttgaatgacgctgcatccatagccaccaatgggcaattcctcagcaaatgagcctttatgagaccaagcagattgtgtagctgaggctttgtctgaatcatcatgcctctcaggaagcaaaggtgcttttgactcaacatctaaattacttctgctggctctatagaaactcggaggattactcctgagcgacccgaagattggtgatgccgcaatcgtataagaatcagtcgtttccctaaaagaaccacaaaacttgtcaatgtttcatcacaaaatctcaaataacaaaactttatgagatgggttacaaggaaagtttcgagctttacaattaattacctgaagctttgaggccattgaacctgggaaatgaaaggttcatcgatgtcgtcgtcacgatcaacagcatcaccaggaagatctccgagatcgctttgatcagtttcactgtcgttctcgtacttactgctgttgtcttctagatcttcgttatcttcgtcatcttcgaacgtaacgtcggtttttttctccttatcattgttcttgtcctccatatttcgaacaaacccaagtaagaatagatctagagagtatcaagaaccttagaggattaaatctcaccgaaaaaggaaaaaaaaagatcaaatctttatgattgattttggttacagagtgggttcgagaactttgcagagaggtggcaaaagactaataaggaaagctgagtgtctgagcacaaaatgtccgtttttttttaatcaagaattttactttttcgaggatttgtgtgatttgattgctcttgttctccgtctctctctgttcgcgagagttgattgcccctagttataaggcgggaaaatagtgacgtggcggtgatgatagagactagaggaaagagatcaaagttgagaagcaatgtttttagacttttgatcgacgacaagtgttgcgttgagatggttcgatatattgatccctcgtagggatgtgttgccgtagccgggatcactaggacttggaaagttatatgttctagtattctccaaaaatttaaaataaatattcaaaacatagaataatttataaatgcctagaatattaagaaatatataaagtttcaatattatggaaaaatcatgtttcttgtaaaatatataaaacggtttttagcctattgacaaaaagaattcataacgcttagttccaatgatatctattgacaaaaggaattcataacctttctctctttatttctttcacgtttaagatataaatggcgaatgataccatgaatgttgctggattcttaagcttattctaccttttttttttttcataggcttagtacttacttaaactcatttgttgttctaaatctaagtgtctcgcaagagtccaaagaaggagatgggagtgactcaaggtcgacgagggaatggggtgtaaatgtaatcgtgttagtgaacatagaaatacattatctctatgtggtgacatgtgaattttctccaagtgtcaaacttccatatgctcattaacaatccaataatttaagctttttgacaaaattgtattttttttggtcaattatctccaatgtggttttaaacaaagatatatattaaataaagatttacatgccttttccaccttgatattttgcaaatcatgagaatctcttccttttaatgttgccagttatataggttaaaaacatatttgcatttcaaaaggaatattaaaaaaacttaattgttctgctacattttggctttcaaaagtcatattgtgagtctaaaactattaaactgtaaacaaaggaaaataaaatagtatttatatgctatatgtaaaatatgaaatgaatagactcacactttttctctagatccttaagttaaactgtcacgcttccggtacgtggcttatcgatcaggaaatgccaagatactgatcccacctcacaagtcacaagtcacggtctccaaaatttatttctcaatattatccttcaaatttgttacgatatgcaaaaaaacaagaagaaggaagttatcacaatatgggtcaagctctcaataccggttcgtcctttctctttctcccccaaaatcacgtctttcattgatgttcacttcattaataaaattatcatttttttgtttggtatacttaattatggaacgaagcaaaaggtaaaggagaggtagacgcgaaagacttggaagctatg

SEQ ID NO: 15538 - DNA, 3003 bp, Unknown
  misc_feature (1)..( 3003): 2750-1469P.txt file - cDNA_ID_1009276; gDNA_ID_1620717; Annot_ID_49128
ttttcatacagacagtgcaagtttaacgaatcaaatatagccttttcattcataactaatgccgaatctaatctaaacgcacgatgatgcaaaatacaatcaaaaccccacgacttctttcaagaattatgaggccatttactttctcttttgtttttctttggtacgtaaatttacaaatgtgattgatttgcctactaaacgaatttttttttatctacccttatgtattctgatagtaaatgttcaaattcaatcttacttcttagaatcaaaaatgtgaagaataaaaaacctcatccacacgtgtgtcgcggtcgttaggattttccaacccaatgctactttttgagggtcaaaggtcaattgaacagctggaagaatcttagccgtcagatcagtccccaccgcacacgcgtatcacgctgacaggctggcgcctaaaatcattggccaagtcccacgtgtgaactaatcatcaacgtcgtcattagttttactacattggtctcgtcttcgtgtcgtattacgatcgagctgcttcacaattatgttcttatggacttatctatacaacaacccgaaacctataaatctttattgtcaaaaggaaatacacattacacactatacacgtacttatattggacccaaaagtggttaggttaaaagtgtttgtatcagttctagtaattactaaattagaatattggtatagttccgttttttttctttttctaaatgataattcaataattcatatcatccattgtatgtaatctgtaaaaagtacggacagaaattcattgatcagaaactttttttttttaataaccaaattttgtggcatcatcattaattccgaacacagagattgatatatcacacttacatatatagattagttggatgattgctatatcattgctattgaaaaattgcaaaaagttcttctaattcagatgatataaaatgtgactgtacatttacttattatttaataaagtcgaatttgtagttgaaaataaatacttgtaatcaagtggtttgtactactagtagtctagtacccacgtcgtatcataacttcattcaaatttgcaagtgtatgtgttggagactttgaattatatactaaaaataaataggcaaaaaataaactgaatttccaaaaattctttaaatgatttcgtacgtgtattattgcttgtgatctttgtttttgtttagatgattttagtgagacgagaaaaaaagagaagaagataaaaatgcatgacatcacatgtcagtggatccagagtattatttgatgacaatctagtcagattaggcattcggtgtttaatcaagtacttgtatatgatagctagctaatcattaagcaaaaaaatgagatccaatgactaattaatatatttgattagcgtgtttaatgaagatgacatataattataatacggtgttgggtgagatatactttgttactcgctttgtacatacaacaagtgtttgcattattttattcctcttgaatatattgaatattacggatgagtctgattgtttctcaatagttttggaatggcaataattttatcaggaaacaaaaaaaacgaaaaacaaggtgataacaaaaagaacaataggaatatgaatgaaaaaaacaaaaaagaacaagaaaaacagaaaatgataataagtaggaaccaagagaaacatagaaatagaacaaaatgattatggtaaatggtaacaaaaaaggtgaattaatatttaatataataattactaaataatcatttatttgaattttgtttattattttcatttaaaattaaagttctgtataaatttaaaataatttatattataaatttttcttcaaaacatttatttattttatagtaaaattttcaattatattacaaagttaaaataagtttcactttaaaacatttatttatactaatttaaaataaattcataacattcattaaattgaaagtttgataaatttttttatatatatcaatatatactaaagatatgtaaaatattatatttaaatataaatattatcataaaagctattttaaatttatttaataaataaaaacgaattttatttttttgttcctcttggttcctctacaattttgttctatcatttttttttttttgaggaatgatgaggaaaaatgtaagacccatatgtataaaaatggaacaaaaataccttgcaaatggtaaaaaaaactgaggaacaaagaggaatacaaactttcctactcattcttttcctaaaaaatggttatgaataggagccaataatttagtaatttacacaaatcgaatatttctatgcgtgagaggtgagacctaacaattcaattcaaatttgacattatttgggcctccttcttaagattcgcctacgtttgatcaatctaatttcatattgggctattaagagttattaaaggctcatatgaggcctgtaatgtttttttcgccgcattatcggaaaaacctcaagaagaagagtggtgacataacaaaaccccaaaagctcccaagcctagagattctgttgttgatccgattcccgctctccttctccggtagtacaatctccgtcgccggttacatcagccaggtaagagacattagtttttattttgtttcgaagtttcatctcttttctttccactttatccccttcaaggaatttgtgctagatctacgcttttaggtcgctggcatttgattgattttggaccaacaaaagctaatttaaatgttcatgaggtcttgagatttgatgattaggcttttattttgtcgagactgatgttaggtcgaactatgttgatttaggtttgggattcgatttgattttatggaattggattccttagatagatcctttatatgcatccgttaggtcctcttttaatttgtaattctaaactgtgtcttagggaagagttttaagagatg

SEQ ID NO: 15539 - DNA, 3003 bp, Unknown; identical to SEQ ID NO: 15538
  misc_feature (1)..( 3003): 2750-1469P.txt file - cDNA_ID_1009276; gDNA_ID_1620717; Annot_ID_165675

SEQ ID NO: 15540 - DNA, 3003 bp, Unknown; identical to SEQ ID NO: 15538
  misc_feature (1)..( 3003): 2750-1469P.txt file - cDNA_ID_1009276; gDNA_ID_2926188; Annot_ID_140906

SEQ ID NO: 15541 - DNA, 3003 bp, Unknown; identical to SEQ ID NO: 15538
  misc_feature (1)..( 3003): 2750-1469P.txt file - cDNA_ID_1009276; gDNA_ID_2926188; Annot_ID_200820

SEQ ID NO: 15542 - DNA, 1011 bp, Unknown; identical to SEQ ID NO: 537
  misc_feature (1)..( 1011): 2750-1469P.txt file - cDNA_ID_1009364; gDNA_ID_1591752; Annot_ID_151470
  misc_feature (886)..(886): n is a, c, g, or t

SEQ ID NO: 15543 - DNA, 3000 bp, Unknown; identical to SEQ ID NO: 2397
  misc_feature (1)..( 3000): 2750-1469P.txt file - cDNA_ID_1009364; gDNA_ID_1620530; Annot_ID_159709

SEQ ID NO: 15544 - DNA, 3003 bp, Unknown
  misc_feature (1)..( 3003): 2750-1469P.txt file - cDNA_ID_1009366; gDNA_ID_1620480; Annot_ID_158279
acacaatatttaccattgtttaacatgtacacatgtgtttataaatctccgtacactataatgcatatttgaaccatatatgacagaaagttttccactagttctaattacattttgttgccctttcctactcgtctattgcctatagaaatattattttagttatgattaagaattgggatgcacattccgaaattaattattaaatgccactatgaagaacccttgaacatagtctaattcaattttaagatcataaggaacattaacagtgacaatagctaaggtctctcgacaatgagacaatccgctttttaaatatatacatataagagataccatattgtatacatatgcagatacaattacaacttgaccaaatttattcaatttctccttctctttatatcaataagaaactattcatgatactggaccagcctgtttgaatcttgtcccatccacaaatctcccaatatataaataaagaaccttcacccgtaaaaccaaaaccatcaacaacttcaaagctttctaagcaagagattgagagaaatcggattttctttctaagactcaaaatatctaaaaacaataatggctttttggtctgctgagaatgctactaaagcctatcttagtacattgaaaacggtaagagtttattcttataaccaaaacatttacccgtgatattgtttcaaattacgataaaagattagttaatgtcacattttgacatatttctctatatgcattttcaggatcaaaggacaaaagaaccaaacgtcgccgaattcatatcagccctagccgccggaaatagcgctagaaagatagccgtggcttgcgccggagcagcaaacgccgacatactcgttgcactaatcgcagcggctaaccaaacgcgtggtcaagttgtatgcgttttacgtggtatcgaagaactaatcatatcccaaaaaatgttggaaccatcagagattcatcagatacaattcgtagtcggagaatctaacgacgacactctaatcaataatcatttcggagaagcagatttcgtcctcgtggattgtaacctcgaaaaccaccaagagatcgttggaaaaatccttaatcatcacgaagaaaacgcaagaaccgggggtggaagcggtgtggcggttgtggtgggttataacgcgttttcgagagggtcatggaggtttagcgatggaaggaaaacgcagtttttacctataggagaagggttacttgtgacgagggtcaatgataatcagaagatgatgatgaaaaatcaccatcgtgaccaagtgatgaggaagagtcgttgggtggtgaaggttgataagtgcactggagaggaacatgtgtttagggttagggttccccgaggagaagccattattgaagcttaaattcaaatcttatagattattgggtacgttagagcaaagatgatcacctctgtgatggttcagacgagtgaaagtagtaattaagaagatgattagttattttgtataagtaattatattaagagagttttgattggctttggagtattttgtgtggtgagaagagtgaaaaagtctatgtttttcgagtaaatgactttttttgtaagtgtaaatatgaaatgatgtgttttggtttaaacttctctctgattttggattttttttttttttttttttgtcttttcttgagcatatgtacacgcattgttattcttcagattttggatgtttagcaaataagatattcaaaaaatgcacatgcatgcatgagagatggcatctgaaactaatataatgaaacattaaagtaagcatatgtatttagctgtcttatacagattctcaaaatagatgtagacgtatattattgagaattgacaaaaaaaaacgtatattattgagttgttgagtctaattttttttgttgacactatttaaaaccgacaagcacgtcaaacagatattagtaatagtatatagggtcttcagacatgtattcgtttgccttaaaattgtattttaaaaagatcttcttctttttttcatcaccgttacctttattataaaaccaagaagattaatatatagtgaaatccgtaaagacgaaaaattaacgtagttcttatattgaagatgaactaccaaaatctaattaattcttatgtgattttgttaatcattgtcttggaattcactatataatgaagttcatcatctctaaggaatggttttactttggtccgattctttcgacttttggtcgttccatttctcattgaatcaaatctatgcccaaaggtaaaacataatcttctacagtacttttagatatatgatccaaattctcatcgacctaaacttataagtcattgaattcaactaggcttgtgcacatagctgggaggcaccaaataaactccttcttcgaagtagacaactcgtaatgaatgtatattatttttatcaaccgacatctccgttaagaaaatagataacaatttgaagagaagagtcgttgttgacaatgatccgttcattaatataaagcattgtcacaatctctatatgtcccataaccttcccctatccccatgaatgaccacccccatctcttccttatccatcatctcccacacctcatcactctcaaagacaacgacatttttcacccataaatatatttacataacaaaatttattcgaaacaacattaatcaacaaccaaacattacattcacacaaagtaacaaaaaaggttcaagggaaatggaccaccagagagacttatctgatctcaatagtttagtgggcttatgttttaatgtagtatgggcttttttaacgaagcccattttgtcaaaagccttgtagtgttcttcatcagtaaacgtaacaaatcattcctctgagaaaccctaagaaaaaccctgcctgaaaatctctgttttttttgacgattctttctttgtgatcggaaaaaatg

SEQ ID NO: 15545 - DNA, 3000 bp, Unknown; identical to SEQ ID NO: 6126
  misc_feature (1)..( 3000): 2750-1469P.txt file - cDNA_ID_1009437; gDNA_ID_2926131; Annot_ID_196945

SEQ ID NO: 15546 - DNA, 3000 bp, Unknown; identical to SEQ ID NO: 6126
  misc_feature (1)..( 3000): 2750-1469P.txt file - cDNA_ID_1009437; gDNA_ID_2926131; Annot_ID_138761

SEQ ID NO: 15547 - DNA, 3000 bp, Unknown; identical to SEQ ID NO: 6126
  misc_feature (1)..( 3000): 2750-1469P.txt file - cDNA_ID_1009437; gDNA_ID_1620847; Annot_ID_50946

SEQ ID NO: 15548 - DNA, 3000 bp, Unknown; identical to SEQ ID NO: 6126
  misc_feature (1)..( 3000): 2750-1469P.txt file - cDNA_ID_1009437; gDNA_ID_1620847; Annot_ID_170240

SEQ ID NO: 15549 - DNA, 123 bp, Unknown; identical to SEQ ID NO: 106
  misc_feature (1)..( 123): 2750-1469P.txt file - cDNA_ID_1009520; gDNA_ID_2689; Annot_ID_145859

SEQ ID NO: 15550 - DNA, 3003 bp, Unknown
  misc_feature (1)..( 3003): 2750-1469P.txt file - cDNA_ID_1009528; gDNA_ID_2214576; Annot_ID_135179
gcacaattaagtacacgatattaatcttctagctgcaaatctcattaatttcccatcaatccaatgcaggttgaatatgtattaatggagagaaagcaggaagatgcatataaagaagccatagaggagtatcgtgctgcttctcaagcacggcttgtgaagctttcatcaaaatccttgaattctttagccaaggcacttccaaagcgtcaaatttcaaactattttactcaattccggaaggtaattctcagctactaatacaaagccccttttgtgccaaatgagtgtgttattcatgtgttattaaattttggttgtacagattgcaaaccatccattgttaattaggcggatatacagcgatgaggatgtcattcgcatcgccaggaaattgcacccaatcggtgcatttggatttgaatgttccttggatagagttatcgaggaagttaagggtttcaacgatttccgtatccaccaggtaaatgtttctctttccaaaagcagttgaatatccattaacaaacatgttatgcaattgaagaagctaactaacttgtttctttccatagcttttgttccaatatggagttaacgataccaaaggaactctctcagacaaacatgtcatgctctcagcaaaatgtcgggtacgtgatattcttcttcatttcataagtcttctttgtgaaactgattaagtataactaaacctgtgagcgatctaaatctccctttatgtatcagacattagctgagcttctcccttcaatgaagaaatccggccatcgtgttctaatatttagtcaatggacatcgatgctcgatatcttagaatggacacttgatgtcatcggcgttacataccgaagacttgacggcaggtaataaaagaaaaaagagtaatttgtcacatttttgacgattctacaaaaaggaagaagcttaagtcattttccttttgttttcaacagtactcaagttacagatagacaaaccatagtcgacacattcaacaacgataagtcgatattcgcatgtctcttgtcaactcgagcaggtggacaaggtcttaatttaaccggagcggatacagtcattattcacgatatggattttaatccacagattgatcggcaagctgaagatcgttgccatcgtattggtcaaacaaaaccagtcactatcttcaggtttgagctttaaatccttgaatcagtttagataactttcagaacaaaattgtggtttggattggtttatgtgtgctctgttttgtattctcacatatatctgtattaactctggcaatgctggtgcagactggtgacgaaatcgacggttgatgagaacatctacgagatagcgaagcggaaactagttcttgatgcggcggttctagagtccggagttcacgtagatgacaacggagacacgcctgagaaaaccatgggagagattcttgcttctcttctcatgggataacattattgttaccttttttgttttgaggtaaaattagtcaagaaacgaagttaatgtgttattctaaacatgtgtaaccactagctattattagacttaaatttaatagatcacgatagttatattttcttctacgcatgtaaattataacccaaaaatttccttctttagacctaaaagtcacaattgttccaaacactaaaatgtggatcagtgatcaaatgaagtgaaccttcaggatagtttagtcttcgatcatcaaagattgtataaaggagtgacttagctgtatttgtaggtatcaaaattgaaaacctcacgcaatgattaaaggtctcaagtatctttattcgtcagagttgtataagacacaaatctcactagattgttttcccattgtctttgccgaaacctaacaatgaacaactagttctattaggattggttcaagaatgtcacatagtataagtttttcttagctgaaaaattctagataacttggaataaattctagatagtcttttttttttgctacatttgaagataaatatctatgaaaatgttcaaattcatgattatattattgcgattaaataattgaatatgactatacaaaataattcactagtaaatcaaagccatactaagtttggattctttgtggtaactgccattgccaagtcacgttttgaaggtgttctcatggtcaatttacacttaaaattgaacctgaaaactaaggccaaccggaaacttgttgaattgtgtgaagtgagaaaatgataatcgtgtataacttataaagtcacatgataaagagaaagcaaccagctttttgtctgccataacagttctttaaaatatagccacaattatactacttaatttagagtaactaatcccaaatattacttatctaagtaataattagaaaagtattcgatatttattatcaattgcgttttaacttgctatataaatacaaagtttaatttttatataacccactaactttttcattttggtatatgataaaaatactctatcccgtgactattccacttgttgttactttttagttttttttttacatagccattatcattgtggactccacaacatccgcaaactcaattatttacttttctatacgtttatttgtttttttctgatacaaaatttggtgcatgaatgacttctcgaaacggtagatggactccacaacatctgcgtgtcttgtcaccttacgttacggaccacaatttacacctatgaaagtgtcggtaaagcaaataaaatcgagaaactcacaccactcttattcaaatccaaagtgaatactccaaaaataaagtaaatgatatttatccaaaaatatctaacaaacgcgtaaaatgtgaattatcttgaacgttttaatacctctttactctctttatatagtgccattttcctcactagcagcaacacacttgaacactactttcgaactctctctttatctctcttgcaatg

SEQ ID NO: 15551 - DNA, 3003 bp, Unknown
  misc_feature (1)..( 3003): 2750-1469P.txt file - cDNA_ID_1009643; gDNA_ID_1620448; Annot_ID_157366
aaccaagatgatccactgtgttcactactgcctttgctgcatactctttcaacgtctctatcactctgcaatcattcatcaaaatcactcgccacaacaaacacatggactagttcaaaaatactatcgttagtatcaagaaagacaagtaagattacgtttctttgtgttctgctttgccataagatgtttcgaagtactcagctgctgagtataactgtttccgcagattctttaaatccttaaaacaccaaaacagaacagaagatgaatcttgaatgaagacaaaaaatcacaattgcctattgatcaatctatgtttgaggagagaaagagatagagagaacgatcatacaaaccttgagggtttctgagaattgaagagtttgcttcatgaagagttcgtcatgattggaagattgatgaagaactatcgctaaagatgtagagctcgccattaatgagatgagggaaagagagagaagaagataatggagtaagtaagaaagatccaagtggagacactatacacacatactcgacacattccatacgttctttacaagccaattattttcttttaaatgttagtaactaataataccaaattacatttcattaaagactgaaaaataatatattaaatttattacgaggatttaaaaattgaaaaaagcagtcgacaaatcaaaacataatgacccggaatattgtatttagagcacacttttcaattatcaaaatgctttttaagaaattaatttataagttattaatgattccatcaattattaaatacacaagtcaagaaaaaatcggaagaaagatttgtagttggaaaattaatggagcagaaagtagagaagaagaattatttaacattttgttaattaaagagaaaacaacttctcaacaattttgatattcttgtccctctttcttgaataaaaaaaataatacacataatatatttacaagcagtgggacacaagaatcaaaattcaatcacggactcatttaatggagttgcctttatgagccagaaatcattcatgtgaccataacatataagttgcattataaccagacgacaaaagaaagaaaggacagagctaaattatctgatgaatcaaatcaactgtttgggaaaatactagtgatgactgaggcgtgtaagtcaaacaatggtaacacttgaatgggatttacaagatacgctcgagctctctggtgtaactgagagtctggttgatgagttgaagtgacggtatctccttgcacggtgcggtttctctggttttttggaagacaactaacccgtctttaacttcccactccgggtgctcctcgttcacatatgttaacagttgttgatcagacgagaagagtaacatcttacaaccttcactgattgagagatgatcgtatgctttctcactgcatccagctatttcatctctacagataaacaatgatgttttaagtcacggcaatgagctaaagaagagaaagggtcaaatgacaaatgaagcctatttacctaatggtttttgccaagagatccatgaaatagacgtaagtctcatcaggtgcggtttgtctagcactcaacacacggttataagcaccttccatgaaggattgctcgagctccaccgcatgcttgatgcaaggattctccaaggttgcagatgaaagtaatcccagttctgtgtggaattcagctattctgttctgaacaagcagtctcagtaggttcaaccccatgattagattctcttgcggagatggcggaatacgattcctggtacatagaaaaaacagagcacacgtaagcaaaagcaatgcattcagtgagagtgatataagataatgatcaaacaactctaaatcaattggttcaacttaggctctctactcattaataaatcaaatctatattaaactttgacattgatatattcaaggttttatctattgatccgcattgaattagggctaaaaggaaacagtaccttaagctgagacaagagactggaacaggtatcgaaatcttttattataaacgcagctttaaacctctcgaactgctgtgaaacctccattagttgcggatccatctctttctctatgaatttttctctgtcaaactggcttcaggaagaagaagaattgaagaataagattgccttttctaattgggccgtacatgggcctgttgaatcagtaattgaatgggcttaaagtggggaatgtaacccaatagaagcttccggggaattttaatacgtgttatacagagtcgaaaacttgatgctgacacactcactgtctttctcgtcaacgcgtttttggtgtttggtccacaatccttagcctctaagacaaatcaacccaaattttcaaaacataaaattaattagttttgaaaaaaacaatattttaaaattagatatttgttactatcggcacaaataaatctcctctcaaaagtctgccacgtcataattgcaattgttccgcgtctctgctgctacatgctcattcactcgcaaatcgcaattttcttcttaaccaaatttttatacaaaaaaaaaagctcagacagaagtactaaatggtaaatttgacataattaattggtgtgtaattttataaatacagaagtacttgtgtcttgtatttattagtattccttatttaataaattacttttcacttaatcatccaactttgtcagattcacacgcaaccttgaaaaaataaaatagaatggtattgtgactttcgtggaaatttctacttagatgacacagttgctccaattaaaagcttacaactttttcttcatctttctttatatttctcacccatttttcaccaatttctctccacttaaaaccaaccccaattctcaccaaaaatcgcaaaaaagatttcaactttcgataaacccagatcgaaaaatcagatttttccagatcaatcagagagttagagatg

SEQ ID NO: 15552 - DNA, 3000 bp, Unknown; identical to SEQ ID NO: 12033
  misc_feature (1)..( 3000): 2750-1469P.txt file - cDNA_ID_1009988; gDNA_ID_2214528; Annot_ID_134225

SEQ ID NO: 15553 - DNA, 3000 bp, Unknown; identical to SEQ ID NO: 12033
  misc_feature (1)..( 3000): 2750-1469P.txt file - cDNA_ID_1009988; gDNA_ID_2214528; Annot_ID_184841

SEQ ID NO: 15554 - DNA, 529 bp, Unknown; identical to SEQ ID NO: 291
  misc_feature (1)..( 529): 2750-1469P.txt file - cDNA_ID_1009988; gDNA_ID_1563421; Annot_ID_147652
  misc_feature (256)..(256): n is a, c, g, or t

SEQ ID NO: 15555 - DNA, 3003 bp, Unknown
  misc_feature (1)..( 3003): 2750-1469P.txt file - cDNA_ID_1010051; gDNA_ID_1972177; Annot_ID_180044
gtagtgcgtttctttttccctattcatgaatttgtcttttgcttatttcaattgtgcattgatttggtttcaatttgttatggcattggctaaagcttgattctttatgattggttctgttgtgctactttgctccactcattggataaaacattaatgacttgttttcctcgtctgctgtttattcatagtgatgaatttgttatggtaccaatatttacattgcattgaaacttttatctctctgattgcagtgaaggtggcttttttaatgcaattatgtcgtttccggagaattatccagtttcaccaccaactgtgacgtttacctcggagatgtggcatcctaatggtgactgatttttctggaaaatatatctctttctcgagcttttaggatttagtcttctgatgatttatactcttttgactgcagtttattctgatggaaaagtttgcatttctattcttcatcctcctggtgatgatcctcatggatacgagcttgcctctgaacgttggacccctgtccatacggtatgttttttcttttaccgtttagcttcagtactctggtaatttgtttgcagggttgagttatctatggcttcgaatatcttggggtctgctttatagcctaacattcttcgaatacagctagctttctcttgtgtagatagcttgtagaaacagacatgttttgttcgatattgagcttatacagtgattgcttttcaaatgttcgtggaatttataagtcaggacttaggaatactctggaggatagtgcaacttagattgaacctctgtcgttagggtgcttgagtggaatatgattcactttctgatttatctgccctgtaccacctcttaatcgatagtgttcttattagatcatgaggaaagaaactagaggtacattgaagctaatgttgggtctgtgtatgatatgcaggtagaaagcattgtgttgagtatcatatcgatgctctcaggtcccaacgatgagtcaccagcgaatgtggaagctgcaaaggaatggagagacaacagagcagagtttaggaagaaagtgagtcgctgtgtgagaagatcgcaagagatgctatgaacatctctccagcgtttttttcgtgttgtagaaatatcgattctaatcttcttatgagaaagcctaagcagaaccaaccatcttcaagcagcagccagatgaatctgactttgcaaaagcttctctttctttttcctttttgggttttgttctctaaggtttggtttggaatattggtgtggaatcaaatccgctccatattttaggattatattattgcactcgttaatggattcgtttgatctggctttttaactttattctggttttgggttacaaaatacttgcctcgttaattatctcaaatttaactgatggtggtttaactgcaaaaggccagaagttcgaaaagagtattgttattcagttggtatgcaacaaaaaattgtggttaatggtttcaactgatgttgccgcggtcataagaaacaaaacaaaaaatattccttgaagattgcggggtctagcacacgagctcacacataaaataagataagagcaacgagaagattatatttttaaatgtcctaaccatatataatttaacaattaagggatcaatcataaatttattcgtatttcagttacatgactggttaattatagcccaaattttttacaattaactattattatattcatatgctaggtttctttcttactcattattggtccactcacatcttccccaaacaattgtatttaagtttttttcttcgaaagttatcacttttagttagatccgcaaaatcgtggatctccaaagctaaaacgaaaaaaaagaaaaatagtctataagtaaaacatgataccgaacaaaacaagagtatataacttatagactataagtaaacaattaaaacaataaagaaccaaaatatgtgaaccaaattaaaattagtgttaaattttgttttggttattctcgtgaaaaggaggaatagctcgaacgtcattttcacactttctttaacgactccactccagcattaattacccaaacagttctgttgcaaaaacatttaaagagagaccagcaaaagttttgagttattgtctcttttgtgtgtacctaatccattttttttttttttaaagaagtaatattacggagtatattgctttcttaatgatatgtcagaaatgtcccgtgtaagtaatatgaaaaccggttttcaaatcaaagtgcactttctctagctcacctgtgtttggtcgaactcgaatccctctgaccactactaacgtaaaaaagctcattgcattaatgtttcgaccgtttcatcgtttattatactgtcttaaattaaaatcattaagcatttaattgatttgtcatttcgaaatttatgttgacaaaaatgactttacgatcaaaccggtttgattaagtaacgtagactaatgctattatggtgatatatatgcaaaagataagaatagtttatcaacgaaaggatctataaattatgcttgttcgacttcttagcatagaaaattggtaatttatttacacctcatgccgttaaaaaatcacaatcacaagtattcataacctaaaattcaacaaagaaatcaattacgtattcttcatttttccacattaaaccagaatcttaaaccaaaccaatccaaaaaagcgacatttaaaccaatccggttatcaaactatctctctctcactcacacacctttctcttttcgcatcactttccctctcattcttctttcttatctctctctctctctttctctgactctctccttgatgcctcgtgactgcaaccaaagcaatttaaaaccgccgcacttctcatgagtcttcttcctcatcatcatcatcatcaccgttaactgtaatttatcttctccgatcttcattctccgccatg

SEQ ID NO: 15556 - DNA, 3000 bp, Unknown; identical to SEQ ID NO: 12760
  misc_feature (1)..( 3000): 2750-1469P.txt file - cDNA_ID_1010079; gDNA_ID_2214570; Annot_ID_135044

SEQ ID NO: 15557 - DNA, 3000 bp, Unknown; identical to SEQ ID NO: 12760
  misc_feature (1)..( 3000): 2750-1469P.txt file - cDNA_ID_1010079; gDNA_ID_2214570; Annot_ID_186139
